United States Patent 11,446,398 (REGULATED BIOCIRCUIT SYSTEMS) - sequence listing, part 94

SEQ ID NO: 203099 - DNA, 6822 bp, Homo sapiens
  Payload ID: 20050
  Gene Name: zinc finger protein 585A
  ENST ID: ENST00000356958
  CDS Start-End: 527-2671
agcctacaaaggggaggtgctagaagtcggaccggaagtggaagtggtcttccaaggcttttttgccgctggtgtcaggagtattttcatattccaataccgataaatctttgaggtttctgggtgtctctggggagcccctgggccagattttcctctagactccagcccatctcttcagagcagctctgcttgagttcacagatgactgccaagcttcagacaccctacagaaaaagggttgagacccagtgtggccatgccagctaattggacctcacctcagaaatcctcagccctggctccagaggatcatggcagctcctatgagtgttaaccttgatgcctgaaagaactggaaattatgaagatagattcagaagtcaaatatgttaactaactgcattgaagagtagaagaaaacaatagcctaggatcagtgtccttcagggatgtggctatcgatttcagcagagaggaatggcggcacctggacccttctcagagaaacctgtaccgggatgtgatgctggagacctacagccacctgctctcagtaggatatcaagttcctgaagcagaggtggtcatgttggagcaaggaaaggaaccatgggcactgcagggtgagaggccacgtcagagctgcccaggagagaaattatgggaccataatcaatgtagaaaaatcctcagttataaacaagtatcctctcaacctcaaaaaatgtatcctggggagaaagcttatgaatgcgccaaatttgaaaagatattcacccagaagtcacagctcaaagtacacctgaaagttcttgcaggagaaaagctctatgtatgcattgaatgtgggaaggcttttgtacagaagccagaatttattatacaccagaaaacccatatgagagagaaaccctttaaatgcaatgaatgtggaaaatccttttttcaagtgtcgtccctcttcaggcatcagagaattcataccggagagaaactctatgaatgcagccagtgtgggaaaggcttctcttataactcagatctcagtatacatgagaaaattcatactggagagagacaccatgaatgcactgactgtggcaaagcattcacacaaaagtccacactcaagatgcatcagaaaatccatacaggcgagagatcctacatctgtattgaatgcggacaggccttcatccagaagacccatttgattgcacaccgaagaattcatactggagaaaaaccatatgagtgcagtaactgtggcaaatccttcatttccaagtcacaacttcaggtacatcaacgtgttcacacaagagtgaagccctatatatgtaccgaatatgggaaggtcttcagcaataattccaacctcgttacacataagaaagttcaaagtagagagaaatcttccatatgtactgagtgtgggaaggcctttacctacaggtcagagttgattattcatcagagaattcacactggagagaaaccttatgaatgcagtgactgtgggaaagccttcactcagaagtcagcactcacagtgcatcagagaattcatacaggagaaaaatcgtatatatgcatgaaatgtggactggccttcattcagaaggcacacttgattgcacatcaaataattcatactggagagaaacctcataaatgtggtcactgtgggaaattgtttacctccaagtcgcaactccatgttcataaacgaattcacacaggagaaaagccctatatgtgcaataaatgtgggaaggcattcaccaaccggtcaaatctcattacacatcagaaaactcatacaggagagaaatcttatatatgttccaaatgtggaaaggccttcacccagaggtcagacttgattacacatcagagaatccatactggggagaagccttatgaatgcaatacttgtggaaaagccttcactcagaagtcacacctcaatatacatcagaaaattcacactggagagagacagtatgaatgccacgaatgtgggaaagccttcaaccagaaatcaatactcattgttcatcagaaaattcatacaggagagaaaccctatgtatgcactgagtgtggaagagctttcatccgcaagtcaaactttattactcatcaaagaattcatactggagagaagccttatgaatgcagtgactgtgggaagtcctttacctccaagtctcagctcctggtgcatcagccagttcacacaggagagaaaccctatgtgtgtgccgagtgcgggaaggcctttagtggcaggtcaaatctcagtaagcaccagaaaactcataccggagaaaagccctacatttgttctgaatgtgggaagacctttcgacagaagtcagagttgattacacatcacagaattcatactggagagaaaccttatgagtgcagtgactgtgggaagtctttcactaaaaaatcacagctccaagtgcatcagcgaattcacactggagagaagccttacgtgtgtgctgagtgtgggaaggcctttactgacaggtccaatttgaataaacatcagacaacacacactggagacaaaccctacaagtgtggcatctgtgggaaaggcttcgttcagaaatcagtgttcagcgtccatcagagcagccacgcttgagagaaacagtgtgagaaaacccccctgagggttgggtctgattgtacactgttgcacgcatgcagcagaaaaatatgtatattattgtaaatagaaatgaccacagcagaatgtcacacatggctgttctggagagggcctctgagaaggcactgaatgaggcgagggacccttcctacattgtcaccatccccagtaaaccttgggtcattattcatactgacaaggaaccgagtcaatttggtgaataggaaaagccttctcatgaaaactacaatagaatactgttaccaaattcttcctaagaaagatcgtattaagttaacgataatcctgtttactgtggattaggtatagtgccaacaaattgaatgataaaacaacataatacgtagttattttgatagtgatgaatcctaagttatgtgagttgttcgttgtggaacacattgtgtaacagactcctgggtgtttttctttctcattcgaatctaccacagttggtcatatccaaccctcattcagtatttctatcaagaaagagatgctacaaaaaaaaaaagaaaaaacctttatgtatacagacgtaaacctcagaatgtatgttgagtccccactgtcatctaccaagacttgcacccccctcattatctaccatgactgtctctcagcctcacgggccctcagcactttgtgttttgacccccagcaccgtgtcttgtgaactcccatcaccttcaagaaagcttccgaggtaagaattttatggtcatctgggacaacttaaatctcccttctgctgtcatagttcttccaactcagttgcctttttttttttttcgtactcatcactgacttgaagcttagtatctggcttccttaaggatgtaactttcatgtaacagattaataacttatatgaaaaccaacacaaccatatgtttagggctggaaagggccatgacgcctggccatttttcctgttttaccttactcttatgtgtgtcacacttcatcaattccggaaacagtttctggagatctcctcattacctcttttacaatcacctcactccagcatggtgtctgttacctcttcccacttgtgacaatgtctagtaaggtccactctccattctgtgtgatgaccacttattacaaccctcagaataggggacagtggtgtgccccctgcaatacaatggtttctatctcctgatacttttattacacctctagcaggatgtcttgtgatcctccttattgatttttccctcacgatgatgaacaattatctcccgttactcacctagcagtatctaactgtccctaacacagcatgtgggaatgccctcaatacggtggatgctgttaactttcttccttcccctcaggcaatggcggtgacttacaatgaaccataatgtccacatttcccaactgtattttggagcctcttctgtccccttctttctaggaccccagttaaaaaaaaaaaaaacaaaaactagcccaatgtctgttgatgcccattaatcactaacacagtgtctgacccctccattaaattttgatggtatctcttggctccccattgtcccgttaacccaatgtctgctgattcccaatttcccacattgcttcatgcggttccttagtcacccttggctactgtacttcccccaagattgcatctccatgtttgcatggtcatgatccctggaagatggtgatgaggatgaggtcccagcctcatagaccttttcctctgagttccccccaaggcacaatggaatgatggacccagggtgggccagggatgatctggagatctcaggagaccacaagctgggcttcctgtctactacatgagtatggtgtgagcagaacagtgaaagctgtctatgttggttcaaattctggtgccaacactgatccacttagggaccctcagcctgcccagaaacctcctctgggcctcaattttctcacttgtaaaatgggattatgggagaatgaagtgactttttttgggtcacatgatggatgggatccaagccagcagggcccaatgacagcatcctgttaatattagtcatcagtcaacataagcatctgactatcctctgtatgcccaagcctcatgaagggaaacaatttattgtaaatgacttttgattatttctcttatatatttattgtaacaatattataatacttacgtatatgtatatgcatatacccgtatatacggaaggctttattttttagagtagttttaggttcaaagcaaaattgggtagaaattacagaggtttcccatatatcccctaatccacatatgcatagcctcccacattatcagcattcctctcagagtagtatatttgttacaattggtgaacctccactgacactcattaccaccccaagtctataggttatattagggttcatccttggtgtaacaccatagaatgtgtcttgtactttctgcttgttggagcaagtggatcatggcatgtttccactgttatacacagagtagtttcactgccctaaaaatcctctgtgttctgcctgtcatcccttcatctcctctaatcctggcaacattttttctgtctccatagttttacctttgatcttttatatcatatagttgaaattatacagtgtgtagccttttcaaattgacttctttcacttagtaatgtggatttcagtttcctccatgtcttttcatggcttgataatgcatttctttttagagccaaattatgttccatcgtctggatgtttatttattcacctactgaaggactgttggatgcttccttttggcaattatgaggaaagctgttataaatatctgtgcaggctttttgtgtggacataactgaaatatttttaaagttatatttattgaggtataatttacattcagtaatagtcacactttttagtgtagagttctgagttttgacagttgtatctaatcatgcaatcaacaccacaatcaagatgaagaacaggcccctcacttccctaacttctttcctatccctttttagtcccttttcccactcccagcccttggcaatcaccagtctgtttccgtctctatagttctgccttttccataatattgtataagtggagtccttgtgtgtgtgtgtgtgtgtgtgtgtgttttgtacgtgtatgtatatctccttttgagtcggagtgctttcatttaatgtgatgtatctgagattcatccatatggttctatgaaaaacaaatggaaaataaggtgatgaaaagatgctcaacatctttaattatcaggaaaatgtaaatcaaaccacaatgagatactactatagaatggcttttagaatggctaaaaatgaaaacgtgccataaattggcaagaatacagaccaatggaaattttcatgcattgcttgtaggattgtaaaacggtctgtccactatgcacaaaagtttggcagcttcttatactattaaccatacatttatcatatgactcagcaactccacacttaggtatttaccctagatgaaagaaaaattctgtttacatgaaaacctatactcagatgttcacagcaattgtataattgcccaaattaggaagtaacacaaatgtacatcagtggatgagtgattaaacaaattgtgtacaccaatactatggagggctgctcagacataaagaaatgatttattgacacttactacaacatggatgaatctcaaaagtgctgttgtattttaggtaaaccatgtgataacttgaattacatttgataaaagatttataagtgtaaaaactagatttatatattttaattttatatgtgcctgtcattacatactatagaaaattgtgtctacagtatgttatatagcatattgtaatatttattactgtatattccttgtgacaataaaatagtttgtattttatataatagtacctgttttatagtatatgttttattttatatgattacctaattttaatattttacatatcaaactttcacataatattttggttatttctactttcacgtagttgcatttaatgtttgtagtgtaaagatataactacaataaaagaggccagagagtctgca

SEQ ID NO: 203100 - DNA, 3190 bp, Homo sapiens
  Payload ID: 20050
  Gene Name: zinc finger protein 585A
  ENST ID: ENST00000392157
  CDS Start-End: 467-2611
agtgatgggagtctgtggtcagtgacagagcctgtagggtcagttatggtgatcggtttctgggtgtctctggggagcccctgggccagattttcctctagactccagcccatctcttcagagcagctctgcttgagttcacagatgactgccaagcttcagacaccctacagaaaaagggttgagacccagtgtggccatgccagctaattggacctcacctcagaaatcctcagccctggctccagaggatcatggcagctcctatgagtgttaaccttgatgcctgaaagaactggaaattatgaagatagattcagaagtcaaatatgttaactaactgcattgaagagtagaagaaaacaatagcctaggatcagtgtccttcagggatgtggctatcgatttcagcagagaggaatggcggcacctggacccttctcagagaaacctgtaccgggatgtgatgctggagacctacagccacctgctctcagtaggatatcaagttcctgaagcagaggtggtcatgttggagcaaggaaaggaaccatgggcactgcagggtgagaggccacgtcagagctgcccaggagagaaattatgggaccataatcaatgtagaaaaatcctcagttataaacaagtatcctctcaacctcaaaaaatgtatcctggggagaaagcttatgaatgcgccaaatttgaaaagatattcacccagaagtcacagctcaaagtacacctgaaagttcttgcaggagaaaagctctatgtatgcattgaatgtgggaaggcttttgtacagaagccagaatttattatacaccagaaaacccatatgagagagaaaccctttaaatgcaatgaatgtggaaaatccttttttcaagtgtcgtccctcttcaggcatcagagaattcataccggagagaaactctatgaatgcagccagtgtgggaaaggcttctcttataactcagatctcagtatacatgagaaaattcatactggagagagacaccatgaatgcactgactgtggcaaagcattcacacaaaagtccacactcaagatgcatcagaaaatccatacaggcgagagatcctacatctgtattgaatgcggacaggccttcatccagaagacccatttgattgcacaccgaagaattcatactggagaaaaaccatatgagtgcagtaactgtggcaaatccttcatttccaagtcacaacttcaggtacatcaacgtgttcacacaagagtgaagccctatatatgtaccgaatatgggaaggtcttcagcaataattccaacctcgttacacataagaaagttcaaagtagagagaaatcttccatatgtactgagtgtgggaaggcctttacctacaggtcagagttgattattcatcagagaattcacactggagagaaaccttatgaatgcagtgactgtgggaaagccttcactcagaagtcagcactcacagtgcatcagagaattcatacaggagaaaaatcgtatatatgcatgaaatgtggactggccttcattcagaaggcacacttgattgcacatcaaataattcatactggagagaaacctcataaatgtggtcactgtgggaaattgtttacctccaagtcgcaactccatgttcataaacgaattcacacaggagaaaagccctatatgtgcaataaatgtgggaaggcattcaccaaccggtcaaatctcattacacatcagaaaactcatacaggagagaaatcttatatatgttccaaatgtggaaaggccttcacccagaggtcagacttgattacacatcagagaatccatactggggagaagccttatgaatgcaatacttgtggaaaagccttcactcagaagtcacacctcaatatacatcagaaaattcacactggagagagacagtatgaatgccacgaatgtgggaaagccttcaaccagaaatcaatactcattgttcatcagaaaattcatacaggagagaaaccctatgtatgcactgagtgtggaagagctttcatccgcaagtcaaactttattactcatcaaagaattcatactggagagaagccttatgaatgcagtgactgtgggaagtcctttacctccaagtctcagctcctggtgcatcagccagttcacacaggagagaaaccctatgtgtgtgccgagtgcgggaaggcctttagtggcaggtcaaatctcagtaagcaccagaaaactcataccggagaaaagccctacatttgttctgaatgtgggaagacctttcgacagaagtcagagttgattacacatcacagaattcatactggagagaaaccttatgagtgcagtgactgtgggaagtctttcactaaaaaatcacagctccaagtgcatcagcgaattcacactggagagaagccttacgtgtgtgctgagtgtgggaaggcctttactgacaggtccaatttgaataaacatcagacaacacacactggagacaaaccctacaagtgtggcatctgtgggaaaggcttcgttcagaaatcagtgttcagcgtccatcagagcagccacgcttgagagaaacagtgtgagaaaacccccctgagggttgggtctgattgtacactgttgcacgcatgcagcagaaaaatatgtatattattgtaaatagaaatgaccacagcagaatgtcacacatggctgttctggagagggcctctgagaaggcactgaatgaggcgagggacccttcctacattgtcaccatccccagtaaaccttgggtcattattcatactgacaaggaaccgagtcaatttggtgaataggaaaagccttctcatgaaaactacaatagaatactgttaccaaattcttcctaagaaagatcgtattaagttaacgataatcctgtttactgtggattaggtatagtgccaacaaattgaatgataaaacaacataatacgtagttattttgatagtgatgaatcctaagttatgtgagttgttcgttgtggaacacattgtgtaacagactcctgggtgtttttctttctcattcgaatctaccacagttggtcatatccaaccctcattcagtatttctatcaagaaagagatgctacaaaaaaaaaaagaaaaaacctttatgta

SEQ ID NO: 203101 - DNA, 596 bp, Homo sapiens
  Payload ID: 20050
  Gene Name: zinc finger protein 585A
  ENST ID: ENST00000588354
  CDS Start-End: 213-290
tcttccaaggcttttttgccgctggtgtcaggagtattttcatattccaataccgataaatctttgaggtttctgggtgtctctggggagcccctgggccagattttcctctagactccagcccatctcttcagagcagctctgcttgagttcacagatgactgccaagcttcagacaccctacagaaaaagggttgagacccagtgtggccatgccagctaattggacctcacctcagaaatcctcagccctggctccagaggatcatggcagctcctatgagtgttaaccttgatgcctgaaagaactggaaattatgaagatagattcagaagtcaaatatgttaactaactgcattgaagagtagaagaaaacaatagcctagtaggtttttactgggattagtgaaacaactgctatgttctcagcaacccactccaaagccaaagtcaaaactaaaattgtaaaatatctcaaaaacaataaaaatggtatatatatatcagaagctctggtatatagcaaaactgtactaaaaataatttagaaaaataatttatctcatgcaaatgaataaaaaaatctaaatgaaaa

SEQ ID NO: 203102 - DNA, 2316 bp, Homo sapiens
  Payload ID: 20050
  Gene Name: zinc finger protein 585A
  ENST ID: ENST00000587817
  CDS Start-End: 245-586
ggtgctagaagtcggaccggaagtggaagtggtcttccaaggcttttttgccgctggtgtcaggagtattttcatattccaataccgataaatctttgaggtttctgggtgtctctggggagcccctgggccagattttcctctagactccagcccatctcttcagagcagctctgcttgagttcacagatgactgccaagcttcagacaccctacagaaaaagggttgagacccagtgtggccatgccagctaattggacctcacctcagaaatcctcagccctggctccagaggatcatggcagctcctatgagggatcagtgtccttcagggatgtggctatcgatttcagcagagaggaatggcggcacctggacccttctcagagaaacctgtaccgggatgtgatgctggagacctacagccacctgctctcagtaggatatcaagttcctgaagcagaggtggtcatgttggagcaaggaaaggaaccatgggcactgcagggtgagaggccacgtcagagctgcccagcaccgtgtcttgtgaactcccatcaccttcaagaaagcttccgagggtgaaggtacgctcgagcgtggtcaatgaggacaagtcaacgagagattcctgagtacgtctatggtcaccctttgcggtaaacttgtgcgctcagaagaagccagggtaacaatgggacaaactaaaaaaacgagagacaaattaattgactgttacacatttctgcaagcagaggttgccaacgcaggactggcaatagcatctgaaatcagactactactcctgcagaacaacatcttactggtaaaaaaaagaatagcccacatgaaggaaaactgatttggtggaaagacaacaacaataagacatgggaaatagggaaggtggtaacgtggaggagaggttttgcttgtgtttcaccaggagaaaatcagcttcctgtttggataccaactagacatttgaagttctacaatgaacctgtcggagatgcaaagaaaagcacctccacggagacagaaacactgcaatcaagcaccatcaactcacaagataaaatggtgatgtcagaagaatagatgaagttgccattcaccaagaaggcagagccgccgacttgggcacaattaaagaagctgacacagttagctaaaaaaggccttgagaacacaaaggtgacacaaactccagagagtatgctgcttgcagctttgatgattgtatcaatggtgcaccgtattctgctagtgagagcaagggaaggcgtgtggatccctgtgtccatggaccgacagtgggaggcctcgccatccatccatattttgactgaatctgcaggtgtacccaacagctccaaagagacagcgaccatcgagaacgggccatgatgacgatggcggttttgtccaaaagaaaagggggaaatgggaaaagagagatcagactgttaccgtgtctatgcagaaataagtagacataagagactccgttttgttctgtaccaagaaaattcttctgccttgagatgctgttaatctgtaaccctagccccaaccctgtgctcacagagacatgtgctgtgttgactcaaggtttaatggatttaccaaagggctatgcaggatgtactttgttaaaaaaaagtgcttgaaggcagtatgcttgttaaaagtcatcaccattctctaatctcaagtacccaggacacaatacactgtggaaggccacagggacctctgcctgggaaagccaggtattgcccaagatttctccccatgtgatagcctgagatatggcctcatgggaagggtaagacctgactgtcccccagcccgacatcccccagcccgacacccgaaaagggtctgtgctgaggaggattagtaaaagaggaaggcctctttgcagttcagataagaggaagtcatctgtctcctgctcgtccctgggcaatagaatgtctcagtgtaaaacccaattgtatgttctatttactgagataggagaaaaccaccttagggctggaggagagacatgctagtggtaatactgctctttaatgcaccgagatgtttgtacacgtgcacatcaaggcacagcaccttttcttaaccttgtttacgacacagagacttttgtttacatgttttcccgctgaccctctccccactattaccctattgtcctgccacatccccctctccgagatggtagagataatgatcaataaatactgagggaactcagagaccagtaagcaccggtcccctgggcccacttttctttctccaca

SEQ ID NO: 203103 - DNA, 600 bp, Homo sapiens
  Payload ID: 20051
  Gene Name: zinc finger protein 585B
  ENST ID: ENST00000392156
  CDS Start-End: 235-405
ggtgctagaagtcggaccggaagtggaagtggtccccgaaggctatttcgccgctggcgtcaggactattttcacgttttaatgccgagaggttcttgggtgtctctggggagtccctgggccagaccttcctccagactccagcccacctcttcggagcagctctgctgagttcacagatgaccactaaacttcaggcaccctagacaaaaagggttgagatccagtgtggccatgccagctagttggacctcaccccagaaatcctcagccctggctccagaggatcatggcagctcctatgaggtatataggtaccattttcaaagaaatgatgttctgagccctataagcacaatcaatatgcatcacaagagacaaactgtaatctctgaatgcagttaaatgaagaaatcaacaagggatcagtgtccttcagggatgtggctatcgatttcagcagagaggaatggcggcacctggacctttctcagagaaacctgtaccgggatgtgatgctggagacctacagccacctgctctcagtagggtatcaagttcctaaaccagaggtggtcatgttggagcaaggaaaggaac

SEQ ID NO: 203104 - DNA, 6210 bp, Homo sapiens
  Payload ID: 20051
  Gene Name: zinc finger protein 585B
  Uniprot ID: Q52M93
  ENST ID: ENST00000532828
  CDS Start-End: 253-2562
ggtgctagaagtcggaccggaagtggaagtggtccccgaaggctatttcgccgctggcgtcaggactattttcacgttttaatgccgagaggtctctgtgacgattttggttcttgggtgtctctggggagtccctgggccagaccttcctccagactccagcccacctcttcggagcagctctgctgagttcacagatgaccactaaacttcaggcaccctagacaaaaagggttgagatccagtgtggccatgccagctagttggacctcaccccagaaatcctcagccctggctccagaggatcatggcagctcctatgagggatcagtgtccttcagggatgtggctatcgatttcagcagagaggaatggcggcacctggacctttctcagagaaacctgtaccgggatgtgatgctggagacctacagccacctgctctcagtagggtatcaagttcctaaaccagaggtggtcatgttggagcaaggaaaggaaccatgggcactgcagggtgagaggccacgtcacagctgcccaggagagaaattatgggaccataatcaacatagaaaaatcatcggttataaaccagcttcctctcaagatcaaaaaatttattctggggaaaaatcctatgagtgtgctgaatttggaaagagcttcacctggaagtcacagttcaaggtacatctgaaagttcctacaggagaaaaactctatgtatgtattgaatgtgggagggcttttgtacagaagccagaattcatcacacatcagaaaacccatatgagagagaagccctataagtgcaatgaatgtggaaaatccttttttcaagtatcgtctcttttcaggcatcacagaattcataccggagaaaaactatatgaatgtagtgaatgtgggaaaggtttcccttataactcagatctcagtatacatgagaaaattcatactggagagagacaccatgaatgcactgactgtggcaaagcgttcacacaaaagtccacactcaagattcatcagaaaatccatacaggcgagagatcctacatctgtattgaatgcgggcaggccttcatccagaaaacacaattgattgcacaccgaagaattcatagtggagaaaaaccatatgaatgcaataactgtggcaaatccttcatttccaagtcacaacttcaggtacatcaacgtgttcacacaagagtgaagccctatatatgtaccgaatatgggaaggtcttcagcaataattccaacctcattacacatgagaagattcaaagtagagagaaatcttccatatgtactgagtgtgggaaggcctttacctacaggtcagagttgattattcatcagagaattcacactggagagaaaccttatgaatgcagtgactgtgggagagccttcactcagaagtcagcactcacagtgcatcagagaattcatacaggagaaaaatcgtatatatgcatgaaatgtggactggccttcatccggaaggcacacttgattacacatcaaataattcatactggagagaaaccttataaatgtggtcactgtgggaaattgtttacttccaagtcacaactccatgttcataaacgaattcacacaggagaaaagccctatgtatgcaataaatgtgggaaggcattcaccaaccggtcaaatctcattacacatcagaaaactcatacaggagagaaatcttatatatgttccaaatgtggaaaggccttcacccagaggtcagacttgattacacatcagagaatccatactggggagaagccttatgaatgcaatacttgtggaaaagcctttactcagaagtcaaatcttaatatacatcagaaaattcacactggagagagacagtatgaatgccacgaatgtgggaaagccttcaaccagaaatcaatactcattgttcatcagaaaattcatacaggagagaaaccctatgtatgcactgagtgtggaagagctttcatccgcaagtcaaactttattactcatcaaagaattcatactggagagaagccttatgaatgcagtgactgtgggaagtcctttacctccaagtctcagctcctggtgcatcagccagttcacacaggagagaaaccctatgtgtgtgccgagtgtgggaaagcctttagtggcaggtcaaatctcagtaagcaccagaaaactcataccggagaaaagccctacatttgttctgaatgtgggaagacctttcgacagaagtcagagttgattacacatcacagaattcatactggagagaaaccttatgagtgcagtgactgtgggaagtctttcactaaaaaatcacagctccaagtgcatcagcgaattcacactggagagaagccttacgtgtgtgctgagtgtgggaaggcctttagcaacaggtccaatttgaataaacatcagacaacacacactggagacaaaccctacaagtgtggcatctgtgggaaaggcttcgttcagaaatcagtgttcagtgttcatcagagcagccacgcttgagagaaacagtgtgagaaaacccccctgagggttgggtctgattgtacactgttgcacgcatgcagcagaaaaatatgtatattattgtaaatagaaatgaccacatcagaatgtcacacatggctgttctggagagggcctctgagaaggcactgaatgaggcgagggacccttcctacattgtcaccatccccagtaaaccttgggtcattattcatactgacaaggaaccgagtcaatttggtgaataggaaaagccttctcatgaaaactacaatagaatactgttaccaaattcttcataagaaagatcatattatgggaatgataatcctgtttactgtggattaggtatagtgccaacagtttgaatggtaagacaacataatatatatgatagtgatgaatccttctgtgagttgtttgttccagaacacactgtctagtagaattgtgggtattttcttcttttgaatcgaacacagttgtgcatatccaattccccattgagtatttctatcaagcaagagatactgcaataagacaaactccctgtgtattcagacacagacctcagagcgtatgttgagtccccattgtcatagaaaaagacttacagtccccttcattatctgccaggactctctctgagccccacaggttctcagcacattgtgtttgacacccagcacagtgttttttctttttctttctttctttctctttctttctttctttctttctttctttctttctttctttctttctttctttctttctttccttctttctttctttttctttctttctctttctttctttctttctttctttctttctttctttctttctttctttctttctttctttttttgagacagagtcttgctctgtcgggcaagctagagtgcagtggcgctatcttggctcactgcaacctccgtctcccgggctcaagcaattctcctgcctcagcctcctgagtagctgggattgcgtgtgccaccacgcccagctaatttttgtatgtttagtagaaacgggggtttcaccatgctggccaggctggtctcgaactcctgacctcatgatccgcccgcctcggcctcccaaagtcctgggattacggacgtgagccactgcgcccggcccagcacagtgttttgtacactcccaccaccctcaagaaagcctttgaggttaggattttcaggtcatctgggagaacttaaattcttccttctgctattacaattcttctcactcagttgcctgcctcttttttttttttaatttacttgtgactgagttgaagcccagcattttactttccttaatgatctgactttcataagttgataagtcatgaaatcattatcttacattatatgagatatgagataaatcataaatcatatgaaattgataactcatatgaaaaccaaccccaccatatgttcactgtctacttgtgtccatcttcgtcccacgcaccccacaaggaccttccccgccatgtgcctcaaacatcagttcctgactcagggcctttgtatttgcagtgcccgttgcaaagagcacaattctttattttatctgtggcttgtccgtcatgtctttttttccatgacacctccacacaggccttccctgcctgcctggtttaaaattccagccccttacccttcctcctttattcttctccctagcaatttccaccatgctgcctggtgtattttcctcatttctctgtggcttctacactagaaaatatttcccttttgttcaccactatgagtctagacccatgactgccatacagcaggcattccataaatgcacctgtggagagttgacccatgcttgttgcgtgacttctgtctgatttttttctgtgttgcagcataagaagcgctaatagggagaaccaacttggctaaaacacaccaggctttttcacctctagtctgtacctgggctgtatcccttctcaaccctaaagctaaaaagtcattgtgaaccttttggtctgatgctaaagaagggaaaacaggtacaggaaatcccatgtggatgcttgcttccaggatttcctgccatgattccagaatcccacagctccaacatgattgcaaaagactccctgctcatttttcctcagcatgcacagcgctgtcctgtctcagttgcaactcgacagagccgcatttactccagaacccaatccacacacctgctcatcctgccccgagaggagtgcctgaagccaatagcagggaactagagcagacttgggtggatcttcattggatattaggtatcttgccctagataggcagcagtggccttacagatgctgacagatgatctgattagatgcacagttgctgggtggcgtctggggccagtctattggcagttctgggagtgggaactatttgggctctgcaaagatggtttcacctttaagaagggcagtatggggaggtgaagatggggcccaaaggatagaacatagtcaaagaagcagggccacaatgcccctttaattcccaagccctagttgggcagtgcttggtgacacatcccattacctcaccttagatcaatgtctactgagccatcattagctctgcttcctcacttcttcacagtatctgatggcccatcacatgctgctcaacatcttagaccaatgtctgctcacccattacctcccttcacctcatccagcactgtatctgaagcttcactattcttccttcagttttggatattttgtgatacaacattatccccaacttaggacaatgtcagctgactctcaggagggtgcctggagatcacctcttccttcctaacataccctagaacaaggtctggtccccttcattattcccattttaccttactcctaagtgtatcactcctcatgaattccaggaaatatggaggaaaacacatttcactgtacatgactttcaataatttctcctttatatttattgtaacgtgatattttagtgctgacatatatatgtatatgtatgcccatttatataaaagactagtttttagagaaattttaggttcacagcaaaatggggcagaaggtacagagatttcccatatatcccctaccctcacatatacacagcctcccccatcatcaacatcccccttcagagtggtacatttgttacaattgatgaaactacattgacactatcggccaaagtccatggtttaattagggttcagtcttgatgtgcattctgtgggttgagacaaatgaataatgacatgtatgcattattacagaaggataaagagccgtttcactgtcccaataatcctctgtgtttcgcctactcctctaaactcctggctattttcttttgtctccataattttgcctctgaaccataaagtatgcagccttttcagattgatttgtttcacttagtaatgtggatttaagtttcttccatgtcttttcgtagcttgctagctcttttttttttttttttctcattgaataatatgctattgtctggaagtaccatgacttatttatccattcacctactgaaggacaccttaattgcttccaagttttgttgattatgaataaagatgctataaaca

SEQ ID NO: 203105 - DNA, 572 bp, Homo sapiens
  Payload ID: 20051
  Gene Name: zinc finger protein 585B
  ENST ID: ENST00000526705
  CDS Start-End: 209-316
atttcgccgctggcgtcaggactattttcacgttttaatgccgagaggtctctgtgacgattttggttcttgggtgtctctggggagtccctgggccagaccttcctccagactccagcccacctcttcggagcagctctgctgagttcacagatgaccactaaacttcaggcaccctagacaaaaagggttgagatccagtgtggccatgccagctagttggacctcaccccagaaatcctcagccctggctccagaggatcatggcagctcctatgaggctggagtgctgtggtgcaatcacggctcactgtagcctggacttcccaggttcaatcgatccccccaccttagcctgccgagtagctgggactacaggtatataggtaccattttcaaagaaatgatgttctgagccctataagcacaatcaatatgcatcacaagagacaaactgtaatctctgaatgcagttaaatgaagaaatcaacaagggatcagtgtccttcagggatgtggctatcgatttcagcagagaggaatggcggcacctggacctttctcagagaaac

SEQ ID NO: 203106 - DNA, 2732 bp, Homo sapiens
  Payload ID: 20051
  Gene Name: zinc finger protein 585B
  ENST ID: ENST00000527838
  CDS Start-End: 188-661
ctattttcacgttttaatgccgagaggtctctgtgacgattttggttcttgggtgtctctggggagtccctgggccagaccttcctccagactccagcccacctcttcggagcagctctgctgagttcacagatgaccactaaacttcaggcaccctagacaaaaagggttgagatccagtgtggccatgccagctagttggacctcaccccagaaatcctcagccctggctccagaggatcatggcagctcctatgagggatcagtgtccttcagggatgtggctatcgatttcagcagagaggaatggcggcacctggacctttctcagagaaacctgtaccgggatgtgatgctggagacctacagccacctgctctcagtagggtatcaagttcctaaaccagaggtggtcatgttggagcaaggaaaggaaccatgggcactgcagggtgagaggccacgtcacagctgcccaggagagaaattatgggaccataatcaacatagaaaaatcatcggttataaaccagcttcctctcaagatcaaaaaatttattctggggaaaaatcctatgagtgtgctgaatttggaaagagcttcacctggaagtcacagttcaaggcatcacagaattcataccggagaaaaactatatgaatgtagtgaatgtgggaaaggtttcccttataactcagatctcagtatacatgagaaaattcatactggagagagacaccatgaatgcactgactgtggcaaagcgttcacacaaaagtccacactcaagattcatcagaaaatccatacaggcgagagatcctacatctgtattgaatgcgggcaggccttcatccagaaaacacaattgattgcacaccgaagaattcatagtggagaaaaaccatatgaatgcaataactgtggcaaatccttcatttccaagtcacaacttcaggtacatcaacgtgttcacacaagagtgaagccctatatatgtaccgaatatgggaaggtcttcagcaataattccaacctcattacacatgagaagattcaaagtagagagaaatcttccatatgtactgagtgtgggaaggcctttacctacaggtcagagttgattattcatcagagaattcacactggagagaaaccttatgaatgcagtgactgtgggagagccttcactcagaagtcagcactcacagtgcatcagagaattcatacaggagaaaaatcgtatatatgcatgaaatgtggactggccttcatccggaaggcacacttgattacacatcaaataattcatactggagagaaaccttataaatgtggtcactgtgggaaattgtttacttccaagtcacaactccatgttcataaacgaattcacacaggagaaaagccctatgtatgcaataaatgtgggaaggcattcaccaaccggtcaaatctcattacacatcagaaaactcatacaggagagaaatcttatatatgttccaaatgtggaaaggccttcacccagaggtcagacttgattacacatcagagaatccatactggggagaagccttatgaatgcaatacttgtggaaaagcctttactcagaagtcaaatcttaatatacatcagaaaattcacactggagagagacagtatgaatgccacgaatgtgggaaagccttcaaccagaaatcaatactcattgttcatcagaaaattcatacaggagagaaaccctatgtatgcactgagtgtggaagagctttcatccgcaagtcaaactttattactcatcaaagaattcatactggagagaagccttatgaatgcagtgactgtgggaagtcctttacctccaagtctcagctcctggtgcatcagccagttcacacaggagagaaaccctatgtgtgtgccgagtgtgggaaagcctttagtggcaggtcaaatctcagtaagcaccagaaaactcataccggagaaaagccctacatttgttctgaatgtgggaagacctttcgacagaagtcagagttgattacacatcacagaattcatactggagagaaaccttatgagtgcagtgactgtgggaagtctttcactaaaaaatcacagctccaagtgcatcagcgaattcacactggagagaagccttacgtgtgtgctgagtgtgggaaggcctttagcaacaggtccaatttgaataaacatcagacaacacacactggagacaaaccctacaagtgtggcatctgtgggaaaggcttcgttcagaaatcagtgttcagtgttcatcagagcagccacgcttgagagaaacagtgtgagaaaacccccctgagggttgggtctgattgtacactgttgcacgcatgcagcagaaaaatatgtatattattgtaaatagaaatgaccacatcagaatgtcacacatggctgttctggagagggcctctgagaaggcactgaatgaggcgagggacccttcctacattgtcaccatccccagtaaaccttgggtcattattcatactgacaaggaaccgagtcaatttggtgaataggaaaagccttctcatgaaaactacaatagaatactgttaccaaattcttcataagaaagatcatattatgggaatgataatcctgtttactgtggattaggtatagtgccaacagtttgaatggtaagacaacataatatatatgatagtgatg

SEQ ID NO: 203107 - DNA, 2971 bp, Homo sapiens
  Payload ID: 20051
  Gene Name: zinc finger protein 585B
  ENST ID: ENST00000531805
  CDS Start-End: 420-2564
gtcaggagattgagaccatcctggccaacatggtgaaaccccgtctctactaaaaatacaaaaattagctgggtgtggtggcacgtgcctgtaatcccagctactcaggaggctgaggcaggagaatcacttgaacccgggaggtggaggttgcagtaagccaagatcgcgccactgcactccagcctggggaacagagcaagactgtctcaaaaaaaaaatgaagtaaattaaaaacaacaaaacccatgttccgtaatcccatatatagtcactccaccgtgcaaagctgactatgcacattgaacaggaatgtgcccttacagggatcagtgtccttcagggatgtggctatcgatttcagcagagaggaatggcggcacctggacctttctcagagaaacctgtaccgggatgtgatgctggagacctacagccacctgctctcagtagggtatcaagttcctaaaccagaggtggtcatgttggagcaaggaaaggaaccatgggcactgcagggtgagaggccacgtcacagctgcccaggagagaaattatgggaccataatcaacatagaaaaatcatcggttataaaccagcttcctctcaagatcaaaaaatttattctggggaaaaatcctatgagtgtgctgaatttggaaagagcttcacctggaagtcacagttcaaggtacatctgaaagttcctacaggagaaaaactctatgtatgtattgaatgtgggagggcttttgtacagaagccagaattcatcacacatcagaaaacccatatgagagagaagccctataagtgcaatgaatgtggaaaatccttttttcaagtatcgtctcttttcaggcatcacagaattcataccggagaaaaactatatgaatgtagtgaatgtgggaaaggtttcccttataactcagatctcagtatacatgagaaaattcatactggagagagacaccatgaatgcactgactgtggcaaagcgttcacacaaaagtccacactcaagattcatcagaaaatccatacaggcgagagatcctacatctgtattgaatgcgggcaggccttcatccagaaaacacaattgattgcacaccgaagaattcatagtggagaaaaaccatatgaatgcaataactgtggcaaatccttcatttccaagtcacaacttcaggtacatcaacgtgttcacacaagagtgaagccctatatatgtaccgaatatgggaaggtcttcagcaataattccaacctcattacacatgagaagattcaaagtagagagaaatcttccatatgtactgagtgtgggaaggcctttacctacaggtcagagttgattattcatcagagaattcacactggagagaaaccttatgaatgcagtgactgtgggagagccttcactcagaagtcagcactcacagtgcatcagagaattcatacaggagaaaaatcgtatatatgcatgaaatgtggactggccttcatccggaaggcacacttgattacacatcaaataattcatactggagagaaaccttataaatgtggtcactgtgggaaattgtttacttccaagtcacaactccatgttcataaacgaattcacacaggagaaaagccctatgtatgcaataaatgtgggaaggcattcaccaaccggtcaaatctcattacacatcagaaaactcatacaggagagaaatcttatatatgttccaaatgtggaaaggccttcacccagaggtcagacttgattacacatcagagaatccatactggggagaagccttatgaatgcaatacttgtggaaaagcctttactcagaagtcaaatcttaatatacatcagaaaattcacactggagagagacagtatgaatgccacgaatgtgggaaagccttcaaccagaaatcaatactcattgttcatcagaaaattcatacaggagagaaaccctatgtatgcactgagtgtggaagagctttcatccgcaagtcaaactttattactcatcaaagaattcatactggagagaagccttatgaatgcagtgactgtgggaagtcctttacctccaagtctcagctcctggtgcatcagccagttcacacaggagagaaaccctatgtgtgtgccgagtgtgggaaagcctttagtggcaggtcaaatctcagtaagcaccagaaaactcataccggagaaaagccctacatttgttctgaatgtgggaagacctttcgacagaagtcagagttgattacacatcacagaattcatactggagagaaaccttatgagtgcagtgactgtgggaagtctttcactaaaaaatcacagctccaagtgcatcagcgaattcacactggagagaagccttacgtgtgtgctgagtgtgggaaggcctttagcaacaggtccaatttgaataaacatcagacaacacacactggagacaaaccctacaagtgtggcatctgtgggaaaggcttcgttcagaaatcagtgttcagtgttcatcagagcagccacgcttgagagaaacagtgtgagaaaacccccctgagggttgggtctgattgtacactgttgcacgcatgcagcagaaaaatatgtatattattgtaaatagaaatgaccacatcagaatgtcacacatggctgttctggagagggcctctgagaaggcactgaatgaggcgagggacccttcctacattgtcaccatccccagtaaaccttgggtcattattcatactgacaaggaaccgagtcaatttggtgaataggaaaagccttctcatgaaaactacaatagaatactgttaccaaattcttcataagaaagatcatattatgggaatgataatcctgtttactgtggattaggtatagtgccaacagtttgaatggtaagacaacataatatatatgatagtgatgaa

SEQ ID NO: 203108 - DNA, 548 bp, Homo sapiens
  Payload ID: 20051
  Gene Name: zinc finger protein 585B
  ENST ID: ENST00000591492
  CDS Start-End: 137-548
atttcgccgctggcgtcaggactattttcacgttttaatgccgagaggtatataggtaccattttcaaagaaatgatgttctgagccctataagcacaatcaatatgcatcacaagagacaaactgtaatctctgaatgcagttaaatgaagaaatcaacaagggatcagtgtccttcagggatgtggctatcgatttcagcagagaggaatggcggcacctggacctttctcagagaaacctgtaccgggatgtgatgctggagacctacagccacctgctctcagtagggtatcaagttcctaaaccagaggtggtcatgttggagcaaggaaaggaaccatgggcactgcagggtgagaggccacgtcacagctgcccaggagagaaattatgggaccataatcaacatagaaaaatcatcggttataaaccagcttcctctcaagatcaaaaaatttattctggggaaaaatcctatgagtgtgctgaatttggaaagagcttcacctggaagtcacagttcaaggtacatctgaaagttccta

SEQ ID NO: 203109 - DNA, 574 bp, Homo sapiens
  Payload ID: 20051
  Gene Name: zinc finger protein 585B
  ENST ID: ENST00000591273
  CDS Start-End: 217-399
ggaagtggaagtggtccccgaaggctatttcgccgctggcgtcaggactattttcacgttttaatgccgagaggttcttgggtgtctctggggagtccctgggccagaccttcctccagactccagcccacctcttcggagcagctctgctgagttcacagatgaccactaaacttcaggcaccctagacaaaaagggttgagatccagtgtggccatgccagctagttggacctcaccccagaaatcctcagccctggctccagaggatcatggcagctcctatgagagttttgctcttgttgcccaggctggagtgcagtggcacaatcttggctcaccgcaacctctgcctcctgggttcaagcgattctcctgcctcagcctcccgagtagctgagattacaggcatgcaccaccacgcccagggatcagtgtccttcagggatgtggctatcgatttcagcagagaggaatggcggcacctggacctttctcagagaaacctgtaccgggatgtgatgctggagacctacagccacctgctctcagtagggtatcaagttcctaaacca

SEQ ID NO: 203110 - DNA, 403 bp, Homo sapiens
  Payload ID: 20051
  Gene Name: zinc finger protein 585B
  ENST ID: ENST00000586320
  CDS Start-End: 44-298
gcacaatcaatatgcatcacaagagacaaactgtaatctctgaatgcagttaaatgaagaaatcaacaagggatcagtgtccttcagggatgtggctatcgatttcagcagagaggaatggcggcacctggacctttctcagagaaacctgtaccgggatgtgatgctggagacctacagccacctgctctcagtagggtatcaagttcctaaaccagaggtggtcatgttggagcaaggaaaggaaccatgggcactgcagggtgagaggccacgtcacagctgcccaggtgagtgaagtgaggtgaatgtgactcaggttagatgggagacaggaggaaatctcagctgtcttgaaaaacactggaacctgtgaagtgctattaagaccactcttcagtaa

SEQ ID NO: 203111 - DNA, 2265 bp, Homo sapiens
  Payload ID: 20052
  Gene Name: zinc finger protein 586
  Uniprot ID: Q9NXT0
  ENST ID: ENST00000391702
  CDS Start-End: 368-1447
ctagccgtggcagccattttggcctgtcaggtccatccggcgatgctgggtctggacgagctcgggaggagtggttgtggccattgcacacaggcggatctgaggttcggcgacgccgctggtcgcgacccgggacaggacaacgacaggaacaccgccgagcccgcgttccccccccgcccagagtcatggcggcagcagccgctctgagggcgcctgctcagactactgtggatgatgtcagccacattatggtgtaagccctaaagttaagagcagtgtgacctttgaagatgtggctgtaaacttttccctggaggaatggagtcttcttaatgaggctcagagatgcctgtaccgtgacgtgatgctggagaccttgacacttatatcctccctgggttgttggcatggaggggaagatgaggcagcaccttctaagcagagcacgtgtatacatatatacaaagaccagggaggtcatagtggagaaaggccttatgagtgtggggaatataggaaattatttaagaacaagtcctgcctcactgaacccagaagagatcacaaacacaggaatgttcgcactggagaaaggccttatgagtgcagcaaatatgggaaattatttcaccaaaagcctacactccatattcatgagagatttcatactgggcaaaagacctatgagtgcagtgagtgtggaaaatcatttcaccaaagctcttcactcttgcagcgtcagacacttcacactagagaaaggccttatgagtgtattgaatgtgggaaagcctttgctgaaaagtccagtctcattaaccacaggaaagttcactctggagcaaagcgttatgaatgcaatgaatgtgggaagtcctttgcttatacatctagtctcattaaacacaggaggattcacactggagagaggccttatgagtgcagtgaatgtgggagatcctttgctgaaaactccagtcttattaaacacttgagagttcacacaggagaaaggccttatgaatgcgttgagtgtggaaaatcatttcgccgaagctcttcactcttgcagcatcagagagttcacactagagaaaggccttatgaatgtagtgaatgtgggaaatcctttagcttaaggtccaacctcattcaccatcagcgagttcatactggagaaaggcatgagtgcgggcagtgtgggaaatcctttagccgaaaatctagccttattatacatctgagagttcacactggagaaaggccttatgagtgcagtgactgtgggaaatcctttgctgaaaactccagccttattaaacacttgagagttcacactggagaaaggccatatgaatgcattgattgtggaaaatcatttcgccacagttcttcgttccgtcgccatcagagagttcatactggaatgaggccttataagtgaagcaaattttggaaattctcttgcccaggctttttgctccttcaaggccagagagttcacaccagatcaaggtgttatgagtgtgacaaatggggaatattctttagctagaatgctagcttctttacataaaagagtgctcccactgaagaagtgccttttgagtgcaatgaatgtgagaaagccttcagccctctctcattggttaccacaatatttacatgaggaaaataccacagatgtggaggtaatattattttttcttcaatataacactggaggaaaccccttatgaggatgccatctgcctaaattgaatgtcatacatcaaatagctgcatacattccaggtatgtgggaactgcatagtatttttcgacctgcccaggtctcttgctagacttctgtgacttacagttctcttctaaaaagcatttcacctttaccacttggcaggtgcccacagtacatcattcgcctaactcatcatgatccagaagtaactttgattttgtttcattcaacagagggattttttagtatcctcagcactcattctattctcatttctttctctccaatgagttaggccatgaacctgactcatttttggcacagaggactcttctgataacttgaaaaaatggactacctttttcagggatcttttggatctcacagagttcttaagatggaattttccagcctgccagtcatgaatctcagacagcctgccacctattgccctgatttgtgttataataaaggccttgttgcttaagacaccttcagtctttgcaggagggcatggaagctcc

SEQ ID NO: 203112 - DNA, 1977 bp, Homo sapiens
  Payload ID: 20052
  Gene Name: zinc finger protein 586
  Uniprot ID: Q9NXT0
  ENST ID: ENST00000396150
  CDS Start-End: 148-780
gatgctgggtctggacgagctcgggaggagtggttgtggccattgcacacaggcggatctgaggttcggcgacgccgctggtcgcgacccgggacaggacaacgacaggaacaccgccgagcccgcgttccccccccgcccagagtcatggcggcagcagccgctctgagggcgcctgctcaggttgttggcatggaggggaagatgaggcagcaccttctaagcagagcacgtgtatacatatatacaaagaccagggaggtcatagtggagaaaggccttatgagtgtggggaatataggaaattatttaagaacaagtcctgcctcactgaacccagaagagatcacaaacacaggaatgttcgcactggagaaaggccttatgagtgcagcaaatatgggaaattatttcaccaaaagcctacactccatattcatgagagatttcatactgggcaaaagacctatgagtgcagtgagtgtggaaaatcatttcaccaaagctcttcactcttgcagcgtcagacacttcacactagagaaaggccttatgagtgtattgaatgtgggaaagcctttgctgaaaagtccagtctcattaaccacaggaaagttcactctggagcaaagcgttatgaatgcaatgaatgtgggaagtcctttgcttatacatctagtctcattaaacacaggaggattcacactggagagaggccttatgagtgcagtgaatgtgggagatcctttgctgaaaactccagtcttattaaacacttgagagttcacacaggagaaaggccttatgaatgcgttgagtgtggaaaatcatttcgccgaagctcttcactcttgcagcatcagagagttcacactagagaaaggccttatgaatgtagtgaatgtgggaaatcctttagcttaaggtccaacctcattcaccatcagcgagttcatactggagaaaggcatgagtgcgggcagtgtgggaaatcctttagccgaaaatctagccttattatacatctgagagttcacactggagaaaggccttatgagtgcagtgactgtgggaaatcctttgctgaaaactccagccttattaaacacttgagagttcacactggagaaaggccatatgaatgcattgattgtggaaaatcatttcgccacagttcttcgttccgtcgccatcagagagttcatactggaatgaggccttataagtgaagcaaattttggaaattctcttgcccaggctttttgctccttcaaggccagagagttcacaccagatcaaggtgttatgagtgtgacaaatggggaatattctttagctagaatgctagcttctttacataaaagagtgctcccactgaagaagtgccttttgagtgcaatgaatgtgagaaagccttcagccctctctcattggttaccacaatatttacatgaggaaaataccacagatgtggaggtaatattattttttcttcaatataacactggaggaaaccccttatgaggatgccatctgcctaaattgaatgtcatacatcaaatagctgcatacattccaggtatgtgggaactgcatagtatttttcgacctgcccaggtctcttgctagacttctgtgacttacagttctcttctaaaaagcatttcacctttaccacttggcaggtgcccacagtacatcattcgcctaactcatcatgatccagaagtaactttgattttgtttcattcaacagagggattttttagtatcctcagcactcattctattctcatttctttctctccaatgagttaggccatgaacctgactcatttttggcacagaggactcttctgataacttgaaaaaatggactacctttttcagggatcttttggatctcacagagttcttaagatggaattttccagcctgccagtcatgaatctcagacagcctgccacctattgccct

SEQ ID NO: 203113 - DNA, 2163 bp, Homo sapiens
  Payload ID: 20052
  Gene Name: zinc finger protein 586
  Uniprot ID: Q9NXT0
  ENST ID: ENST00000396154
  CDS Start-End: 174-1382
attttggcctgtcaggtccatccggcgatgctgggtctggacgagctcgggaggagtggttgtggccattgcacacaggcggatctgaggttcggcgacgccgctggtcgcgacccgggacaggacaacgacaggaacaccgccgagcccgcgttccccccccgcccagagtcatggcggcagcagccgctctgagggcgcctgctcagagcagtgtgacctttgaagatgtggctgtaaacttttccctggaggaatggagtcttcttaatgaggctcagagatgcctgtaccgtgacgtgatgctggagaccttgacacttatatcctccctgggttgttggcatggaggggaagatgaggcagcaccttctaagcagagcacgtgtatacatatatacaaagaccagggaggtcatagtggagaaaggccttatgagtgtggggaatataggaaattatttaagaacaagtcctgcctcactgaacccagaagagatcacaaacacaggaatgttcgcactggagaaaggccttatgagtgcagcaaatatgggaaattatttcaccaaaagcctacactccatattcatgagagatttcatactgggcaaaagacctatgagtgcagtgagtgtggaaaatcatttcaccaaagctcttcactcttgcagcgtcagacacttcacactagagaaaggccttatgagtgtattgaatgtgggaaagcctttgctgaaaagtccagtctcattaaccacaggaaagttcactctggagcaaagcgttatgaatgcaatgaatgtgggaagtcctttgcttatacatctagtctcattaaacacaggaggattcacactggagagaggccttatgagtgcagtgaatgtgggagatcctttgctgaaaactccagtcttattaaacacttgagagttcacacaggagaaaggccttatgaatgcgttgagtgtggaaaatcatttcgccgaagctcttcactcttgcagcatcagagagttcacactagagaaaggccttatgaatgtagtgaatgtgggaaatcctttagcttaaggtccaacctcattcaccatcagcgagttcatactggagaaaggcatgagtgcgggcagtgtgggaaatcctttagccgaaaatctagccttattatacatctgagagttcacactggagaaaggccttatgagtgcagtgactgtgggaaatcctttgctgaaaactccagccttattaaacacttgagagttcacactggagaaaggccatatgaatgcattgattgtggaaaatcatttcgccacagttcttcgttccgtcgccatcagagagttcatactggaatgaggccttataagtgaagcaaattttggaaattctcttgcccaggctttttgctccttcaaggccagagagttcacaccagatcaaggtgttatgagtgtgacaaatggggaatattctttagctagaatgctagcttctttacataaaagagtgctcccactgaagaagtgccttttgagtgcaatgaatgtgagaaagccttcagccctctctcattggttaccacaatatttacatgaggaaaataccacagatgtggaggtaatattattttttcttcaatataacactggaggaaaccccttatgaggatgccatctgcctaaattgaatgtcatacatcaaatagctgcatacattccaggtatgtgggaactgcatagtatttttcgacctgcccaggtctcttgctagacttctgtgacttacagttctcttctaaaaagcatttcacctttaccacttggcaggtgcccacagtacatcattcgcctaactcatcatgatccagaagtaactttgattttgtttcattcaacagagggattttttagtatcctcagcactcattctattctcatttctttctctccaatgagttaggccatgaacctgactcatttttggcacagaggactcttctgataacttgaaaaaatggactacctttttcagggatcttttggatctcacagagttcttaagatggaattttccagcctgccagtcatgaatctcagacagcctgccacctattgccctgatttgtgttataataaaggccttgttgcttaa

SEQ ID NO: 203114 - DNA, 578 bp, Homo sapiens
  Payload ID: 20052
  Gene Name: zinc finger protein 586
  ENST ID: ENST00000598885
  CDS Start-End: 183-488
gtggcagccattttggcctgtcaggtccatccggcgatgctgggtctggacgagctcgggaggagtggttgtggccattgcacacaggcggatctgaggttcggcgacgccgctggtcgcgacccgggacaggacaacgacaggaacaccgccgagcccgcgttccccccccgcccagagtcatggcggcagcagccgctctgagggcgcctgctcagagcagtgtgacctttgaagacgtggctgtaaacttttccctggaggaatggagtcttcttaatgaggctcagggatgcctgtaccatgatgtgatgctggagaccttgacacttatatcctccctgggaggagttccgcctcacaggttgttccctacaggcgcctgtggaccccaggttccatcctcccggatccgtccatctccaggccattgcccgcgcccctccctgtacctgtcgctctccccaccgcatcccacgggtgtctgaaacagggatccctcccgagagcgcctcagtgtcccgacgccgggtccgggttgcagagccgtaaacaggtgccgctccctcgctgcttta

SEQ ID NO: 203115 - DNA, 603 bp, Homo sapiens
  Payload ID: 20052
  Gene Name: zinc finger protein 586
  ENST ID: ENST00000598183
  CDS Start-End: 177-407
gccattttggcctgtcaggtccatccggcgatgctgggtctggacgagctcgggaggagtggttgtggccattgcacacaggcggatctgaggttcggcgacgccgctggtcgcgacccgggacaggacaacgacaggaacaccgccgagcccgcgttccccccccgcccagagtcatggcggcagcagccgctctgagggcgcctgctcagagcagtgtgacctttgaagacgtggctgtaaacttttccctggaggaatggagtcttcttaatgaggctcagggatgcctgtaccatgatgtgatgctggagaccttgacacttatatcctccctggaaagggtgcactcgccagcagttttgcaacaggagcacactgaacaaagaagacagggtcatttataacctgaggcgttcaccctcctgccggtttccattgcctggaacaggacctcatattctgtatgtgtcctgattggctagcaacttagaaccttttaagaggcaaaggtagaggagaacaaagaaaggaggaagtaacttgtggaatgctgagaaaggtaaaaacacttttaaataaggaagaggaacaggctatgac

SEQ ID NO: 203116 - DNA, 581 bp, Homo sapiens
  Payload ID: 20052
  Gene Name: zinc finger protein 586
  ENST ID: ENST00000599802
  CDS Start-End: 174-245
attttggcctgtcaggtccatccggcgatgctgggtctggacgagctcgggaggagtggttgtggccattgcacacaggcggatctgaggttcggcgacgccgctggtcgcgacccgggacaggacaacgacaggaacaccgccgagcccgcgttccccccccgcccagagtcatggcggcagcagccgctctgagggcgcctgctcagatgcacctctgggtagcgccctctttacagccttgaaacctggtcaactacattactcagaaagctctgcgttgaatgaatgccgtcagagccaatgagggctcggaaagaagcatttccgtgtgtgcgcctaatgtagggccgagacttccggggtcctcttgtagcggccacgttgatctgcgatacgcgtgtttgcccagtgagtggccccggactgctacgtgggactgcggtgaatgaacccagaaggtggagaggaaccgttctcggtgcacagaggcggctctgcagcccggtgagggcgcctgctgctcccgggcagtgctttccccaagtagtccgatggctgcggctgcgccgaggcgccct

SEQ ID NO: 203117 - DNA, 6882 bp, Homo sapiens
  Payload ID: 20053
  Gene Name: zinc finger protein 587
  Uniprot ID: Q96SQ5
  ENST ID: ENST00000339656
  CDS Start-End: 183-1910
ctagtagcggctgtgtatcggcgatgcgggtgtttccccagtttgtggcccctgagtgctgggtgggaccgcggtgactgaacctagaaggtggagaggaatcgtcctcggtgcccagaggcggctctgcagccccgtgacggcgaccactgctcccgggccgtgcttccccaagtagtccgatggcagcggctgtgccgaggcgcccaactcagcagggcactgtgacctttgaagatgtggctgtgaacttttcccaggaggagtggtgtcttcttagtgaggctcagaggtgcttgtaccgtgatgtgatgctagagaacctggctctcatatcctcgctgggttgttggtgtggatcaaaagatgaggaggcaccttgtaagcagagaatttctgtacaaagagagtctcagagcaggactcctagggcaggtgtttctcctaagaaggctcacccctgtgaaatgtgtggcctcatcttggaggatgtttttcactttgctgaccaccaggaaactcatcacaagcagaagctgaacaggagtggagcatgtggaaaaaacttggatgacactgcataccttcatcagcaccagaagcagcatattggagagaaattctacagaaagagtgtcagagaagcatcgtttgtaaagaaacgtaagctcagggtgtcacaggagccatttgtcttccgcgagtttgggaaggacgttctgcccagttcaggattgtgccaagaagaagctgctgtagagaagacagacagtgaaactatgcatggcccaccctttcaggagggaaaaactaattacagttgtggaaaacgcacaaaagccttcagcaccaaacactcagttattccacaccagaaacttttcactagagatggatgttatgtgtgcagtgattgtggaaaatcctttagcagatatgtcagcttcagtaatcatcagcgagatcacactgcaaaaggaccttatgattgtggagagtgtgggaaatcttatagtcgaaagagcagccttattcaacatcagcgagtccacactggacagacagcttatccctgtgaggagtgcgggaaatcttttagtcagaagggcagccttattagccatcagcttgttcacactggagaagggccttatgagtgtagagaatgtgggaaatcttttggtcaaaagggtaacctcattcaacatcagcaaggtcacactggagagagagcttatcactgtggggaatgtgggaaatcttttcgtcagaagttctgctttattaaccatcagcgtgttcacactggagaaaggccttacaagtgtggagaatgtgggaaatcttttggtcaaaagggcaacctcgttcaccatcagcgaggtcatactggagaaaggccctatgagtgcaaggaatgtgggaaatcatttaggtacagatcccacctcactgaacaccagagacttcacactggggaaagaccttacaattgtagggaatgtgggaaattatttaacaggaagtatcatcttctggttcatgagagagttcacactggagaaaggccatatgcgtgtgaggtatgtgggaaattatttggcaataagcacagcgtgactatacatcagaggattcacactggagaaaggccgtatgaatgcagtgaatgtgggaaatcatttctttccagctctgcgcttcatgttcataaaagagttcattctggacaaaagccttataagtgcagtgaatgtggaaaatccttttctgaatgttccagtctcattaaacacaggagaattcacactggagaaaggccttatgaatgcaccaaatgtggaaaaacatttcagcgaagctctaccctccttcatcatcagagttcacacaggagaaaggccttatgagtgcagtgaatatgggaaatcgtttgctgaagcatcccgtctcgttaaacacaggagagttcatactggagaaaggccttatgagtgctgtcaatgtggaaaacatcagaatgtctgctgtcctcggtcttaagcgacttcgtgttgagatggagtcttgttctgtcacccaggctggagtgcagtggtgcagtcttggctcgctgcaacttgggcctcctgggttcatgcaatcctcctacctcagcctcctgagtagctgggattatgagtacacaccaccacgcccagctaatttttgtgtttttagtggagatggggttttaccatgttggccaggctggtctcaaactcctgacctcaagtgatccacccaccttgactcccaaagtgctgaaattacaggcatgagcctctgcacctggccttcattcttttcgtattgcttagaatatgacatgctgaaccaggcatggtggctcatgcttgtaaacctgatgctttgggaggacaaggtggttcattggaggccaggagttagagatcagcctgggcaacatagccagacctcctctctacaaaaagaaaaaagaatgacatgcttcttgtttttgtctgttataaatgaaactgctatatttgaatgcagttgttcatgtaggtatgtttcactatggtaatatggtggtgtgcagtgcctgagtcacgtgatagattaaagtacaactcttttttgagacagagtctcactctgtcacccaggcgggagttaggtggcatgatttcggctcactgcaacctctgcctcccaagttcaactgattcttctgcctcagcctcccgagtagcagggattaccggtgtgcaccaccatgcctggataacttttttttttatttctattagcaatggggtttcaccatgctggccaggcttgttatgaactgacctcaagtgatctgcctgcctcagcttctcaggtgtgacctactgtgcttggcctaatgtacaactttttaagcaatgccaaactatgacttaagaatgaaattattgctcatttgtatatctatctaccatcagtgtccaagaatttctgttctatcttaccaagagggagtatggttagtatttgaaattgtttattattttaataagtggttataacttttgagtcagtggtttatgttttgcattttttttgttttgagacaaagtctcgctctgtctcccaggctagagtaccgtggcacaatctcagctcattgcaacctctgcttcctgggctcaagcactctgcccacctcagcctccagagtagctggaaatacaggtatgcaccaccacaactggataacttttgtattttctgtagagagggttttacctttttgcccagtctgatcgcgaactcctgggctcaggcgatccacttgcctaggctccaaaagtgcttggtctacaggggtgaggcaccctgcctggcctcacctgtaggcttgttttttaaaatgaattttatctatttcccatttcattaatatatttaaaaataatgaaataacaaagacgtatgttggacttcattcattcttcagtgatgtcactttgctgcaaggaatatttggttttcttttttttttttttttccagatggagtctagctctgtctcctaagctacagtgaagtggcatgatctcggcccactgcaacctccacctcctgtgttcaagcgattctgcctcagcctcctgagtagctgggactacaggcatgtgccattatacctggctaattttatttatttattttagtagagatggggtttcaccatgttacccaggctgctctctaccttctgagctcaagtgatccacctgcctcggcctcccaaagtgctgggattacaggtgtcagccactgtacctggctgaatacttggttttcagtaccacaagaactatgagctggttatccacttcatgtggaatcataagcgtcccaaagtgacaatacatatagattgccaggcagtgaaacagttaagatgccaccatagctttcttttcaacatctttctaagattaccttactatttcttttgttccaagtttgtacttcctcacagttctcacatatggaaaggatacacactttgtagaaacaagaactttatgttatccaagttctaggatagccatgagctccaattatctcagagctctgagtcctctactcaatacccattgagatttatgtgttctgaggcttttgtcttctagctacttacttcattctccatgggtaacgtcattcatccacattaactaatttcctcactccaagctcttttctagagataatctccagtccctgtgcagaaactgtcattgcactttctgctgaaatggcagtttcttctcagcaaggtgagattatggaatccagaatcttttttcaggggtcacatgcccatttccccacttgcatgaatgtcgacactgcagccacagttttggccgtaaatgtgaatttggcaagtaaccactgttcccagggaaatgtcccaatcagaagaagattatctgggacactgatactgacagggagatgggacattctgagggacccggaggcagggtgccacctcctcaacttccctgagggctgcctagaatctgtttcctctcactctgaattattcttcctcttatggctgaccaaaaacatggaacctcacaaagtccactgtaacagctttatatttgtgaagtgaagaacatgaagacagtttcaagcaaagttattgagtggacactttgtgttttttttgagaagtctcactctttcacccaggctggagtgcagtggcacgatctcggctcactgcaactccacctcccgggttcacgccattctcttgcctcagcctcctgagtagctgggaccacaagcgcccaccacgtcagcttaatttttttgttttgtttcttgagacagagtcttgctctcttgcccaggttggagtgccgtgtcgcaatctcagctcactgcaacttctacctcctggattcaagcacttctccttgcctcagccacctctttagctgggattacaggtgcgtgccaccacacccagctaatttttgtatttttagcagagaccaggtttcaccatgttggtcaggctggtctcaaactcctgacctcgtgatccacccacctcggcctcccaaagtgctggaattacaggcgtgagccactgcacctggcctgtattcttttctttagtagagacggggttttactgtatttgccaggatggtctcgatctccagacctcgtgatccgcccgccttagcctcccaaagtgctgggattataggcgtgagccaacacgccctggccacttcttgtctttgcaacattttttagatatgtatttgtgttttttggggagcttaatttgctaatggaatctctgttattttcctaacatgcttggtggatacaagagttaagacttcctgtcccgtttagtgtaacaaaagaaagttaagaaatgtggataaaagattgtaagttagaaatggcaagataatcagctatatgaagaatcttggccaggtgtggtggctgaggcctgtaatcccaccactttgggaggctgaggtgggcggatcacaaggtcaggagttcaagaccaccctggccaatattgtgaattcctgtctctactaaaaatacaaaaattagtcgggcatggtggcgggtgcctgtagtcccagctactcgggaggctgaggccagaaaatcggttgaacctgggaggtggaaggtgcactgagccaatatcacaccagtgcactccaacctggtgacagagagacacatcatctcaaaaaaaaaaaaaaaactcaatccataaatgttatactttataactttataacagcatgttatatgggcttagatattatccctaaatttttttttttttttttttttttgagacagagtctcactctgtcacccaggctgaagtgcaatggcatggtctcggctcactgcaacctccgcctcccaggttcaagtgattctcttgcctcagcctcccgagtagctgggcctataggttccctccaccacgcccagctaatttttgtatttttagtagagatgggctttcactacgttagccaggctggtctcaaactcctgacctcatgatccacccccctcggcctcctaaagtgctgggattacaggcatctgccaccgcactcggcttatccctagaaatcctatgatagcatgatgtataggcacctaaaggcatggcacttgagaaatgtgaataagattgtaagttacaaatagcaaggtacagtcagatgttaacagtctcagcccctaaatgtcaccttgtattacagcatgttatataagcacatacaggcacatacatgaaatagtgatacttcattctcagtaatatcttcatccttctcactggaaagatctttgatgatttttaatcaacataggagtttcaatgatatctagaagtttaaaagggctcgttcaaacaaattatgaccacacacactgaagagtatgtttgtctcttgtggtgtaaatttttttttattacaccaaattatgttcacacaaaacctttgtaatcagggggaattaaagagccttcctggaaaatggaggttgcaatcagccgagatggtgccatcgcactctagcctggggaatagagtgagatcctgcctcaaaaaaaacaaaaaaattctttattttctccataaactacagtttatataagcaaaagtttcagtactaagcaattttagtctctgcagtctcttgtcttgaattaatacaacttttgttaattctcttatgaagttaatcttcctgcttgtatgtgaattaaatatatgtcaaactttttttgta

SEQ ID NO: 203118 - DNA, 1974 bp, Homo sapiens
  Payload ID: 20053
  Gene Name: zinc finger protein 587
  Uniprot ID: Q96SQ5
  ENST ID: ENST00000423137
  CDS Start-End: 180-1904
gtagcggctgtgtatcggcgatgcgggtgtttccccagtttgtggcccctgagtgctgggtgggaccgcggtgactgaacctagaaggtggagaggaatcgtcctcggtgcccagaggcggctctgcagccccgtgacggcgaccactgctcccgggccgtgcttccccaagtagtccgatggcagcggctgtgccgaggcgcccaactcagggcactgtgacctttgaagatgtggctgtgaacttttcccaggaggagtggtgtcttcttagtgaggctcagaggtgcttgtaccgtgatgtgatgctagagaacctggctctcatatcctcgctgggttgttggtgtggatcaaaagatgaggaggcaccttgtaagcagagaatttctgtacaaagagagtctcagagcaggactcctagggcaggtgtttctcctaagaaggctcacccctgtgaaatgtgtggcctcatcttggaggatgtttttcactttgctgaccaccaggaaactcatcacaagcagaagctgaacaggagtggagcatgtggaaaaaacttggatgacactgcataccttcatcagcaccagaagcagcatattggagagaaattctacagaaagagtgtcagagaagcatcgtttgtaaagaaacgtaagctcagggtgtcacaggagccatttgtcttccgcgagtttgggaaggacgttctgcccagttcaggattgtgccaagaagaagctgctgtagagaagacagacagtgaaactatgcatggcccaccctttcaggagggaaaaactaattacagttgtggaaaacgcacaaaagccttcagcaccaaacactcagttattccacaccagaaacttttcactagagatggatgttatgtgtgcagtgattgtggaaaatcctttagcagatatgtcagcttcagtaatcatcagcgagatcacactgcaaaaggaccttatgattgtggagagtgtgggaaatcttatagtcgaaagagcagccttattcaacatcagcgagtccacactggacagacagcttatccctgtgaggagtgcgggaaatcttttagtcagaagggcagccttattagccatcagcttgttcacactggagaagggccttatgagtgtagagaatgtgggaaatcttttggtcaaaagggtaacctcattcaacatcagcaaggtcacactggagagagagcttatcactgtggggaatgtgggaaatcttttcgtcagaagttctgctttattaaccatcagcgtgttcacactggagaaaggccttacaagtgtggagaatgtgggaaatcttttggtcaaaagggcaacctcgttcaccatcagcgaggtcatactggagaaaggccctatgagtgcaaggaatgtgggaaatcatttaggtacagatcccacctcactgaacaccagagacttcacactggggaaagaccttacaattgtagggaatgtgggaaattatttaacaggaagtatcatcttctggttcatgagagagttcacactggagaaaggccatatgcgtgtgaggtatgtgggaaattatttggcaataagcacagcgtgactatacatcagaggattcacactggagaaaggccgtatgaatgcagtgaatgtgggaaatcatttctttccagctctgcgcttcatgttcataaaagagttcattctggacaaaagccttataagtgcagtgaatgtggaaaatccttttctgaatgttccagtctcattaaacacaggagaattcacactggagaaaggccttatgaatgcaccaaatgtggaaaaacatttcagcgaagctctaccctccttcatcatcagagttcacacaggagaaaggccttatgagtgcagtgaatatgggaaatcgtttgctgaagcatcccgtctcgttaaacacaggagagttcatactgga

SEQ ID NO: 203119 - DNA, 5731 bp, Homo sapiens
  Payload ID: 20053
  Gene Name: zinc finger protein 587
  ENST ID: ENST00000419854
  CDS Start-End: 232-1830
ggcaccagtggatgtggtttcaactccgtgttggggaccttgggaggaggatgggcaagggtgggtgtgtgggagaggtgggttgtggtacctcagcagaggggctgcttgtggtttcatctgtcactatcatagcagggcactgtgacctttgaagatgtggctgtgaacttttcccaggaggagtggtgtcttcttagtgaggctcagaggtgcttgtaccgtgatgtgatgctagagaacctggctctcatatcctcgctgggttgttggtgtggatcaaaagatgaggaggcaccttgtaagcagagaatttctgtacaaagagagtctcagagcaggactcctagggcaggtgtttctcctaagaaggctcacccctgtgaaatgtgtggcctcatcttggaggatgtttttcactttgctgaccaccaggaaactcatcacaagcagaagctgaacaggagtggagcatgtggaaaaaacttggatgacactgcataccttcatcagcaccagaagcagcatattggagagaaattctacagaaagagtgtcagagaagcatcgtttgtaaagaaacgtaagctcagggtgtcacaggagccatttgtcttccgcgagtttgggaaggacgttctgcccagttcaggattgtgccaagaagaagctgctgtagagaagacagacagtgaaactatgcatggcccaccctttcaggagggaaaaactaattacagttgtggaaaacgcacaaaagccttcagcaccaaacactcagttattccacaccagaaacttttcactagagatggatgttatgtgtgcagtgattgtggaaaatcctttagcagatatgtcagcttcagtaatcatcagcgagatcacactgcaaaaggaccttatgattgtggagagtgtgggaaatcttatagtcgaaagagcagccttattcaacatcagcgagtccacactggacagacagcttatccctgtgaggagtgcgggaaatcttttagtcagaagggcagccttattagccatcagcttgttcacactggagaagggccttatgagtgtagagaatgtgggaaatcttttggtcaaaagggtaacctcattcaacatcagcaaggtcacactggagagagagcttatcactgtggggaatgtgggaaatcttttcgtcagaagttctgctttattaaccatcagcgtgttcacactggagaaaggccttacaagtgtggagaatgtgggaaatcttttggtcaaaagggcaacctcgttcaccatcagcgaggtcatactggagaaaggccctatgagtgcaaggaatgtgggaaatcatttaggtacagatcccacctcactgaacaccagagacttcacactggggaaagaccttacaattgtagggaatgtgggaaattatttaacaggaagtatcatcttctggttcatgagagagttcacactggagaaaggccatatgcgtgtgaggtatgtgggaaattatttggcaataagcacagcgtgactatacatcagaggattcacactggagaaaggccgtatgaatgcagtgaatgtgggaaatcatttctttccagctctgcgcttcatgttcataaaagagttcattctggacaaaagccttataagtgcagtgaatgtggaaaatccttttctgaatgttccagtctcattaaacacaggagaattcacactggagaaaggccttatgaatgcaccaaatgtggaaaaacatttcagcgaagctctaccctccttcatcatcagagttcacacaggagaaaggccttatgagtgcagtgaatatgggaaatcgtttgctgaagcatcccgtctcgttaaacacaggagagttcatactggagaaaggccttatgagtgctgtcaatgtggaaaacatcagaatgtctgctgtcctcggtcttaagcgacttcgtgttgagatggagtcttgttctgtcacccaggctggagtgcagtggtgcagtcttggctcgctgcaacttgggcctcctgggttcatgcaatcctcctacctcagcctcctgagtagctgggattatgagtacacaccaccacgcccagctaatttttgtgtttttagtggagatggggttttaccatgttggccaggctggtctcaaactcctgacctcaagtgatccacccaccttgactcccaaagtgctgaaattacaggcatgagcctctgcacctggccttcattcttttcgtattgcttagaatatgacatgctgaaccaggcatggtggctcatgcttgtaaacctgatgctttgggaggacaaggtggttcattggaggccaggagttagagatcagcctgggcaacatagccagacctcctctctacaaaaagaaaaaagaatgacatgcttcttgtttttgtctgttataaatgaaactgctatatttgaatgcagttgttcatgtaggtatgtttcactatggtaatatggtggtgtgcagtgcctgagtcacgtgatagattaaagtacaactcttttttgagacagagtctcactctgtcacccaggcgggagttaggtggcatgatttcggctcactgcaacctctgcctcccaagttcaactgattcttctgcctcagcctcccgagtagcagggattaccggtgtgcaccaccatgcctggataacttttttttttatttctattagcaatggggtttcaccatgctggccaggcttgttatgaactgacctcaagtgatctgcctgcctcagcttctcaggtgtgacctactgtgcttggcctaatgtacaactttttaagcaatgccaaactatgacttaagaatgaaattattgctcatttgtatatctatctaccatcagtgtccaagaatttctgttctatcttaccaagagggagtatggttagtatttgaaattgtttattattttaataagtggttataacttttgagtcagtggtttatgttttgcattttttttgttttgagacaaagtctcgctctgtctcccaggctagagtaccgtggcacaatctcagctcattgcaacctctgcttcctgggctcaagcactctgcccacctcagcctccagagtagctggaaatacaggtatgcaccaccacaactggataacttttgtattttctgtagagagggttttacctttttgcccagtctgatcgcgaactcctgggctcaggcgatccacttgcctaggctccaaaagtgcttggtctacaggggtgaggcaccctgcctggcctcacctgtaggcttgttttttaaaatgaattttatctatttcccatttcattaatatatttaaaaataatgaaataacaaagacgtatgttggacttcattcattcttcagtgatgtcactttgctgcaaggaatatttggttttcttttttttttttttttccagatggagtctagctctgtctcctaagctacagtgaagtggcatgatctcggcccactgcaacctccacctcctgtgttcaagcgattctgcctcagcctcctgagtagctgggactacaggcatgtgccattatacctggctaattttatttatttattttagtagagatggggtttcaccatgttacccaggctgctctctaccttctgagctcaagtgatccacctgcctcggcctcccaaagtgctgggattacaggtgtcagccactgtacctggctgaatacttggttttcagtaccacaagaactatgagctggttatccacttcatgtggaatcataagcgtcccaaagtgacaatacatatagattgccaggcagtgaaacagttaagatgccaccatagctttcttttcaacatctttctaagattaccttactatttcttttgttccaagtttgtacttcctcacagttctcacatatggaaaggatacacactttgtagaaacaagaactttatgttatccaagttctaggatagccatgagctccaattatctcagagctctgagtcctctactcaatacccattgagatttatgtgttctgaggcttttgtcttctagctacttacttcattctccatgggtaacgtcattcatccacattaactaatttcctcactccaagctcttttctagagataatctccagtccctgtgcagaaactgtcattgcactttctgctgaaatggcagtttcttctcagcaaggtgagattatggaatccagaatcttttttcaggggtcacatgcccatttccccacttgcatgaatgtcgacactgcagccacagttttggccgtaaatgtgaatttggcaagtaaccactgttcccagggaaatgtcccaatcagaagaagattatctgggacactgatactgacagggagatgggacattctgagggacccggaggcagggtgccacctcctcaacttccctgagggctgcctagaatctgtttcctctcactctgaattattcttcctcttatggctgaccaaaaacatggaacctcacaaagtccactgtaacagctttatatttgtgaagtgaagaacatgaagacagtttcaagcaaagttattgagtggacactttgtgttttttttgagaagtctcactctttcacccaggctggagtgcagtggcacgatctcggctcactgcaactccacctcccgggttcacgccattctcttgcctcagcctcctgagtagctgggaccacaagcgcccaccacgtcagcttaatttttttgttttgtttcttgagacagagtcttgctctcttgcccaggttggagtgccgtgtcgcaatctcagctcactgcaacttctacctcctggattcaagcacttctccttgcctcagccacctctttagctgggattacaggtgcgtgccaccacacccagctaatttttgtatttttagcagagaccaggtttcaccatgttggtcaggctggtctcaaactcctgacctcgtgatccacccacctcggcctcccaaagtgctggaattacaggcgtgagccactgcacctggcctgtattcttttctttagtagagacggggttttactgtatttgccaggatggtctcgatctccagacctcgtgatccgcccgccttagcctcccaaagtgctgggattataggcgtgagccaacacgccctggccacttcttgtctttgcaacattttttagatatgtatttgtgttttttggggagcttaatttgctaatggaatctctgttattttcctaacatgcttggtggatacaagagttaagacttcctgtcccgtttagtgtaacaaaagaaagttaagaaatgtggataaaagattgtaagttagaaatggcaagataatcagctatatgaagaatcttggccaggtgtggtggctgaggcctgtaatcccaccactttgggaggctgaggtgggcggatcacaaggtcaggagttcaagaccaccctggccaatattgtgaattcctgtctctactaaaaatacaaaaattagtcgggcatggtggcgggtgcctgtagtcccagctactcgggaggctgaggccagaaaatcggttgaacctgggaggtggaaggtgcactgagccaatatcacaccagtgcactccaacctggtgacagagagacacatcatctc

SEQ ID NO: 203120 - DNA, 3339 bp, Homo sapiens
  Payload ID: 20054
  Gene Name: zinc finger protein 587B
  Uniprot ID: E7ETH6
  ENST ID: ENST00000442832
  CDS Start-End: 235-1443
ttttgattggtgttgggtttatttgtcggagaggctcctgagcgctaggtcggcactgcggtgactgaacccagaaggcggagaacagttgtcctctgctgcacagaggcgactctggagctctgtgacggcgccaagcgtgacccacccctgggccaggatagggaccgtcatgcccatatctcctggctggtcaccctctcctcccaaccctgctttaaaccacgtggttcgatggcggtggtggccacgctgaggctctctgctcagggcacagtgacttttgaagacgtggctgtgaaatttacccaggaggaatggaatctccttagtgaggctcagagatgcctgtaccgtgatgtgactctggagaacctggcacttatgtcctccctgggttgttggtgtggagtggaagatgaggcggcaccttctaagcagagtatttatatacaaagagagactcaggtcaggactcctgtgacaggtgtgtctcccaagaaggcccacccctgtgagatgtgtggcccgatcttgggagacattttgcatgtggcagatcatcagggaacacatcacaagcagaaactgcacaggtgtgaggcctgggggaataaattgtatgacagtggaaactttcatcagcaccagaatgagcacattggagagaaaccctacagagggagtgttgaggaggcgttgtttgtgaagaggtgtaagttgcatgtgtcaggggagtcatctgtcttcagtgagagtgggaaggactttttgcccaggtcaggattactccagcaggaggccagtcacactggggagaagtcaaacagcaaaactgagtgtgtgtctccctttcagtgtgggggagctcactatagccatggagattccatgaaacattttagcaccaaacatatactcagtcagcaccagagacttctccctcgagaagaatgttatgtgtgctgtgaatgtgggaaatcctttagcaaatatgttagcttcagtaatcatcagagagttcacagtggaaaaagaccttatgaatgtggagaatgtgagaaatcttttagtcaaaagagcagcctcattcaacatcagcaatttcacactggaggaaaaccttatgggtgtgaagaatgtgggaaatattttagcttagaaggatatcttaggcgccatcaaaaagttcacgctggaaaagggccttatgagtgtggagaatgtgggaaatcttttagttcaaacgtgaaccttaagagtcatcagcgcattcacactggagagagaccttacaagtgtggagaatgtgagaaatcttttagtcggaagcccagccttagttaccatcagcgctttgggaggccgaggtgggtggatcacaaggacaggaaggagttcaagaccagcctgggcaatatagtgaaatcctgtctcttctaaaaatataaaaattagccgggcatggtggcgcacctgtagccgcagctactcaggaggctgaggcaggaaaattgcttgaaccccgggaggtagaggttgcagtgagctgagatcatgccactgcactccagcctgggtcctgctaccttgaaggacagcatagctaaactgcgtggcccaagggacagcatgaatgcagaatatagctttcttcacttgtggcctatttgcatagctgcccaaggcctccagtggacgacttcatggctttgtggtcttcatctgtagcatggatactacagattgtgggttcataggtcagctgggtacagggcagtttttataacaacctctggtgggttttttattttagtgtcaatatcacactgaaagattggtgattttttttgaaccagacaaaattctctcttatgaggtatattgcactgtgctcggtactgttgagggaactctgttcagcagatcttacaaggcacacatgtgccatgatatccagaattctgtaaggcaacatcacaggttgtaaggctataggatgaaattataattttatggttacttagttactgcatttatagtcagcagaggggacagcaataaagtttttgaaatatatcttttttttttttttgagacacagtctcactctgtcacccaggctagagtgctgttgcaccatctcggctcactgcaacctgtgccttctgggttcaagcgattctcccacctcagtcacccaagtagctagaattacaggtgcatgccaccacaccactaatgttttgtggttttagtagagacgggtttcaccgtgttgcacagactggtcttgaattcaactcttgagctcaggtgatctgctcacctccgccttccaaagtgctgggactacaggtgtgggccgctgtgtttggctgaaatgtatgtcttttaaaggagtgtccacagttatccagtcactgtgtctgtgatggataagcagatacagaaattctcaagacttccataataatgaatgttgtgtagctaagctttggtcagaggaaataatctaaaggttttgtgaattcatgtaaccttttgggctgctcaccttaaggtaactcctgtattaacaggaggaacagaatagggaaaaagatctcagttcagtgatgtagctttgtgaccagccagtgatccagttcaatcaggtagaaatgaccttcctgctacatcaatatttgcttctatggaggctagtttccccacttagggcatgagaagaattggtaaagtcaacataaaattgccaaacctgtcaccaaaaatgatggcaaatctgtatttttctcttaaaccgtgttataaaagctgtaataaggtataggctgagcatcatggctcatgcctgtattcccagcactttgggaggccagattccttgagaccagtgtggggaacatggcaaaaccttgtctctaggaaaaatagccaggtatggtggcatgtaccttagtcttagtgatgtgggaggattgcttgagcctgggaggcagaagttgcagtgagctaagattgcaacgctgcagtccagcctgggtgatagagtgagaccccatcttaaaaataaaataaagatataaatgacatccaataaagtacacatatttgagctgtaggataagtcttgaattttattataatcccgtgaaaccatcatcagagtcaccataatgaatttatctaatctatcacctttgtatttacttggagcctttataaagtttttctctctgctcttcaaacaaccattgatttactttgctgtatgatggagtactttccattttctggaattttctgactgatgtaataaagtgtttcctcttataa

SEQ ID NO: 203121 - DNA, 2118 bp, Homo sapiens
  Payload ID: 20054
  Gene Name: zinc finger protein 587B
  ENST ID: ENST00000594901
  CDS Start-End: 217-2118
ttatttgtcggagaggctcctgagcgctaggtcggcactgcggtgactgaacccagaaggcggagaacagttgtcctctgctgcacagaggcgactctggagctctgtgacggcgccaagcgtgacccacccctgggccaggatagggaccgtcatgcccatatctcctggctggtcaccctctcctcccaaccctgctttaaaccacgtggttcgatggcggtggtggccacgctgaggctctctgctcagggcacagtgacttttgaagacgtggctgtgaaatttacccaggaggaatggaatctccttagtgaggctcagagatgcctgtaccgtgatgtgactctggagaacctggcacttatgtcctccctgggttgttggtgtggagtggaagatgaggcggcaccttctaagcagagtatttatatacaaagagagactcaggtcaggactcctgtgacaggtgtgtctcccaagaaggcccacccctgtgagatgtgtggcccgatcttgggagacattttgcatgtggcagatcatcagggaacacatcacaagcagaaactgcacaggtgtgaggcctgggggaataaattgtatgacagtggaaactttcatcagcaccagaatgagcacattggagagaaaccctacagagggagtgttgaggaggcgttgtttgtgaagaggtgtaagttgcatgtgtcaggggagtcatctgtcttcagtgagagtgggaaggactttttgcccaggtcaggattactccagcaggaggccagtcacactggggagaagtcaaacagcaaaactgagtgtgtgtctccctttcagtgtgggggagctcactatagccatggagattccatgaaacattttagcaccaaacatatactcagtcagcaccagagacttctccctcgagaagaatgttatgtgtgctgtgaatgtgggaaatcctttagcaaatatgttagcttcagtaatcatcagagagttcacagtggaaaaagaccttatgaatgtggagaatgtgagaaatcttttagtcaaaagagcagcctcattcaacatcagcaatttcacactggaggaaaaccttatgggtgtgaagaatgtgggaaatattttagcttagaaggatatcttaggcgccatcaaaaagttcacgctggaaaagggccttatgagtgtggagaatgtgggaaatcttttagttcaaacgtgaaccttaagagtcatcagcgcattcacactggagagagaccttacaagtgtggagaatgtgagaaatcttttagtcggaagcccagccttagttaccatcagcgcattcacactgaagtaagaccttacaagtgtggagaatgtgggaaatcttatatttcaaaggggcaccttaggatccatcagcgcatgcacactggagaaagaccttacaagtgtggagactgtgggaaatcttttaatgaaaaaggacaccttaggagtcatcagcgagttcacactacagaaagaccttataagtgtggggaatgtgggaaatgttttagtcacaagggtaacctcattctacaccagcatggccatactagaaaaaggccttatatgtgttgggaatgtggaaaattatttaagaagaagtctcacctccttgtacaccagagaattcacagtggagagaagccatatgcttgtgaggcttgtcagaaattttttaggcacaagtgccacctcactgcacaccagagagttcacactggagaaaggccatatgaatgcagtgattgtgggaagtcatttacccacagctgtgcattcattgttcataagagagttcacactggtcagaagccttatgagtgcagtgaatgtgggaaatcttttgctgcaagctcctatctcactagtcacaggagagttcacactggtcagaagccttatgagtgcagtgaatgtgggaaatcttttgctggaatctccagtctcactaatcacaggagagttcacactggagaaaagccttatgggtgtagtgaatgtgaaaaaaaatttaggaaaagctcttcacttcgttaccatcagagagttcatgaaagaaaggccttatga

SEQ ID NO: 203122 - DNA, 1670 bp, Homo sapiens
  Payload ID: 20054
  Gene Name: zinc finger protein 587B
  ENST ID: ENST00000594328
  CDS Start-End: 376-1670
cgttgatctgcgatacgcgtgtttgcccagtgagtggccccggactgctacgtgggactgcggtgaatgaacccagaaggtggagaggaaccgttctcggtgcacagaggcggctctgcagcccggtgagggcgcctgctgctcccgggcagtgctttccccaagtagtccgatggctgcggctgcgccgaggcgccctactcaggagcaacttggcgaggttcagactcttggagccagaagctacatgacccctaaacgggcacagtgacttttgaagacgtggctgtgaaatttacccaggaggaatggaatctccttagtgaggctcagagatgcctgtaccgtgatgtgactctggagaacctggcacttatgtcctccctgggttgttggtgtggagtggaagatgaggcggcaccttctaagcagagtatttatatacaaagagagactcaggtcaggactcctgtgacaggtgtgtctcccaagaaggcccacccctgtgagatgtgtggcccgatcttgggagacattttgcatgtggcagatcatcagggaacacatcacaagcagaaactgcacaggtgtgaggcctgggggaataaattgtatgacagtggaaactttcatcagcaccagaatgagcacattggagagaaaccctacagagggagtgttgaggaggcgttgtttgtgaagaggtgtaagttgcatgtgtcaggggagtcatctgtcttcagtgagagtgggaaggactttttgcccaggtcaggattactccagcaggaggccagtcacactggggagaagtcaaacagcaaaactgagtgtgtgtctccctttcagtgtgggggagctcactatagccatggagattccatgaaacattttagcaccaaacatatactcagtcagcaccagagacttctccctcgagaagaatgttatgtgtgctgtgaatgtgggaaatcctttagcaaatatgttagcttcagtaatcatcagagagttcacagtggaaaaagaccttatgaatgtggagaatgtgagaaatcttttagtcaaaagagcagcctcattcaacatcagcaatttcacactggaggaaaaccttatgggtgtgaagaatgtgggaaatattttagcttagaaggatatcttaggcgccatcaaaaagttcacgctggaaaagggccttatgagtgtggagaatgtgggaaatcttttagttcaaacgtgaaccttaagagtcatcagcgcattcacactggagagagaccttacaagtgtggagaatgtgagaaatcttttagtcggaagcccagccttagttaccatcagcgcattcacactgaagtaagaccttacaagtgtggagaatgtgggaaatcttatatttcaaaggggcaccttaggatccatcagcgcatgcacactggagaaagaccttacaagtgtggagactgtgggaaatcttttaatgaaaaaggacaccttaggagtcatcagcgagttcacactacagaaagaccttataagtgtggggaatgtgggaaatgttttagtcacaagggtaacctcattctacaccagcatggccatactagaaaaaggccttatatgtgttgggaatgtggaaaattatttaagaagaagtctcacctcct

SEQ ID NO: 203123 - DNA, 3368 bp, Homo sapiens
  Payload ID: 20055
  Gene Name: zinc finger protein 589
  Uniprot ID: Q86UQ0
  ENST ID: ENST00000354698
  CDS Start-End: 73-1167
cggtgcgcattctaatccgtttcacacacggtgctgctacctcgtttgcttcgtgcgtgcgtgcgcgcgcagatgtgggccccgcgggagcagctactgggctggactgcggaagctctgcctgccaaggattctgcctggccctgggaagagaagcctagatatctgggaccagtgactttcgaggatgtggctgtgcttttcactgaggcagagtggaagagactgagccttgagcagaggaacctatacaaagaagtgatgctggaaaatctcaggaatctggtctcattggcagaatcaaagccagaagtccatacctgcccttcttgccctctggcctttggcagtcagcagttcctcagccaagatgagctacacaatcatcctattccaggtttccatgcaggaaatcaactccacccaggaaatccctgcccagaggatcagccacagtcacaacatccttctgataaaaatcacaggggggctgaagcagaagatcaacgagtggaaggaggcgtcagacccttgttttggagtacaaatgaaaggggggctttagtgggtttctctagcctgttccagagaccaccaataagctcttggggaggcaacagaatattagagatacagctcagtccagcccagaatgcaagctctgaggaagtagacagaatttccaagagggcagaaaccccagggtttggagcagtcacgtttggggagtgtgcactagcttttaaccagaagtcaaacctgttcagacagaaggcagtcacagcagaaaaatcttcagacaaaaggcagtcacaggtgtgcagggagtgtgggcgaggctttagcaggaagtcacagctcatcatacaccagaggacacacacaggagaaaagccttatgtctgcggagagtgtgggcgaggctttatagttgagtcagtcctccgcaaccacctgagtacacactccggggagaaaccttatgtgtgcagccattgtgggcgaggctttagctgcaagccatacctcatcagacatcagaggacacacacaagggagaaatcgtttatgtgcacagtgtgtgggcgaggctttcgtgaaaagtcagagctcattaagcaccagagaattcacacgggggataagccttatgtgtgcagagattgaggccgaggctttgtaaggagatcatgtctcaacacacaccagaggatacattcagatgagaagccttttgtttgcagagagtgtgggcgaggctttcgtgctaaatcaactctcctcctacaccagtggacacattcagaggtgaaacctcacgtgtgtgaggagtgtgggcatggatttagccagaagtcgtcgctcaaatcacatcggagaacacactcaggggagaagccttatgtgtgtggggaatgtgggcggggatttagccggaggatagtcctcaatggacactggaggacacacacgggagagaagccttacacgtgctttgagtgtgggcgaaactttagcctcaagtccgctcttagtgtacatcagaggatacactctggggagaagccttatgcatgcacggagtgtgggcaaggctttatcacgaaatcacagctcatcagacaccagaggacacacacaggagaaaagccttatgtctgcggagagtgtgggcgaggctttatagctcagtcaaccctccactaccaccggagtacacactccaaggaaaaaccttatgtgtgcagccagtgtgggcgaggcttttgtgataaatcaactctcctcgcacacgagcagacacattcaggggagaagccttatgtgtgtggggaatgtgggcggggatttggccggaagatactcctcaacagacactggaggacacacacaggagagaaaccttacgcatgcatcgagtgtgggcgaaactttagccacaagtccactctcagcttacatcagaggatacactcgggggagaagccttatgcatgcgtggagtgtgggcaaagctttaggagaaagtcacagctcatcatacaccagaagatacactcggggaaaagctttagaggtgcaaggagtgaggatgtgattttagcaacaagtcagccatcagccacaccagcggaaatgcttagggagaagccttgtttgtaaggtaatgtggacagagctgtacgtggacatcattacttgtcacgtgtcagaggacacactcgggagaaaccttcatggagtgagagtaaggtgttggctggaagtggccccttaagagatacttggagtcaaatctatccactgtacgcccaccccactcttgttctaagagctttggggacagtcttttgaccccttacattcctttagatgtgaagatgacagagatctaacttctgagagcagaggtgtcaagtgacggtccccttggaggaatggtctttgcatctgactacttccttctgcaactgtgttcttccattagcttccatgacactctcctgctttatttttttctacatctctagcctttgctgtttcctctcctaccccacctttagattttactcagagttcagtctccagccctacaatctgagggacacctttaccaggtccccttcctaaccctccagtcccaaatccaagattctttaaccacactctaaaagttcttcagactcaggacttaaacatagccacgccaccttggccttcaatgacagggatctagcaatgctgcatcatcagccttccaataccaggtttaagggtattttaaacacagctcctcttaaatcctccaatctcagtacccagtgttttagccatgctcgggtggctaaattacatccaggaatggtgccagggcctttagccatttgtctctcctcacactccagggcccatatggcccaggttctgacagtttgccttactcccttgggctggggctagccctacctgataccctgtgtcaatgagtgtaccttggagagctatccactcaggccccagtgcctctatttgctaagggactctgccacagaaaagaaggggagagatgttcatgtaacctcaaaatacttaggcttggttttgatgctagagaggaaaaaggacttggagagagagaaggaatggctggtccagaggcttttgtccactccctctcactggaagtggttgatctccagggaatccccaaggttagcctgcttaggggaagggctaggggtacctggaatgtaggatctcccccatgcctggcctaccaccctaatgtgtctggaattggtgggttcttggtcttgctgacttcaagaatgaagccgtggaccctcacggtgagtgttacaattctt

SEQ ID NO: 203124 - DNA, 1677 bp, Homo sapiens
  Payload ID: 20055
  Gene Name: zinc finger protein 589
  ENST ID: ENST00000427617
  CDS Start-End: 73-363
cggtgcgcattctaatccgtttcacacacggtgctgctacctcgtttgcttcgtgcgtgcgtgcgcgcgcagatgtgggccccgcgggagcagctactgggctggactgcggaagctctgcctgccaaggattctgcctggccctgggaagagaagcctagatatctgggaccagtgactttcgaggatgtggctgtgcttttcactgaggcagagtggaagagactgagccttgagcagaggaacctatacaaagaagtgatgctggaaaatctcaggaatctggtctcattggttctggaactgggaagtccaagatcagggctcctgcccctggacctgaacctggatctttggctttgatgttggaccttgtgtgtggatatgaactttgaacctgcaccttggaactaaacctctgacttggatttgttctgcattttggaactcaccttagacctgaaccttggtcatgaaatggatctgaatcattcttgggtcttggacatgggacttggacctccatgtgtatcttggacttaggaccatgatctggaccttgtaaattgacttggactttggacttggaccttggactagaatttgtccctggctgtggacctcgtctttggatctggatctggacctggtcttggatgttggacctagatgcaggccttgatttgatttggaacatggacttggtccttgcacatggcccaacacccgcgtctttggaactgcatcttggaccttggatctgaaatttaaacagggaggtgaccttcatttcttgtatttgactttataactggaaattcaatctctacctggatcttggacctggatctcagaccttgctttttattgggccatggatcttataccttaaacatggaaattgtacctggatttggacctttgacttggacctggatctggacccagggataagatttggacctcacttgcaaattttggtaatgaaattttcctttgctcctgtagtccttggacctaggcttcagtcatggatttagaccttagacgtgaccatcagaccttagagttgaacctaaattcctggtccccagtcctataactcagaatgattatgcataaccttggacttagaacttagatctggatcttagagctgatacttgacctggtactggatatttaaccttggacttcagacatggatttaatctgggccttgggatgatttaagatctagaagtggacctagaattagaccttggacttatgtgcctgagcctggactttggaagtggactttgggccttgtaactcaaccttgaatatgagcctcaaatgtagactgtgggccaggcacagtggctcacatctgtaatcccagcactttgggtggaaagctgaggcaggtggatcacttgagctcaggaattcaagaccagcctggggaacatggtgaaaacctggctctacaaaaaataaaaaaattagccaggcttggtggcacacacctgtagttccaggtactcaggaggctgaggcaggaggttcacttgggcccaggaggcagaggttgcagtgagctgagcttgtacagctgcactccagcctggaggacagagtgagactctgtctcaagaaaaaaaaataaaaaataaataaataaataagagaaaa

SEQ ID NO: 203125 - DNA, 3658 bp, Homo sapiens
  Payload ID: 20055
  Gene Name: zinc finger protein 589
  ENST ID: ENST00000457782
  CDS Start-End: 18-287
cgtgcgtgcgcgcgcagatgtgggccccgcgggagcagctactgggctggactgcggaagctctgcctgccaaggattctgcctggccctgggaagagaagcctagatatctggttccagtggcagatggggcactggccagaggggttaggaggatttggactctccttgggagtcgctgtgatacggccttcaattatagttgtctttccttcttggatttccaccacttccctgaaaccacgagctggaagctgagaccagctggtcactgctgggcctgctaggagcccacacggaagctgcccacagccagacaccagagcctcaaaggccgccatcttgaaaaaccaaccctgacctccacaatgattgattttcaaatgttgaaccagctttgcagaactataataaacccaagtgtgataccctgtctcaagtattgtggtgatcaaataggaccagtgactttcgaggatgtggctgtgcttttcactgaggcagagtggaagagactgagccttgagcagaggaacctatacaaagaagtgatgctggaaaatctcaggaatctggtctcattggaatcaaagccagaagtccatacctgcccttcttgccctctggcctttggcagtcagcagttcctcagccaagatgagctacacaatcatcctattccaggtttccatgcaggaaatcaactccacccaggaaatccctgcccagaggatcagccacagtcacaacatccttctgataaaaatcacaggggggctgaagcagaagatcaacgagtggaaggaggcgtcagacccttgttttggagtacaaatgaaaggggggctttagtgggtttctctagcctgttccagagaccaccaataagctcttggggaggcaacagaatattagagatacagctcagtccagcccagaatgcaagctctgaggaagtagacagaatttccaagagggcagaaaccccagggtttggagcagtcacgtttggggagtgtgcactagcttttaaccagaagtcaaacctgttcagacagaaggcagtcacagcagaaaaatcttcagacaaaaggcagtcacaggtgtgcagggagtgtgggcgaggctttagcaggaagtcacagctcatcatacaccagaggacacacacaggagaaaagccttatgtctgcggagagtgtgggcgaggctttatagttgagtcagtcctccgcaaccacctgagtacacactccggggagaaaccttatgtgtgcagccattgtgggcgaggctttagctgcaagccatacctcatcagacatcagaggacacacacaagggagaaatcgtttatgtgcacagtgtgtgggcgaggctttcgtgaaaagtcagagctcattaagcaccagagaattcacacgggggataagccttatgtgtgcagagattgaggccgaggctttgtaaggagatcatgtctcaacacacaccagaggatacattcagatgagaagccttttgtttgcagagagtgtgggcgaggctttcgtgctaaatcaactctcctcctacaccagtggacacattcagaggtgaaacctcacgtgtgtgaggagtgtgggcatggatttagccagaagtcgtcgctcaaatcacatcggagaacacactcaggggagaagccttatgtgtgtggggaatgtgggcggggatttagccggaggatagtcctcaatggacactggaggacacacacgggagagaagccttacacgtgctttgagtgtgggcgaaactttagcctcaagtccgctcttagtgtacatcagaggatacactctggggagaagccttatgcatgcacggagtgtgggcaaggctttatcacgaaatcacagctcatcagacaccagaggacacacacaggagaaaagccttatgtctgcggagagtgtgggcgaggctttatagctcagtcaaccctccactaccaccggagtacacactccaaggaaaaaccttatgtgtgcagccagtgtgggcgaggcttttgtgataaatcaactctcctcgcacacgagcagacacattcaggggagaagccttatgtgtgtggggaatgtgggcggggatttggccggaagatactcctcaacagacactggaggacacacacaggagagaaaccttacgcatgcatcgagtgtgggcgaaactttagccacaagtccactctcagcttacatcagaggatacactcgggggagaagccttatgcatgcgtggagtgtgggcaaagctttaggagaaagtcacagctcatcatacaccagaagatacactcggggaaaagctttagaggtgcaaggagtgaggatgtgattttagcaacaagtcagccatcagccacaccagcggaaatgcttagggagaagccttgtttgtaaggtaatgtggacagagctgtacgtggacatcattacttgtcacgtgtcagaggacacactcgggagaaaccttcatggagtgagagtaaggtgttggctggaagtggccccttaagagatacttggagtcaaatctatccactgtacgcccaccccactcttgttctaagagctttggggacagtcttttgaccccttacattcctttagatgtgaagatgacagagatctaacttctgagagcagaggtgtcaagtgacggtccccttggaggaatggtctttgcatctgactacttccttctgcaactgtgttcttccattagcttccatgacactctcctgctttatttttttctacatctctagcctttgctgtttcctctcctaccccacctttagattttactcagagttcagtctccagccctacaatctgagggacacctttaccaggtccccttcctaaccctccagtcccaaatccaagattctttaaccacactctaaaagttcttcagactcaggacttaaacatagccacgccaccttggccttcaatgacagggatctagcaatgctgcatcatcagccttccaataccaggtttaagggtattttaaacacagctcctcttaaatcctccaatctcagtacccagtgttttagccatgctcgggtggctaaattacatccaggaatggtgccagggcctttagccatttgtctctcctcacactccagggcccatatggcccaggttctgacagtttgccttactcccttgggctggggctagccctacctgataccctgtgtcaatgagtgtaccttggagagctatccactcaggccccagtgcctctatttgctaagggactctgccacagaaaagaaggggagagatgttcatgtaacctcaaaatacttaggcttggttttgatgctagagaggaaaaaggacttggagagagagaaggaatggctggtccagaggcttttgtccactccctctcactggaagtggttgatctccagggaatccccaaggttagcctgcttaggggaagggctaggggtacctggaatgtaggatctcccccatgcctggcctaccaccctaatgtgtctggaattggtgggttcttggtcttgctgacttcaagaatgaagccgtggaccctcacggtgagtgttacaattcttaaa

SEQ ID NO: 203126 - DNA, 593 bp, Homo sapiens
  Payload ID: 20055
  Gene Name: zinc finger protein 589
  ENST ID: ENST00000412564
  CDS Start-End: 72-314
ggtgcgcattctaatccgtttcacacacggtgctgctacctcgtttgcttcgtgcgtgcgtgcgcgcgcagatgtgggccccgcgggagcagctactgggctggactgcggaagctctgcctgccaaggattctgcctggccctgggaagagaagcctagatatctgggaccagtgactttcgaggatgtggctgtgcttttcactgaggcagagtggaagagactgagccttgagcagaggaacctatacaaagaagtgatgctggaaaatctcaggaatctggtctcattggtgctctcctatcaaatctagaattggaagattgatggacagcaactgaggtgctaccaggataccaaaaagtctgctggataaacaccatctctattctaatattatggagagatcaggatctcctgtgcccaaatcaaacctgttaatacactcagctgtcctcagtggtaacactgaggtcaacacacaactccaacatcaggaacaagtcataaccattttgcatctgaaacagtgcctgacacaaaggtgcttgatcaattttatttactaaataaacctatatagtcttatttc

SEQ ID NO: 203127 - DNA, 4703 bp, Homo sapiens
  Payload ID: 20055
  Gene Name: zinc finger protein 589
  Uniprot ID: Q86UQ0
  ENST ID: ENST00000448461
  CDS Start-End: 44-1138
ggtgctgctacctcgtttgcttcgtgcgtgcgtgcgcgcgcagatgtgggccccgcgggagcagctactgggctggactgcggaagctctgcctgccaaggattctgcctggccctgggaagagaagcctagatatctgggaccagtgactttcgaggatgtggctgtgcttttcactgaggcagagtggaagagactgagccttgagcagaggaacctatacaaagaagtgatgctggaaaatctcaggaatctggtctcattggcagaatcaaagccagaagtccatacctgcccttcttgccctctggcctttggcagtcagcagttcctcagccaagatgagctacacaatcatcctattccaggtttccatgcaggaaatcaactccacccaggaaatccctgcccagaggatcagccacagtcacaacatccttctgataaaaatcacaggggggctgaagcagaagatcaacgagtggaaggaggcgtcagacccttgttttggagtacaaatgaaaggggggctttagtgggtttctctagcctgttccagagaccaccaataagctcttggggaggcaacagaatattagagatacagctcagtccagcccagaatgcaagctctgaggaagtagacagaatttccaagagggcagaaaccccagggtttggagcagtcacgtttggggagtgtgcactagcttttaaccagaagtcaaacctgttcagacagaaggcagtcacagcagaaaaatcttcagacaaaaggcagtcacaggtgtgcagggagtgtgggcgaggctttagcaggaagtcacagctcatcatacaccagaggacacacacaggagaaaagccttatgtctgcggagagtgtgggcgaggctttatagttgagtcagtcctccgcaaccacctgagtacacactccggggagaaaccttatgtgtgcagccattgtgggcgaggctttagctgcaagccatacctcatcagacatcagaggacacacacaagggagaaatcgtttatgtgcacagtgtgtgggcgaggctttcgtgaaaagtcagagctcattaagcaccagagaattcacacgggggataagccttatgtgtgcagagattgaggccgaggctttgtaaggagatcatgtctcaacacacaccagaggatacattcagatgagaagccttttgtttgcagagagtgtgggcgaggctttcgtgctaaatcaactctcctcctacaccagtggacacattcagaggtgaaacctcacgtgtgtgaggagtgtgggcatggatttagccagaagtcgtcgctcaaatcacatcggagaacacactcaggggagaagccttatgtgtgtggggaatgtgggcggggatttagccggaggatagtcctcaatggacactggaggacacacacgggagagaagccttacacgtgctttgagtgtgggcgaaactttagcctcaagtccgctcttagtgtacatcagaggatacactctggggagaagccttatgcatgcacggagtgtgggcaaggctttatcacgaaatcacagctcatcagacaccagaggacacacacaggagaaaagccttatgtctgcggagagtgtgggcgaggctttatagctcagtcaaccctccactaccaccggagtacacactccaaggaaaaaccttatgtgtgcagccagtgtgggcgaggcttttgtgataaatcaactctcctcgcacacgagcagacacattcaggggagaagccttatgtgtgtggggaatgtgggcggggatttggccggaagatactcctcaacagacactggaggacacacacaggagagaaaccttacgcatgcatcgagtgtgggcgaaactttagccacaagtccactctcagcttacatcagaggatacactcgggggagaagccttatgcatgcgtggagtgtgggcaaagctttaggagaaagtcacagctcatcatacaccagaagatacactcggggaaaagctttagaggtgcaaggagtgaggatgtgattttagcaacaagtcagccatcagccacaccagcggaaatgcttagggagaagccttgtttgtaaggtaatgtggacagagctgtacgtggacatcattacttgtcacgtgtcagaggacacactcgggagaaaccttcatggagtgagagtaaggtgttggctggaagtggccccttaagagatacttggagtcaaatctatccactgtacgcccaccccactcttgttctaagagctttggggacagtcttttgaccccttacattcctttagatgtgaagatgacagagatctaacttctgagagcagaggtgtcaagtgacggtccccttggaggaatggtctttgcatctgactacttccttctgcaactgtgttcttccattagcttccatgacactctcctgctttatttttttctacatctctagcctttgctgtttcctctcctaccccacctttagattttactcagagttcagtctccagccctacaatctgagggacacctttaccaggtccccttcctaaccctccagtcccaaatccaagattctttaaccacactctaaaagttcttcagactcaggacttaaacatagccacgccaccttggccttcaatgacagggatctagcaatgctgcatcatcagccttccaataccaggtttaagggtattttaaacacagctcctcttaaatcctccaatctcagtacccagtgttttagccatgctcgggtggctaaattacatccaggaatggtgccagggcctttagccatttgtctctcctcacactccagggcccatatggcccaggttctgacagtttgccttactcccttgggctggggctagccctacctgataccctgtgtcaatgagtgtaccttggagagctatccactcaggccccagtgcctctatttgctaagggactctgccacagaaaagaaggggagagatgttcatgtaacctcaaaatacttaggcttggttttgatgctagagaggaaaaaggacttggagagagagaaggaatggctggtccagaggcttttgtccactccctctcactggaagtggttgatctccagggaatccccaaggttagcctgcttaggggaagggctaggggtacctggaatgtaggatctcccccatgcctggcctaccaccctaatgtgtctggaattggtgggttcttggtcttgctgacttcaagaatgaagccgtggaccctcacgttctggaactgggaagtccaagatcagggctcctgcccctggacctgaacctggatctttggctttgatgttggaccttgtgtgtggatatgaactttgaacctgcaccttggaactaaacctctgacttggatttgttctgcattttggaactcaccttagacctgaaccttggtcatgaaatggatctgaatcattcttgggtcttggacatgggacttggacctccatgtgtatcttggacttaggaccatgatctggaccttgtaaattgacttggactttggacttggaccttggactagaatttgtccctggctgtggacctcgtctttggatctggatctggacctggtcttggatgttggacctagatgcaggccttgatttgatttggaacatggacttggtccttgcacatggcccaacacccgcgtctttggaactgcatcttggaccttggatctgaaatttaaacagggaggtgaccttcatttcttgtatttgactttataactggaaattcaatctctacctggatcttggacctggatctcagaccttgctttttattgggccatggatcttataccttaaacatggaaattgtacctggatttggacctttgacttggacctggatctggacccagggataagatttggacctcacttgcaaattttggtaatgaaattttcctttgctcctgtagtccttggacctaggcttcagtcatggatttagaccttagacgtgaccatcagaccttagagttgaacctaaattcctggtccccagtcctataactcagaatgattatgcataaccttggacttagaacttagatctggatcttagagctgatacttgacctggtactggatatttaaccttggacttcagacatggatttaatctgggccttgggatgatttaagatctagaagtggacctagaattagaccttggacttatgtgcctgagcctggactttggaagtggactttgggccttgtaactcaaccttgaatatgagcctcaaatgtagactgtgggccaggcacagtggctcacatctgtaatcccagcactttgggtggaaagctgaggcaggtggatcacttgagctcaggaattcaagaccagcctggggaacatggtgaaaacctggctctacaaaaaataaaaaaattagccaggcttggtggcacacacctgtagttccaggtactcaggaggctgaggcaggaggttcacttgggcccaggaggcagaggttgcagtgagctgagcttgtacagctgcactccagcctggaggacagagtgagactctgtctcaagaaaaaaaaataaaaaataaataaataaataagagaaaa

SEQ ID NO: 203128 - DNA, 917 bp, Homo sapiens
  Payload ID: 20055
  Gene Name: zinc finger protein 589
  ENST ID: ENST00000440261
  CDS Start-End: 67-600
gcattctaatccgtttcacacacggtgctgctacctcgtttgcttcgtgcgtgcgtgcgcgcgcagatgtgggccccgcgggagcagctactgggctggactgcggaagctctgcctgccaaggattctgcctggccctgggaagagaagcctagatatctgggaccagtgactttcgaggatgtggctgtgcttttcactgaggcagagtggaagagactgagccttgagcagaggaacctatacaaagaagtgatgctggaaaatctcaggaatctggtctcattggaatcaaagccagaagtccatacctgcccttcttgccctctggcctttggcagtcagcagttcctcagccaagatgagctacacaatcatcctattccaggtttccatgcaggaaatcaactccacccaggaaatccctgcccagaggatcagccacagtcacaacatccttctgataaaaatcacaggggggctgaagcagaagatcaacgagtggaaggaggcgtcagacccttgttttggattctggaactgggaagtccaagatcagggctcctgcccctggacctgaacctggatctttggctttgatgttggaccttgtgtgtggatatgaactttgaacctgcaccttggaactaaacctctgacttggatttgttctgcattttggaactcaccttagacctgaaccttggtcatgaaatggatctgaatcattcttgggtcttggacatgggacttggacctccatgtgtatcttggacttaggaccatgatctggaccttgtaaattgacttggactttggacttggaccttggactagaatttgtccctggctgtggacctcgtctttggatctggatctggacctggtcttggatgttggacctagatgcaggcctt

SEQ ID NO: 203129 - DNA, 7863 bp, Homo sapiens
  Payload ID: 20056
  Gene Name: zinc finger protein 592
  Uniprot ID: Q92610
  ENST ID: ENST00000299927
  CDS Start-End: 23-3826
cagcccttgccagcatccagccatgggggatatgaaaaccccagattttgatgaccttctggctgcctttgacatcccagaccccaccagccttgatgccaaggaggccatccagacacccagtgaggagaatgagagtcccctcaaacctccaggcatatgtatggatgaaagtgtgtccttgtctcactcaggatcagcccccgatgtgccggccgtgagtgtcattgtcaagaacaccagccgccaggagtcatttgaagcggagaaagaccacattactcccagtctcctacacaatggattccggggctcagatctgcctccagatccccacaactgtgggaaatttgattctacttttatgaatggagacagtgccaggagtttccctggcaaactggagcctcccaagtcagagccattacccaccttcaaccagttcagtccaatctccagcccagaacctgaggatcccatcaaagataacggatttgggataaagcccaaacactctgacagttatttcccaccccctcttgggtgcggggctgtgggaggcccagtcctggaggctctggctaagtttccggttccagagctgcatatgtttgatcatttttgtaagaaagaacccaagccagaacccctgcccttggggagccagcaggaacacgagcaaagtgggcagaacacagtggaacctcacaaggatccggatgccactcgattcttcggggaagctttggagttcaacagccatcctagcaacagtattggagagtccaaggggcttgcccgggagcttggtacctgctcatcagtcccccctaggcagcgtctaaagccagctcattccaagctgtcctcttgtgtggcagccttggtggccttgcaggccaaaagagtggctagtgtcactaaggaggatcagcctggccacacaaaggatctctcagggcccactaaagagagttctaaaggtagccccaaaatgcccaagtcaccaaagagtccccggagccctctggaggccactagaaaaagtatcaagccatcggacagccctcgtagcatctgcagtgacagcagcagcaaaggctcaccgtctgtggctgccagctccccaccagcaattcccaaagtgagaatcaaaaccattaagacatcatcaggggaaatcaaacggactgtcacaaggatcctgccagatcctgatgatccaagtaagtcccctgttgggtcacctctagggagcgccattgcagaggcccccagcgagatgccaggggatgaggtgcctgtggaagagcactttcctgaggcaggcacaaattcagggagcccccagggggccaggaaaggggacgagagcatgacaaaggccagtgactcgtcatctcccagctgcagttctgggccccgggtcccaaagggggctgccccaggctcacagacaggcaagaagcaacagagcacagcactgcaggcatccaccctggcccctgccaacctcctgcccaaagccgtgcacttggccaacctgaacctcgtcccccacagtgttgctgcatcagtgacagccaagtcttcagtgcaaagacggagccagccacagcttacacaaatgtcggtgcccctggtccaccaggtgaaaaaggctgccccactgattgtagaggtcttcaacaaggtccttcacagctccaaccccgtgcccctctatgcgccaaatctcagcccgcctgcggacagcaggatccacgtgccggccagtgggtactgctgcctggagtgtggagacgcatttgccttagagaagagcctgagccagcactatggccggcggagcgtccacattgaggtactgtgcacactgtgctccaagacgctgctcttcttcaacaagtgcagcctgctccggcacgcccgtgaccacaagagcaaggggctcgtcatgcagtgttcccagctgctggtgaagcctatctctgcggaccaaatgttcgtgtcggcccctgtgaactccacggcaccagcagccccagccccttcatcctctcccaaacatggcctcacttcgggcagtgccagtccccctcctccagccttgccactctacccagaccctgtgaggctcatccggtactcaatcaagtgtcttgaatgtcacaagcagatgcgggactacatggtcctggctgcacatttccagaggacaacagaggagacagaggggctgacctgccaggtatgccaaatgctgctgcccaaccagtgcagtttctgtgcccaccagcggattcatgcacacaagtccccctactgctgcccggagtgtggggtcctctgccgctctgcctacttccagacccatgtaaaggagaattgcctgcactatgcccgcaaggtgggctacaggtgcatccactgtggtgtcgtccacctgaccttggccttgctgaaaagccacatccaggagcgacactgccaggttttccacaaatgtgcattctgccccatggccttcaagactgccagcagcactgcagaccacagtgccacccagcaccccacccagccccacagaccctcccagctcatttataagtgctcctgtgaaatggtcttcaacaagaagaggcacattcagcagcatttttaccagaatgtcagcaagacgcaggtgggcgtcttcaagtgccctgagtgcccactcttgttcgtgcagaagccggagttgatgcaacacgtcaagagcacccacggtgttccccgaaatgtggacgagctgtcaagcctccagtcttcagcggacacatcctcaagccgccctggctctcgagttcccactgagccaccagccactagtgtggctgctcggagcagctccctgccttctggccgctggggtaggcctgaagcccaccgcagggtggaagccaggccgcggctgaggaacactggctggacctgccaggagtgccaggagtgggttccagatcgggagagctacgtgtcccacatgaaaaagagccacggtcggacattgaagcggtacccatgccggcagtgtgaacagtccttccacacccccaacagcctgcgcaaacacatccgcaacaaccatgacacagtaaagaagttctacacctgcgggtactgcacagaggacagccccagctttcctcggccctcccttctggagagccacatcagccttatgcatggcatcagaaaccctgatttgagccagacgtccaaagtgaaacctccgggtggacattcccctcaggtgaaccatctgaaaagaccagtcagtggagtgggggacgctccaggcaccagcaatggcgcaactgtctcttccaccaaaaggcacaagtccctttttcagtgcgcgaaatgtagttttgccacagactcggggctcgagtttcagagccacatacctcagcaccaggtggacagctccacagcccaatgtctcctctgtggtttgtgctacacctctgccagctccctcagccgccacctcttcattgtccacaaggtgagagaccaggaggaggaggaggaagaggaggcggcggcagcggagatggcagtggaggtggcagagccagaggagggctccggggaggaggtgcccatggagactagagagaatggactggaagaatgtgccggtgagcctttgtcagctgacccagaggcgaggagattgctgggcccggcccctgaggacgatggtggccacaatgatcacagtcaaccacaggcctctcaggaccaggacagccacacactgtcccctcaggtgtgaccggagactttgcagtgtgcatggtcaggggtggtgccgaagtgtcttccacctgccctgcggaccgtggaaaataaaaggctctgcccccagtgtgagtgtgaccggttgtaccctggagtagtgtctgccctgagctgccagtgctgggtatcccccagccccaggaaatgtggggtcggccaggaccctcacagctctgaatttgcttctgttatttatggcttttcgctgcttcttggtgccccatctcttgtctgtgtccttccaaccccaagctgcttatgtggcccaaccccactgctgtcaactaggcttgaaccccacagcggctgtgctcttctgggaggttcccgcttgctgccttcagccagggcgctcctcagagctctattttcctgcagacaccagctctccttcctgcctttagatcctgagaaggagggaaatgaggggtgctgacacagtccctctgggagagctctgcctagtctggtttggcgagggcccttgatcaccttgcccctcctccctgtcttctctgattcttttccctcaaaatagtcctgagaactaattgtcacactggctcatcatgtctctgtgggtggggtgggagaaacctctgctgcacacctctgtttggaacctgggcagagcaggaggtaaggcaaaggcaggcaggcaccaagaaccagaccccttgagaaggcgctgtgggtgggtctttgttctgctgttctgcctttcctgacaggtggggttggggcacacagacattggaatatttgtactgctctcgtgccatttgagaggctgctgccccaggcaggccagcccctactcctcttggctacactcatgttgctcagactatatttcaaataaaaaatcttctcaccatgcaggtaggctcttgtattcctctccaagtgagcctggccccaccctattccacccaagggtctttcccagacttcccctgtttgtcccatctctgagggagaacaatacttcctactgtctaaggaaggccttctctagattctggagcttgtggttaggaaaccgggagccctgtactacttagttctctagagaccttctgaaggggtgaggggagcggctccacaatggtcaagtcacctccaagatctccaggctagtgacattggctttagggcgtatcgaaattttctaggcaccttcatctttccttcagttgattttcaacataagagaaccccttactggtaaaaagggaaaagggggtggagaagaggaattttataattttcttatagcattcaagaggtttcttatttcttacagcatcgctactgccacagagaactcaaatgtggcagaactgggattagacttgggagactggctgtcttttcactgatggtggagtcagggcccacccaagcacgaggagcaggctgtgtggaggtgtcgtctgacctctaacccaggtggcatggggttgcgcccagcaggatgtagtggagtaaagggaagagggtgctggccgggtgcttagaggtcatctttcaaggaggcattaaatatcaattataaattattaagtcagataaatatgcctgaccttttcacagttgaaaaaatacattttttcccctctatcaaatgccaagtttttagtggaaatgctaatggcagtgggaaaggttgcctcactttcagagagactctcgctgtctgcacccttttaataattgctcttcctggcaaggctgccacttccctgcctccccagctggcagtggggcaacccaggcctgtttccagctacctgcaaagccagacctagacctgccgtagctgttgtcccatgcctaattctagttacaggaagccatccctgtaccctgggtccattcacaggaatgggttccagaggaggctgatagaagggtttgaaatgactggctggatcccttcctgctcagacacagtggtagctggagagcaggcagagatggtagaattgcaggtttgaccacctgtcgtgaccccagatatacatctccttcctgggaagaacgtgagttggaaaaatgctgagccagtccctggaaaacctgggtcctggcctggattctgtccttagccagctcttaacaaatcccttaacctcactgtctcctctccttcacaatagagttagtaattcccatccaactggcttcacaggcttttgtgagcttatgaatgtgaaagtattttctagtttataaaacactatatgaatgtggggaaatctttacttgaccttagggcatggagggtggagcacattttgtctgctgtttggacttggatgctgattagcagttatgaagtggcccagacacctagccattctttagtaagagtgaagatagcattttaagccctccttgtgtgcctagcatcttactgaacactttctggtgattctctcctttaatcctcacaaagatctcacagttgtcctccattttacggagaagaaaccgaggctccgagaggttaaacgatgtgcagaggctacctgtagtgatggtgctgagtcaagcctgtcaaccactgtgctcgttagtgaccaaggctgctttgacaggctgccagcttgtcagtggtttgcagccccccagacatttgctttcctacttcccatgcagttggggtgccctgccaagtgccaggttctctttggagtccatctgtgccttgtcaccccaaggagggcctcgagcatcacaccgttgacatttcgaaacgtggtatctctacaacctttcattctcattgggatttaccttgccatttgaacaccatcattttttgaggactgtctagaaaaggttgcctaaccctcacagggaacacacagttccctcagagtccagcatcttctggtcttttctttttcaagatttttttaaatggttgtgctatcatttgtcatcatcagaaaatgcttgctgtaacaagcgtttatctgcacattatgctgcagtgaatgctctactgatcaagttaaacagataagatcccttcccttgtagaaactacaacttaatacagtctaagacttgacaaattacttagtatttattttccaactgctttatctctgtaaaatgatatgctgaattattataagctaattgttgtagaaagaactttccccttaacttatgtaaacagtctggttttaaaaaatttgataattgtggcccagtaagctcaacactttgccttccccaagactggggaacctctgtcctgttcaccactgtatattcagcaccaggcagtttctttttttgtttgtttgtttttttgttttgaaaaattaatacatatacatggtaagacattccacaatacaaaagggtatacaataaatggtaagcttccccatggaggtcagcctctagtcccctctccagagttaatcactgttatctatatgttgtgtatcctttcatagcaattctatgcatttacaagtttataaatatgtatatttatatatctatttttaatacaaatagtagaattctatacacagtgttctgaagcttgctttcttatatagtattttggagattattccaaattcatacattgggtcagagtaattctttaaaagttccttgcatataacagtgattcaaaaagtatatggatgaatgagtgaatgctgcatgaatgaatgaatctgattcaattggtagctacagctgttctctcagggtctgatctgaccaagacagcaccttctagattctagaatgtgtcctcctgactaaggggttcaggatactgttcaccttctccaacagatgccaccggagccttaggaactgggcacaggaagccttgggcccctggaggaaaaagttgagactaggacgcaggtcccaagtatgggatttttttgggttcctacttaaaatgcttttttctttattggaaaatgatgtaacattttagagaaattaaaaagcacacatatttat

SEQ ID NO: 203130 - DNA, 8131 bp, Homo sapiens
  Payload ID: 20056
  Gene Name: zinc finger protein 592
  Uniprot ID: Q92610
  ENST ID: ENST00000560079
  CDS Start-End: 289-4092
ctggcctgcagtcgccgccgccgccgccaggtggtgtttggactctagaccatgtgcctaggtagaagtttttcctttctccgcagctctgctcccctagcaacgctcgccacacccttgttttgagatcctctctaaggagcggagagtttaataggcaagaaggaagggagaagacagaaggaagacgctcccccgtacggagacagagggagggggggctccaaagccgaaagaggaggtccctacctgccacggataccagtcagcccttgccagcatccagccatgggggatatgaaaaccccagattttgatgaccttctggctgcctttgacatcccagaccccaccagccttgatgccaaggaggccatccagacacccagtgaggagaatgagagtcccctcaaacctccaggcatatgtatggatgaaagtgtgtccttgtctcactcaggatcagcccccgatgtgccggccgtgagtgtcattgtcaagaacaccagccgccaggagtcatttgaagcggagaaagaccacattactcccagtctcctacacaatggattccggggctcagatctgcctccagatccccacaactgtgggaaatttgattctacttttatgaatggagacagtgccaggagtttccctggcaaactggagcctcccaagtcagagccattacccaccttcaaccagttcagtccaatctccagcccagaacctgaggatcccatcaaagataacggatttgggataaagcccaaacactctgacagttatttcccaccccctcttgggtgcggggctgtgggaggcccagtcctggaggctctggctaagtttccggttccagagctgcatatgtttgatcatttttgtaagaaagaacccaagccagaacccctgcccttggggagccagcaggaacacgagcaaagtgggcagaacacagtggaacctcacaaggatccggatgccactcgattcttcggggaagctttggagttcaacagccatcctagcaacagtattggagagtccaaggggcttgcccgggagcttggtacctgctcatcagtcccccctaggcagcgtctaaagccagctcattccaagctgtcctcttgtgtggcagccttggtggccttgcaggccaaaagagtggctagtgtcactaaggaggatcagcctggccacacaaaggatctctcagggcccactaaagagagttctaaaggtagccccaaaatgcccaagtcaccaaagagtccccggagccctctggaggccactagaaaaagtatcaagccatcggacagccctcgtagcatctgcagtgacagcagcagcaaaggctcaccgtctgtggctgccagctccccaccagcaattcccaaagtgagaatcaaaaccattaagacatcatcaggggaaatcaaacggactgtcacaaggatcctgccagatcctgatgatccaagtaagtcccctgttgggtcacctctagggagcgccattgcagaggcccccagcgagatgccaggggatgaggtgcctgtggaagagcactttcctgaggcaggcacaaattcagggagcccccagggggccaggaaaggggacgagagcatgacaaaggccagtgactcgtcatctcccagctgcagttctgggccccgggtcccaaagggggctgccccaggctcacagacaggcaagaagcaacagagcacagcactgcaggcatccaccctggcccctgccaacctcctgcccaaagccgtgcacttggccaacctgaacctcgtcccccacagtgttgctgcatcagtgacagccaagtcttcagtgcaaagacggagccagccacagcttacacaaatgtcggtgcccctggtccaccaggtgaaaaaggctgccccactgattgtagaggtcttcaacaaggtccttcacagctccaaccccgtgcccctctatgcgccaaatctcagcccgcctgcggacagcaggatccacgtgccggccagtgggtactgctgcctggagtgtggagacgcatttgccttagagaagagcctgagccagcactatggccggcggagcgtccacattgaggtactgtgcacactgtgctccaagacgctgctcttcttcaacaagtgcagcctgctccggcacgcccgtgaccacaagagcaaggggctcgtcatgcagtgttcccagctgctggtgaagcctatctctgcggaccaaatgttcgtgtcggcccctgtgaactccacggcaccagcagccccagccccttcatcctctcccaaacatggcctcacttcgggcagtgccagtccccctcctccagccttgccactctacccagaccctgtgaggctcatccggtactcaatcaagtgtcttgaatgtcacaagcagatgcgggactacatggtcctggctgcacatttccagaggacaacagaggagacagaggggctgacctgccaggtatgccaaatgctgctgcccaaccagtgcagtttctgtgcccaccagcggattcatgcacacaagtccccctactgctgcccggagtgtggggtcctctgccgctctgcctacttccagacccatgtaaaggagaattgcctgcactatgcccgcaaggtgggctacaggtgcatccactgtggtgtcgtccacctgaccttggccttgctgaaaagccacatccaggagcgacactgccaggttttccacaaatgtgcattctgccccatggccttcaagactgccagcagcactgcagaccacagtgccacccagcaccccacccagccccacagaccctcccagctcatttataagtgctcctgtgaaatggtcttcaacaagaagaggcacattcagcagcatttttaccagaatgtcagcaagacgcaggtgggcgtcttcaagtgccctgagtgcccactcttgttcgtgcagaagccggagttgatgcaacacgtcaagagcacccacggtgttccccgaaatgtggacgagctgtcaagcctccagtcttcagcggacacatcctcaagccgccctggctctcgagttcccactgagccaccagccactagtgtggctgctcggagcagctccctgccttctggccgctggggtaggcctgaagcccaccgcagggtggaagccaggccgcggctgaggaacactggctggacctgccaggagtgccaggagtgggttccagatcgggagagctacgtgtcccacatgaaaaagagccacggtcggacattgaagcggtacccatgccggcagtgtgaacagtccttccacacccccaacagcctgcgcaaacacatccgcaacaaccatgacacagtaaagaagttctacacctgcgggtactgcacagaggacagccccagctttcctcggccctcccttctggagagccacatcagccttatgcatggcatcagaaaccctgatttgagccagacgtccaaagtgaaacctccgggtggacattcccctcaggtgaaccatctgaaaagaccagtcagtggagtgggggacgctccaggcaccagcaatggcgcaactgtctcttccaccaaaaggcacaagtccctttttcagtgcgcgaaatgtagttttgccacagactcggggctcgagtttcagagccacatacctcagcaccaggtggacagctccacagcccaatgtctcctctgtggtttgtgctacacctctgccagctccctcagccgccacctcttcattgtccacaaggtgagagaccaggaggaggaggaggaagaggaggcggcggcagcggagatggcagtggaggtggcagagccagaggagggctccggggaggaggtgcccatggagactagagagaatggactggaagaatgtgccggtgagcctttgtcagctgacccagaggcgaggagattgctgggcccggcccctgaggacgatggtggccacaatgatcacagtcaaccacaggcctctcaggaccaggacagccacacactgtcccctcaggtgtgaccggagactttgcagtgtgcatggtcaggggtggtgccgaagtgtcttccacctgccctgcggaccgtggaaaataaaaggctctgcccccagtgtgagtgtgaccggttgtaccctggagtagtgtctgccctgagctgccagtgctgggtatcccccagccccaggaaatgtggggtcggccaggaccctcacagctctgaatttgcttctgttatttatggcttttcgctgcttcttggtgccccatctcttgtctgtgtccttccaaccccaagctgcttatgtggcccaaccccactgctgtcaactaggcttgaaccccacagcggctgtgctcttctgggaggttcccgcttgctgccttcagccagggcgctcctcagagctctattttcctgcagacaccagctctccttcctgcctttagatcctgagaaggagggaaatgaggggtgctgacacagtccctctgggagagctctgcctagtctggtttggcgagggcccttgatcaccttgcccctcctccctgtcttctctgattcttttccctcaaaatagtcctgagaactaattgtcacactggctcatcatgtctctgtgggtggggtgggagaaacctctgctgcacacctctgtttggaacctgggcagagcaggaggtaaggcaaaggcaggcaggcaccaagaaccagaccccttgagaaggcgctgtgggtgggtctttgttctgctgttctgcctttcctgacaggtggggttggggcacacagacattggaatatttgtactgctctcgtgccatttgagaggctgctgccccaggcaggccagcccctactcctcttggctacactcatgttgctcagactatatttcaaataaaaaatcttctcaccatgcaggtaggctcttgtattcctctccaagtgagcctggccccaccctattccacccaagggtctttcccagacttcccctgtttgtcccatctctgagggagaacaatacttcctactgtctaaggaaggccttctctagattctggagcttgtggttaggaaaccgggagccctgtactacttagttctctagagaccttctgaaggggtgaggggagcggctccacaatggtcaagtcacctccaagatctccaggctagtgacattggctttagggcgtatcgaaattttctaggcaccttcatctttccttcagttgattttcaacataagagaaccccttactggtaaaaagggaaaagggggtggagaagaggaattttataattttcttatagcattcaagaggtttcttatttcttacagcatcgctactgccacagagaactcaaatgtggcagaactgggattagacttgggagactggctgtcttttcactgatggtggagtcagggcccacccaagcacgaggagcaggctgtgtggaggtgtcgtctgacctctaacccaggtggcatggggttgcgcccagcaggatgtagtggagtaaagggaagagggtgctggccgggtgcttagaggtcatctttcaaggaggcattaaatatcaattataaattattaagtcagataaatatgcctgaccttttcacagttgaaaaaatacattttttcccctctatcaaatgccaagtttttagtggaaatgctaatggcagtgggaaaggttgcctcactttcagagagactctcgctgtctgcacccttttaataattgctcttcctggcaaggctgccacttccctgcctccccagctggcagtggggcaacccaggcctgtttccagctacctgcaaagccagacctagacctgccgtagctgttgtcccatgcctaattctagttacaggaagccatccctgtaccctgggtccattcacaggaatgggttccagaggaggctgatagaagggtttgaaatgactggctggatcccttcctgctcagacacagtggtagctggagagcaggcagagatggtagaattgcaggtttgaccacctgtcgtgaccccagatatacatctccttcctgggaagaacgtgagttggaaaaatgctgagccagtccctggaaaacctgggtcctggcctggattctgtccttagccagctcttaacaaatcccttaacctcactgtctcctctccttcacaatagagttagtaattcccatccaactggcttcacaggcttttgtgagcttatgaatgtgaaagtattttctagtttataaaacactatatgaatgtggggaaatctttacttgaccttagggcatggagggtggagcacattttgtctgctgtttggacttggatgctgattagcagttatgaagtggcccagacacctagccattctttagtaagagtgaagatagcattttaagccctccttgtgtgcctagcatcttactgaacactttctggtgattctctcctttaatcctcacaaagatctcacagttgtcctccattttacggagaagaaaccgaggctccgagaggttaaacgatgtgcagaggctacctgtagtgatggtgctgagtcaagcctgtcaaccactgtgctcgttagtgaccaaggctgctttgacaggctgccagcttgtcagtggtttgcagccccccagacatttgctttcctacttcccatgcagttggggtgccctgccaagtgccaggttctctttggagtccatctgtgccttgtcaccccaaggagggcctcgagcatcacaccgttgacatttcgaaacgtggtatctctacaacctttcattctcattgggatttaccttgccatttgaacaccatcattttttgaggactgtctagaaaaggttgcctaaccctcacagggaacacacagttccctcagagtccagcatcttctggtcttttctttttcaagatttttttaaatggttgtgctatcatttgtcatcatcagaaaatgcttgctgtaacaagcgtttatctgcacattatgctgcagtgaatgctctactgatcaagttaaacagataagatcccttcccttgtagaaactacaacttaatacagtctaagacttgacaaattacttagtatttattttccaactgctttatctctgtaaaatgatatgctgaattattataagctaattgttgtagaaagaactttccccttaacttatgtaaacagtctggttttaaaaaatttgataattgtggcccagtaagctcaacactttgccttccccaagactggggaacctctgtcctgttcaccactgtatattcagcaccaggcagtttctttttttgtttgtttgtttttttgttttgaaaaattaatacatatacatggtaagacattccacaatacaaaagggtatacaataaatggtaagcttccccatggaggtcagcctctagtcccctctccagagttaatcactgttatctatatgttgtgtatcctttcatagcaattctatgcatttacaagtttataaatatgtatatttatatatctatttttaatacaaatagtagaattctatacacagtgttctgaagcttgctttcttatatagtattttggagattattccaaattcatacattgggtcagagtaattctttaaaagttccttgcatataacagtgattcaaaaagtatatggatgaatgagtgaatgctgcatgaatgaatgaatctgattcaattggtagctacagctgttctctcagggtctgatctgaccaagacagcaccttctagattctagaatgtgtcctcctgactaaggggttcaggatactgttcaccttctccaacagatgccaccggagccttaggaactgggcacaggaagccttgggcccctggaggaaaaagttgagactaggacgcaggtcccaagtatgggatttttttgggttcctacttaaaatgcttttttctttattggaaaatgatgtaacattttagagaaattaaaaagcacacatatttataa

SEQ ID NO: 203131 - DNA, 3910 bp, Homo sapiens
  Payload ID: 20056
  Gene Name: zinc finger protein 592
  ENST ID: ENST00000559607
  CDS Start-End: 73-2649
gggggctccaaagccgaaagaggaggtccctacctgccacggataccagtcagcccttgccagcatccagccatgggggatatgaaaaccccagattttgatgaccttctggctgcctttgacatcccagaccccaccagccttgatgccaaggaggccatccagacacccagtgaggagaatgagagtcccctcaaacctccaggcatatgtatggatgaaagtgtgtccttgtctcactcaggatcagcccccgatgtgccggccgtgagtgtcattgtcaagaacaccagccgccaggagtcatttgaagcggagaaagaccacattactcccagtctcctacacaatggattccggggctcagatctgcctccagatccccacaactgtgggaaatttgattctacttttatgaatggagacagtgccaggagtttccctggcaaactggagcctcccaagtcagagccattacccaccttcaaccagttcagtccaatctccagcccagaacctgaggatcccatcaaagataacggatttgggataaagcccaaacactctgacagttatttcccaccccctcttgggtgcggggctgtgggaggcccagtcctggaggctctggctaagtttccggttccagagctgcatatgtttgatcatttttgtaagaaagaacccaagccagaacccctgcccttggggagccagcaggaacacgagcaaagtgggcagaacacagtggaacctcacaaggatccggatgccactcgattcttcggggaagctttggagttcaacagccatcctagcaacagtattggagagtccaaggggcttgcccgggagcttggtacctgctcatcagtcccccctaggcagcgtctaaagccagctcattccaagctgtcctcttgtgtggcagccttggtggccttgcaggccaaaagagtggctagtgtcactaaggaggatcagcctggccacacaaaggatctctcagggcccactaaagagagttctaaaggtagccccaaaatgcccaagtcaccaaagagtccccggagccctctggaggccactagaaaaagtatcaagccatcggacagccctcgtagcatctgcagtgacagcagcagcaaaggctcaccgtctgtggctgccagctccccaccagcaattcccaaagtgagaatcaaaaccattaagacatcatcaggggaaatcaaacggactgtcacaaggatcctgccagatcctgatgatccaagtaagtcccctgttgggtcacctctagggagcgccattgcagaggcccccagcgagatgccaggggatgaggtgcctgtggaagagcactttcctgaggcaggcacaaattcagggagcccccagggggccaggaaaggggacgagagcatgacaaaggccagtgactcgtcatctcccagctgcagttctgggccccgggtcccaaagggggctgccccaggctcacagacaggcaagaagcaacagagcacagcactgcaggcatccaccctggcccctgccaacctcctgcccaaagccgtgcacttggccaacctgaacctcgtcccccacagtgttgctgcatcagtgacagccaagtcttcagtgcaaagacggagccagccacagcttacacaaatgtcggtgcccctggtccaccaggtgaaaaaggctgccccactgattgtagaggtcttcaacaaggtccttcacagctccaaccccgtgcccctctatgcgccaaatctcagcccgcctgcggacagcaggatccacgtgccggccagtgggtactgctgcctggagtgtggagacgcatttgccttagagaagagcctgagccagcactatggccggcggagcgtccacattgaggtactgtgcacactgtgctccaagacgctgctcttcttcaacaagtgcagcctgctccggcacgcccgtgaccacaagagcaaggggctcgtcatgcagtgttcccagctgctggtgaagcctatctctgcggaccaaatgttcgtgtcggcccctgtgaactccacggcaccagcagccccagccccttcatcctctcccaaacatggcctcacttcgggcagtgccagtccccctcctccagccttgccactctacccagaccctgtgaggctcatccggtactcaatcaagtgtcttgaatgtcacaagcagatgcgggactacatggtcctggctgcacatttccagaggacaacagaggagacagaggggctgacctgccaggtatgccaaatgctgctgcccaaccagtgcagtttctgtgcccaccagcggattcatgcacacaagtccccctactgctgcccggagtgtggggtcctctgccgctctgcctacttccagacccatgtaaaggagaattgcctgcactatgcccgcaaggtgcatccactgtggtgtcgtccacctgaccttggccttgctgaaaagccacatccaggagcgacactgccaggttttccacaaatgtgcattctgccccatggccttcaagactgccagcagcactgcagaccacagtgccacccagcaccccacccagccccacagaccctcccagctcatttataagtgctcctgtgaaatggtcttcaacaagaagaggcacattcagcagcatttttaccagaatgtcagcaagacgcaggtgggcgtcttcaagtgccctgagtgcccactcttgttcgtgcagaagccggagttgatgcaacacgtcaagagcacccacggtgttccccgaaatgtggacgagctgtcaagcctccagtcttcagcggacacatcctcaagccgccctggctctcgagttcccactgagccaccagccactagtgtggctgctcggagcagctccctgccttctggccgctggggtaggcctgaagcccaccgcagggtggaagccaggccgcggctgaggaacactggctggacctgccaggagtgccaggagtgggttccagatcgggagagctacgtgtcccacatgaaaaagagccacggtcggacattgaagcggtacccatgccggcagtgtgaacagtccttccacacccccaacagcctgcgcaaacacatccgcaacaaccatgacacagtaaagaagttctacacctgcgggtactgcacagaggacagccccagctttcctcggccctcccttctggagagccacatcagccttatgcatggcatcagaaaccctgatttgagccagacgtccaaagtgaaacctccgggtggacattcccctcaggtgaaccatctgaaaagaccagtcagtggagtgggggacgctccaggcaccagcaatggcgcaactgtctcttccaccaaaaggcacaagtccctttttcagtgcgcgaaatgtagttttgccacagactcggggctcgagtttcagagccacatacctcagcaccaggtggacagctccacagcccaatgtctcctctgtggtttgtgctacacctctgccagctccctcagccgccacctcttcattgtccacaaggtgagagaccaggaggaggaggaggaagaggaggcggcggcagcggagatggcagtggaggtggcagagccagaggagggctccggggaggaggtgcccatggagactagagagaatggactggaagaatgtgccggtgagcctttgtcagctgacccagaggcgaggagattgctgggcccggcccctgaggacgatggtggccacaatgatcacagtcaaccacaggcctctcaggaccaggacagccacacactgtcccctcaggtgtgaccggagactttgcagtgtgcatggtcaggggtggtgccgaagtgt

SEQ ID NO: 203132 - DNA, 1885 bp, Homo sapiens
  Payload ID: 20057
  Gene Name: zinc finger protein 593
  ENST ID: ENST00000270812
  CDS Start-End: 43-513
gccctgctcctggccccttggccggccgggctgtttctggccatgggtcgctcccgccggacaggcgcgcaccgagcgcactctctagcccggcagatgaaggcgaagcggcggcggccggacttggatgagattcaccgcgagctgcggcctcagggatccgcacgaccccagcccgacccaaacgccgagttcgaccccgacctgccagggggcggtctgcaccgctgtctggcctgcgcgaggtacttcatcgattccaccaacctgaagacccacttccgatccaaagaccacaagaaaaggtatgaaggagtaaggagaggattgatggatgggtgctcagcagatagggctctcacctggtcagctcccaactcctgtttttctttctcccaggctgaagcagctgagcgtcgagccctacagtcaggaagaggcggagagggcagcgggtatgggatcctatgtgccccccaggcggctggcagtgcccacggaagtgtccactgaggtccctgagatggatacctctacctgacatggcctgaagatgcagggcagaggaattgcccatggacagtgacgcaaggactaggctgggagggagcgtgccaaccccttttgcctctgggtttggggagcggagggcctcttcttggtgccctgccccaaataaaggaactggacaaagagaacttgcctccaactctaacttccaggccgctgtctcaaactcctgccctggaagggcttctctactactttctgtacaccaggcctagggtgtctactccccacttggtctatctctgccttccctctgaggtcctagcatctgaactggagcacccagatggaggcctgatgcagtgtggggtggcgggagtgggatcagattactctgtcctgcttctgacagagactgatccccagaaaagaaggcttctgagattgcacccccctcccgagtcacctacccccagcatccaagtgagagtctctcttcttcgttacggggcccgtggcacccgccgctgccccaccatcttccagacggcatagcaggagccacccaggccgaggacagctagcactgtagccacaactcctgccagcagactccggggctctgccttcagctcaccagctacctgcatctggaggtgcacagagggtgtgcctcaggggtcagttgagactgccaggaaggtggggagtgggaaagggctgagtagatgtagctaggggaaggagacatggacgccggtcctgccccagggagattccaccccaatccctttcgcctcactgcccatctgggcctgcctgctcaggcggcagggaacgtgacagcctggctgttgggggtgtcaacccagctatggtagggggaggaaggggtcagtcgtgccagaaaccgttgatcaggggtacttacctgtaacacccggaagtaaccaggggtcaagcgtcgaaatcgcatggtgggcggcactggtctccctggcggcctgtagggtgggagcggacgtgaagaccagtggtcttcatgacaccaagaagtggaaactagggtagaggggtctctgaccttccacatacgcaagacccaagctctcagaggatgctcacccgcgcctgcctgcccaggtctggcagggggcggagcaactggacctttaaatctggtcccttcccccactgcctaccatcctgccagccttagaagcagctgtcaaaagagatcagcatcaggcttgagcggcacctcccccactctccgaggaggcgggtccggttaggcaggagaggccttggctggcagtgctcaggagtcccaggcctggaccaggtactgggcgggcctccctcagccctggtc

SEQ ID NO: 203133 - DNA, 1862 bp, Homo sapiens
  Payload ID: 20057
  Gene Name: zinc finger protein 593
  Uniprot ID: O00488
  ENST ID: ENST00000374266
  CDS Start-End: 114-518
gagcctgcctagccccccggcgtggcctgacgtagctgatcggcccggaagtgctcacacgtgtgctccctgccctgctcctggccccttggccggccgggctgtttctggccatgggtcgctcccgccggacaggcgcgcaccgagcgcactctctagcccggcagatgaaggcgaagcggcggcggccggacttggatgagattcaccgcgagctgcggcctcagggatccgcacgaccccagcccgacccaaacgccgagttcgaccccgacctgccagggggcggtctgcaccgctgtctggcctgcgcgaggtacttcatcgattccaccaacctgaagacccacttccgatccaaagaccacaagaaaaggctgaagcagctgagcgtcgagccctacagtcaggaagaggcggagagggcagcgggtatgggatcctatgtgccccccaggcggctggcagtgcccacggaagtgtccactgaggtccctgagatggatacctctacctgacatggcctgaagatgcagggcagaggaattgcccatggacagtgacgcaaggactaggctgggagggagcgtgccaaccccttttgcctctgggtttggggagcggagggcctcttcttggtgccctgccccaaataaaggaactggacaaagagaacttgcctccaactctaacttccaggccgctgtctcaaactcctgccctggaagggcttctctactactttctgtacaccaggcctagggtgtctactccccacttggtctatctctgccttccctctgaggtcctagcatctgaactggagcacccagatggaggcctgatgcagtgtggggtggcgggagtgggatcagattactctgtcctgcttctgacagagactgatccccagaaaagaaggcttctgagattgcacccccctcccgagtcacctacccccagcatccaagtgagagtctctcttcttcgttacggggcccgtggcacccgccgctgccccaccatcttccagacggcatagcaggagccacccaggccgaggacagctagcactgtagccacaactcctgccagcagactccggggctctgccttcagctcaccagctacctgcatctggaggtgcacagagggtgtgcctcaggggtcagttgagactgccaggaaggtggggagtgggaaagggctgagtagatgtagctaggggaaggagacatggacgccggtcctgccccagggagattccaccccaatccctttcgcctcactgcccatctgggcctgcctgctcaggcggcagggaacgtgacagcctggctgttgggggtgtcaacccagctatggtagggggaggaaggggtcagtcgtgccagaaaccgttgatcaggggtacttacctgtaacacccggaagtaaccaggggtcaagcgtcgaaatcgcatggtgggcggcactggtctccctggcggcctgtagggtgggagcggacgtgaagaccagtggtcttcatgacaccaagaagtggaaactagggtagaggggtctctgaccttccacatacgcaagacccaagctctcagaggatgctcacccgcgcctgcctgcccaggtctggcagggggcggagcaactggacctttaaatctggtcccttcccccactgcctaccatcctgccagccttagaagcagctgtcaaaagagatcagcatcaggcttgagcggcacctcccccactctccgaggaggcgggtccggttaggcaggagaggccttggctggcagtgctcaggagtcccaggcctggaccaggtactgggcgggcctccctcagccctggtc

SEQ ID NO: 203134 - DNA, 4862 bp, Homo sapiens
  Payload ID: 20058
  Gene Name: zinc finger protein 594
  Uniprot ID: Q96JF6
  ENST ID: ENST00000399604
  CDS Start-End: 142-2565
ctcagctttggcagggaaaggtcttctgagttctttgttcctccctcttagactgcccagtataatgaagagatgatatttgtattttaggaattatagaatgatctacttatcatttcagattctgaagacaggaataagatgaaggaatggaaatcaaagatggaaatttctgaagaaaagaagtcagcaagggctgcatccgaaaaactccaaagacaaatcacccaggaatgtgagttagttgaaaccagtaattctgaggacagattattgaagcactgggtaagccctttaaaggatgcaatgagacatctcccttcccaagagagcggtatcagggaaatgcatattatcccccagaaagccattgtgggagagattggccatggatgtaatgaaggagaaaaaatactttctgcaggagaaagctcccatagatatgaggttagtggccaaaacttcaaacagaagtcaggattaactgaacatcagaaaattcataatataaataagacctatgaatgtaaggaatgtgaaaaaaccttcaacaggagttcaaacctgatcatacatcagagaattcatacaggaaataagccatatgtgtgtaatgaatgtgggaaagactctaatcaaagttcaaatcttattatacatcagagaattcatacaggaaagaaaccttatatatgtcatgaatgtggaaaagacttcaatcagagctccaatctggtgagacataagcaaattcacagtggtgggaatccctatgagtgcaaagagtgtgggaaggcttttaagggaagctcaaaccttgtcctgcaccagagaatccacagtagggggaagccatatttatgcaataaatgtgggaaggctttcagtcaaagcacagatcttattatacatcacagaattcacactggagagaaaccctatgaatgttatgactgtggacagatgttcagtcaaagttcacaccttgtcccacatcagagaattcacactggagagaaacccctcaaatgtaatgaatgtgaaaaagccttcaggcagcattctcaccttactgaacaccagagactccacagtggagagaaaccctatgaatgtcacagatgtgggaagaccttcagtgggcgcacagcttttcttaaacatcagagattgcatgctggagagaaaattgaagaatgtgagaaaaccttcagcaaggatgaggagcttagggaagagcagagaattcaccaggaagagaaagcttattggtgtaatcagtgtggtaggaatttccagggcacctcagacctcatcagacatcaggtaactcatacaggagagaaaccatatgaatgtaaagaatgtgggaaaactttcaatcagagctcagaccttctgagacatcatagaattcacagtggagaaaaaccttgtgtatgtagcaaatgtgggaaatcttttaggggcagctcagatcttattagacaccatcgtgttcatactggagagaaaccctatgaatgtagtgaatgtgggaaagcctttagccagaggtcacaccttgttacacaccagaaaatccatactggagagaagccctatcagtgcactgaatgtgggaaagccttcaggcggcgttcactccttattcaacatcggagaattcatagtggtgagaaaccctatgaatgtaaggaatgtgggaagctcttcatttggcgcacagctttcctcaaacatcagagcctgcatactggagagaaacttgaatgtgagaaaaccttcagccaggatgaggagcttaggggagagcagaaaattcaccaggaagcgaaagcttattggtgtaatcagtgtggtagggctttccagggcagctcagacctcatcagacatcaggtaactcatacaagagagaaaccatatgaatgcaaagaatgtgggaaaactttcaatcagagctcagaccttctgagacatcatagaattcacagtggagaaaaaccttatgtatgcaacaaatgtgggaaatcttttaggggtagctcagatcttattaaacaccatcgtattcatactggagagaaaccctatgaatgtagtgaatgtgggaaagccttcagccagaggtcacaccttgctacacaccagaaaatccatactggagagaaaccctatcagtgcagtgaatgtgggaatgccttcaggcggcgttccctccttattcaacatcggagacttcatagtggtgagaaaccctatgaatgtaaggaatgtgggaaactcttcatgtggcacacggctttcctcaaacatcagagactgcatgctggagagaaacttgaagaatgtgagaaaaccttcagcaaggatgaggagcttagaaaagagcagagaactcaccaggaaaagaaagtttattggtgtaatcagtgtagtaggaccttccagggcagctcagatctcatcagacatcaggtaactcatacaagagagaaaccatatgaatgtaaagaatgtgggaaaactcaatcagagctcagaccttctgagacatcatagaattcacagtggagaaaaaccttacgtatgcaataaatgtggggaatcttttaggagcagctcagatcttattaaacaccatcgtgttcatactggagagaaacctcatgaatgtagtgaatgtgggaaagtctttagccagaggtcccaccttgtcacacaccagaaaatccacactggagagaagccctatcagtgcactgaatgtgaaaaagccttcaggcggcgttcactccttattcaacgtcggagaattcatagtggtgagaaaccctatgaatgtaaggaatgtgggaaactcttcatgtggcacacagctttcctcaaacatcagagactgcatgctggagagaaacttgaagaacgtgagaaaaccttcagcaaggatgaggagcttaggggagagcagaaaattcaccaagaagagaaagcttattggtgtaatcagtgtggtagggctttccagggcagctcagacctcatcggacatcaggtaactcatacaggagagaaaccatatgaatgtaaagaatgtgggaaaactttcaatcagagctcagaccttctgagacatcatagaattcacagtggagaaaaaccttatgtatgcaacaaatgtgggaaatcttttaggggcagctcagatcttattagacaccatcgtgttcatactggagagaaaccctatgaatgccctgaatgttggaaggccttcagtcagaactcacaccttgtcagtcatcaaagaattcataccagagagaaaccctttgaatgtagcaactgtggtaaggccttcagtgggtggacagcttttcttaagcaccagaaacttcacattggaaaggaatttgaagactgtaagagtctacaaacaggacctattctaataggtagcagaaacctaatgaatgcagtaaaactaggaaaagtctgatggagaccacatcttattgcactacaaatgagttttattagaaaaaaaccatgggaaggtgggaaagcagagaaaatacctactggatttttcaaacgtaagtataatcaagtggaaaagccaaaagctcttggacataatcaccttttttttttctgtctcagaactgacactagaatatggtcccaacgatacaattttttaaattatttattttttaacatacaaagagatgaggtctcactatgttgcccaggctggacttgaactcttgggctcaagcactcctccctcctcagcctcccaaagggttgggattaccggcatgagccactgcaccagccccaggggtctaattacttgagaatgttttaagggatgtctatcattattaaaatcattataaatcactttggcaacaaccccaaaactaaattattcatggaaagagccatttcaatcttgacttcctagtcgagtgacaagtttaaatgtgggaaaaaaccctgtgaaagtaatgagtgtaggccaggtgcggtggctcgtacctgtaatccagcactttgggaagccaaggtgggcagatcacgaggtcacgagttgatcatgaggagttactatgcccagccaacatactaaaaccccgtctctactaaaaataacaaaaattagccaggcatggtggggcacgcctgtagtcccaggtacttgcgaggctagggcaggagaatcacttgaacctgggaggtggaggttgcggtgagccaagatcatgccactgcactccagcctgggcaacaagtgcgaaactccatctcaaaaaaaaaaaaaagtctaactcttctgcttgtctttacaatgctgtacagtgagagctaatgtttataaggataaacaggatacttacagggatttgaaggtaatttaattcagtggtttccaactttttaatcaccaaggccttctttttactcccctatgtcctgtgtcttaaaagattatgtttaccaaactgcatttattaaagaattatattttgctacataaaggcatgtacaacacaaatcatgcttctgactggcaccatgtaggcagacctaggtactaaaattccagcccaaagcaaataatttaccattttcattagtctttttattccttttgtgggcaaacatatcgtctatgttaggctttttgaaatattaactatgacttgtaaactccagattaaaaactaaccaattcatctttgatggagcttgaatcaaactaagggtattggacttttgaaagattgaaatttttgttacagtatggaatgtttttaactgaatgttgaaataaaagttatttaagaatt

SEQ ID NO: 203135 - DNA, 4335 bp, Homo sapiens
  Payload ID: 20058
  Gene Name: zinc finger protein 594
  Uniprot ID: Q96JF6
  ENST ID: ENST00000575779
  CDS Start-End: 157-2580
agtcccggggagcgcaccggaagttctcgcctggcccaggcgcggggtccaagatggtggcgctaggagccgcgacccagtgatagcggccgtggaggggcccccgaccgagcgggaggttgggggtagcctggagattctgaagacaggaataagatgaaggaatggaaatcaaagatggaaatttctgaagaaaagaagtcagcaagggctgcatccgaaaaactccaaagacaaatcacccaggaatgtgagttagttgaaaccagtaattctgaggacagattattgaagcactgggtaagccctttaaaggatgcaatgagacatctcccttcccaagagagcggtatcagggaaatgcatattatcccccagaaagccattgtgggagagattggccatggatgtaatgaaggagaaaaaatactttctgcaggagaaagctcccatagatatgaggttagtggccaaaacttcaaacagaagtcaggattaactgaacatcagaaaattcataatataaataagacctatgaatgtaaggaatgtgaaaaaaccttcaacaggagttcaaacctgatcatacatcagagaattcatacaggaaataagccatatgtgtgtaatgaatgtgggaaagactctaatcaaagttcaaatcttattatacatcagagaattcatacaggaaagaaaccttatatatgtcatgaatgtggaaaagacttcaatcagagctccaatctggtgagacataagcaaattcacagtggtgggaatccctatgagtgcaaagagtgtgggaaggcttttaagggaagctcaaaccttgtcctgcaccagagaatccacagtagggggaagccatatttatgcaataaatgtgggaaggctttcagtcaaagcacagatcttattatacatcacagaattcacactggagagaaaccctatgaatgttatgactgtggacagatgttcagtcaaagttcacaccttgtcccacatcagagaattcacactggagagaaacccctcaaatgtaatgaatgtgaaaaagccttcaggcagcattctcaccttactgaacaccagagactccacagtggagagaaaccctatgaatgtcacagatgtgggaagaccttcagtgggcgcacagcttttcttaaacatcagagattgcatgctggagagaaaattgaagaatgtgagaaaaccttcagcaaggatgaggagcttagggaagagcagagaattcaccaggaagagaaagcttattggtgtaatcagtgtggtaggaatttccagggcacctcagacctcatcagacatcaggtaactcatacaggagagaaaccatatgaatgtaaagaatgtgggaaaactttcaatcagagctcagaccttctgagacatcatagaattcacagtggagaaaaaccttgtgtatgtagcaaatgtgggaaatcttttaggggcagctcagatcttattagacaccatcgtgttcatactggagagaaaccctatgaatgtagtgaatgtgggaaagcctttagccagaggtcacaccttgttacacaccagaaaatccatactggagagaagccctatcagtgcactgaatgtgggaaagccttcaggcggcgttcactccttattcaacatcggagaattcatagtggtgagaaaccctatgaatgtaaggaatgtgggaagctcttcatttggcgcacagctttcctcaaacatcagagcctgcatactggagagaaacttgaatgtgagaaaaccttcagccaggatgaggagcttaggggagagcagaaaattcaccaggaagcgaaagcttattggtgtaatcagtgtggtagggctttccagggcagctcagacctcatcagacatcaggtaactcatacaagagagaaaccatatgaatgcaaagaatgtgggaaaactttcaatcagagctcagaccttctgagacatcatagaattcacagtggagaaaaaccttatgtatgcaacaaatgtgggaaatcttttaggggtagctcagatcttattaaacaccatcgtattcatactggagagaaaccctatgaatgtagtgaatgtgggaaagccttcagccagaggtcacaccttgctacacaccagaaaatccatactggagagaaaccctatcagtgcagtgaatgtgggaatgccttcaggcggcgttccctccttattcaacatcggagacttcatagtggtgagaaaccctatgaatgtaaggaatgtgggaaactcttcatgtggcacacggctttcctcaaacatcagagactgcatgctggagagaaacttgaagaatgtgagaaaaccttcagcaaggatgaggagcttagaaaagagcagagaactcaccaggaaaagaaagtttattggtgtaatcagtgtagtaggaccttccagggcagctcagatctcatcagacatcaggtaactcatacaagagagaaaccatatgaatgtaaagaatgtgggaaaactcaatcagagctcagaccttctgagacatcatagaattcacagtggagaaaaaccttacgtatgcaataaatgtggggaatcttttaggagcagctcagatcttattaaacaccatcgtgttcatactggagagaaacctcatgaatgtagtgaatgtgggaaagtctttagccagaggtcccaccttgtcacacaccagaaaatccacactggagagaagccctatcagtgcactgaatgtgaaaaagccttcaggcggcgttcactccttattcaacgtcggagaattcatagtggtgagaaaccctatgaatgtaaggaatgtgggaaactcttcatgtggcacacagctttcctcaaacatcagagactgcatgctggagagaaacttgaagaacgtgagaaaaccttcagcaaggatgaggagcttaggggagagcagaaaattcaccaagaagagaaagcttattggtgtaatcagtgtggtagggctttccagggcagctcagacctcatcggacatcaggtaactcatacaggagagaaaccatatgaatgtaaagaatgtgggaaaactttcaatcagagctcagaccttctgagacatcatagaattcacagtggagaaaaaccttatgtatgcaacaaatgtgggaaatcttttaggggcagctcagatcttattagacaccatcgtgttcatactggagagaaaccctatgaatgccctgaatgttggaaggccttcagtcagaactcacaccttgtcagtcatcaaagaattcataccagagagaaaccctttgaatgtagcaactgtggtaaggccttcagtgggtggacagcttttcttaagcaccagaaacttcacattggaaaggaatttgaagactgtaagagtctacaaacaggacctattctaataggtagcagaaacctaatgaatgcagtaaaactaggaaaagtctgatggagaccacatcttattgcactacaaatgagttttattagaaaaaaaccatgggaaggtgggaaagcagagaaaatacctactggatttttcaaacgtaagtataatcaagtggaaaagccaaaagctcttggacataatcaccttttttttttctgtctcagaactgacactagaatatggtcccaacgatacaattttttaaattatttattttttaacatacaaagagatgaggtctcactatgttgcccaggctggacttgaactcttgggctcaagcactcctccctcctcagcctcccaaagggttgggattaccggcatgagccactgcaccagccccaggggtctaattacttgagaatgttttaagggatgtctatcattattaaaatcattataaatcactttggcaacaaccccaaaactaaattattcatggaaagagccatttcaatcttgacttcctagtcgagtgacaagtttaaatgtgggaaaaaaccctgtgaaagtaatgagtgtaggccaggtgcggtggctcgtacctgtaatccagcactttgggaagccaaggtgggcagatcacgaggtcacgagttgatcatgaggagttactatgcccagccaacatactaaaaccccgtctctactaaaaataacaaaaattagccaggcatggtggggcacgcctgtagtcccaggtacttgcgaggctagggcaggagaatcacttgaacctgggaggtggaggttgcggtgagccaagatcatgccactgcactccagcctgggcaacaagtgcgaaactccatctc

SEQ ID NO: 203136 - DNA, 757 bp, Homo sapiens
  Payload ID: 20058
  Gene Name: zinc finger protein 594
  ENST ID: ENST00000576772
  CDS Start-End: 452-757
agttctcgcctggcccaggcgcggggtccaagatggtggcgctaggagccgcgacccagtgatagcggccgtggaggggcccccgaccgagcgggaggttgggggtagcctggaggtgagaccccgctgcgttcacagagctggcggccgcggcgcctgcgtccaccggcaagcgaggagtggagcagagctcatatgcctatggggagaggcctgggggaccgcaggaggatgtaggcgccgggtgcgcatgactgggccttcttgctctcggtcggcttcttggtctcggcgtgccccattcccggccctgtcccgctactcttgcctgttccagttccctcctgtgggtaccgctaacggcatcttcccgaggcccagaatccaccgtcaggcataaattgattattcctcgcccacatctgtgccagattctgaagacaggaataagatgaaggaatggaaatcaaagatggaaatttctgaagaaaagaagtcagcaagggctgcatccgaaaaactccaaagacaaatcacccaggaatgtgagttagttgaaaccagtaattctgaggacagattattgaagcactgggtaagccctttaaaggatgcaatgagacatctcccttcccaagagagcggtatcagggaaatgcatattatcccccagaaagccattgtgggagagattggccatggatgtaatgaaggagaaaaaatactttctgcaggagaaagctcccatagatatgag

SEQ ID NO: 203137 - DNA, 1072 bp, Homo sapiens
  Payload ID: 20059
  Gene Name: zinc finger protein 595
  ENST ID: ENST00000509152
  CDS Start-End: 186-443
ccgggatctggcgcggcgttttcctctggctcctgcgagggcttggtttagggcttcagctctctgcgttctcggctccgggaggcctcggtgattcagccacagcctctgcctcccgttgctctgtgacctgagggtattggacaatttgtagctaagactcccggataccctgaagtcgggaaatggaactcgtaacattcagggatgtggccatagaattctcccctgaagagtggaaatgtctggaccctgcccagcagaatttgtatagagatgtgatgttggagaactacaggaacctggtctccctgggttttgtgatctctaacccagacctggtcacctgtctggagcaaataaaagagccctgcaatttgaagatacatgagacagcagccaaacccccagttgttcagcacttctggtctcttcagttctgatatgattttaggattgcttctttttttttttttgaggcggagtggagtgcagtggcgccatctcgtttcattgcaagttccgcctcccatgttcacaccattgtcctgcctcagcctccctagtagctgggactacaggtgcccgccaccacgcccggctaattttttgtattttagtagagacggggtttcactgagttagccaggatggtctcgatctcctgacctcgtgatccgcccatttcggcctcccgaagtgctgggattacaggtgtgagccactgcaccacgtcaggattgcgtcttatgttaatgcgaaatatgcatagctgtcatccgaagtataccaccattcccttcagcactctacgtcagaggaggcacgtcaggggagacaaaattcctcttcggacagtccctcaaaagacaggaatgtggacatatattccacatttctctttgtctcctgaggaagaagcatagagttgggagtttctcctggattgcaccatgctgtattgggaggaggtcaggctgcgctgggcatatctaataagctttttcttctcttctacatgtttttggcattgtgctcaactgaagtagtacaaattcttaactatgttcag

SEQ ID NO: 203138 - DNA, 1999 bp, Homo sapiens
  Payload ID: 20059
  Gene Name: zinc finger protein 595
  ENST ID: ENST00000608255
  CDS Start-End: 530-1927
gagaggaggggttggcttccgggatctggcgcggcgttttcctctggctcctgcgagggcttggtttagggcttcagctctctgcgttctcggctccgggaggcctcggtgattcagccacagcctctgcctcccgttgctctgtgacctgagggtattggacaatttgtagctaagactcccggataccctgaagtcgggaaatgctatatgttctcctttcagccaagacctttcaccagtgcaggggatagaagattcattccacaaacttatactgaaaagatacgagaaatgtggacatgagaatttacaattaagaaaaggctgtaaacgtgtgaatgagtgtaaggtgcagaaaggagttaataatggagtttaccagtgcttgtcaactacccagagcaaaatatttcaatgtaatacatgtgttaaagtttttagtaaattttcaaattcaaacaaacataagataagacatactggagagaaaccctttaaatgtacagaatgtggcagatcgttttacatgtcacacctaactcaacatacaggaattcatgctggagagaaaccctacaaatgtgaaaaatgtggcaaagcctttaataggtccacatcacttagtaaacataagagaattcatactggagagaaaccctacacatgtgaagaatgtggcaaagcctttagacggtccacagttctgaacgaacataagaaaattcatactggagagaaaccctacaaatgtgaagaatgtggcaaagcctttacaaggtccacaacactgaatgaacacaagaaaattcatactggagagaaaccctacaaatgtaaagaatgtggcaaagcctttagatggtccacaagcctgaatgaacataagaatattcatactggagagaaaccctacaaatgtaaagaatgtggcaaagcctttagacagtccaggagcctgaatgaacataaaaatattcatactggcgaaaaaccctacacatgtgaaaaatgtggcaaagcttttaaccaatcctcaagtcttattatacacaggagcattcattctgaacaaaaactttacaaatgtgaagaatgtggcaaagcctttacttggtcctcatcccttaataaacataagagaattcatactggagagaaaccctacacatgtgaagaatgtggcaaagctttttataggtcctcacaccttgctaaacataagagaattcatactggagagaaaccctacacgtgcgaagaatgtggcaaagcttttaaccaatcctcaactcttatattacacaagagaatccattctgggcaaaaaccttacaaatgtgaagaatgtggcaaagcctttacacggtccacaacactgaacgaacataagaaaattcatactggcgagaaaccctacaaatgtgaagaatgtggcaaagctttcatatggtccgcaagcctgaatgaacataagaatattcatactggagagaaaccctacaaatgtaaagaatgtggcaaagcttttaaccaatcctcaggccttattatacacaggagcattcattctgaacaaaaactttacaaatgtgaagaatgtggcaaagcctttactcggtccacagccctgaatgaacataagaaaattcattctggagagaaaccctacaaatgcaaagaatgtggcaaagcctataacttatcctcaacccttactaaacataagagaattcatactggagagaaacccttcacatgtgaagaatgtggcaaagccttcaattggtcctcatcccttactaaacataagataattcatactggagagaaatcctacaaatgtgaagaatgtggcaaagcttttaatcggccctcaacccttactgtacacaagcgaattcatactggcaaggaacatagttgaatgacatttctagtaatctctaattccagtgtctttacacagcaaataaattggagaatattgctcccatat

SEQ ID NO: 203139 - DNA, 2115 bp, Homo sapiens
  Payload ID: 20059
  Gene Name: zinc finger protein 595
  ENST ID: ENST00000609518
  CDS Start-End: 195-2045
ggttggcttccgggatctggcgcggcgttttcctctggctcctgcgagggcttggtttagggcttcagctctctgcgttctcggctccgggaggcctcggtgattcagccacagcctctgcctcccgttgctctgtgacctgagggtattggacaatttgtagctaagactcccggataccctgaagtcgggaaatggaactcgtaacattcagggatgtggccatagaattctcccctgaagagtggaaatgtctggaccctgcccagcagaatttgtatagagatgtgatgttggagaactacaggaacctggtctccctggctatatgttctcctttcagccaagacctttcaccagtgcaggggatagaagattcattccacaaacttatactgaaaagatacgagaaatgtggacatgagaatttacaattaagaaaaggctgtaaacgtgtgaatgagtgtaaggtgcagaaaggagttaataatggagtttaccagtgcttgtcaactacccagagcaaaatatttcaatgtaatacatgtgttaaagtttttagtaaattttcaaattcaaacaaacataagataagacatactggagagaaaccctttaaatgtacagaatgtggcagatcgttttacatgtcacacctaactcaacatacaggaattcatgctggagagaaaccctacaaatgtgaaaaatgtggcaaagcctttaataggtccacatcacttagtaaacataagagaattcatactggagagaaaccctacacatgtgaagaatgtggcaaagcctttagacggtccacagttctgaacgaacataagaaaattcatactggagagaaaccctacaaatgtgaagaatgtggcaaagcctttacaaggtccacaacactgaatgaacacaagaaaattcatactggagagaaaccctacaaatgtaaagaatgtggcaaagcctttagatggtccacaagcctgaatgaacataagaatattcatactggagagaaaccctacaaatgtaaagaatgtggcaaagcctttagacagtccaggagcctgaatgaacataaaaatattcatactggcgaaaaaccctacacatgtgaaaaatgtggcaaagcttttaaccaatcctcaagtcttattatacacaggagcattcattctgaacaaaaactttacaaatgtgaagaatgtggcaaagcctttacttggtcctcatcccttaataaacataagagaattcatactggagagaaaccctacacatgtgaagaatgtggcaaagctttttataggtcctcacaccttgctaaacataagagaattcatactggagagaaaccctacacgtgcgaagaatgtggcaaagcttttaaccaatcctcaactcttatattacacaagagaatccattctgggcaaaaaccttacaaatgtgaagaatgtggcaaagcctttacacggtccacaacactgaacgaacataagaaaattcatactggcgagaaaccctacaaatgtgaagaatgtggcaaagctttcatatggtccgcaagcctgaatgaacataagaatattcatactggagagaaaccctacaaatgtaaagaatgtggcaaagcttttaaccaatcctcaggccttattatacacaggagcattcattctgaacaaaaactttacaaatgtgaagaatgtggcaaagcctttactcggtccacagccctgaatgaacataagaaaattcattctggagagaaaccctacaaatgcaaagaatgtggcaaagcctataacttatcctcaacccttactaaacataagagaattcatactggagagaaacccttcacatgtgaagaatgtggcaaagccttcaattggtcctcatcccttactaaacataagataattcatactggagagaaatcctacaaatgtgaagaatgtggcaaagcttttaatcggccctcaacccttactgtacacaagcgaattcatactggcaaggaacatagttgaatgacatttctagtaatctctaattccagtgtctttacacagcaaataaattggagaatattgctcccat

SEQ ID NO: 203140 - DNA, 2911 bp, Homo sapiens
  Payload ID: 20059
  Gene Name: zinc finger protein 595
  ENST ID: ENST00000610261
  CDS Start-End: 205-2151
agagaggaggggttggcttccgggatctggcgcggcgttttcctctggctcctgcgagggcttggtttagggcttcagctctctgcgttctcggctccgggaggcctcggtgattcagccacagcctctgcctcccgttgctctgtgacctgagggtattggacaatttgtagctaagactcccggataccctgaagtcgggaaatggaactcgtaacattcagggatgtggccatagaattctcccctgaagagtggaaatgtctggaccctgcccagcagaatttgtatagagatgtgatgttggagaactacaggaacctggtctccctgggttttgtgatctctaacccagacctggtcacctgtctggagcaaataaaagagccctgcaatttgaagatacatgagacagcagccaaacccccagctatatgttctcctttcagccaagacctttcaccagtgcaggggatagaagattcattccacaaacttatactgaaaagatacgagaaatgtggacatgagaatttacaattaagaaaaggctgtaaacgtgtgaatgagtgtaaggtgcagaaaggagttaataatggagtttaccagtgcttgtcaactacccagagcaaaatatttcaatgtaatacatgtgttaaagtttttagtaaattttcaaattcaaacaaacataagataagacatactggagagaaaccctttaaatgtacagaatgtggcagatcgttttacatgtcacacctaactcaacatacaggaattcatgctggagagaaaccctacaaatgtgaaaaatgtggcaaagcctttaataggtccacatcacttagtaaacataagagaattcatactggagagaaaccctacacatgtgaagaatgtggcaaagcctttagacggtccacagttctgaacgaacataagaaaattcatactggagagaaaccctacaaatgtgaagaatgtggcaaagcctttacaaggtccacaacactgaatgaacacaagaaaattcatactggagagaaaccctacaaatgtaaagaatgtggcaaagcctttagatggtccacaagcctgaatgaacataagaatattcatactggagagaaaccctacaaatgtaaagaatgtggcaaagcctttagacagtccaggagcctgaatgaacataaaaatattcatactggcgaaaaaccctacacatgtgaaaaatgtggcaaagcttttaaccaatcctcaagtcttattatacacaggagcattcattctgaacaaaaactttacaaatgtgaagaatgtggcaaagcctttacttggtcctcatcccttaataaacataagagaattcatactggagagaaaccctacacatgtgaagaatgtggcaaagctttttataggtcctcacaccttgctaaacataagagaattcatactggagagaaaccctacacgtgcgaagaatgtggcaaagcttttaaccaatcctcaactcttatattacacaagagaatccattctgggcaaaaaccttacaaatgtgaagaatgtggcaaagcctttacacggtccacaacactgaacgaacataagaaaattcatactggcgagaaaccctacaaatgtgaagaatgtggcaaagctttcatatggtccgcaagcctgaatgaacataagaatattcatactggagagaaaccctacaaatgtaaagaatgtggcaaagcttttaaccaatcctcaggccttattatacacaggagcattcattctgaacaaaaactttacaaatgtgaagaatgtggcaaagcctttactcggtccacagccctgaatgaacataagaaaattcattctggagagaaaccctacaaatgcaaagaatgtggcaaagcctataacttatcctcaacccttactaaacataagagaattcatactggagagaaacccttcacatgtgaagaatgtggcaaagccttcaattggtcctcatcccttactaaacataagataattcatactggagagaaatcctacaaatgtgaagaatgtggcaaagcttttaatcggccctcaacccttactgtacacaagcgaattcatactggcaaggaacatagttgaatgacatttctagtaatctctaattccagtgtctttacacagcaaataaattggagaatattgctcccatataaacttgtattatttttcttattttaaattttttaaaatttctgtaggtacatagtatgtgtatctattcatggcttatttggattattttgatacaggcatatgacatgtaattatcacatcagagtaaatgagttattcttcacaagcatttgttctttgtattacacacagtccagttatacactttaatttttttttttttttttttttttgagacagagtctcgttctgtcgcccaggctggagcgcagtggtgcgatcttggctcactgcaacctccacctgctgggttcaagcaattctcctgcctcagcctcatgagtagctgtgactaccggcaggtgccaccatgcccagctaattttttgtattttcagtagagacagggtttcacaatgctggccaggctgttctcgaactcctgagctcatgatccacccacctcggcctcccaaagtgctgggattacgggtgtgagccatcgtacctggccactttaattatttttaaatgtgcaattatttttttactacaggttattttatgattataataagtatatgagtataattataattcacacatttctaagtcatgaatgcttttaaaaaatgttccatatttatctttgaacatgtagcatctctttccgcaaataaatgcagactttggttttgatttacat

SEQ ID NO: 203141 - DNA, 2783 bp, Homo sapiens
  Payload ID: 20060
  Gene Name: zinc finger protein 596
  Uniprot ID: Q8TC21
  ENST ID: ENST00000308811
  CDS Start-End: 289-1803
gacacgcgctttcaaccggcggagacactggcagggccagaaacgcgcgcagcgggggcgggaggtcggtaagctccccgcccctgcccgagaccccgccccggcccggccccgcctttttctctgcctcccctccctgcacgtacgggccccgcccctcgcgcgacgttttttgttgacccggaaacggattctccggagccgaggtccgctcggatttgtcttcttagtgcttggatggtgtgagtgaaaacccagaggaatacatttggtggctgagctagtacaatgccatcaccggattccatgaccttcgaggatatcattgtagacttcactcaagaagagtgggccctgctggacacatcccagagaaagctgtttcaagatgtgatgttggagaacatcagtcatctggtctctattggcaaacagctctgcaaatcagttgtgctttcccaattggagcaagtagagaaactttcaacacaaagaataagcttactgcaaggtagagaagttggcattaaacatcaagagataccattcattcaacatatctatcagaagggcacgtccaccatcagcacaatgagatctcatactcaagaggatccttttctatgcaatgacttaggagaagatttcactcaacatatagcattgactcaaaatgtgattacctacatgagaacgaaacactttgtaagcaaaaagtttgggaaaatcttcagtgactggttatcctttaatcaacacaaggaaattcacaccaaatgtaaatcatatggaagtcatctatttgattatgcctttatccaaaactctgcccttagaccacacagtgtgactcacactagagagataacattggaatgtcgtgtgtgtgggaaaacctttagcaaaaattctaatcttaggcgacatgagatgattcacactggagagaaaccacacggatgtcatctatgtgggaaagcctttactcattgctctgatcttcgaaaacatgagagaactcacactggagagaagccatatggatgtcatctatgtgggaaagccttcagtaaaagttctaaccttagacgacatgagatgattcacactagagaaaaagcacagatatgccatctatgtgggaaagccttcactcattgctctgaccttagaaaacatgagagaactcacttaggagataaaccatatggatgtctcctatgtgggaaggctttcagtaaatgttcttaccttagacaacatgaaagaactcacaatggagagaaaccatatgaatgtcatctatgtggaaaagccttctctcattgttctcaccttagacaacatgagcgaagtcacaatggagagaaaccacatggatgtcatctatgtgggaaagcattcactgaatcttctgtgcttaaacgacatgagagaattcacactggagagaaaccatatgagtgccatgtatgtgggaaagccttcactgaatcttctgacctcagacgacatgagagaactcacactggagaaaaaccatatgaatgccatctatgcggaaaagccttcaatcactcttctgtccttagacgacatgagagaactcacactggagagaaaccatatgaatgcaatatatgtggtaaagccttcaatagaagttacaactttagacttcatagaagagttcacactggagagaaaccatatgtatgtcctctatgtgggaaagcctttagtaaattttttaaccttagacaacatgagagaactcacactaaaaaagcaatgaatatgtaagaatcatcagctgtagcgttaacactaaatacaccaaggacaaacatactacaggaatattatgtctgtaatcagtgtggaaaagcctttatttatatttaccactttgctcaacctaaatgaattcaaggtagagagaatccagatgtatttaatgtttatggcacaaacttcagactctaggctgaccatatacaacgtgagagaatgaaactatagatcaaaggaatgtggaggagtcttcatccacagctctgttaaataaatgggagaaatcacatcacgaaaattctgtgcctgtcgtcagtgtgaaaatgcctttgctgataatttatcctctaaacaaatgagtaaaatccacaggcaagcaaccatatgtctgtaattgctgtgcactctcattcagctaagcaccaattttggtgtgtgcaagaaaattcattataaggtaactgataaaaacaggaaatatgtgaaaatattttttattaggtggatgaggcctcttgaacaattccagacattcatagtggagaagttattcaatgaaaactcatgagaaatccttttcttaatacagcagcacttctataatagatcagaattcacatggtgtagaactctcaatgacatgaatggagggtagtcctcagtaaattactcattccttagtcaataccagcatttttccagtgagaaaactatcttgacaggatagtggaaaaaccttcaggcagcttttatgtcaaaaaagtgagacagggatgaaaactctaaaaagccattgatgagatgtatagctgggggacaaaacataaagccatcaagcacgtgcttgagaaaaaaattataattttgaataaagactttctacttaaaatatgtgggttgaaatgtacaattctgaaataacctgggaatattgaatgcagaattatgtaagaagtaataagattaaattagtactgtcaaaaatacaa

SEQ ID NO: 203142 - DNA, 2696 bp, Homo sapiens
  Payload ID: 20060
  Gene Name: zinc finger protein 596
  Uniprot ID: Q8TC21
  ENST ID: ENST00000320552
  CDS Start-End: 204-1718
aagttgggtggaagcagcgcggacccacggcacaccgaacgcactccaacagaacccgacgcagacacgcgctttcaaccggcggagacactggcagggccagaaacgcgcgcagcgggggcgggaggtcgatttgtcttcttagtgcttggatggtgtgagtgaaaacccagaggaatacatttggtggctgagctagtacaatgccatcaccggattccatgaccttcgaggatatcattgtagacttcactcaagaagagtgggccctgctggacacatcccagagaaagctgtttcaagatgtgatgttggagaacatcagtcatctggtctctattggcaaacagctctgcaaatcagttgtgctttcccaattggagcaagtagagaaactttcaacacaaagaataagcttactgcaaggtagagaagttggcattaaacatcaagagataccattcattcaacatatctatcagaagggcacgtccaccatcagcacaatgagatctcatactcaagaggatccttttctatgcaatgacttaggagaagatttcactcaacatatagcattgactcaaaatgtgattacctacatgagaacgaaacactttgtaagcaaaaagtttgggaaaatcttcagtgactggttatcctttaatcaacacaaggaaattcacaccaaatgtaaatcatatggaagtcatctatttgattatgcctttatccaaaactctgcccttagaccacacagtgtgactcacactagagagataacattggaatgtcgtgtgtgtgggaaaacctttagcaaaaattctaatcttaggcgacatgagatgattcacactggagagaaaccacacggatgtcatctatgtgggaaagcctttactcattgctctgatcttcgaaaacatgagagaactcacactggagagaagccatatggatgtcatctatgtgggaaagccttcagtaaaagttctaaccttagacgacatgagatgattcacactagagaaaaagcacagatatgccatctatgtgggaaagccttcactcattgctctgaccttagaaaacatgagagaactcacttaggagataaaccatatggatgtctcctatgtgggaaggctttcagtaaatgttcttaccttagacaacatgaaagaactcacaatggagagaaaccatatgaatgtcatctatgtggaaaagccttctctcattgttctcaccttagacaacatgagcgaagtcacaatggagagaaaccacatggatgtcatctatgtgggaaagcattcactgaatcttctgtgcttaaacgacatgagagaattcacactggagagaaaccatatgagtgccatgtatgtgggaaagccttcactgaatcttctgacctcagacgacatgagagaactcacactggagaaaaaccatatgaatgccatctatgcggaaaagccttcaatcactcttctgtccttagacgacatgagagaactcacactggagagaaaccatatgaatgcaatatatgtggtaaagccttcaatagaagttacaactttagacttcatagaagagttcacactggagagaaaccatatgtatgtcctctatgtgggaaagcctttagtaaattttttaaccttagacaacatgagagaactcacactaaaaaagcaatgaatatgtaagaatcatcagctgtagcgttaacactaaatacaccaaggacaaacatactacaggaatattatgtctgtaatcagtgtggaaaagcctttatttatatttaccactttgctcaacctaaatgaattcaaggtagagagaatccagatgtatttaatgtttatggcacaaacttcagactctaggctgaccatatacaacgtgagagaatgaaactatagatcaaaggaatgtggaggagtcttcatccacagctctgttaaataaatgggagaaatcacatcacgaaaattctgtgcctgtcgtcagtgtgaaaatgcctttgctgataatttatcctctaaacaaatgagtaaaatccacaggcaagcaaccatatgtctgtaattgctgtgcactctcattcagctaagcaccaattttggtgtgtgcaagaaaattcattataaggtaactgataaaaacaggaaatatgtgaaaatattttttattaggtggatgaggcctcttgaacaattccagacattcatagtggagaagttattcaatgaaaactcatgagaaatccttttcttaatacagcagcacttctataatagatcagaattcacatggtgtagaactctcaatgacatgaatggagggtagtcctcagtaaattactcattccttagtcaataccagcatttttccagtgagaaaactatcttgacaggatagtggaaaaaccttcaggcagcttttatgtcaaaaaagtgagacagggatgaaaactctaaaaagccattgatgagatgtatagctgggggacaaaacataaagccatcaagcacgtgcttgagaaaaaaattataattttgaataaagactttctacttaaaatatgtgggttgaaatgtacaattctgaaataacctgggaatattgaatgcagaattatgtaagaagtaataagattaaattagtactgtcaaaaatac

SEQ ID NO: 203143 - DNA, 2863 bp, Homo sapiens
  Payload ID: 20060
  Gene Name: zinc finger protein 596
  Uniprot ID: Q8TC21
  ENST ID: ENST00000398612
  CDS Start-End: 371-1885
ggagccgaggtccgctcgggtgagtgccctccgctttttgtggccaaacccagccacgcagttcccttcctgcggcgtcctccacacccggggtctgctggtctccgcggatgtcacaggctcggcaaccgccctcctgtcggcggggagtcccgcgacgcccggaaatgctccgaagcctgtcgcccagctgccagatctgcgtctgtgtccggttccgtcactgaggtcgcccctgtccggcccttccaccctagttctcttcaccgtccgcccatcctatcgcgcgcggcctcagatttgtcttcttagtgcttggatggtgtgagtgaaaacccagaggaatacatttggtggctgagctagtacaatgccatcaccggattccatgaccttcgaggatatcattgtagacttcactcaagaagagtgggccctgctggacacatcccagagaaagctgtttcaagatgtgatgttggagaacatcagtcatctggtctctattggcaaacagctctgcaaatcagttgtgctttcccaattggagcaagtagagaaactttcaacacaaagaataagcttactgcaaggtagagaagttggcattaaacatcaagagataccattcattcaacatatctatcagaagggcacgtccaccatcagcacaatgagatctcatactcaagaggatccttttctatgcaatgacttaggagaagatttcactcaacatatagcattgactcaaaatgtgattacctacatgagaacgaaacactttgtaagcaaaaagtttgggaaaatcttcagtgactggttatcctttaatcaacacaaggaaattcacaccaaatgtaaatcatatggaagtcatctatttgattatgcctttatccaaaactctgcccttagaccacacagtgtgactcacactagagagataacattggaatgtcgtgtgtgtgggaaaacctttagcaaaaattctaatcttaggcgacatgagatgattcacactggagagaaaccacacggatgtcatctatgtgggaaagcctttactcattgctctgatcttcgaaaacatgagagaactcacactggagagaagccatatggatgtcatctatgtgggaaagccttcagtaaaagttctaaccttagacgacatgagatgattcacactagagaaaaagcacagatatgccatctatgtgggaaagccttcactcattgctctgaccttagaaaacatgagagaactcacttaggagataaaccatatggatgtctcctatgtgggaaggctttcagtaaatgttcttaccttagacaacatgaaagaactcacaatggagagaaaccatatgaatgtcatctatgtggaaaagccttctctcattgttctcaccttagacaacatgagcgaagtcacaatggagagaaaccacatggatgtcatctatgtgggaaagcattcactgaatcttctgtgcttaaacgacatgagagaattcacactggagagaaaccatatgagtgccatgtatgtgggaaagccttcactgaatcttctgacctcagacgacatgagagaactcacactggagaaaaaccatatgaatgccatctatgcggaaaagccttcaatcactcttctgtccttagacgacatgagagaactcacactggagagaaaccatatgaatgcaatatatgtggtaaagccttcaatagaagttacaactttagacttcatagaagagttcacactggagagaaaccatatgtatgtcctctatgtgggaaagcctttagtaaattttttaaccttagacaacatgagagaactcacactaaaaaagcaatgaatatgtaagaatcatcagctgtagcgttaacactaaatacaccaaggacaaacatactacaggaatattatgtctgtaatcagtgtggaaaagcctttatttatatttaccactttgctcaacctaaatgaattcaaggtagagagaatccagatgtatttaatgtttatggcacaaacttcagactctaggctgaccatatacaacgtgagagaatgaaactatagatcaaaggaatgtggaggagtcttcatccacagctctgttaaataaatgggagaaatcacatcacgaaaattctgtgcctgtcgtcagtgtgaaaatgcctttgctgataatttatcctctaaacaaatgagtaaaatccacaggcaagcaaccatatgtctgtaattgctgtgcactctcattcagctaagcaccaattttggtgtgtgcaagaaaattcattataaggtaactgataaaaacaggaaatatgtgaaaatattttttattaggtggatgaggcctcttgaacaattccagacattcatagtggagaagttattcaatgaaaactcatgagaaatccttttcttaatacagcagcacttctataatagatcagaattcacatggtgtagaactctcaatgacatgaatggagggtagtcctcagtaaattactcattccttagtcaataccagcatttttccagtgagaaaactatcttgacaggatagtggaaaaaccttcaggcagcttttatgtcaaaaaagtgagacagggatgaaaactctaaaaagccattgatgagatgtatagctgggggacaaaacataaagccatcaagcacgtgcttgagaaaaaaattataattttgaataaagactttctacttaaaatatgtgggttgaaatgtacaattctgaaataacctgggaatattgaatgcagaattatgtaagaagtaataagattaaattagtactgtcaaaaatac

SEQ ID NO: 203144 - DNA, 581 bp, Homo sapiens
  Payload ID: 20060
  Gene Name: zinc finger protein 596
  ENST ID: ENST00000521270
  CDS Start-End: 451-581
aaacccagccacgcagttcccttcctgcggcgtcctccacacccggggtctgctggtctccgcggatgtcacaggctcggcaaccgccctcctgtcggcggggagtcccgcgacgcccggaaatgctccgaagcctgtcgcccagctgccagatctgcgtctgtgtccggttccgtcactgaggtcagacttgagggactggtatttctagaagcctcacatggaagagacagaatcattcagtacaagtgtatccagaggaccagcagaagggagaaggaatggagggaggctcctgagggctgagatgcatgtggagaaagcctgcaagcacacaaaccgagaataattaaatctgagaaattccaggatttatctatttgtcttcttagtgcttggatggtgtgagtgaaaacccagaggaatacatttggtggctgagctagtacaatgccatcaccggattccatgaccttcgaggatatcattgtagacttcactcaagaagagtgggccctgctggacacatcccagagaaagctgtttcaagatgtgatgttggagaacatcagtcatctggt

SEQ ID NO: 203145 - DNA, 643 bp, Homo sapiens
  Payload ID: 20060
  Gene Name: zinc finger protein 596
  ENST ID: ENST00000521145
  CDS Start-End: 204-643
aagttgggtggaagcagcgcggacccacggcacaccgaacgcactccaacagaacccgacgcagacacgcgctttcaaccggcggagacactggcagggccagaaacgcgcgcagcgggggcgggaggtcgatttgtcttcttagtgcttggatggtgtgagtgaaaacccagaggaatacatttggtggctgagctagtacaatgccatcaccggattccatgaccttcgaggatatcattgtagacttcactcaagaagagtgggccctgctggacacatcccagagaaagctgtttcaagatgtgatgttggagaacatcagtcatctggtctctattggcaaacagctctgcaaatcagttgtgctttcccaattggagcaagtagagaaactttcaacacaaagaataagcttactgcaaggtagagaagttggcattaaacatcaagagataccattcattcaacatatctatcagaagggcacgtccaccatcagcacaatgagatctcatactcaagaggatccttttctatgcaatgacttaggagaagatttcactcaacatatagcattgactcaaaatgtgattacctacatgagaacgaaacactttgtaagcaaaaagtttgggaaaat

SEQ ID NO: 203146 - DNA, 564 bp, Homo sapiens
  Payload ID: 20060
  Gene Name: zinc finger protein 596
  ENST ID: ENST00000518414
  CDS Start-End: 346-564
gccctccgctttttgtggccaaacccagccacgcagttcccttcctgcggcgtcctccacacccggggtctgctggtctccgcggatgtcacaggctcggcaaccgccctcctgtcggcggggagtcccgcgacgcccggaaatgctccgaagcctgtcgcccagctgccagatctgcgtctgtgtccggttccgtcactgaggtcgcccctgtccggcccttccaccctagttctcttcaccgtccgcccatcctatcgcgcgcggcctcagatttgtcttcttagtgcttggatggtgtgagtgaaaacccagaggaatacatttggtggctgagctagtacaatgccatcaccggattccatgaccttcgaggatatcattgtagacttcactcaagaagagtgggccctgctggacacatcccagagaaagctgtttcaagatgtgatgttggagaacatcagtcatctggtctctattggcaaacagctctgcaaatcagttgtgctttcccaattggagcaagtagagaaactttcaacacaaagaataagcttactg

SEQ ID NO: 203147 - DNA, 1006 bp, Homo sapiens
  Payload ID: 20060
  Gene Name: zinc finger protein 596
  ENST ID: ENST00000523162
  CDS Start-End: 251-484
agaaacgcgcgcagcgggggcgggaggtcggtaagctccccgcccctgcccgagaccccgccccggcccggccccgcctttttctctgcctcccctccctgcacgtacgggccccgcccctcgcgcgacgttttttgttgacccggaaacggattctccggagccgaggtccgctcggatttgtcttcttagtgcttggatggtgtgagtgaaaacccagaggaatacatttggtggctgagctagtacaatgccatcaccggattccatgaccttcgaggatatcattgtagacttcactcaagaagagtgggccctgctggacacatcccagagaaagctgtttcaagatgtgatgttggagaacatcagtcatctggtctctattggcaaacagctctgcaaatcagttgtgctttcccaattggagcaagtagagaaactttcaacacaaagaataagcttactgcaaggtgagctctaagaagcagtgcttcaataggaggaggagaaacatggccagtgagtagagaagttggcattaaacatcaagagataccattcattcaacatatctatcagaagggcacgtccaccatcagcacaatgagatctcatactcaagaggatccttttctatgcaatgacttaggagaagatttcactcaacatatagcattgactcaaaatgtgattacctacatgagaacgaaacactttgtaagcaaaaagtttgggaaaatcttcagtgactggttatcctttaatcaacacaaggaaattcacaccaaatgtaaatcatatggaagtcatctatttgattatgcctttatccaaaactctgcccttagaccacacagtgtgactcacactagagagataacattggaatgtcgtgtgtgtgggaaaacctttagcaaaaattctaatcttaggcgacatgagatgattcacactggagagaaaccacacggatgtcatctatgtgggaaagcctttactcatt

SEQ ID NO: 203148 - DNA, 522 bp, Homo sapiens
  Payload ID: 20060
  Gene Name: zinc finger protein 596
  ENST ID: ENST00000518320
  CDS Start-End: 316-522
agttcccttcctgcggcgtcctccacacccggggtctgctggtctccgcggatgtcacaggctcggcaaccgccctcctgtcggcggggagtcccgcgacgcccggaaatgctccgaagcctgtcgcccagctgccagatctgcgtctgtgtccggttccgtcactgagatttgtcttcttagtgcttggatggtgtgagtgaaaacccagaggaatacatttggtggctgagctagtacaatgccatcaccgacttcactcaagaagagtgggccctgctggacacatcccagagaaagctgtttcaagatgtgatgttggagaacatcagtcatctggtctctattggcaaacagctctgcaaatcagttgtgctttcccaattggagcaagtagagaaactttcaacacaaagaataagcttactgcaaggtagagaagttggcattaaacatcaagagataccattcattcaacatatctatcagaagggcacgtccaccatcagcacaatgagatct

SEQ ID NO: 203149 - DNA, 714 bp, Homo sapiens
  Payload ID: 20060
  Gene Name: zinc finger protein 596
  ENST ID: ENST00000522866
  CDS Start-End: 314-714
aaacggattctccggagccgaggtccgctcgggtgagtgccctccgctttttgtggccaaacccagccacgcagttcccttcctgcggcgtcctccacacccggggtctgctggtctccgcggatgtcacaggctcggcaaccgccctcctgtcggcggggagtcccgcgacgcccggaaatgctccgaagcctgtcgcccagctgccagatctgcgtctgtgtccggttccgtcactgagatttgtcttcttagtgcttggatggtgtgagtgaaaacccagaggaatacatttggtggctgagctagtacaatgccatcaccggattccatgaccttcgaggatatcattgtagacttcactcaagaagagtgggccctgctggacacatcccagagaaagctgtttcaagatgtgatgttggagaacatcagtcatctggtctctattggcaaacagctctgcaaatcagttgtgctttcccaattggagcaagtagagaaactttcaacacaaagaataagcttactgcaaggtagagaagttggcattaaacatcaagagataccattcattcaacatatctatcagaagggcacgtccaccatcagcacaatgagatctcatactcaagaggatccttttctatgcaatgacttaggagaagatttcactcaacatatagcattgactcaaaatgtgattacctacat

SEQ ID NO: 203150 - DNA, 5513 bp, Homo sapiens
  Payload ID: 20061
  Gene Name: zinc finger protein 597
  Uniprot ID: Q96LX8
  ENST ID: ENST00000301744
  CDS Start-End: 237-1511
aggatggcggagagggctgagggcgggtcgcttccggcggcttttcccgcagctcctgcgtaaaggagcatgagagcgtgggagttttgcagtggccgtggcgttcttcgtcgcgtctcggtcgggcgtcgctttctgcagctcctgtcagggagcgcgaggcctgttattaaccgcggagcgctttgtcacgaagtccctgtggcgtcttgaagaaggcattccccacccgccaaatggcgtccatgcccccgacgcccgaggcccagggaccaatactctttgaggatctggctgtgtatttttctcaagaggagtgcgtgactctgcaccctgcccagaggtccctcagcaaagatggtacaaaagagtctttggaggatgcggctttgatgggagaggaaggcaagcctgagattaatcagcagttaagcctagagtctatggaacttgacgagcttgccttagaaaagtaccccattgctgcaccccttgtcccttacccagaaaaatcctctgaggatggagttggaaaccctgaagcgaaaatattaagtggaactcccacttacaagagaagggtcatcagccttttagttaccattgaaaaccacaccccattagtagaactctctgaatatttaggaaccaacacactttctgaaattcttgattctccctgggaaggagccaaaaatgtgtacaaatgtcctgagtgtgaccaaaacttcagcgatcattcatacctagttttgcatcagaaaattcattcaggagagaaaaaacataaatgtggtgactgtggaaagatcttcaatcatagagccaacctgaggacacacaggagaatccatactggtgagaaaccttataagtgtgccaagtgcagtgccagctttcgccagcactctcatctatcccgacacatgaatagccacgtaaaggagaagccctatacatgtagcatatgtggtagaggttttatgtggctcccaggattggcacagcatcagaaaagccacagtgctgaaaacacctacgaatctactaactgtgataaacattttaatgagaaaccaaatcttgctttgcctgaggaaacattcgtatcaggcccccagtaccagcacactaagtgcatgaagagcttcaggcagtccttatatcctgccctttccgagaagagccacgacgaggactctgaacgctgcagcgatgatggggacaatttcttctcattctcaaaattcaagcccttacagtgtcctgactgtgacatgacctttccttgtttctctgagcttatttcccatcagaacattcatacagaggaaaggccccataagtgcaaaacatgcgaggaaagttttgctttggactcagaacttgcatgccaccagaagagccacatgctagcggaaccttttaaatgtaccgtgtgtgggaaaactttcaagtcgaatttgcatctcattactcataagcgaactcacataaaaaacaccacgtaaagtaaatataacaaattgttattagtgattgggcttttcagtatctgtatggtgggaagcagttactgtatatgtcccaggcaatgtgctaagcactttacacacattcccatgtaatacttaattctcagcacaaccgtgatttaggcagtatcatttccattttataagtagggatgcaaaatccgtgtcactaaactagtgaatgaacccaggatttgaactcagttactgtacaactgtgagccagaagaagatacacaacttttgtttaaattcaattttcattaaaatgaaggctcttgctaaagttattttaattttgtttacgtagtttctgacttttagaaggaggagaatttatttatattttgccagttctgcagacatatctaggaaagtaaatgcttttatatgttttatacttttttttgctataactatttgaatgtaatacttgtataagattgctgttctacatgtgaattcccacaggcgttcagaagtttttttctgccctgtaaaagttcccaaatgggtagactagtttatattttgatggccattagtatccggagttctctgtcatggttctgatgccaggggcacatactggcatttaggacccaattgtttgcaaggagttttggaagtctaactgcagcccttttctggaggctggacttgacttggggagggggagaagtacttgctcttttctaagatttgcctccaaattgctactgaagcacattacctgtcttactatgaataattgtaattgtttctcagtgagcatgctagctactttagatatattatgtaatttaatcttcagaatctgtgacagagaaaaaaaatctttgtttcataaacgaggaaactgaagtcctcagagggtaaagtcagttctttgcccagcacacaaatcacattgtggtgaaactgacattaagcttgggtttctctgactccaaaggccatgcagtctgcaagactgcggcatttgttggcatttgcaccacgtagtagcactgcaggcagccagggaaaggggagctgagataggtgagggtggtcctcatggaggcgattctgtgtgcttgcatcctggaaccccttcattccctttgtgctgtacccaaagcctgactaacatatacagttacaaagcagcagaagactctccaggacttcaggtttgaattcttgtccctctaatcagatgagagatttcacacttggcagagtacaatactgaaggtcttaactgggttttggttttttaaaaaacacccataacatttcctctccatctccaaagaaaatgcatatagaaaattgttagattttaaccaaaatacttgataatatatagatctttagatattgctattatagataaatactggagcaaaatattattaaatggtatggttattaatgttaaagaaccacagaatgttgtaaatatagattcatatacaatttctcattaaagtcgattgtatgcctatcagcaaaacaatatttacatgggttttgattaggatggaagaatgctctcattctatttaaatagacagtataaaagtacaatatttgctaaaattgaattgttgctgggaatttttgctgggagaaaagataaaggactcttgaggactaattatatggaaggtagcagaaggtggtcctacagaacagcagattgaggactaaatatacaaaaaatgctggctactcagctaagctcttattactgagtagaggcaggaagatactgttcaggtgagagaaaaactgaaactaacaaaaacatccctaacccagagagagtttctctctctttgtcattcttgtcttgtttcttgtttgcagatccacagttgagacaatgtgctgctctgtatgtcaaggtcagactttggctgtttgtttctgatgtctccactcttaggagacaggacaccagcttccaggtttctctgaggtgctttgaaatgtgtagaaagatagtctccagttagattacttattaggcaactctgagataccatgacctttgttaaataacaagaacaccacctccttgctctcctgcttctgccctcagtgggagaaactggcaggagcctcatcagcacatatcaggggccctaagagttcagtcaaagatctaatgagtcacaggatgggggatgaaattgggaaaggtctggattagcagagttgctgcagaaagaagtagaggggaatatcttagaaggcacttggacagaatgggggtgatataaaagatgtatgctgtcatttttgttttggctcctagaaaatatagcagaaagtgagaatttgtgccatacatcctgttctgcaccttaatatggaagtttgcctttccacacgagtcttccttcacaattaacctctaatttttttttttgcagttttctccagattttggaagattacgacaaacttcctaaaagattagaaaaaatagcccttttcagaaacattaacatacgtgtgggtagaactaaaatggctttttggtataatactgttaatgattagtatgcagaaaaaaatgaaaaccccggaagtgtcagttactgtgaaagaggcatattttcagttgtgcttattgtgcagttgtacttaaatacatttgctagatgtaattcaagctgctttacccccagggaattgaaggaaaagatatatctgctggtgagcttcaggctttttatgatgatggcatttcacccttctgtttacagtgtcaactgatggagataaattccataaaattgtcattaactcagatactagccttccatgttaggtgctattcacaaatactggataaaagttaatatgggaatgaaaaactaaatgcaagagtttattgctatgaatgattggttaactgcattttgcagcatggaaatcaacacactatgagagtgaaaactttgtgctgaataaattgactcagacaaatttctccgtttttgtcgttgatgcagtgatgaaaatgtatatccaacagttccttaacatgattgctggaatagttaaacagtcttttaaacagtcgtcattgatgaaaacagcatttttccaatggaattcagatgtcagcagtttacattttataatttaagaaattgtggaatgtagttgttttgaatgaggtcgactcagaatagttttatttagagctttgttgctacaggtggtagtctattgacacctcctcatttaacatagaaaatgactaacccaataattcagggagttaaaactcaaatgacatttcacagcaaatgccattttgagtctttgcctcctgagtttccatataattaagtggcaatgttctagtgactgcagcataagatgtcatacaatctgaaactgcagagtttgatcaaagtaatctgcaatttactgcctatgtgtacaaagggagacatagcaggttatagtttatatgaatagtctattttgaatgttcattaaacttgttatccctgtgggattttagtaggaaagtgtatttgctttgaccatctgtttaacaaaatgatgttcattacattagaagtgtatgtattcatctggtttagttttgtaatttagaagagctattgatctgattcaaagataaccattacccatctttccaaggcccatctaagtagtacaggtgttttgtcttttaaaattgacagtcctctttgcattaagtctgtagggggggaatacaatataaatattcttctgtgtaaacgtaagaatgtgctgtaatctccagttcctttggatacctcagaattctatttattgtatacacttatactgtttattcaatgttttgggtcttactctttttgacgtattctcatcagtcttcactctagtttgcaagctctgaagttattgattacgtctaatgtgcaatttggcttctattaaatgctattttatgat

SEQ ID NO: 203151 - DNA, 3366 bp, Homo sapiens
  Payload ID: 20062
  Gene Name: zinc finger protein 598
  Uniprot ID: Q86UK7
  ENST ID: ENST00000431526
  CDS Start-End: 75-2789
ggaaggggcgggcccgccgggagccaggccgctcggcgccacgaccggccgagaggggggccggatcccggaccatggcggcggccgggggcgccgaggggcggcgcgcggacatggaggcggaggcggcggcagctcctgagcggggaggcgggagctgcgtgctgtgctgcggagacctggaggccacggcgctgggccgctgcgaccacccggtgtgctaccgctgctctaccaagatgcgggtgctctgcgagcagcgctactgcgccgtgtgccgcgaggagctgcgccaggtggtctttgggaagaagcttcctgcctttgccaccatccccatccaccagctgcagcatgagaagaaatatgatatctactttgcagatggaaaggtgtacgcattgtacaggcagctgctgcagcacgagtgcccgcggtgccccgagctgccacctttcagcctcttcggggacctggagcagcacatgcggaggcagcatgagctcttctgctgccgtctgtgcctccagcacctccagatcttcacatatgagcgcaagtggtactcgcgcaaggacctggcccggcatcgcatgcagggtgaccccgatgacacgtcgcaccgtgggcacccgctctgcaagttctgtgacgagcgctacctggacaatgatgagctgcttaagcacctgcgccgcgaccactacttctgccacttctgcgactcggacggggcccaggactactacagcgactatgcctacctgcgtgagcacttccgggagaagcactttctgtgtgaggaaggccgctgcagcacggagcagttcacccacgccttccgcaccgagatcgacctcaaggcccacaggacggcctgccacagtcgcagccgcgccgaggcacgccagaaccgccacatcgacctgcagttcagctacgcgccacggcactcgcgccggaacgagggggtcgttggtggcgaagactacgaggaggtggacaggtacagccgccagggccgagtggcccgggctggcactcgcggagcccagcagagccgccgaggaagctggaggtacaaaagggaagaagaggaccgagaagtagcagctgctgtccgggcctccgtggccgcacagcagcaggaggaggctcgcaggagtgaggatcaggaggaaggcggtaggcccaagaaggaggaggcagcggcgcggggacctgaggatccccgtggcccccggcgctcaccccggactcagggcgaaggcccaggccccaaggaaacctcgacaaatggtcctgtaagccaagaagccttctcggtgacaggcccagccgccccagggtgtgtgggggtgccaggcgccctcccaccacccagcccgaagctcaaggacgaagacttccccagcctctctgcctccacttcctcctcctgctccactgcagcaaccccgggccctgtggggttggcgctgccgtacgccatccctgccagaggcaggagtgccttccaggaggaggacttccccgccctggtgtcctcggtgcccaagcctggcaccgcccccaccagccttgtctctgcctggaacagcagcagtagcagcaagaaggtagcacagcccccactctcggcgcaggctaccggcagcggccagcccaccaggaaggctgggaaggggagcaggggcggcaggaagggcggcccgcccttcacacaggaggaggaggaggacggcggcccggccctgcaggagcttctgagcacacgccccacgggctccgtctcctccacactggggctggcctccatccaaccctctaaagttgggaagaagaagaaagtgggctcggagaagccaggcaccacattgccacagcccccgcccgctacctgtcccccaggggctttgcaggccccggaagctcctgccagcagagccgaggggccagttgccgtcgtcgttaatggacacatggagggcccggcccctgctcggagtgcccccaaggaaccccctgggctcccaaggcccctggggtccttcccctgccccacgccacaggaggacttcccagcgctcggcggcccctgcccaccccggatgccgccgcccccaggcttcagcgctgtggtgctcctgaagggcacgcctcccccacccccgccgggcctggtgcccccaatcagcaagccgccccctggcttctctggccttctgcctagcccccacccggcctgtgtccccagccccgccaccaccaccaccacaaaagcacccaggctgctgcctgccccacgggcgtacctagtccccgagaacttccgggagaggaaccttcagctcatccagtccatcagggacttcctgcagagcgacgaggcccgcttcagcgagttcaagagccactcaggggagttcagacagggcctgatctccgcagcccagtattacaagagttgccgggacctgctgggggagaatttccagaaggtctttaatgagctgctggtcctgctgcccgacacggccaagcagcaggagctcctgtctgcacacacggacttctgcaaccgcgagaagcctctgagcaccaagtccaagaagaacaagaagagcgcgtggcaggccaccacccagcaggcgggcctggactgccgtgtgtgccccacctgccagcaggtgctcgcgcatggcgatgccagcagccaccaggcgctgcatgctgcccgggacgacgacttcccctccctgcaagccatcgccaggatcatcacgtagctcccgccagcgtggccagagctgtcgcaccgtgagcgtccttcctccttcctctccgggctgccaggcagccaggtaaggcctggtgaggccacttggcctcttggttggccaggcccaccaggaagtcaccaggacagtccacccgccctgttggcacactcaagcgggagtccacccctgcctcagtggtgggccagtctcggtttgcattcttgtgcttttgggaggtgccaggggagggaagggctgggatgctgggacctgttgttgctggcaaagccagaggtcacagtggcctgatctgggccctcccaaagctgagggctgcagcccgtggggcctcagagctgaaagctgcggcgccactggtgccagagtcagatgtcacagatgtgttgtgtaaacagttggctgtttcatgcttcaagaatgttcaggattaaaagcagacaagaaattgtgctacttgaagttgaatctttttatgagacaagctgaatctgggatctcaaattgcctctgaccttttataagacagtttatcttcaaataaatttattttgcaataccacgc

SEQ ID NO: 203152 - DNA, 775 bp, Homo sapiens
  Payload ID: 20062
  Gene Name: zinc finger protein 598
  ENST ID: ENST00000567625
  CDS Start-End: 1-272
cacccacgccttccgcaccgagatcgacctcaaggcccacaggacggcctgccacagtcgcagccgcgccgaggcacgccagaaccgccacatcgacctgcagttcagctacgcgccacggcactcgcgccggaacgagggggtcgttggtggcgaagactacgaggaggtggacaggtacagccgccagggccgagtggcccgggctggcactcgcggagcccagcagagccgccgaggaagctggagggaagaagaggaccgagaagtagcagctgctgtccgggcctccgtggccgcacagcagcaggaggaggctcgcaggagtgaggatcaggaggaaggcggtaggcccaagaaggaggaggcagcggcgcggggacctgaggatccccgtggcccccggcgctcaccccggactcagggcgaaggcccaggccccaaggaaacctcgacaaatggtcctgtaagccaagaagccttctcggtgacaggcccagccgccccagggtgtgtgggggtgccaggcgccctcccaccacccagcccgaagctcaaggacgaagacttccccagcctctctgcctccacttcctcctcctgctccactgcagcaaccccgggccctgtggggttggcgctgccgtacgccatccctgccagaggcaggagtgccttccaggaggaggacttccccgccctggtgtcctcggtgcccaagcctggcaccgcccccaccagccttgtctctgcctggaacagcagcagtagcagc

SEQ ID NO: 203153 - DNA, 2717 bp, Homo sapiens
  Payload ID: 20062
  Gene Name: zinc finger protein 598
  ENST ID: ENST00000562103
  CDS Start-End: 168-2717
atggcggcggccggggggcgccgaggggcggcgcgcggacatggaggcggaggcggcggcagctcctgagcggggaggcgggagctgcgtgctgtgctgcggagacctggaggccacggcgctggggccgctgcgaccacccggtgtgctaccgctgctctaccaagatgcgggtgctctgcgagcagcgctactgcgccgtgtgccgcgaggagctgcgccaggtggtctttgggaagaagcttcctgcctttgccaccatccccatccaccagctgcagcatgagaagaaatatgatatctactttgcagatggaaaggtgtacgcattgtacaggcagctgctgcagcacgagtgcccgcggtgccccgagctgccacctttcagcctcttcggggacctggagcagcacatgcggaggcagcatgagctcttctgctgccgtctgtgcctccagcacctccagatcttcacatatgagcgcaagtggtactcgcgcaaggacctggcccggcatcgcatgcagggtgaccccgatgacacgtcgcaccgtgggcacccgctctgcaagttctgtgacgagcgctacctggacaatgatgagctgcttaagcacctgcgccgcgaccactacttctgccacttctgcgactcggacggggcccaggactactacagcgactatgcctacctgcgtgagcacttccgggagaagcactttctgtgtgaggaaggccgctgcagcacggagcagttcacccacgccttccgcaccgagatcgacctcaaggcccacaggacggcctgccacagtcgcagccgcgccgaggcacgccagaaccgccacatcgacctgcagttcagctacgcgccacggcactcgcgccggaacgagggggtcgttggtggcgaagactacgaggaggtggacaggtacagccgccagggccgagtggcccgggctggcactcgcggagcccagcagagccgccgaggaagctggaggtacaaaagggaagaagaggaccgagaagtagcagctgctgtccgggcctccgtggccgcacagcagcaggaggaggctcgcaggagtgaggatcaggaggaaggcggtaggcccaagaaggaggaggcagcggcgcggggacctgaggatccccgtggcccccggcgctcaccccggactcagggcgaaggcccaggccccaaggaaacctcgacaaatggtcctgtaagccaagaagccttctcggtgacaggcccagccgccccagggtgtgtgggggtgccaggcgccctcccaccacccagcccgaagctcaaggacgaagacttccccagcctctctgcctccacttcctcctcctgctccactgcagcaaccccgggccctgtggggttggcgctgccgtacgccatccctgccagaggcaggagtgccttccaggaggaggacttccccgccctggtgtcctcggtgcccaagcctggcaccgcccccaccagccttgtctctgcctggaacagcagcagtagcagcaagaaggtagcacagcccccactctcggcgcaggctaccggcagcggccagcccaccaggaaggctgggaaggggagcaggggcggcaggaagggcggcccgcccttcacacaggaggaggaggaggacggcggcccggccctgcaggagcttctgagcacacgccccacgggctccgtctcctccacactggggctggcctccatccaaccctctaaagttgggaagaagaagaaagtgggctcggagaagccaggcaccacattgccacagcccccgcccgctacctgtcccccaggggctttgcaggccccggaagctcctgccagcagagccgaggggccagttgccgtcgtcgttaatggacacatggagggcccggcccctgctcggagtgcccccaaggaaccccctgggctcccaaggcccctggggtccttcccctgccccacgccacaggaggacttcccagcgctcggcggcccctgcccaccccggatgccgccgcccccaggcttcagcgctgtggtgctcctgaagggcacgcctcccccacccccgccgggcctggtgcccccaatcagcaagccgccccctggcttctctggccttctgcctagcccccacccggcctgtgtccccagccccgccaccaccaccaccacaaaagcacccaggctgctgcctgccccacgggcgtacctagtccccgagaacttccgggagaggaaccttcagctcatccagtccatcagggacttcctgcagagcgacgaggcccgcttcagcgagttcaagagccactcaggggagttcagacagggcctgatctccgcagcccagtattacaagagttgccgggacctgctgggggagaatttccagaaggtctttaatgagctgctggtcctgctgcccgacacggccaagcagcaggagctcctgtctgcacacacggacttctgcaaccgcgagaagcctctgagcaccaagtccaagaagaacaagaagagcgcgtggcaggccaccacccagcaggcgggcctggactgccgtgtgtgccccacctgccagcaggtgctcgcgcatggcgatgccagcagccaccaggcgctgcatgctgcccgggacgacgacttcccctccctgcaagccatcgccaggatcatcacgtag

SEQ ID NO: 203154 - DNA, 3371 bp, Homo sapiens
  Payload ID: 20062
  Gene Name: zinc finger protein 598
  ENST ID: ENST00000563630
  CDS Start-End: 244-2793
ccggaaggggcgggcccgccgggagccaggccgctcggcgccacgaccggccgagaggggggccggatcccggaccatggcggcggccggggggcgccgaggggcggcgcgcggacatggaggcggaggcggcggcagctcctgagcggggaggcgggagctgcgtgctgtgctgcggagacctggaggccacggcgctggggccgctgcgaccacccggtgtgctaccgctgctctaccaagatgcgggtgctctgcgagcagcgctactgcgccgtgtgccgcgaggagctgcgccaggtggtctttgggaagaagcttcctgcctttgccaccatccccatccaccagctgcagcatgagaagaaatatgatatctactttgcagatggaaaggtgtacgcattgtacaggcagctgctgcagcacgagtgcccgcggtgccccgagctgccacctttcagcctcttcggggacctggagcagcacatgcggaggcagcatgagctcttctgctgccgtctgtgcctccagcacctccagatcttcacatatgagcgcaagtggtactcgcgcaaggacctggcccggcatcgcatgcagggtgaccccgatgacacgtcgcaccgtgggcacccgctctgcaagttctgtgacgagcgctacctggacaatgatgagctgcttaagcacctgcgccgcgaccactacttctgccacttctgcgactcggacggggcccaggactactacagcgactatgcctacctgcgtgagcacttccgggagaagcactttctgtgtgaggaaggccgctgcagcacggagcagttcacccacgccttccgcaccgagatcgacctcaaggcccacaggacggcctgccacagtcgcagccgcgccgaggcacgccagaaccgccacatcgacctgcagttcagctacgcgccacggcactcgcgccggaacgagggggtcgttggtggcgaagactacgaggaggtggacaggtacagccgccagggccgagtggcccgggctggcactcgcggagcccagcagagccgccgaggaagctggaggtacaaaagggaagaagaggaccgagaagtagcagctgctgtccgggcctccgtggccgcacagcagcaggaggaggctcgcaggagtgaggatcaggaggaaggcggtaggcccaagaaggaggaggcagcggcgcggggacctgaggatccccgtggcccccggcgctcaccccggactcagggcgaaggcccaggccccaaggaaacctcgacaaatggtcctgtaagccaagaagccttctcggtgacaggcccagccgccccagggtgtgtgggggtgccaggcgccctcccaccacccagcccgaagctcaaggacgaagacttccccagcctctctgcctccacttcctcctcctgctccactgcagcaaccccgggccctgtggggttggcgctgccgtacgccatccctgccagaggcaggagtgccttccaggaggaggacttccccgccctggtgtcctcggtgcccaagcctggcaccgcccccaccagccttgtctctgcctggaacagcagcagtagcagcaagaaggtagcacagcccccactctcggcgcaggctaccggcagcggccagcccaccaggaaggctgggaaggggagcaggggcggcaggaagggcggcccgcccttcacacaggaggaggaggaggacggcggcccggccctgcaggagcttctgagcacacgccccacgggctccgtctcctccacactggggctggcctccatccaaccctctaaagttgggaagaagaagaaagtgggctcggagaagccaggcaccacattgccacagcccccgcccgctacctgtcccccaggggctttgcaggccccggaagctcctgccagcagagccgaggggccagttgccgtcgtcgttaatggacacatggagggcccggcccctgctcggagtgcccccaaggaaccccctgggctcccaaggcccctggggtccttcccctgccccacgccacaggaggacttcccagcgctcggcggcccctgcccaccccggatgccgccgcccccaggcttcagcgctgtggtgctcctgaagggcacgcctcccccacccccgccgggcctggtgcccccaatcagcaagccgccccctggcttctctggccttctgcctagcccccacccggcctgtgtccccagccccgccaccaccaccaccacaaaagcacccaggctgctgcctgccccacgggcgtacctagtccccgagaacttccgggagaggaaccttcagctcatccagtccatcagggacttcctgcagagcgacgaggcccgcttcagcgagttcaagagccactcaggggagttcagacagggcctgatctccgcagcccagtattacaagagttgccgggacctgctgggggagaatttccagaaggtctttaatgagctgctggtcctgctgcccgacacggccaagcagcaggagctcctgtctgcacacacggacttctgcaaccgcgagaagcctctgagcaccaagtccaagaagaacaagaagagcgcgtggcaggccaccacccagcaggcgggcctggactgccgtgtgtgccccacctgccagcaggtgctcgcgcatggcgatgccagcagccaccaggcgctgcatgctgcccgggacgacgacttcccctccctgcaagccatcgccaggatcatcacgtagctcccgccagcgtggccagagctgtcgcaccgtgagcgtccttcctccttcctctccgggctgccaggcagccaggtaaggcctggtgaggccacttggcctcttggttggccaggcccaccaggaagtcaccaggacagtccacccgccctgttggcacactcaagcgggagtccacccctgcctcagtggtgggccagtctcggtttgcattcttgtgcttttgggaggtgccaggggagggaagggctgggatgctgggacctgttgttgctggcaaagccagaggtcacagtggcctgatctgggccctcccaaagctgagggctgcagcccgtggggcctcagagctgaaagctgcggcgccactggtgccagagtcagatgtcacagatgtgttgtgtaaacagttggctgtttcatgcttcaagaatgttcaggattaaaagcagacaagaaattgtgctacttgaagttgaatctttttatgagacaagctgaatctgggatctcaaattgcctctgaccttttataagacagtttatcttcaaataaatttattttgcaataccacgca

SEQ ID NO: 203155 - DNA, 889 bp, Homo sapiens
  Payload ID: 20062
  Gene Name: zinc finger protein 598
  ENST ID: ENST00000564556
  CDS Start-End: 1-611
tgcccaagcctggcaccgcccccaccagccttgtctctgcctggaacagcagcagtagcagcaagaaggtagcacagcccccactctcggcgcaggctaccggcagcggccagcccaccaggaaggctgggaaggggagcaggggcggcaggaagggcggcccgcccttcacacaggaggaggaggaggacggcggcccggccctgcaggagcttctgagcacacgccccacgggctccgtctcctccacactggggctggcctccatccaaccctctaaagttgggaagaagaagaaagtgggctcggagaagccaggcaccacattgccacagcccccgcccgctacctgtcccccaggggctttgcaggccccggaagctcctgccagcagagccgaggggccagttgccgtcgtcgttaatggacacatggagggcccggcccctgctcggagtgcccccaaggaaccccctgggctcccaaggcccctggggtccttcccctgccccacgccacaggaggacttcccagcgctcggcggcccctgcccaccccggatgccgccgcccccagacccaggctgctgcctgccccacgggcgtacctagtccccgagaacttccgggagaggaaccttcagctcatccagtccatcagggacttcctgcagagcgacgaggcccgcttcagcgagttcaagagccactcaggggagttcagacagggcctgatctccgcagcccagtattacaagagttgccgggacctgctgggggagaatttccagaaggtctttaatgagctgctggtcctgctgcccgacacggccaagcagcaggagctcctgtctgcacacacggacttctgcaaccgcgagaagcctctg

SEQ ID NO: 203156 - DNA, 3099 bp, Homo sapiens
  Payload ID: 20063
  Gene Name: zinc finger protein 599
  Uniprot ID: Q96NL3
  ENST ID: ENST00000329285
  CDS Start-End: 375-2141
cggcgtccagtcttcgtccgccgttaggttgcggctgctgtggttgccaacgctacactgggtagaacgccagacaggggccacttttcgagaccgagtagagacggacagtgaggaggataggacccacttacacgcttttatgtcagccgcgatcccacccccacaagcgtctgcaaaacccttcctggggccttggcgacagccctgtgtcctcacggcgcgcagaggcggcgccgcgaaccttgtgtgcattttacacgacggcggggactgaggtccctcgcagcccagagccggagcccggggtcggccgagcccgcaggaccggcttcctcgccgactctcacggcctcacccagccccctgggcccatggcggcgccggcgttggcattagtatcatttgaagacgtggttgtgaccttcactggagaggaatgggggcacctggacctggcccagaggaccctgtaccaggaggtgatgctggagacctgcaggctcctggtctcactggggcatcctgttcccaaaccagagctgatctatctactggaacatggacaggaactgtggacagtgaagagaggcctctcccaaagcacctgcgcaggtgaaaaagcaaaacccaagattacagagcctactgcttctcagctggccttctctgaggaatcctctttccaggaacttctggcacagagatcctcaagagattccaggttggggcaagctagagatgaggaaaagctaataaaaattcaggaagggaacttgaggccaggaacaaacccccacaaagagatatgccctgagaagttgagttataaacatgatgatttggagccagatgatagtctgggcttaagggttttacaggaacgagtcactccacaagatgctctccatgagtgtgactctcaaggaccaggaaaagaccccatgactgatgcaaggaataacccttacacatgcacggaatgtgggaaagggtttagcaagaagtgggcccttgttcggcatcaacagattcatgctggagtgaagccctatgagtgcaatgagtgtgggaaagcctgtcgttatatggctgatgtcattcgacatatgaggcttcatactggggaaaaaccatacaagtgtattgagtgtgggaaagccttcaaacgcaggtttcacctcacggagcaccagcgtattcacaccggagataagccctatgagtgcaaagaatgtggcaaagcattcacccaccgctcttcttttatccagcataatatgactcacactcgagaaaaaccctttttatgcaaagaatgtgggaaagctttttactacagctcctcatttgctcaacatatgaggattcatactggaaagaaactctatgagtgcggtgaatgtggaaaggccttcacgcaccgctccacatttatccagcacaatgtgacccacacaggagaaaaaccatttttatgtaaagaatgtggaaaaaccttttgcctcaactcatccttcactcagcacatgaggattcacactggagagaaaccctatgagtgcggtgaatgtggaaaggcctttactcatcgctccactttcatccgacataagaggacccataccggagagaagccctttgagtgcaaagaatgtgggaaggccttttgtgacagctcttccttaattcaacatatgaggattcacactggtgagaagccttatgagtgcagtgaatgtggaaaggcttttacacaccactctgtttttattcgacataataggacccacagtggacaaaaacccttggagtgcaaagaatgtgcaaaagccttttactatagctcttccttcactcgacacatgaggattcacactggagagaagccctatgtttgtagagaatgtggaaaggcttttacccaacctgcaaattttgttcggcataataggatccacactggagaaaaaccttttgaatgcaaagaatgtgagaaagccttctgtgacaactttgctttaactcagcacatgagaactcacactggagagaaaccctttgaatgcaatgaatgtggaaagaccttcagccacagttcatcgttcactcaccatcgaaagattcataccagagtttaaaagatacaggaaggcctattacaagtgtgtttgtctttagtgaactcatagtggtgacatacctttccttttgagtataactattgagggaaatattttggccagagagatgtcttagtatctgataatttatactaactagaaacagaattgtccctgtgaaatctttttatggcaggtaatcacttgtcatccaaagaattatattaaagattcacccagtttagagccttacactgtacctgagaataatcgaggggagagacctggtggttaacatgcatttaggtaaaatgtcaggaacaactttcctcttattaatactataaatccatctcaagcatattttaaaataatgagagatggaggaaacaatctagaagataaaagaaaaagatgtgcataacttgttttcagtttccctgtttatgacagtttgtcatttggcgggttgggggatggagcagggaataagacattgaaaaagtctcatcccctttgtgtgttttacatatatatatctctaagtccagagccaggagagttggaccattgagggcagctctgccaacatttagtaaaagtattcattgttccaaaactgtcatctctacccttgagggagtgtgtctttgtgagaaatataaaggcttgagtcatgaaatacttaacacatgtgcacatgtacacatgtacatttatatgcagtgaattgttactcgtggtagttaggttctgtgaattttctgtgcacactgaattagtgaatgctgaatgattgttgctaggggaaatacagcgttagcttctgtgagcctctgatccaaacatttttatcaaccagtcaacacataaccttcttctatgggtatttgtttgtttgtttgtttaaagacactttatcagtgtttcttgaataattataattattctttataataaaaatattttaattata

SEQ ID NO: 203157 - DNA, 948 bp, Homo sapiens
  Payload ID: 20063
  Gene Name: zinc finger protein 599
  ENST ID: ENST00000588760
  CDS Start-End: 360-608
gtccgccgttaggttgcggctgctgtggttgccaacgctacactgggtagaacgccagacaggggccacttttcgagaccgagtagagacggacagtgaggaggataggacccacttacacgcttttatgtcagccgcgatcccacccccacaagcgtctgcaaaacccttcctggggccttggcgacagccctgtgtcctcacggcgcgcagaggcggcgccgcgaaccttgtgtgcattttacacgacggcggggactgaggtccctcgcagcccagagccggagcccggggtcggccgagcccgcaggaccggcttcctcgccgactctcacggcctcacccagccccctgggcccatggcggcgccggcgttggcattagtatcatttgaagacgtggttgtgaccttcactggagaggaatgggggcacctggacctggcccagaggaccctgtaccaggaggtgatgctggagacctgcaggctcctggtctcactggggcatcctgttcccaaaccagagctgatctatctactggaacatggacaggaactgtggacagtgaagagaggcctctcccaaagcacctgcgcaggttggtgactgagagtctggcagcgggtatcagggcagcctgcagaccacccaggcatcactgtgtctgaaatgccatgggcagctattttgtggtcttgagcagtcatggagcccttgaccccatggtcccccgtcttcccacttctgtcacacactctttgcctttattcaggttggaatatgttaggtaggagacagattctaggctttaatgatttgccactcactagcctcatgactctggagaggttgtgtgacgtcactgtgcctttggtatataagttaggctgagttaatgaccttctctgaaaaataaactccaaaatcatgtgactcaacagattaa

SEQ ID NO: 203158 - DNA, 3476 bp, Homo sapiens
  Payload ID: 20063
  Gene Name: zinc finger protein 599
  Uniprot ID: Q96NL3
  ENST ID: ENST00000587354
  CDS Start-End: 389-676
gtgggcgggacttccggcgtccagtcttcgtccgccgttaggttgcggctgctgtggttgccaacgctacactgggtagaacgccagacaggggccacttttcgagaccgagtagagacggacagtgaggaggataggacccacttacacgcttttatgtcagccgcgatcccacccccacaagcgtctgcaaaacccttcctggggccttggcgacagccctgtgtcctcacggcgcgcagaggcggcgccgcgaaccttgtgtgcattttacacgacggcggggactgaggtccctcgcagcccagagccggagcccggggtcggccgagcccgcaggaccggcttcctcgccgactctcacggcctcacccagccccctgggcccatggcggcgccggcgttggcattagtatcatttgaagacgtggttgtgaccttcactggagaggaatgggggcacctggacctggcccagaggaccctgtaccaggaggtgatgctggagacctgcaggctcctggtctcactggggcatcctgttcccaaaccagagctgatctatctactggaacatggacaggaactgtggacagtgaagagaggcctctcccaaagcacctgcgcagcttccttctcacttctgtggaagagttatcatcctggccatggctaatttctccagcagaatctagattacactttctgccttctcaggtgtattagccatctactattaatatgtaacaatattaccacaaaccctgcagctgaaaacatcacttatttattatctcccacctatggattgggagtccaggcacagcttagctgggtcctctcaggcgtgtcataggcagctcatagctcatcatcaccatcagctcacttcttcaaatcaagccactgtgtgagactccagcaagacggatgttccagtcttataaaattacatatattttatcatgtacattccatcatctttgccatattctatactttagaagcaaatcgaggtcctgccaacattttaacaggggaactacaaaagggtgtgaacactatgacttggggatcatgagaagccatacgtgaatctctcagctgcatcagggaacatgcttcttcacttacttcctacctcttctatattttcatcccctctctactcaacattaaaaaaaaatgatgatgtttctgatacctgggggagacttttttttttttagtgctcttacgtctccagcagcatctacatattgttgactctatttcacctgaacagccaagcttgttggagaagtcttctcattctttgaagagacatctacacaagactttcctttatttattttttcccttatttttgtactgaggtgcaatttatacataataagtgtacaaatcataaagtttcatttctataaagttttatatatgtacaagtcagagaaaccatctcacagttcaagaaatacagtgttttcagcacttaacaggctccttgtgctcattctttgtcagtatccccttctataaaagtagtcagtgtttatactctatatcaccatacattagttttgaaggcatataaatagaaccccctagtacatactctgtcctgacttcttttgataatctttatgactcagattcattcatgtggttgcatatagttggagttagttcattaccatcattgaatgaatagactacatatacccattttcctattgatggacatttgacttggtctccatttttggaatattatgaagactactcttatgaatattcttgattgtattttttgttggatataaacccatatttctgttgggaatatacatacaagtggactggccagatcaagtgtgggcatatgattagctttaatcgaaaccaccagtttcagagtaactacaccatttcacatttccactagccacgtatgagagtcttcattgttccatgtacgcctgagcagttggtgtctttccctttactctttgatgcctggtagtggtgtttctcagcaccacagcacttaaagtgttcttgcccaggtcactgttgccatcctgattgctaaattcaactataatgataatagacagtggtctacagtttaccaaacatttattctttgtcacacgaatgaacttttgtttggtttttgggttttttttgagacaggatctcactctgtcgcctaggctagtgtgcagtggcacaatctcggctcactgcagcctctgcctcctgggttcaagtgattctcgtgcctcagcctcctgagtaactggaattacaggcatgcaccaccacacctggctgaattttttgtatttttagtagagatagggttttgctgtgttggccaggctggtaactcctggcctcaagtgatcttcctgcctcagcctcccaaagtgctgggattacaggtgtgagcccccacacccagccacaaatcaatattttgtatgctttttctcctaacaacttgtaggcaggaactgagagtatcccagtttttcagatgaggaaagtgaatcttagaaaagtgtgttagtctgctctggctgctgtaataaaatactatagactgcgtggcttatatagcagaaatgtgttttctctcaggtctagaggccgcaagtctaaggtcagggtaccagcattgttgggttctgataagggctgtcttctcagcttgcagatggccgccttctcactttgtgctcacatggccttccctcagtgccttcacttcttacaagaagtttaccatgttggccaggctggtcttgaactcccgaccttcagtgatccgcctgtcttggccttccaaagtgctgggattacaggcatgagccaccatgcctggcccccctctgactttcataattgtccctaggtgtgcagaattagaaaaattataaataatgatttatgacacattgtcatcattagtcaatgcgtgtcctggttttttgttttattttctttcattgcattttattaatatatttattcatcctcctttaaaaagattgtaatgaacacctacaaacctttcgccaagtacaagaacatgacctgcttcctgcatctgttgatgtgtttctttcctttcccattcctatgctgcctcccttgcatacatggccactttaagatttgttattccattgcttattctgtaggaagattcaggtttttttcataaatataggctattcagatgttctgtttttgtttgtccgttttggtaatttgagtaatgtaaaatatttgcctactttatctttgtcttcccattactttttaagattgtttcatctcataatggtaaattttgtattttatcacaataaaaagtcagaaaaatatatttaacatatctacatatctttttataatgccatttaaaactgataaacctcaaaaaaataaaaggttgttacattgta

SEQ ID NO: 203159 - DNA, 3829 bp, Homo sapiens
  Payload ID: 20064
  Gene Name: zinc finger protein 600
  Uniprot ID: Q6ZNG1
  ENST ID: ENST00000338230
  CDS Start-End: 269-2437
ggatcgcgtggagtgaaggtcctaccacggcgcgtgagttttgctctgccttggattaagtctgcacttcccaggtccccggcgcttctgcccctgggacgtgggatccccacggacctggaaattctcgcctgtcttcccttcacccagagcaaattgagacgtcccggattgattcctaaagactcatgttatgtgaagaagcagctcagaagaggaaaggaaaggagccaggcatggctcttcctcagatatctcttccaaacgcatgatgaaggaggtcttgtcaacagggcaaggcaatacagaagtgatccacacagggacattgcaaagatatcaaagttatcacattggagatttttgcttccaggaaattgagaaagaaattcatgatattgagtttcagtgtcaagaagatgaaagaaatggccatgaagcacccatgacaaaaataaaaaagttgactggtagcacagaccaacatgatcacaggcatgctggaaacaagcctattaaagatcagcttggatcaagcttttattcacatctgcctgaactccacataattcagatcaaaggtaaaattggtaatcaatttgagaagtctaccagtgatgctccctcggtttcaacatcccaaagaatttctcctaggccccaaatccatatttctaataactatgggaataattccccgaattcttcactactcccacaaaaacaggaagtatacatgagagaaaaatctttccaatgtaatgagagtggcaaagcctttaattgtagctcactcttaaggaaacaccagataccccatttaggagacaaacaatataaatgtgatgtatgtggcaagctctttaatcacaagcaataccttacatgccattgtagatgtcacactggagagaaaccttacaagtgtaatgagtgtggaaagtccttcagtcaggtatcatcccttacatgccatcgtagacttcacactgcagtaaaatctcacaagtgtaatgagtgtggcaagatctttggtcaaaattcagcccttgtaattcataaggcaattcatactggagaaaaaccttacaagtgtaatgaatgtgacaaagcttttaatcagcaatcaaaccttgcacgtcatcgtagaattcatactggagagaaaccttacaaatgtgaagaatgtgacaaagttttcagtcggaaatcaacccttgagtcacataagagaattcatactggagagaaaccatacaaatgtaaggtttgtgacacagctttcacatggaattctcagctggcaagacataaaagaattcacactggagagaaaacttacaagtgtaatgagtgtggcaagaccttcagtcacaagtcatcccttgtatgccatcatagacttcatggtggagagaaatcttacaaatgtaaggtctgtgacaaggcttttgcgtggaattcacacctggtaagacatactagaattcatagtggaggaaaaccttacaagtgtaatgaatgtgggaagacctttggtcaaaattcagatcttctaattcataagtcaattcatactggagagcaaccttacaaatatgaagaatgtgaaaaggttttcagttgtggatcaacccttgagacacataagataattcacaccggagagaaaccatacaaatgtaaggtttgtgacaaggcttttgcgtgtcattcctatctggcaaaacatactagaattcatagtggagagaaaccttacaagtgtaatgagtgcagcaagaccttccgtctgaggtcataccttgcaagccatcgcagagttcatagtggtgagaaaccttacaagtgtaatgagtgcagcaagaccttcagtcagaggtcataccttcattgccatcgtagacttcatagtggtgagaaaccttacaagtgtaatgagtgtggcaagaccttcagtcacaagccatcccttgttcaccatcgtagacttcatactggagagaaatcttacaaatgtacggtttgtgacaaggctttcgtgcgtaattcatacctggcaagacataccagaattcacactgcagagaaaccttacaagtgtaatgaatgtgggaaggcttttaatcaacaatcacaactttcacttcatcatagaattcatgctggggagaaactttacaaatgtgaaacatgtgacaaagttttcagtcgcaaatcacaccttaaaagacataggagaattcatcctggaaagaaaccatacaaatgtaaggtttgtgacaagacttttgggagtgattcacacctgaaacaacatactggacttcacactggagagaaaccttacaagtgtaatgagtgtggcaaagcctttagcaagcagtcaacacttattcaccatcaggcagttcatggtgtagggaaacttgactaatgtaatgattgtcacaaagtcttcagtaacgctacaaccattgcaaatcattggagaatctataatgaataaagatctaacaagtgtaataaatgtggcaaatttttcagacatcattcatacattgcagttcattgacacactcatactggagagaaaccttacaaatgtcatgactgtggcaaggtcttcagtcaagcttcatcctatgcaaaacataggagaattcatacaggagagaaacctcacatgtgtgatgattgtggcaaagcctttacttcatgttcacacctcattagacatcagagaatccctactggacagaaatcttacaaatgtcagaagtgtggcaaggtcttgagtccgaggtcactccttgcagaacatcagaaaattcatttttgagataactgttcccaatgcagtgagtatagcaaaccatcaagcattaattgacactagagtcagtccagcattgacttgagtttgtgttgacttaacattgagttcaacccttaattgacattcaagtgtttatgttaagaggattgggccaggtgtggtttctcacacctgtaattccagcacggttggaggccaaggcacataggtcacttgaggtcagaagtttgaaaccagcatggccaacagatgtcagccacttttcccagcctgttttttgattcttattttctatttttcttttttgagatagtactttttaaagagatagtacttttttgatatagtactttataaaagggagatcaggccaggcacggaggctcatgtaagtaatcccagcactttgggaggccgagacgggcccatgacaaggtcaggagatcgagaccgtcctggctaacacggtgaaaccccatctctactaaaaatataaaatattagccaggcgtggtggcaggtgcctgtagtcctagctgcttgggaggctgaggcaggagaatggtgtgaatcctggagacggagcttgcagggagccaacatcgtgccactgcactccggcctgggcgacagtgagaatctgtctcaaaaaaaaaaaaaaaaaaaggatatcaaagctggatggtggctcatccctgcaatcacaacactttggtagactgatgtgagtggatcacctaaggtcagaagttcaagagcaccctggctaacatggtgaaaccccatctctactaaaaatacaaaagttagccggggggtggtggtgtgcacctttagttccagctacttgagaggctgaggcacaagagtcgcttaaacctgggaggtagaggttgccgtgaggcaaaatcgtgccactgccctcagcctgggcagtagagtcagtctccatctcaaagaaaccagcaaacaaaaaatattaaaaaaaaa

SEQ ID NO: 203160 - DNA, 1787 bp, Homo sapiens
  Payload ID: 20064
  Gene Name: zinc finger protein 600
  ENST ID: ENST00000360272
  CDS Start-End: 47-1573
tgaggaagaaacccagaagaggaagaggaaagcaaaggagtcagggatggctcttcctcagggtctattgacattcagggacgtggccatagaattctctcaggaggagtggaaatgcctggaccctgctcagaggactctttacagggatgtgatgctggagaattataggaacctggtctccctggatatctcttccaaatgcatgatgaagacattcttctcaacagggcaaggcaatacagaagcgttccacacagggacattgcaaagacaagcaagtcatcacattggagatttttgcttccagaaaattgagaaagacattcatggcttccagtttcagtggaaagaagatgaaacaaatgaccatgcagcacccatgacagaaatcaaagagttgactggtagtacaggccaacatgatcaaaggcatgctggaaacaagcatattaaagatcagcttggattaagctttcattcgcatctgccaaaacatactataattcacactggagagaaaccttacaaatgtgaagaatgtgaaaaagttttcagtcgcaaatcacatcttgaaagacataagaggattcatactggagagaaaccatacaaatgtaaggtttgtgacaaggcttttgcatataattcatacctggcaaaacatagtataattcacactggagagaagccttacaagtgtaatgaatgtggcaaggtttttaatcaacaagcaaaccttgcatgtcatcatagagttcatactggagagaaaccttacaagtgtaatgagtgtggcaagaccttcagtcagatgtcaaaccttgtataccatcatagacttcatactggagagaaaccttacaaatgtaatgagtgtggcaagatctttggtcaaaattcagcccttgtaattcataaggcaattcatactggagaaaaaccttacaagtgtaatgaatgtgacaaagcttttaatcagcaatcaaaccttgcacgtcatcgtagaattcatactggagagaaaccttacaaatgtgaagaatgtgacaaagttttcagtcggaaatcaacccttgagtcacataagagaattcatactggagagaaaccatacaaatgtaaggtttgtgacaaggctttcgtgcgtaattcatacctggcaagacataccagaattcacactgcagagaaaccttacaagtgtaatgaatgtgggaaggcttttaatcaacaatcacaactttcacttcatcatagaattcatgctggggagaaactttacaaatgtgaaacatgtgacaaagttttcagtcgcaaatcacaccttaaaagacataggagaattcatacaggagagaaacctcacatgtgtgatgattgtggcaaagcctttacttcatgttcacacctcattagacatcagagaatccctactggacagaaatcttacaaatgtcagaagtgtggcaaggtcttgagtccgaggtcactccttgcagaacatcagaaaattcattttgataactgttcccaatgcagtgagtatagcaaaccatcaagcattaattgacactagagtcagtccagcattgacttgagtttgtgttgacttaacattgagttcaacccttaattgacattcaagtgtttatgttaagaggattgggccaggtgtggtttctcacacctgtaattccagcacggttggaggccaaggcacataggtcacttgaggtcagaagtttgaaaccagcatggccaacagatgtcagccacttttccca

SEQ ID NO: 203161 - DNA, 9340 bp, Homo sapiens
  Payload ID: 20065
  Gene Name: zinc finger protein 605
  Uniprot ID: Q86T29
  ENST ID: ENST00000360187
  CDS Start-End: 350-2275
gtagttctgcgcgttcacgtccccgatcgggccgtgtccgccgcggccctgcgaggtccgagggactcattctgatgaaggaaagagcgtccctgtgcagctgcgtgtccttcagttctttggctctgattccgtgtctggcttcatctaagtggcctggtccatgggcagtgaagaaatgtaaagtgcaatagccctctggaacaagacaattcatgtgagataagaaagaagagcccacaagaccaaggatgtattctcagtttacagaccactgaccagaggccactccagggtgtcaggactaagagaagtcacaaaacagcagatttcccaagagcagcggaaaatgatccagtcacagatatcatttgaggatgtggctgtggatttcacgctggaggaatggcagctacttaatcctactcagaagaacttgtacagagatgtgatgttggagaactatagcaatctggttttcttggaagtctggctagataatcccaaaatgtggctccgagataatcaagacaaccttaaaagtatggagagaggccataaatatgatgtttttggaaaaatatttaattcaagcataaacattgttcatgtaggactgcgatcccataaatgtggcacaggagaaaaaagtttgaaatgtccttttgatttgcttattccaaaaaataattgtgaaagaaagaaaattgatgaactcaataagaaattattgttctgtatcaaacctggcagaacccatggtgggataaaatactgtgattgcagtacatgtagaaaatccagcaacgaagagccatggctcactgctaatcacataacacacacaggagtctatttatgcatggaatgtggcagattttttaacaagaagtcacaacttgttatacaccagagaactcatacaggagagaagccctatcaatgcagtgagtgtggaaaagccttttcacagaagtcactgctcacggttcatcaaagaactcactcaggagaaaaaccgcatgggtgcagcgaatgtcagaaagcttttagtaggaagtcactcctcattttacatcagagaattcatactggagagaagccgtatggatgcagtgaatgtggaaaagccttcagtaggaagtcgcagcttaaaagacatcagataacgcacacaatagagaaaccctacagttgcagtgagtgtgggaaagcattctcccagaaattaaaactcatcacacatcagagagcgcacacaggagagaaaccctatccatgtagtcactgtggaaaagccttcttttggaagtcgcagctgattactcatcagaggacccacacagggaagaaaccttacggatgtggtgagtgtcaaaaagccttcagcaggaactcacttctcattaggcatcagaggattcatacaggagagaagccctacgaatgcaacgaatgtggtgaagccttcatcagaaaaccacagctgattaaacatcagataactcacacaggagagaagaactatcgatgcagtgattgtgaggaggccttctttaagaagtcagagttaataagacatcaaaaaattcacttaggagagaaaccatatggatgcattcaatgtgggaaaaccttctttgggaagtcccagctcctaacgcatcacagaacacacactggggagaagccttatgaatgcagtgagtgtgggaaggccttcacccagaagtcaagcctgatatcacatcagagaacacatacaggtgagaaaccctatgaatgcagtgaatgcaggaaaaccttcagtgagaagtcaagtctcattcatcatcagagaacccatactggagaaaagccctttgaatgtagtgaatgtaggaaagcttttgcctggaagccacagcttcttaggcatcagagaattcatacaggggagaaaccctatgaatgcagtgaatgtgggaaagcatttgttcagaaagtgcagctcattaagcatcaaagaaatcacacaggagagaaaacctatggatgcagcgattgtgcaaaagctttctttgagaaggcacagctgattatacatcagagaattcatacaggagagagaccatataaatgtggtgaatgtgggaaatctttcacaagaaagtcacaccttatgaggcatcagaggattcatacaggagataaatactatggatgcaatgagtgtgggaccaccttcaacaggaagtcgcagcttatgatacatcagagaaatcatataatataaaaatcatgactttggcgaatgcagaaaggttgctatcaagtgtcatactttctgacacttttgaggatgcatgtgggagagaaaccctattgaggcagtgactgttgaaaaagcttgaattgaggagtcaagagtcactaagcagaatttagaaagagaagtttttaaaaagcaaacagtgtaaaaaaagtcatctcccagaagacactactcgttacatattggatgactcattgaggtgaaaaccttattagtgttgtgatagtagagaagcttttagtcaaaagtcagtttattaaatgtttagaatacctaaacaggaagaaaattctattgttttttataacaaagtggaagatttcaagaaaggacaactcactgtacacttgagaataatacctacagaggttcatactgaagagtagtctcaataatgtaaagaatttgacaagcatgatgctattgaaatagttctgtaaggaagtggtgttctttatacatcaattattacaaaaagcagtgaattgtaagtgtgaggtgtgtttacttagatgtgaagagttctccttactgctgtgatggaataacaagggtcagatttcctctcctgccttaaacaactggaagctatacaatacgtataataggtaatggtttttagacataggacaagcacaggtttgtgatcctcaggagactgcagacagagtgaggtgagcaccatggtttctcagcctgcccccgcatggcagttcctaggttgcagttcagggaagggaaacaataaatctcgctgaattgaagagacaggactggcagttggggaggccacagcagctagaatttccaggggaaagtactggagagatgggatccttctagatacagggctcaagaagtctgctgggagtcccctgagtcctttgacttagtactgacttgcactgaggccaggaaaagaagcactggaaagcagcaggctgaacaattcctggaactcatgcagggctgggaatagtttatgttctcagcagccagagtggaaacagagtggaaacacatggagcatcaggtagaattctcagaaaggttttgttttagtagtgcagctaattaactctagattaaaagctactctggacctacagtgtccggcatccaaaaaaactaatgtgttatgcaaagaagcaataaaatatgacttataaccaggagaaaaatcagtagaaacccagaaaagacagaggtgatggaattagtagacaaggatattaaaagagctattgtaaatataaagtagaggaaaacataagattgatgaaacctgaggtataagagatatttttactggccaaaatggaacttctagggatgaaatcaacttctgattttgttaaaatcccgagtggagagattagatacagaaaaagaagaaaaaatcaatgaacttgaagagtaagaataaaaactaccaaagtgatatacagagagaaaaaaagacttagagaagaggaagagaataggaaaaccattacagtagtgtaatatatgtttaactggagtcccagaaggagaggagaaaatgaagaggcatgaagaagtatttgaataaataatggctaaagattttccaaatctggtgaaaacaatacccccacatattcaagaagctcaaatgacctgaagtagaataaacataatttacatcacagcagtgcacctcagagtcacattcatgaaaagcactgataaacagaatacttttaaaacaccttgagaaaaaaagataatacatacacatgaacaaagaatggcagcatatttctggtgagaactatgcaagctataagacaatggagtattatctctaaattccttaatgaaataaacaacaaaccctgcaacctagaattctgttactgtcaaaaacgttttcaaaaatgaaggcaaaataaagactgtttctgagaaactaaatcaaaggtaattttattacctgtagacctgtctttgggaaacattaaaggatgtttgagggcagcaggaaaataatacaaaacttaagtttgggtctgtacaaaggaatgaagttctgaaaatggtgaatatgtgggtaaatataaaagatatttctctctttttaaaatctttttaaaagggaattggctgcttaaagccaaagtaatgataacgtatttggagtttatttagaagtaaagtgtgatgacgataacacttaagtgtgaatttttaaatatagttgagtagactgcatcatctgagttagaagcctattccttcagggctcggggtagcttgaatttgtagcaggcacatgacagaaattgtatgtattgtggatctgcatgtgtgctgagtattccctatttctttgatcccttttcccccattttctgctctgctcccccctgaggctgtcttctagagactggggtttcttcataggtttgaacagtgggagataccagaggtgggaggagaaaaagttatttattaccgttcccttcctcctgcctggaccatggtagcttctgtgttcccgtaaggatacagcttcctttgggaagccccatctatggctgtagatctctcggtttcagttgacaccattccctctccatgatcttcagacttaactactactgggtgcttccccaacccactggttgggtgtctttaattgtgaacacatatttgtaaatagtgcctttattaattgttcttgagttaatattctgagtgtgccatttattttctgtgccatctgttaaatgatgagcatttaataaaattgtgataatcagttatcagtacaagtgccgcatagtgcataggctgaaatgtctcaagattccccacactacatatcagtattttctatctgtatctggacaatgcagtagaaattataacaaatacaaagttctttgtgcttttctgctgcatatgtcagtggctctggagattgttaccatctgctacatatataaatagacttgcagttattactaagctcctcttcagtaatagaaagacttatgaagtcttttactacctctgggttagccaaacaaccttcaaaaagcattgttatttaggttaaatatctgtggacaagaaacaagataatcagttactgagtgaagaaagacgggaatgatgtcccatacttcccagctctctaaagtgttatgctgtacaattaaaatacccctgacccatcatctgctaccattcgttgtggataattcatgtaatctctaacctgtgggcaagtctttacccttcagtagtcaagattacgttagagacttcgtccacgaatccacaccacctttcccatcagttctcaccggaaatatgctgccaaaaagaaaatcagcttttctaagatcaagccagagttgcttctcttacaaccttacggcgctaatgcattaagttgaagtcgactgccaaagaggcccagcagagggcagcacccccatcatttttttgaatttctcccttaggaattttgccttcctttgtcttctgtccaccaggccttctctccagctggacacaaacctcctttgaagggaaataattgccgttaggcttcacagtagtgctttttcctttcacttggatttgcattttaacctgcatttcgaagatttttatacatgttttctatttccgacaatgccaggaggcttcattgacgttgtagtctgtgttaataaacttgtgtatcactctgctctgatcttttaggaattaacttgcaaatgaaatgaatatgttgggactttggcataatttgaatatagcattgtgtgagttgtgattgtctcttcctaattgtgctgtaataacctgtgtatgagaataaaatgatttccaccatcaggattctcccatgcccccctttattttgccatagactaaaggggaaaggccattctcactctccttaccttagaaaattttatttgcctcatgatgactgtctgccgcttagaagtagacaatataaaatctcatcactatttcacaagaataaaattcaaatcagttatatccaaagtaacttttcaactgggggtggtgtctcacacctgtaatcccagtgcttggggaggccaaattgggaggaccgcttgagcccaggcgtttgagaccagctggacaacatagcaagactcatctctacaaaaaaaaaatttaattagccatgagaggctgggtgcagtgacgcaagcctgtaatcccagcactttgggaggccgaggtgggtggatcacctgagttcaggagttcgcgaccagcctgaataacatggtgaaaccccgtctctactaaatacaaaaaaattagccgggcatggtggcacatgcctgtaatccgagctacttgggaggctgagacaagagaatcacttgtacctgggaggaggaggttgcagtgagccgagatcacggcattgcactccagtctgggcaacaagaacaaaactccatctcaaaaaaaaagttagccatgatggtgcatgtctgtaatcccagctacttgggaagctgaggcagaagggtcacttgagcccaggagttcaaggctgcagtgagccatgatggggccactgcattccagcctgagtgacagagtgaaaccttgcctcttaaatgaataaaaataaagtaagctttcttcaacaagttttcttccaacgccacacactccatcaccatattaatttaaattatttagtatgtagcagatttactttgagaccaaatctgtgaagttggtgatgatatttaataattctttatttcccttatgggatctttgcaacttagaacacaattattactcattgtatccgggtcatttaacatcttgtcagaatgctaacattaaataaaccaggccaggcgcggtggctcacgcctgtaatcccagcactttgggaggccaaggcgggtggatcacgaggtcaggagatcgagaccatcctggctaacacggtgaaaccccgtctctactaaaaatacaaaaaattagccaggtgaggtggccagcgcctgtagtcccagctactcaggaggctgaggcaggagaatggcgtgaacctgggaggtggagcttgcagtgagccaagatcacaccactgcactccagcctgggtgatagagcgaggctctgtctcaaaaaaataaataaatcaggcgctgggcgcggtggctcacacctgtaatcataacactttgggaggctaaggcaggcagatcacaaggtcaggagttcgagaccagcctggccaatatggtgaaaccccatctctactaaaaatgcaaaaattagccgggcttggtggcacgtgtgtagtcccagctactccggaggctgaggcaggagaatcgcttgaacccaggaagccgatgttgcagtgagctgagatcacaccactgcactccagcctgggtgacagagcaagactccatcacacacacacacaaaaaaacagggaacaccaaacttatttagtgatacctaaatctcgaaatgtgcacagcaaaaagaatgtagctatcgaggcattcactgttaagatgaaaagaaatgtaagtgaagggacatttataacttgaagttctcatttaagaattactggccagggccgggcatggtggctcatgcctgtaatctcagcactttgggaggccaagatgggtggatcacgaggtcaggagattgagaccatcctggctaacaaggtgaaaccccgtctctactaaaaatacaaaaaattagccgcgcgtggtggcgggcgcctgtagtcccagctactcgggaggctgaggcaggagaatggcgtgaacccgggaggcggagcttgcagtgagctgagatcgcgccactgcactcactctggcctgagcgacaaagcgagactccatctcaaaaaaaaaaaaaaaaaaaaaaaaggcattactggccagatgtggtggctcatgcctgcaatcccaggactttgggaggcccagctgggaggagaggagagcttgagcccaagagtttgaggccagcctgggcaacatagtggcactttgttctccacaaaaataattaataaagcaagtaagcattcctatcactaaaagtacttaaaaaaacaaatcaagcttaaacttacaatagggggtgggagaagtgaattaactttttattttcattagtgcgtgctcatgtgaaaggagcagttaggcaatggagtgttaccactgcagccaggcaggtctagtgtagattcgtccccaaaccatggtatttgccaggcagctctgagggtatgaacaaggcatgtgcattgtgtcctgttgtgtgtaatgcgtttgtatgaagcagattctgtaagaagatgatgttggctgagatgtgggccagctgtacttcactgcttcattacaagggtaaggctggccaggtgcgatggctcacgcctgtcatcccagcactttgggaggccaaggtgggtggatcacttgagttcaggagctcaagagcagcctggccaacatggcaaaaccctatctctactaaacatacaaaacaaaaaaaatagccgggtgtggtggagcacctgtaaacccagctgctcgggaggctgaggtgggcaaatcacatgaacccaggagttggaggttgcagtgagccaagatggcaccaccactgcactccagcctgagcaacagagtgagactccgtctcaaaaaaagagaaaacaagggtggggctaaaaggctaatagctaactgaaaatgagcagctgtttttcattctgtgaggagcatcttgtataagccgtagtgtttgatccactcatcattgcatgggcagctgtgcgaggtcagacctgttactgacacttccttctgtgctctgtttgaaaagaaaatctctgtatgcaaatgttaactgagtaaactgtttcatgaattcatatgtgtgagtgtgatcactgggagcaatttgcaaataaactctggtttccattcc

SEQ ID NO: 203162 - DNA, 6156 bp, Homo sapiens
  Payload ID: 20065
  Gene Name: zinc finger protein 605
  Uniprot ID: Q86T29
  ENST ID: ENST00000392321
  CDS Start-End: 227-2245
gtagttctgcgcgttcacgtccccgatcgggccgtgtccgccgcggccctgcgaggtccgaggggcaatagccctctggaacaagacaattcatgtgagataagaaagaagagcccacaagaccaaggatgtattctcagtttacagaccactgaccagaggccactccagggtgtcaggactaagagaagtcacaaaacagcagatttcccaagagcagcggaaaatgatccagtcacagatatcatttgaggatgtggctgtggatttcacgctggaggaatggcagctacttaatcctactcagaagaacttgtacagagatgtgatgttggagaactatagcaatctggttttcttgggttttcaaattctcaaacctgatgcaatgttcaaactggaacaacaagatccatggataataggtcaagaaatcctaaatcagaacttttcagaagtctggctagataatcccaaaatgtggctccgagataatcaagacaaccttaaaagtatggagagaggccataaatatgatgtttttggaaaaatatttaattcaagcataaacattgttcatgtaggactgcgatcccataaatgtggcacaggagaaaaaagtttgaaatgtccttttgatttgcttattccaaaaaataattgtgaaagaaagaaaattgatgaactcaataagaaattattgttctgtatcaaacctggcagaacccatggtgggataaaatactgtgattgcagtacatgtagaaaatccagcaacgaagagccatggctcactgctaatcacataacacacacaggagtctatttatgcatggaatgtggcagattttttaacaagaagtcacaacttgttatacaccagagaactcatacaggagagaagccctatcaatgcagtgagtgtggaaaagccttttcacagaagtcactgctcacggttcatcaaagaactcactcaggagaaaaaccgcatgggtgcagcgaatgtcagaaagcttttagtaggaagtcactcctcattttacatcagagaattcatactggagagaagccgtatggatgcagtgaatgtggaaaagccttcagtaggaagtcgcagcttaaaagacatcagataacgcacacaatagagaaaccctacagttgcagtgagtgtgggaaagcattctcccagaaattaaaactcatcacacatcagagagcgcacacaggagagaaaccctatccatgtagtcactgtggaaaagccttcttttggaagtcgcagctgattactcatcagaggacccacacagggaagaaaccttacggatgtggtgagtgtcaaaaagccttcagcaggaactcacttctcattaggcatcagaggattcatacaggagagaagccctacgaatgcaacgaatgtggtgaagccttcatcagaaaaccacagctgattaaacatcagataactcacacaggagagaagaactatcgatgcagtgattgtgaggaggccttctttaagaagtcagagttaataagacatcaaaaaattcacttaggagagaaaccatatggatgcattcaatgtgggaaaaccttctttgggaagtcccagctcctaacgcatcacagaacacacactggggagaagccttatgaatgcagtgagtgtgggaaggccttcacccagaagtcaagcctgatatcacatcagagaacacatacaggtgagaaaccctatgaatgcagtgaatgcaggaaaaccttcagtgagaagtcaagtctcattcatcatcagagaacccatactggagaaaagccctttgaatgtagtgaatgtaggaaagcttttgcctggaagccacagcttcttaggcatcagagaattcatacaggggagaaaccctatgaatgcagtgaatgtgggaaagcatttgttcagaaagtgcagctcattaagcatcaaagaaatcacacaggagagaaaacctatggatgcagcgattgtgcaaaagctttctttgagaaggcacagctgattatacatcagagaattcatacaggagagagaccatataaatgtggtgaatgtgggaaatctttcacaagaaagtcacaccttatgaggcatcagaggattcatacaggagataaatactatggatgcaatgagtgtgggaccaccttcaacaggaagtcgcagcttatgatacatcagagaaatcatataatataaaaatcatgactttggcgaatgcagaaaggttgctatcaagtgtcatactttctgacacttttgaggatgcatgtgggagagaaaccctattgaggcagtgactgttgaaaaagcttgaattgaggagtcaagagtcactaagcagaatttagaaagagaagtttttaaaaagcaaacagtgtaaaaaaagtcatctcccagaagacactactcgttacatattggatgactcattgaggtgaaaaccttattagtgttgtgatagtagagaagcttttagtcaaaagtcagtttattaaatgtttagaatacctaaacaggaagaaaattctattgttttttataacaaagtggaagatttcaagaaaggacaactcactgtacacttgagaataatacctacagaggttcatactgaagagtagtctcaataatgtaaagaatttgacaagcatgatgctattgaaatagttctgtaaggaagtggtgttctttatacatcaattattacaaaaagcagtgaattgtaagtgtgaggtgtgtttacttagatgtgaagagttctccttactgctgtgatggaataacaagggtcagatttcctctcctgccttaaacaactggaagctatacaatacgtataataggtaatggtttttagacataggacaagcacaggtttgtgatcctcaggagactgcagacagagtgaggtgagcaccatggtttctcagcctgcccccgcatggcagttcctaggttgcagttcagggaagggaaacaataaatctcgctgaattgaagagacaggactggcagttggggaggccacagcagctagaatttccaggggaaagtactggagagatgggatccttctagatacagggctcaagaagtctgctgggagtcccctgagtcctttgacttagtactgacttgcactgaggccaggaaaagaagcactggaaagcagcaggctgaacaattcctggaactcatgcagggctgggaatagtttatgttctcagcagccagagtggaaacagagtggaaacacatggagcatcaggtagaattctcagaaaggttttgttttagtagtgcagctaattaactctagattaaaagctactctggacctacagtgtccggcatccaaaaaaactaatgtgttatgcaaagaagcaataaaatatgacttataaccaggagaaaaatcagtagaaacccagaaaagacagaggtgatggaattagtagacaaggatattaaaagagctattgtaaatataaagtagaggaaaacataagattgatgaaacctgaggtataagagatatttttactggccaaaatggaacttctagggatgaaatcaacttctgattttgttaaaatcccgagtggagagattagatacagaaaaagaagaaaaaatcaatgaacttgaagagtaagaataaaaactaccaaagtgatatacagagagaaaaaaagacttagagaagaggaagagaataggaaaaccattacagtagtgtaatatatgtttaactggagtcccagaaggagaggagaaaatgaagaggcatgaagaagtatttgaataaataatggctaaagattttccaaatctggtgaaaacaatacccccacatattcaagaagctcaaatgacctgaagtagaataaacataatttacatcacagcagtgcacctcagagtcacattcatgaaaagcactgataaacagaatacttttaaaacaccttgagaaaaaaagataatacatacacatgaacaaagaatggcagcatatttctggtgagaactatgcaagctataagacaatggagtattatctctaaattccttaatgaaataaacaacaaaccctgcaacctagaattctgttactgtcaaaaacgttttcaaaaatgaaggcaaaataaagactgtttctgagaaactaaatcaaaggtaattttattacctgtagacctgtctttgggaaacattaaaggatgtttgagggcagcaggaaaataatacaaaacttaagtttgggtctgtacaaaggaatgaagttctgaaaatggtgaatatgtgggtaaatataaaagatatttctctctttttaaaatctttttaaaagggaattggctgcttaaagccaaagtaatgataacgtatttggagtttatttagaagtaaagtgtgatgacgataacacttaagtgtgaatttttaaatatagttgagtagactgcatcatctgagttagaagcctattccttcagggctcggggtagcttgaatttgtagcaggcacatgacagaaattgtatgtattgtggatctgcatgtgtgctgagtattccctatttctttgatcccttttcccccattttctgctctgctcccccctgaggctgtcttctagagactggggtttcttcataggtttgaacagtgggagataccagaggtgggaggagaaaaagttatttattaccgttcccttcctcctgcctggaccatggtagcttctgtgttcccgtaaggatacagcttcctttgggaagccccatctatggctgtagatctctcggtttcagttgacaccattccctctccatgatcttcagacttaactactactgggtgcttccccaacccactggttgggtgtctttaattgtgaacacatatttgtaaatagtgcctttattaattgttcttgagttaatattctgagtgtgccatttattttctgtgccatctgttaaatgatgagcatttaataaaattgtgataatcagttatcagtacaagtgccgcatagtgcataggctgaaatgtctcaagattccccacactacatatcagtattttctatctgtatctggacaatgcagtagaaattataacaaatacaaagttctttgtgcttttctgctgcatatgtcagtggctctggagattgttaccatctgctacatatataaatagacttgcagttattactaagctcctcttcagtaatagaaagacttatgaagtcttttactacctctgggttagccaaacaaccttcaaaaagcattgttatttaggttaaatatctgtggacaagaaacaagataatcagttactgagtgaagaaagacgggaatgatgtcccatacttcccagctctctaaagtgttatgctgtacaattaaaatacccctgacccatcatctgctaccattcgttgtggataattcatgtaatctctaacctgtgggcaagtctttacccttcagtagtcaagattacgttagagacttcgtccacgaatccacaccacctttcccatcagttctcaccggaaatatgctgccaaaaagaaaatcagcttttctaagatcaagccagagttgcttctcttacaaccttacggcgctaatgcattaagttgaagtcgactgccaaagaggcccagcagagggcagcacccccatcatttttttgaatttctcccttaggaattttgccttcctttgtcttctgtccaccaggccttctctccagctggacacaaacctcctttgaagggaaataattgccgttaggcttcacagtagtgctttttcctttcacttggatttgcattttaacctgcatttcgaagatttttatacatgttttctatttccgacaatgccaggaggcttcattgacgttgtagtctgtgttaataaacttgtgtatcactctgctctgatcttttaggaattaacttgcaaatgaaatgaatatgttgggactttggcataatttgaatatagcattgtgtgagttgtgattgtctcttcctaattgtgctgtaataacctgtgtatgagaataaaatgatttccacc

SEQ ID NO: 203163 - DNA, 4248 bp, Homo sapiens
  Payload ID: 20066
  Gene Name: zinc finger protein 606
  Uniprot ID: Q8WXB4
  ENST ID: ENST00000341164
  CDS Start-End: 622-3000
gaggaaaactcacagggtgcgtcgctggtaacccatgctcccataaagcctggcctctggaaagagacttgggaacgagccctgacgttctcagccgtcgagcttcacagagaagggtagctcgaattaggttccttatcttaaagagaataacagcagtcactttctcacaatcttgcgaacgccaaatggaaggatccctcgagagcgctgagaactcgccgagctcctcccgggaaacccggtaccacgaggcgccattttgcggatgggcaaaccgaggcccgcggggccgcgacttacccaggcctttttgcagtgggaggcgacggtggaggagggtggtctgggaccgggacaacaaagtccatcctgccgccggcttcgacgcaggtgccagaaaggtcccaaccccgcccaggcagggcgaggcggcgcggcccaggaacctgtcatggcggcgccgctgcccgacgccggaagtgcccgcctggaactacagctcccagcagaccccgcggcgcgctccggtcgacgccggggaagcagccgccattgtccgcggctgaggttgggatttgctgtgttcctgggcaggtgcctggtcaatcagtcctcgggatggcagccatcaacccgtgggcctcctggggtgcccttacggaccaatcttgggggatgacagctgttgacccatgggcctcctgggctctgtgtcctcagtatcctgcctggcacgtggagggaagcctggaggaggggaggagggccactgggctcccagcagcccaggttcaggaaccagtgaccttcaaggacgtggccgtggacttcacccaagaagagtgggggcagctggaccttgttcagaggaccctgtaccgtgatgtgatgctggagacctatggtcacctgctctctgtgggaaatcagattgccaagcctgaggtcatctccctgttggagcaaggagaagagccgtggtcagtggagcaggcatgtcctcaacgcacttgtccagaatgggtgagaaatcttgaaagcaaagcattgatcccagcacagagcatttttgaggaagaacaatcccatggcatgaagttggaaagatatatatgggatgatccttggttctccaggttagaagttttgggatgtaaagaccaattagaaatgtaccacatgaaccagagtacagctatgaggcagatggtcttcatgcaaaagcaagtactatcccagagaagctctgaattctgtggacttggggcagagtttagccagaacttaaactttgttccatctcagagagtttctcagatagaacatttctataagcctgatacacatgctcaaagttggagatgtgactcagccataatgtatgcagataaggttacctgtgaaaataatgattatgacaaaactgtttatcagtccattcaacctatttaccctgcaagaatacaaactggagataatcttttcaaatgtactgatgctgttaaatctttcaatcatataatacattttggtgatcataaaggaattcacacaggagaaaaactctatgaatataaggaatgccatcaaatctttaaccagagcccatcatttaatgaacacccaaggcttcatgttggagaaaaccagtataattacaaagaatatgagaatatcttttatttctcatcctttatggaacatcaaaaaattggtactgtagagaaagcgtataaatacaatgaatgggagaaagtctttgggtatgactctttccttactcaacatacaagcacttacactgcagagaaaccctatgactacaatgaatgtgggacgtctttcatctggagctcttaccttattcaacataagaaaactcatactggagaaaaaccctatgaatgtgataaatgtggaaaagtttttaggaatcgctcagcccttacgaaacatgaacggactcacactggaataaaaccctatgaatgtaataaatgtggaaaagccttcagctggaattctcatcttattgtacataagagaattcatacaggagaaaaaccttatgtttgtaatgagtgtgggaaatctttcaactggaactctcatcttattggacatcagaggactcatacaggagagaaaccttttgaatgtactgaatgtgggaaatcattcagctggagctcccatcttattgcccatatgagaatgcatactggagagaaaccctttaaatgtgatgaatgtgaaaaagcttttagggactactcagcccttagtaaacatgaaagaactcattctggagcaaaaccatataaatgtactgaatgtggaaaatccttcagctggagctcccatcttattgcccatcagagaactcacacgggagagaaaccatataactgtcaggaatgtggcaaagcattcagagaacgctcagccctcactaaacatgagataattcattctggaattaagccctatgaatgtaataaatgtggaaaatcctgtagccagatggctcaccttgttagacatcaaaggactcatactggagaaaaaccctatgaatgcaataaatgtggaaaatccttcagtcagagctgtcaccttgttgctcatcggagaattcacactggtgagaaaccctataaatgtaatcagtgtgaaagatcctttaactgtagttctcacctcattgcacaccggagaactcatactggagagaaaccatacaggtgtaatgaatgtgggaaagcatttaatgagagttcatcccttattgtacacctaagaaaccatactggagaaaagccctacaaatgtaatcattgtgaaaaagcattttgtaagaattcttcccttattattcatcagagaatgcatagtggagagaaacgctttatatgcagtgaatgtggaaaagcctttagtggtcactcagccctacttcaacaccagagaaatcacagtgaagagaaactgaattgaatttatgcgagtttttcgtttcttgtacatttgacaacacattgaggaaaaccctataaacataatcaagaggggacatttttcattaagagttcagtaagacttctcccacattatttactagaaaatatcatcttagaagaaaccccatgaaggaaaagaatagggaaaagctttcagcagttatttagcccttactcaaaatcagataattaacaatgaaggaaactctaaactccccttatggtctaccagtaattcatacttgaggaccatgactgtggggaatgaggcatcttttagcaagagctctcaccaattgtagattggtgtgaattgctaagggaaaaaccttatgcagagaaaagtttttgactggaaatacactgttttgcatcaagctggagtactggatggaaaactctacaataacattttgtgcataattgtagaaatacagattttgttgttataaggggagggtctgggtgcccaggagtagaatatgaagtgctaaatctgaatgtaagaaaaataatagtattgaatggggtatttactgttgattaacctccttagagaaaattaatgaatgagatgactaacggtagaaaagttattgcctaggagtgtgagactgatgttgctggacagaaagtgatccttagcccagtgtgtcagcgtccattgttactcatcactgcattgttgggcaattagtttgtaatttgttttaggcaatcactataaattataattatggacactgcatcagtatacataacatgaaggaataaaaaggatacagaattgtatatacatacttactgtaacacatctaaaaaaatgtatatgggtaaggacctgaaagatccatggaaaagttaacccagttgagatttttaaaaagttttacaaatacatataacacttatgtgctgggctttcttttaaatgctttccaagtgttaacttgtttagtcccctttactctgagataggtactgttaccccagttttacaaatggctaagctgaagcagagatgttgaaggatcctacctaaggggcacaactagtaagggagtagagctgagattggctccagagttcttgttttcagccaccattttatgctgcctctccagtgattttttttcccattttcttcagtgtttctatagcagagatttgataataaaaagaaaatcctaaacaatgagaaataaagttacctggtttctctgtc

SEQ ID NO: 203164 - DNA, 2680 bp, Homo sapiens
  Payload ID: 20066
  Gene Name: zinc finger protein 606
  ENST ID: ENST00000547828
  CDS Start-End: 92-301
gtcgacgccggggaagcagccgccattgtccgcggctgaggttgggatttgctgtgttcctgggcaggtgcctggtcaatcagtcctcgggatggcagccatcaacccgtgggcctcctggggtgcccttacggaccaatcttgggggatgacagctgttgacccatgggcctcctgggctctgtgtcctcagtatcctgcctggcacgtggagggaagcctggaggaggggaggagggccactgggctcccagcagcccaggttcaggtgagatggggctgtcctgttcccagaggatgatgtccaggttatccctggtcatcccagttgatgcggctctccagtttacaacagttggagtttgggtagggaaggaagcaactggaagttaatccttcctgagagcaggtagggagaattaggccgtttttagtgattcggagccttagtgtcaaccagtctgtccacagtactgagctccaactctccctggcttgttgtggggcatgaagggcagcccttttggctggcagccccacttctctattgccaccttcactcatgtctttagcacccgatttaggctgatgctgtgcagtgcctgctgtgcctgctgtgaagggaacaaggacaggtgtgagccttcaccctgaggagctcccagacccttttccagggttattcactcagctaaggagatctcacggcctacctggagccacacgtgcagtgtgggacaggagaaacctgagacgggtagggtaggcctgcaggagcacagtcacctgatgagtcgggagatgggacagagtctgtgtggagctcagcttttactgtggaggggaaggctgcttcgtagacctgggccaagaggtgaaaagaatgcatcagccagttgggcacagcctggtgagtgggggtctggcctcctgcagcaccacaggggtcaggggtggcaggcagcacactgtgtgaccagtgtttgagtgagactgactccagttagattttaggctggagaggccaggccctgaatgcttgctgcagaacctcagaagtcttgggatcaggcggcaccagggtccaaaatgtggtgatgggtgtggaaagaagagggctgtgggaagcaggctggtgtttcaggcttcagtctgaccagggccttggagctatggaggagaggtataaggaaatcaaagcaggggcctttgtgattatggggacagggtggctcctgagagaaataggacaatggagttacttaggaaaggtgtcatctctctgccgtcctcctgcccagcctcctcaccagatgcagccacttaaaaaaatttttataatagctttattgagatggtactgacatattataaagtttatccttttaaagtgtgtaattcagtggtttctcgtatagtcacagaattgtgcaacaatcaccagtatctaattctagaacattttcatcaccctaaaaagaaatcctgtacccattagtagtcactccctgtttcccctactccctcccaaccactagtgtactttctgtctctatgaatttgcctagtctggacatttcataaaaatggaatcataatatggcacagccttttttgtctggcttttttcacttagcataatgtttgccttctcaagagttacccatattgtagcattgtgtcaatatttcttttaatgtaatgtaattacaatgtaaatgtaataagtgtaattacaatgtaattacattgtaaaaaatgactgaggcagccatttttaacttcctgttttcagttttttagagttgtctctgtatttctaaatgggagattttttaaattggttttttcctaattcattaaagttatatttactctgttaactccctgctatgaaagatgaagaaaaagagtttcattacttatttttaggtcttttatttttaagttaagataatgaatcaagcagatgtgagatacttggatataaaacaagatttaaaaatgatgtctctactttgtgcctccccctcaaattaaaaaatattattgaaaccgcccacagtttcaaatctggtgggtgaagtccatcataagtatgctgttcccacttggcagtgttgctatccctggtccaggtgagatgggaagcagaagggcctgaaccatatgatgcaaggtgattgttgcctggcatcagaacttgggcaactatgaggtttgctgctcttacaatgtacagtcattattaaatcctaagacagaataatcagtagtgaagctagactagcctgaaagatggcccctgaatcagactctgaggagtagaagttagctgtaataaaacactgcgaagaagccctgttaaccaccatgctacactctgctgttaatttatgctaggctttctgagaattatctaagttaatgctgagaaaataaaacagaattaaaaataacaacaccctccaatgtctgaagagttgtgatttctgataacatgctcctggctggcccccctccccacactctggattttttcctgtgggaaactcggatttgactgctgtgtgtttttaactaagtgagatcttcaggaatgcaaaagaaccctgtgtccctttattgttccctccaagttaagtatttattgaaataaagcatttatctggtgaaaaca

SEQ ID NO: 203165 - DNA, 2417 bp, Homo sapiens
  Payload ID: 20066
  Gene Name: zinc finger protein 606
  ENST ID: ENST00000550599
  CDS Start-End: 92-268
gtcgacgccggggaagcagccgccattgtccgcggctgaggttgggatttgctgtgttcctgggcaggtgcctggtcaatcagtcctcgggatggcagccatcaacccgtgggcctcctggggtgcccttacggaccaatcttgggggatgacagctgttgacccatgggcctcctggggaaccagtgaccttcaaggacgtggccgtggacttcacccaagaagagtgggggcagctggaccttgttcagaggaccctgtaccgtgatgtgatgctggagacctatggtcacctgctctctgtgggaaatcagattgccaagcctgaggtcatctccctgttggagcaaggagaagagccgtggtcagtggagcaggcatgtcctcaacgcacttgtccagaatgggtgagaaatcttgaaagcaaagcattgatcccagcacagagcatttttgaggaagaacaatcccatggcatgaagttggaaagatatatatgggatgatccttggttctccaggttagaagttttgggatgtaaagaccaattagaaatgtaccacatgaaccagagtacagctatgaggcagatggtcttcatgcaaaagcaagtactatcccagagaagctctgaattctgtggacttggggcagagtttagccagaacttaaactttgttccatctcagagagtttctcagatagaacatttctataagcctgatacacatgctcaaagttggagatgtgactcagccataatgtatgcagataaggttacctgtgaaaataatgattatgacaaaactgtttatcagtccattcaacctatttaccctgcaagaatacaaactggagataatcttttcaaatgtactgatgctgttaaatctttcaatcatataatacattttggtgatcataaaggaattcacacaggagaaaaactctatgaatataaggaatgccatcaaatctttaaccagagcccatcatttaatgaacacccaaggcttcatgttggagaaaaccagtataattacaaagaatatgagaatatcttttatttctcatcctttatggaacatcaaaaaattggtactgtagagaaagcgtataaatacaatgaatgggagaaagtctttgggtatgactctttccttactcaacatacaagcacttacactgcagagaaaccctatgactacaatgaatgtgggacgtctttcatctggagctcttaccttattcaacataagaaaactcatactggagaaaaaccctatgaatgtgataaatgtggaaaagtttttaggaatcgctcagcccttacgaaacatgaacggactcacactggaataaaaccctatgaatgtaataaatgtggaaaagccttcagctggaattctcatcttattgtacataagagaattcatacaggagaaaaaccttatgtttgtaatgagtgtgggaaatctttcaactggaactctcatcttattggacatcagaggactcatacaggagagaaaccttttgaatgtactgaatgtgggaaatcattcagctggagctcccatcttattgcccatatgagaatgcatactggagagaaaccctttaaatgtgatgaatgtgaaaaagcttttagggactactcagcccttagtaaacatgaaagaactcattctggagcaaaaccatataaatgtactgaatgtggaaaatccttcagctggagctcccatcttattgcccatcagagaactcacacgggagagaaaccatataactgtcaggaatgtggcaaagcattcagagaacgctcagccctcactaaacatgagataattcattctggaattaagccctatgaatgtaataaatgtggaaaatcctgtagccagatggctcaccttgttagacatcaaaggactcatactggagaaaaaccctatgaatgcaataaatgtggaaaatccttcagtcagagctgtcaccttgttgctcatcggagaattcacactggtgagaaaccctataaatgtaatcagtgtgaaagatcctttaactgtagttctcacctcattgcacaccggagaactcatactggagagaaaccatacaggtgtaatgaatgtgggaaagcatttaatgagagttcatcccttattgtacacctaagaaaccatactggagaaaagccctacaaatgtaatcattgtgaaaaagcattttgtaagaattcttcccttattattcatcagagaatgcatagtggagagaaacgctttatatgcagtgaatgtggaaaagcctttagtggtcactcagccctacttcaacaccagagaaatcacagtgaagagaaactgaattgaatttatgcgagtttttcgtttcttgtacatttgaca

SEQ ID NO: 203166 - DNA, 2009 bp, Homo sapiens
  Payload ID: 20066
  Gene Name: zinc finger protein 606
  ENST ID: ENST00000551380
  CDS Start-End: 484-2009
gcgctccggtcgacgccggggaagcagccgccattgtccgcggctgaggtgaggcctttgctcaggctgtggggccgccgtagctgcggggcttggggggtcaggagagccggctgggagaggcggcgtcagggtgggtcctgcgcctgccctttccgcgccggctttgcgccgtcgttgccgtcggttctccagccagcagcctgcctccggcctcccgcctccgggcgttcttcgttttctggtcggacgggcctgggtgaactctgctgcacgtcggctccgcgggcctttgtccccgaggccgcgccgggagctcccaagcgcactcctgggccggacctcggcgcgggacaaaagccaaacgccccaggcgggcagaccccgatcctgctgcgccgccttcaagggggaccgccggccgcgagccaggttgggatttgctgtgttcctgggcaggtgcctggtcaatcagtcctcgggatggcagccatcaacccgtgggcctcctggggtgcccttacggaccaatcttgggggatgacagctgttgacccatgggcctcctgggctctgtgtcctcagtatcctgcctggcacgtggagggaagcctggaggaggggaggagggccactgggctcccagcagcccaggttcaggaaccagtgaccttcaaggacgtggccgtggacttcacccaagaagagtgggggcagctggaccttgttcagaggaccctgtaccgtgatgtgatgctggagacctatggtcacctgctctctgtgggaaatcagattgccaagcctgaggtcatctccctgttggagcaaggagaagagccgtggtcagtggagcaggcatgtcctcaacgcacttgtccagaatgggtgagaaatcttgaaagcaaagcattgatcccagcacagagcatttttgaggaagaacaatcccatggcatgaagttggaaagatatatatgggatgatccttggttctccaggttagaagttttgggatgtaaagaccaattagaaatgtaccacatgaaccagagtacagctatgaggcagatggtcttcatgcaaaagcaagtactatcccagagaagctctgaattctgtggacttggggcagagtttagccagaacttaaactttgttccatctcagagagtttctcagatagaacatttctataagcctgatacacatgctcaaagttggagatgtgactcagccataatgtatgcagataaggttacctgtgaaaataatgattatgacaaaactgtttatcagtccattcaacctatttaccctgcaagaatacaaactggagataatcttttcaaatgtactgatgctgttaaatctttcaatcatataatacattttggtgatcataaaggaattcacacaggagaaaaactctatgaatataaggaatgccatcaaatctttaaccagagcccatcatttaatgaacacccaaggcttcatgttggagaaaaccagtataattacaaagaatatgagaatatcttttatttctcatcctttatggaacatcaaaaaattggtactgtagagaaagcgtataaatacaatgaatgggagaaagtctttgggtatgactctttccttactcaacatacaagcacttacactgcagagaaaccctatgactacaatgaatgtgggacgtctttcatctggagctcttaccttattcaacataagaaaactcatactggagaaaaaccctatgaatgtgataaatgtggaaaagtttttaggaatcgctcagcccttacgaaacatgaacggactcacactggaataaaaccctatgaatgtaataaatgtggaaaagccttcagctggaattctcatcttattgtacataagagaattcatacaggagaaaaaccttatgtttgtaatgagtgtgggaaatctttcaactggaactctcatcttattggacatcagaggactcatacaggaga

SEQ ID NO: 203167 - DNA, 651 bp, Homo sapiens
  Payload ID: 20066
  Gene Name: zinc finger protein 606
  ENST ID: ENST00000552184
  CDS Start-End: 452-651
attgtccgcggctgaggtgaggcctttgctcaggctgtggggccgccgtagctgcggggcttggggggtcaggagagccggctgggagaggcggcgtcagggtgggtcctgcgcctgccctttccgcgccggctttgcgccgtcgttgccgtcggttctccagccagcagcctgcctccggcctcccgcctccgggcgttcttcgttttctggtcggacgggcctgggtgaactctgctgcacgtcggctccgcgggcctttgtccccgaggccgcgccgggagctcccaagcgcactcctgggccggacctcggcgcgggacaaaagccaaacgccccaggcgggcagaccccgatcctgctgcgccgccttcaagggggaccgccggccgcgagccaggttgggatttgctgtgttcctgggcaggtgcctggtcaatcagtcctcgggatggcagccatcaacccgtgggcctcctggggtgcccttacggaccaatcttgggggatgacagctgttgacccatgggcctcctggggtgagtcaagagcctggtcagctgtgggctgccatattgtggcctctggctgtagtgctctgccacagctggggaatagaatggggaccaggtggggctttagggcaggtgg

SEQ ID NO: 203168 - DNA, 636 bp, Homo sapiens
  Payload ID: 20066
  Gene Name: zinc finger protein 606
  ENST ID: ENST00000546715
  CDS Start-End: 90-356
cgacgccggggaagcagccgccattgtccgcggctgaggttgggatttgctgtgttcctgggcaggtgcctggtcaatcagtcctcgggatggcagccatcaacccgtgggcctcctggggtgcccttacggaccaatcttgggggatgacagctgttgacccatgggcctcctggggtgagtcaagagcctggtcagctgtgggctgccatattgtggcctctggctgtagtgctctgccacagctggggaatagaatggggaccaggtggggctttagggcaggtggtccagatctgtctctgtgcagagctggaacaaggaggaatcagaaaactagtggccaggcgtggtgactcacgcctacagcactttgggaggccgaggcgagtggatcacgaggtcaggagatcgagaccatcctggctaacacggtgaaaccccgtctctactaaaacaaaatacaaaaaattagctgggcgtggtggtgggcgcctgtagtcccagctgctcgggaggctgaggcaggagaatggcgtgaagccaggaggcggagcgtgcagtgagccaagatcgtgccactgcactccagcctgggcgacagagcgagactcagtctcaaaaaaaaaaagaaaa

SEQ ID NO: 203169 - DNA, 1196 bp, Homo sapiens
  Payload ID: 20066
  Gene Name: zinc finger protein 606
  ENST ID: ENST00000547121
  CDS Start-End: 476-685
gtcgacgccggggaagcagccgccattgtccgcggctgaggtgaggcctttgctcaggctgtggggccgccgtagctgcggggcttggggggtcaggagagccggctgggagaggcggcgtcagggtgggtcctgcgcctgccctttccgcgccggctttgcgccgtcgttgccgtcggttctccagccagcagcctgcctccggcctcccgcctccgggcgttcttcgttttctggtcggacgggcctgggtgaactctgctgcacgtcggctccgcgggcctttgtccccgaggccgcgccgggagctcccaagcgcactcctgggccggacctcggcgcgggacaaaagccaaacgccccaggcgggcagaccccgatcctgctgcgccgccttcaagggggaccgccggccgcgagccaggttgggatttgctgtgttcctgggcaggtgcctggtcaatcagtcctcgggatggcagccatcaacccgtgggcctcctggggtgcccttacggaccaatcttgggggatgacagctgttgacccatgggcctcctgggctctgtgtcctcagtatcctgcctggcacgtggagggaagcctggaggaggggaggagggccactgggctcccagcagcccaggttcaggtgagatggggctgtcctgttcccagaggatgatgtccaggttatccctggtcatcccagttgatgcggctctccagtttacaacagttggagtttgggtagggaaggaagcaactggaagttaatccttcctgagagcaggtagggagaattaggccgtttttagtgattcggagccttagtgtcaaccagtctgtccacagtactgagctccaactctccctggcttgttgtggggcatgaagggcagcccttttggctggcagccccacttctctattgccaccttcactcatgtctttagcacccgatttaggctgatgctgtgcagtgcctgctgtgcctgctgtgaagggaacaaggacaggtgtgagccttcaccctgaggagctcccagacccttttccagggttattcactcagctaaggagatctcacggcctacctggagccacacgtgcagtgtgggacaggagaaacctgagacgggtagggtaggcctgcaggagcacagtcacctgatgagtcgggagatgggacagag

SEQ ID NO: 203170 - DNA, 4364 bp, Homo sapiens
  Payload ID: 20067
  Gene Name: zinc finger protein 607
  Uniprot ID: Q96SK3
  ENST ID: ENST00000355202
  CDS Start-End: 597-2687
gatctgcgcatgcgcactcgaggcaaggcggccactcccagaagtctccggggctcgagcggtgggtgggaggcgcggtccaagtggtcgctgccgtatttctcgtaggtttttaggattctggactccatttctcaccggtacctgcggtcctgactgttctggcttggactacatattacaaaggcaacggagaaaacttggacccctggctccggttccgggaccttttggttccacctgaagaaggcggcgcaggtcactgcgggagcctctgcagccccagcccgccgcccgcgtggtaccctgcgtggcggtgagagtggggctgcaggaggcgctcagagcgcggaggcccccaggcgggccgggcgagtctcccgcctcctcaggccctagggtgctggagctgcggaggaggggcccgtctctaggagacaggcggggagcgtgagagaccgcgcagcggcgacaggaccggcttgcctgtgtgacgtgggtgcagttgcgggactgtgaggggtcttggttcttttgactttgctcttctggtagagaaacgccaaggactgatcaactcttgccagtctcaaaccatgtcctatggatcaataacattcggggatgtggccatagacttctctcatcaggagtgggaatatctcagcctggttcagaagaccttgtaccaggaggtgatgatggagaactatgacaacttagtctcattggcaggacattccgtatctaagccagatttaatcaccttattggagcaaggaaaagagccatggatgattgtgagggaagaaacaagaggagagtgtacagatttggattcaagatgtgaaataatcagcgatgggaaaatgcagctttataggaaacactcatgtgttactctccatcagagaattcataatggacagaaaccatatgagtgtaagcaatgtcagaagtcctttagtcatcttacagaactcatggtacatcaaacaattcatactagtgaggaacctgatcaatgtgaaaagtttaggaaggcatttagccatcttacagaccttagaaagcatcagaaaattaatgctcgtgagaaaccttatgaatgtgaagaatgtgggaaggtcttcagttatcctgcaaaccttgctcaacatgggaaagttcatgttgagaaaccctatgaatgtaaagagtgtggggaagcttttaggactagccgtcaacttactgtacatcatagatttcattatggtgagaaaccctacgaatgtaaggaatgtggcaaggcctttagtgtgtatggacgacttagtcgacatcagagtattcacactggtgagaagccctttgaatgtaacaaatgtgggaagtcctttaggctcaaagcaggccttaaagtacatcagagtattcatactggagagaagccacatgaatgtaaggaatgtggaaaggcctttcgtcagttttcccaccttgtgggtcataaaagaattcatactggagaaaaaccctatgaatgcaaggaatgcgggaagggctttacatgtaggtatcaacttaccatgcatcagagaatttattcaggggagaaacactatgaatgtaaagaaaatggggaggcttttagtagtggccatcaacttactgcacctcatacatttgaaagtgttgagaaaccttataagtgtgaggaatgtgggaaagcctttagtgtgcatggacgacttactcgacatcagggtattcatagtggtaagaaaccctatgaatgtaacaaatgtgggaagtcctttaggctcaattcatcccttaaaatacatcaaaatattcataccggtgagaaaccctacaaatgtaaggaatgtgggaaggccttcagtcagcgtgcacaccttgcccatcataacagaattcatactggttacaaaccctttgaatgtaaagaatgtgggaagtcctttcgttgtgcctcatatcttgttatacatgagagaattcatacaggagagaaaccctatgtatgtcaagagtgtgggaagggttttagttatagccataaactcactatacatcgcagagttcatactggtgagaaaccttatgaatgtaaggaatgtgggaaggcctttagtgtatctggacaacttactcagcatctgagtattcacagtggtaagaaaccctttgaatgcaacaaatgcgggaagtcttttaggttcatttctgtacttaaagcccatcagaatattcatagcgctgagaaaccctacgaatgtaaggaatgtggcaaggcctttcgtcatgccacaagcctcatatatcatgaccgaactcatgctggtgaaaagtcctatgaatgtaaagaatgtggggaaacttttagtcatgcttcacatcttattattcatgagagaattcataccagtgataaaccctatgaatgtaaaagatgtgggaaggcatttcactgtgcctcatatcttgttagacatgaaagcgttcatgctgatggaaatccctatatgtgtgaagagtgtgggaaagcttttaatagtagccatgaacttagtatacatcatagagttcatactggtgagaaaccctttaaatgtaacaaatgcagaaggtcctttaggcttagatccatccttgaagtacatcagagaattcatatttgatagagaaattgtggcatatacaggtagtaaagaaagcacattgtgtcaatggatttatcccactgaacaatttgaatgaagacaatgtggaatggctttgagatacagttcagtttttattaggcatcaatttgtattggtgtgaacttttcaaaatgtaaatcatatatgcagtttctttggtatgacctgtgttaactcagattcagagaatttataatgtatttttttaataacataagaaaacttttctgatattcctctagttttggattgccaaaatattcacagtagaggaaaactgagaaaacgtaggaaaccattctttatacttgcatgtaaacatcttccagcaacaatcatttattgttaaacctggaaaaagccattacacaggaaacctctgttgatataagcgatgatgggaaaggctatttagccactctgcatatttaatgctcatgatcaacatctgcttcctatagctgggatgatatgggggaagatatttatcccttctggggatcatatataaatgatgatagtagtacctacagtatagtgctgttagaattacatgagttagatgtggaggtcagagtggaagcaggtgtgagagggtcccgcagaagaaaacatggctgccaaagtgtttgagtccatcggcaagtttggcctggccttagctgttgcaggaggcatggtgaactctgccttatgtaatgtggatgctgggcacagagctgccatctttgaccaattccgtggagtacagaacattgtggtaggggaagggactcactttctcatcccatgtgtacaaaaaccaattatctttgactgctgttctcaaccacgtagtgcgccagtcatcactggtagcaaagatttacagaatgtcaacatcacactgtgcatcctcttccggcccatcactagccagcttcctcgcatcttcaccagcattggagaggactacgatgagtgtgtgctgccgttcattaccacggagatcctcaagtcactggtggctcgctttgatgctggagaactaatcacccagagggagctggtctccagccaggtgagcaacaaccttatggagtgagcagccacctttgggctcattctggacgacgtgtctttgacacatctgaccttcttgaaggagttaacagacaggtggccccccaggaagcagagagcgccagatttgtggtggaaaaggcggccatcatctctgctgagggtgactccaaggcagctgagctgatcgccaactcactggccactgcaggggacggccagagcgagctgtgcaagctggaagctgcagaagacattgcataccagctctcatgctctcggaacatcacctgcctgccggcagggcagtccgtgctcctccagctgccctagtgaggccccagcctacctgcacctccgtgaggcaactgggccacagccccgatgattcgtaacaccacctttcgccctcaccccagaaatcactgaaatttcatgattggcttaaagtgaaggaagtaaaggtaaaatcacttcagatctctaaaaaacaaagaattacatgagttagtacatgaaaaaattatgggaaactacatgaaatatactgttacgttcaataaacattagcttctgtatataataatatca

SEQ ID NO: 203171 - DNA, 4003 bp, Homo sapiens
  Payload ID: 20067
  Gene Name: zinc finger protein 607
  Uniprot ID: Q96SK3
  ENST ID: ENST00000395835
  CDS Start-End: 249-2336
attgacccttggctccaggttccctgctgcttcctgtgccttcctcagcctagtacgactacaacagagaaatggtcccaatgggaaatcagatactgagtcttagatgaagatttccagtgagaagaaacagataggatgagaagcttagaagagtaattgcccttaagaaaggtcttggttcttttgactttgctcttctggtagagaaacgccaaggactgatcaactcttgccagtctcaaaccatgtcctatggatcaataacattcggggatgtggccatagacttctctcatcaggagtgggaatatctcagcctggttcagaagaccttgtaccaggaggtgatgatggagaactatgacaacttagtctcattgggacattccgtatctaagccagatttaatcaccttattggagcaaggaaaagagccatggatgattgtgagggaagaaacaagaggagagtgtacagatttggattcaagatgtgaaataatcagcgatgggaaaatgcagctttataggaaacactcatgtgttactctccatcagagaattcataatggacagaaaccatatgagtgtaagcaatgtcagaagtcctttagtcatcttacagaactcatggtacatcaaacaattcatactagtgaggaacctgatcaatgtgaaaagtttaggaaggcatttagccatcttacagaccttagaaagcatcagaaaattaatgctcgtgagaaaccttatgaatgtgaagaatgtgggaaggtcttcagttatcctgcaaaccttgctcaacatgggaaagttcatgttgagaaaccctatgaatgtaaagagtgtggggaagcttttaggactagccgtcaacttactgtacatcatagatttcattatggtgagaaaccctacgaatgtaaggaatgtggcaaggcctttagtgtgtatggacgacttagtcgacatcagagtattcacactggtgagaagccctttgaatgtaacaaatgtgggaagtcctttaggctcaaagcaggccttaaagtacatcagagtattcatactggagagaagccacatgaatgtaaggaatgtggaaaggcctttcgtcagttttcccaccttgtgggtcataaaagaattcatactggagaaaaaccctatgaatgcaaggaatgcgggaagggctttacatgtaggtatcaacttaccatgcatcagagaatttattcaggggagaaacactatgaatgtaaagaaaatggggaggcttttagtagtggccatcaacttactgcacctcatacatttgaaagtgttgagaaaccttataagtgtgaggaatgtgggaaagcctttagtgtgcatggacgacttactcgacatcagggtattcatagtggtaagaaaccctatgaatgtaacaaatgtgggaagtcctttaggctcaattcatcccttaaaatacatcaaaatattcataccggtgagaaaccctacaaatgtaaggaatgtgggaaggccttcagtcagcgtgcacaccttgcccatcataacagaattcatactggttacaaaccctttgaatgtaaagaatgtgggaagtcctttcgttgtgcctcatatcttgttatacatgagagaattcatacaggagagaaaccctatgtatgtcaagagtgtgggaagggttttagttatagccataaactcactatacatcgcagagttcatactggtgagaaaccttatgaatgtaaggaatgtgggaaggcctttagtgtatctggacaacttactcagcatctgagtattcacagtggtaagaaaccctttgaatgcaacaaatgcgggaagtcttttaggttcatttctgtacttaaagcccatcagaatattcatagcgctgagaaaccctacgaatgtaaggaatgtggcaaggcctttcgtcatgccacaagcctcatatatcatgaccgaactcatgctggtgaaaagtcctatgaatgtaaagaatgtggggaaacttttagtcatgcttcacatcttattattcatgagagaattcataccagtgataaaccctatgaatgtaaaagatgtgggaaggcatttcactgtgcctcatatcttgttagacatgaaagcgttcatgctgatggaaatccctatatgtgtgaagagtgtgggaaagcttttaatagtagccatgaacttagtatacatcatagagttcatactggtgagaaaccctttaaatgtaacaaatgcagaaggtcctttaggcttagatccatccttgaagtacatcagagaattcatatttgatagagaaattgtggcatatacaggtagtaaagaaagcacattgtgtcaatggatttatcccactgaacaatttgaatgaagacaatgtggaatggctttgagatacagttcagtttttattaggcatcaatttgtattggtgtgaacttttcaaaatgtaaatcatatatgcagtttctttggtatgacctgtgttaactcagattcagagaatttataatgtatttttttaataacataagaaaacttttctgatattcctctagttttggattgccaaaatattcacagtagaggaaaactgagaaaacgtaggaaaccattctttatacttgcatgtaaacatcttccagcaacaatcatttattgttaaacctggaaaaagccattacacaggaaacctctgttgatataagcgatgatgggaaaggctatttagccactctgcatatttaatgctcatgatcaacatctgcttcctatagctgggatgatatgggggaagatatttatcccttctggggatcatatataaatgatgatagtagtacctacagtatagtgctgttagaattacatgagttagatgtggaggtcagagtggaagcaggtgtgagagggtcccgcagaagaaaacatggctgccaaagtgtttgagtccatcggcaagtttggcctggccttagctgttgcaggaggcatggtgaactctgccttatgtaatgtggatgctgggcacagagctgccatctttgaccaattccgtggagtacagaacattgtggtaggggaagggactcactttctcatcccatgtgtacaaaaaccaattatctttgactgctgttctcaaccacgtagtgcgccagtcatcactggtagcaaagatttacagaatgtcaacatcacactgtgcatcctcttccggcccatcactagccagcttcctcgcatcttcaccagcattggagaggactacgatgagtgtgtgctgccgttcattaccacggagatcctcaagtcactggtggctcgctttgatgctggagaactaatcacccagagggagctggtctccagccaggtgagcaacaaccttatggagtgagcagccacctttgggctcattctggacgacgtgtctttgacacatctgaccttcttgaaggagttaacagacaggtggccccccaggaagcagagagcgccagatttgtggtggaaaaggcggccatcatctctgctgagggtgactccaaggcagctgagctgatcgccaactcactggccactgcaggggacggccagagcgagctgtgcaagctggaagctgcagaagacattgcataccagctctcatgctctcggaacatcacctgcctgccggcagggcagtccgtgctcctccagctgccctagtgaggccccagcctacctgcacctccgtgaggcaactgggccacagccccgatgattcgtaacaccacctttcgccctcaccccagaaatcactgaaatttcatgattggcttaaagtgaaggaagtaaaggtaaaatcacttcagatctctaaaaaacaaagaattacatgagttagtacatgaaaaaattatgggaaactacatgaaatatactgttacgttcaataaacattagcttctgtatat

SEQ ID NO: 203172 - DNA, 1190 bp, Homo sapiens
  Payload ID: 20067
  Gene Name: zinc finger protein 607
  ENST ID: ENST00000586559
  CDS Start-End: 186-494
acagagaaatggtcccaatgggaaatcagatactgagtcttagatgaagatttccagtgagaagaaacagataggatgagaagcttagaagagtaattgcccttaagaaaggtcttggttcttttgactttgctcttctggtagagaaacgccaaggactgatcaactcttgccagtctcaaaccatgtcctatggatcaataacattcggggatgtggccatagacttctctcatcaggagtgggaatatctcagcctggttcagaagaccttgtaccaggaggtgatgatggagaactatgacaacttagtctcattgggacattccgtatctaagccagatttaatcaccttattggagcaaggaaaagagccatggatgattgtgagggaagaaacaagaggagagtgtacagcagagctacagagtaaaaattgtggattccaactgagagacctgcaagacagtctccatttaagaaagaattgctagggaaacccaaagagaagacataaataaagactggaagaattgaagctgcaacacaaacacagctacagcacacaatgaacacggcctaactcctacgcagacgaacctcaaactttgcactgaagatttggattcaagatgtgaaataatcagcgatgggaaaatgcagctttataggaaacactcatgtgttactctccatcagagaattcataatggacagaaaccatatgagtgtaagcaatgtcagaagtcctttagtcatcttacagaactcatggtacatcaaacaattcatactagtgaggaacctgatcaatgtgaaaagtttaggaaggcatttagccatcttacagaccttagaaagcatcagaaaattaatgctcgtgagaaaccttatgaatgtgaagaatgtgggaaggtcttcagttatcctgcaaaccttgctcaacatgggaaagttcatgttgagaaaccctatgaatgtaaagagtgtggggaagcttttaggactagccgtcaacttactgtacatcatagatttcattatggtgagaaaccctacgaatgtaaggaatgtggcaaggcctttagtgtgtatggacgacttagtcgacatcagagtattcacactggtgagaagccctttgaatgtaacaaatgtgggaagtcctttaggctcaaagcaggccttaa

SEQ ID NO: 203173 - DNA, 549 bp, Homo sapiens
  Payload ID: 20067
  Gene Name: zinc finger protein 607
  ENST ID: ENST00000590670
  CDS Start-End: 212-549
ttgacccttggctccaggttccctgctgcttcctgtgccttcctcagcctagtacgactacaacagagaaatggtcccaatgggaaatcagatactgagtcttagatgaagatttccagtgagaagaaacagataggatgagaagcttagaagagtaattgcccttaagaaagatttggattcaagatgtgaaataatcagcgatgggaaaatgcagctttataggaaacactcatgtgttactctccatcagagaattcataatggacagaaaccatatgagtgtaagcaatgtcagaagtcctttagtcatcttacagaactcatggtacatcaaacaattcatactagtgaggaacctgatcaatgtgaaaagtttaggaaggcatttagccatcttacagaccttagaaagcatcagaaaattaatgctcgtgagaaaccttatgaatgtgaagaatgtgggaaggtcttcagttatcctgcaaaccttgctcaacatgggaaagttcatgttgagaaaccctatgaatgtaaagagtgtgggga

SEQ ID NO: 203174 - DNA, 741 bp, Homo sapiens
  Payload ID: 20067
  Gene Name: zinc finger protein 607
  ENST ID: ENST00000591664
  CDS Start-End: 530-741
gggaggcgcggtccaagtggtcgctgccgtatttctcgtaggtttttaggattctggactccatttctcaccggtacctgcggtcctgactgttctggcttggactacatattacaaaggcaacggagaaaacttggacccctggctccggttccgggaccttttggttccacctgaagaaggcggcgcaggtcactgcgggagcctctgcagccccagcccgccgcccgcgtggtaccctgcgtggcggtgagagtggggctgcaggaggcgctcagagcgcggaggcccccaggcgggccgggcgagtctcccgcctcctcaggccctagggtgctggagctgcggaggaggggcccgtctctaggagacaggcggggagcgtgagagaccgcgcagcggcgacaggaccggcttgcctgtgtgacgtgggtgcagttgcgggactgtgaggggtcttggttcttttgactttgctcttctggtagagaaacgccaaggactgatcaactcttgccagtctcaaaccatgtcctatggatcaataacattcggggatgtggccatagacttctctcatcaggagtgggaatatctcagcctggttcagaagaccttgtaccaggaggtgatgatggagaactatgacaacttagtctcattggatttggattcaagatgtgaaataatcagcgatgggaaaatgcagctttataggaaacactcatgtgttactctcca

SEQ ID NO: 203175 - DNA, 5958 bp, Homo sapiens
  Payload ID: 20068
  Gene Name: zinc finger protein 608
  Uniprot ID: Q9ULD9
  ENST ID: ENST00000306315
  CDS Start-End: 437-4975
aaaaggtgattatccttgtgttgttgataaagggattttctttttagctaccgtaagatgcttactgtcataggtttatttttcgggtttggttattttcctttaaacctgatattggactgtgaggacaatacatgagccaccttactctccatccttccctgtcccctttactgattccccaatactaatcgttttttattctggtaacacccagacaagaaatattcgacttttcccccccccttcacaggaaaaggtggacctggactgagggtgtaaaatccctggacacattcgtggggcaggaaaaagaagaggaagattagaagattttttttttctttgagagaaagcccagcggagataaacgaatgtcccctcatctccaaagaaaagttcatcggatttttattctagagagctcatcttcaggatgtcagtgaacatttctactgcaggaaaaggtgtggatccaaatacagttgatacttatgacagtggcgatgattgggaaatcggggttggaaatttaataattgatttggacgctgatttggagaaggacagacagaaatttgagatgaataattccaccaccaccactagtagcagcaactccaaggattgtggaggtccggcctccagtggggctggtgctaccgcagccttagctgatggcctaaaatttgcttctgttcaggcctctgctccccaggggaattcacacaaagagaccagcaaatcaaaagtgaaaaggagtaaaacttctaaggatgctaataaatctctgccttctgctgccttgtatgggattcccgagatcagcagcactggcaagaggcaggaagtccaagggcgccctggagaggcaactggcatgaattcagcgctgggtcaaagtgtgagcagcggcggcagcggcaacccaaacagcaatagtaccagcaccagcacctctgccgccaccgcgggggcaggctcctgtgggaaaagcaaagaggagaagccaggtaaaagccagagcagccgaggcgccaagcgggataaggatgcggggaaatccaggaaggacaagcacgacctgcttcagggccaccagaatggcagtggcagccaggccccttccggggggcacctctatggctttggggccaagagcaatggaggtggcgcgagccccttccactgcgggggcactgggagtggcagcgtcgccgctgcaggggaagttagcaaaagtgccccggattcagggctcatgggaaactctatgttggtaaagaaggaagaggaggaggaggagagccacaggcgaatcaagaaactgaaaactgagaaggttgaccccctgtttacagtgccagcgccaccaccgccgatttccagcagtctcacgcctcagattctaccctcctacttttccccatcttcatccaatattgcagcaccggttgaacagcttttggttcggactcgttctgtgggtgtcaatacatgtgaagttggagtagtgacagagccagagtgtcttgggccctgtgaacctgggaccagtgtgaatttggaagggatcgtgtggcatgaaacagaagaaggtgtcctagtggtcaatgtcacgtggaggaacaaaacgtacgtgggaaccctactggactgcaccaagcacgactgggcccctcccaggttttgtgagtcaccgacaagtgacctggagatgagagggggccggggcagagggaagagagcgaggtctgctgctgctgccccgggctccgaggccagcttcacagagtccagagggctgcagaataagaacagagggggggccaatgggaaagggaggcggggcagcctcaatgccagcggacgaaggacacccccaaattgtgctgctgaggatatcaaagccagcccttcctccaccaacaaaaggaaaaacaagcctccaatggagctggacctgaactccagctctgaggacaataagcctggaaagcgtgtccgcacaaattccagaagcactcccactacccctcaagggaaaccagagactacttttttggaccaaggctgctcttctccagtgttaatcgactgtccccacccaaactgcaacaaaaagtacaagcacattaacggcctgaggtaccaccaggctcatgcacacttagacccagaaaacaagctggagttcgagcctgacagtgaggacaagatctcggactgtgaggaaggattgagtaatgtggcacttgaatgcagtgagccaagcacaagtgtatctgcttatgaccagttgaaggcaccggcatcccctggtgctggaaacccacctgggaccccaaagggaaagagagagctgatgagcaatggcccaggttccattattggtgctaaagctgggaagaattctggcaaaaagaagggccttaacaatgaactgaacaaccttccagtaatctccaacatgacggctgcgttagacagttgctcggcagcagacggcagtttggctgctgagatgcctaaactggaagcagaaggattaattgacaagaaaaatttaggagataaagaaaagggcaaaaaagctaccaactgcaaaacggacaaaaacctctctaaactgaaaagtgcccggcccattgcccctgccccagcccccactcccccgcagctaatcgctatacccactgcaacctttacaacgaccaccactgggacaatacccggactgccctccctcacaacaactgttgttcaggctacaccaaagagtcctccgttaaaacccattcaaccaaagcccacaattatgggagagcccatcaccgtgaacccagctctggtgtcactcaaagacaaaaagaaaaaggagaagcgaaagctaaaggacaaagaagggaaagagacgggaagcccaaaaatggatgccaagctggggaaactagaggactccaagggggccagcaaagatttacctgggcattttttaaaggatcatctcaacaagaatgaagggctggcaaatggactgtcggagtctcaggagagccgcatggccagtatcaaagctgaggccgataaggtttacactttcacagacaacgctcccagcccttccatagggagcgcctcgaggctggaatgcagcactttggtgaacgggcaggcaccaatggcacctctgcatgtgttgacccagaatggggcagagagttcagctgcaaagacaagcagcccggcctattcagacatatctgatgctgctgacgatggtggttctgacagcaggtcggagggtatgagatcaaaggccagttccccatcagatattatttctagtaaggacagtgttgtaaaagggcattcttcaactacagcacaatcatctcaactgaaagagtcccattctccctattaccacagctatgatccttattattctccaagttacatgcaccctgggcaggtcggtgcccctgcagctggaaatagtgggagcacgcagggaatgaagatcaagaaggagtctgaggaagatgctgaaaagaaagacaaggcagagcagttagattctaagaaagtggaccacaattctgcatccttacagcctcagcaccagtcggtgatcacacaaagacatcctgccctggctcagtcactttattatggccagtatgcatatgggctctatatggaccagaagtctctgatggccaccagccctgcctatagacagcagtatgagaagtactatgaggaccagaggctggcagagcagaaaatggcccagactgggagaggagactgtgaaaggaaaagtgagctccccttgaaagagctgggcaaggaggaaactaaacagaaaaatatgccatcggccacaatctcaaaagctccctctactccggagcctaacaaaaaccattctaaactagggccatcagtgcctaataaaactgaggagacaggtaaatcgcagcttctctccaatcaccagcagcagcttcaggccgacagcttcaaagctaagcagatggaaaaccaccagcttattaaggaggctgtagaaatgaagtctgtcatggactctatgaagcagacaggtgtagacccaacctcgagatttaaacaagacccagattcaagaacatggcatcattatgtataccagcccaaatatctggatcagcaaaagtcagaagaacttgatagagagaagaaattaaaagaggatagtccgaggaaaactcctaataaagagagtggtgtgcccagccttcctgtatcgttaacaagcattaaagaggagcccaaagaggccaagcatcctgattctcaatcaatggaggagagcaagctgaaaaatgatgatcgaaagactcctgtgaactggaaggactctcggggaacaagagtggctgtctcctcacccatgagtcagcatcagtcatacatacagtacttgcatgcttatccttacccacagatgtacgaccccagccatcctgcataccgggctgtttctcccgtcctaatgcacagttatcctggggcatatctctctccaggatttcattatcctgtttatgggaagatgtcagggagagaagagacagagaaagtcaataccagccctagcgtcaacacgaaaacaaccactgaatctaaagcactggatttgctccagcagcatgctaaccaataccgcagcaagtctcctgctcctgtggaaaaggctacagctgagcgggaacgggaggcagaaagggaaagggatcgccactcccccttcggccagcggcacctgcacacgcaccaccacacccacgttggcatgggttacccgctaatcccgggtcaatatgacccttttcaaggcttgacctctgctgcccttgttgcctctcagcaggtggctgcccaggcatctgcatctggaatgtttcctggacaaagaagagaataacaagattggacatgtacattgtcatgtgactggatcacatggggaagcgctttatacagacatcagttccatggtgttaatttgaaatgccttaatggcaggcaaaaaccagtcatttcatttttgtaaattacagattttatcacagagtaacaaatgttgctgtaattaaacttctgttttatatatatatacgtatacatatctgtatatatacatatatatatatataaatataaatatattctttactttttgtatcagtaaccaggctcgcacacacagggtctgctgccacgtcgcaaaccactcagtaaaggaaattaaaaatgtatttgtcatgttaaaaagtgttagccacaaaaggctacttactttcttttccttttcctttaaaattgtaaataaataatgttatgtatcagtgtgcctgaaccttgcatatccttcacatatttcccataagcccctcagaaaggctaactgtgatgatgacactttggtacaatttagatgtctatttggtggctcctgttaaagacgcaccagtgtaaaatgttcctgtagtcactgtttgtacttgtgtattgtggaaaaagtacttttggaaggcatggggttgccagtaccacaaaaactgtgttgtatataatgtaaagattaaaatggggaaataatgagcatctgtgaataatgaggtgtcattttttgataatcttgaatggcaaataacccaatagcctgcgtaccagagacatctgtgattgttctattacttgaatagttctacagtctttttttttttttaatgtttacaattatccagttttagaagagagagactttaacgccattgcctggttacttgttttatgctgtaatctagtttattttatgtaaaatgtatattgaatgctttccttttttatacctgccttaaataatttggcaatcagaattaaaaagtttttttttttttaaat

SEQ ID NO: 203176 - DNA, 2737 bp, Homo sapiens
  Payload ID: 20068
  Gene Name: zinc finger protein 608
  ENST ID: ENST00000513986
  CDS Start-End: 617-2737
cgcctgtaggtttgctacatgggatcattactgatcacggtgactctgaagtctggaactgaaggcggaatgagaagttgggaaaacttttttctctaaactctctgttttttaaaaaactattattctcgatgcttgttaagaggaaaaaaaaacctttggtgcttctgttgtgaatgtgaaacattattttccagctgtacagtgacacattttttttaaggagaaaaggactgattcgtttgccaaaaggggggtggggaggtggaataatgttatcgagtgattattctggctgagatgtgttatttggtttcttccttcttgatcatttggtgtttaagtaaaatgaggcacaggcttgtttgccgagtggagtgggaaaggcattttgatttgctggcctaattaaaaaatgataaaggattaaaaggaaaaggtggacctggactgagggtgtaaaatccctggacacattcgtggggcaggaaaaagaagaggaagattagaagattttttttttctttgagagaaagcccagcggagataaacgaatgtcccctcatctccaaagaaaagttcatcggatttttattctagagagctcatcttcaggatgtcagtgaacatttctactgcaggaaaaggtgtggatccaaatacagttgatacttatgacagtggcgatgattgggaaatcggggttggaaatttaataattgatttggacgctgatttggagaaggacagacagaaatttgagatgaataattccaccaccaccactagtagcagcaactccaaggattgtggaggtccggcctccagtggggctggtgctaccgcagccttagctgatggcctaaaatttgcttctgttcaggcctctgctccccaggggaattcacacaaagagaccagcaaatcaaaagtgaaaaggagtaaaacttctaaggatgctaataaatctctgccttctgctgccttgtatgggattcccgagatcagcagcactggcaagaggcaggaagtccaagggcgccctggagaggcaactggcatgaattcagcgctgggtcaaagtgtgagcagcggcggcagcggcaacccaaacagcaatagtaccagcaccagcacctctgccgccaccgcgggggcaggctcctgtgggaaaagcaaagaggagaagccaggtaaaagccagagcagccgaggcgccaagcgggataaggatgcggggaaatccaggaaggacaagcacgacctgcttcagggccaccagaatggcagtggcagccaggccccttccggggggcacctctatggctttggggccaagagcaatggaggtggcgcgagccccttccactgcgggggcactgggagtggcagcgtcgccgctgcaggggaagttagcaaaagtgccccggattcagggctcatgggaaactctatgttggtaaagaaggaagaggaggaggaggagagccacaggcgaatcaagaaactgaaaactgagaaggttgaccccctgtttacagtgccagcgccaccaccgccgatttccagcagtctcacgcctcagattctaccctcctacttttccccatcttcatccaatattgcagcaccggttgaacagcttttggttcggactcgttctgtgggtgtcaatacatgtgaagttggagtagtgacagagccagagtgtcttgggccctgtgaacctgggaccagtgtgaatttggaagggatcgtgtggcatgaaacagaagaaggtgtcctagtggtcaatgtcacgtggaggaacaaaacgtacgtgggaaccctactggactgcaccaagcacgactgggcccctcccaggttttgtgagtcaccgacaagtgacctggagatgagagggggccggggcagagggaagagagcgaggtctgctgctgctgccccgggctccgaggccagcttcacagagtccagagggctgcagaataagaacagagggggggccaatgggaaagggaggcggggcagcctcaatgccagcggacgaaggacacccccaaattgtgctgctgaggatatcaaagccagcccttcctccaccaacaaaaggaaaaacaagcctccaatggagctggacctgaactccagctctgaggacaataagcctggaaagcgtgtccgcacaaattccagaagcactcccactacccctcaagggaaaccagagactacttttttggaccaaggctgctcttctccagtgttaatcgactgtccccacccaaactgcaacaaaaagtacaagcacattaacggcctgaggtaccaccaggctcatgcacacttagacccagaaaacaagctggagttcgagcctgacagtgaggacaagatctcggactgtgaggaaggattgagtaatgtggcacttgaatgcagtgagccaagcacaagtgtatctgcttatgaccagttgaaggcaccggcatcccctggtgctggaaacccacctgggaccccaaagggaaagagagagctgatgagcaatggcccaggttccattattggtgctaaagctgggaagaattctggcaaaaagaagggccttaacaatgaactgaacaaccttccagtaatctccaacatgacggctgcgttagacagttgctcggcagcagacggcagtttggctgctgagatgcctaaactggaagcagaaggattaattgac

SEQ ID NO: 203177 - DNA, 2605 bp, Homo sapiens
  Payload ID: 20068
  Gene Name: zinc finger protein 608
  ENST ID: ENST00000509799
  CDS Start-End: 459-2605
cactccccctgtgtgtgtgttgtgtttcagtcctgatttagtgttgcagaacaagcttgttgtgtgtgtgcaccagggggatttttgttttgctttttttaaattttaatttttgcttttataaaaaatacacaggacggtctgtgacatttgatggtccatcttctttaataataaatttgttgaagagattataatttccaaaataaagcggctgcaaccaaacacattcaatgcagttagaaggaaaaggtcaactcgatccaatacagaccgaaaaggtggacctggactgagggtgtaaaatccctggacacattcgtggggcaggaaaaagaagaggaagattagaagattttttttttctttgagagaaagcccagcggagataaacgaatgtcccctcatctccaaagaaaagttcatcggatttttattctagagagctcatcttcaggatgtcagtgaacatttctactgcaggaaaaggtgtggatccaaatacagttgatacttatgacagtggcgatgattgggaaatcggggttggaaatttaataattgatttggacgctgatttggagaaggacagacagaaatttgagatgaataattccaccaccaccactagtagcagcaactccaaggattgtggaggtccggcctccagtggggctggtgctaccgcagccttagctgatggcctaaaatttgcttctgttcaggcctctgctccccaggggaattcacacaaagagaccagcaaatcaaaagtgaaaaggagtaaaacttctaaggatgctaataaatctctgccttctgctgccttgtatgggattcccgagatcagcagcactggcaagaggcaggaagtccaagggcgccctggagaggcaactggcatgaattcagcgctgggtcaaagtgtgagcagcggcggcagcggcaacccaaacagcaatagtaccagcaccagcacctctgccgccaccgcgggggcaggctcctgtgggaaaagcaaagaggagaagccaggtaaaagccagagcagccgaggcgccaagcgggataaggatgcggggaaatccaggaaggacaagcacgacctgcttcagggccaccagaatggcagtggcagccaggccccttccggggggcacctctatggctttggggccaagagcaatggaggtggcgcgagccccttccactgcgggggcactgggagtggcagcgtcgccgctgcaggggaagttagcaaaagtgccccggattcagggctcatgggaaactctatgttggtaaagaaggaagaggaggaggaggagagccacaggcgaatcaagaaactgaaaactgagaaggttgaccccctgtttacagtgccagcgccaccaccgccgatttccagcagtctcacgcctcagattctaccctcctacttttccccatcttcatccaatattgcagcaccggttgaacagcttttggttcggactcgttctgtgggtgtcaatacatgtgaagttggagtagtgacagagccagagtgtcttgggccctgtgaacctgggaccagtgtgaatttggaagggatcgtgtggcatgaaacagaagaaggtgtcctagtggtcaatgtcacgtggaggaacaaaacgtacgtgggaaccctactggactgcaccaagcacgactgggcccctcccaggttttgtgagtcaccgacaagtgacctggagatgagagggggccggggcagagggaagagagcgaggtctgctgctgctgccccgggctccgaggccagcttcacagagtccagagggctgcagaataagaacagagggggggccaatgggaaagggaggcggggcagcctcaatgccagcggacgaaggacacccccaaattgtgctgctgaggatatcaaagccagcccttcctccaccaacaaaaggaaaaacaagcctccaatggagctggacctgaactccagctctgaggacaataagcctggaaagcgtgtccgcacaaattccagaagcactcccactacccctcaagggaaaccagagactacttttttggaccaaggctgctcttctccagtgttaatcgactgtccccacccaaactgcaacaaaaagtacaagcacattaacggcctgaggtaccaccaggctcatgcacacttagacccagaaaacaagctggagttcgagcctgacagtgaggacaagatctcggactgtgaggaaggattgagtaatgtggcacttgaatgcagtgagccaagcacaagtgtatctgcttatgaccagttgaaggcaccggcatcccctggtgctggaaacccacctgggaccccaaagggaaagagagagctgatgagcaatggcccaggttccattattggtgctaaagctgggaagaattctggcaaaaagaagggccttaacaatgaactgaacaaccttccagtaatctccaacatgacggctgcgttagacagttgctcggcagcagacggcagtttggctgctgagatgcctaaactggaagcagaaggattaattgacaagaaaaatttaggagataaagaaaa

SEQ ID NO: 203178 - DNA, 2686 bp, Homo sapiens
  Payload ID: 20068
  Gene Name: zinc finger protein 608
  ENST ID: ENST00000505686
  CDS Start-End: 93-1436
tttgagagaaagcccagcggagataaacgaatgtcccctcatctccaaagaaaagttcatcggatttttattctagagagctcatcttcaggatgtcagtgaacatttctactgcaggaaaaggtgtggatccaaatacagttgatacttatgacagtggcgatgattgggaaatcggggttggaaatttaataattgatttggacgctgatttggagaaggacagacagaaatttgagatgaataattccaccaccaccactagtagcagcaactccaaggattgtggaggtccggcctccagtggggctggtgctaccgcagccttagctgatggcctaaaatttgcttctgttcaggcctctgctccccaggggaattcacacaaagagaccagcaaatcaaaagtgaaaaggagtaaaacttctaaggatgctaataaatctctgccttctgctgccttgtatgggattcccgagatcagcagcactggcaagaggcaggaagtccaagggcgccctggagaggcaactggcatgaattcagcgctgggtcaaagtgtgagcagcggcggcagcggcaacccaaacagcaatagtaccagcaccagcacctctgccgccaccgcgggggcaggctcctgtgggaaaagcaaagaggagaagccaggtaaaagccagagcagccgaggcgccaagcgggataaggatgcggggaaatccaggaaggacaagcacgacctgcttcagggccaccagaatggcagtggcagccaggccccttccggggggcacctctatggctttggggccaagagcaatggaggtggcgcgagccccttccactgcgggggcactgggagtggcagcgtcgccgctgcaggggaagttagcaaaagtgccccggattcagggctcatgggaaactctatgttggtaaagaaggaagaggaggaggaggagagccacaggcgaatcaagaaactgaaaactgagaaggttgaccccctgtttacagtgccagcgccaccaccgccgatttccagcagtctcacgcctcagattctaccctcctacttttccccatcttcatccaatattgcagcaccggttgaacagcttttggttcggactcgttctgtgggtgtcaatacatgtgaagttggagtagtgacagagccagagtgtcttgggccctgtgaacctgggaccagtgtgaatttggaagggatcgtgtggcatgaaacagaagaaggtgtcctagtggtcaatgtcacgtggaggaacaaaacgtacgtgggaaccctactggactgcaccaagcacgactgggcccctcccaggacccagattcaagaacatggcatcattatgtataccagcccaaatatctggatcagcaaaagtcagaagaacttgatagagagaagaaattaaaagaggatagtccgaggaaaactcctaataaagagagtggtgtgcccagccttcctgtatcgttaacaagcattaaagaggagcccaaagaggccaagcatcctgattctcaatcaatggaggagagcaagctgaaaaatgatgatcgaaagactcctgtgaactggaaggactctcggggaacaagagtggctgtctcctcacccatgagtcagcatcagtcatacatacagtacttgcatgcttatccttacccacagatgtacgaccccagccatcctgcataccgggctgtttctcccgtcctaatgcacagttatcctggggcatatctctctccaggatttcattatcctgtttatgggaagatgtcagggagagaagagacagagaaagtcaataccagccctagcgtcaacacgaaaacaaccactgaatctaaagcactggatttgctccagcagcatgctaaccaataccgcagcaagtctcctgctgcttgacctctgctgcccttgttgcctctcagcaggtggctgcccaggcatctgcatctggaatgtttcctggacaaagaagataaagtcgcaaatggagacatttattttcataatgctaaagagaataacaagattggacatgtacattgtcatgtgactggatcacatggggaagcgctttatacagacatcagttccatggtgttaatttgaaatgccttaatggcaggcaaaaaccagtcatttcatttttgtaaattacagattttatcacagagtaacaaatgttgctgtaattaaacttctgttttatatatatatacgtatacatatctgtatatatacatatatatatatataaatataaatatattctttactttttgtatcagtaaccaggctcgcacacacagggtctgctgccacgtcgcaaaccactcagtaaaggaaattaaaaatgtatttgtcatgttaaaaagtgttagccacaaaaggctacttactttcttttccttttcctttaaaattgtaaataaataatgttatgtatcagtgtgcctgaaccttgcatatccttcacatatttcccataagcccctcagaaaggctaactgtgatgatgacactttggtacaatttagatgtctatttggtggctcctgttaaagacgcaccagtgtaaaatgttcctgtagtcactgtttgtacttgtgtattgtggaaaaagtacttttggaaggcatggggttg

SEQ ID NO: 203179 - DNA, 4726 bp, Homo sapiens
  Payload ID: 20068
  Gene Name: zinc finger protein 608
  Uniprot ID: Q9ULD9
  ENST ID: ENST00000504926
  CDS Start-End: 485-3742
gtgagcagcggcggcagcggcaacccaaacagcaatagtaccagcaccagcacctctgccgccaccgcgggggcaggctcctgtgggaaaagcaaagaggagaagccaggttgaccccctgtttacagtgccagcgccaccaccgccgatttccagcagtctcacgcctcagattctaccctcctacttttccccatcttcatccaatattgcagcaccggttgaacagcttttggttcggactcgttctgtgggtgtcaatacatgtgaagttggagtagtgacagagccagagtgtcttgggccctgtgaacctgggaccagtgtgaatttggaagggatcgtgtggcatgaaacagaagaaggtgtcctagtggtcaatgtcacgtggaggaacaaaacgtacgtgggaaccctactggactgcaccaagcacgactgggcccctcccaggttttgtgagtcaccgacaagtgacctggagatgagagggggccggggcagagggaagagagcgaggtctgctgctgctgccccgggctccgaggccagcttcacagagtccagagggctgcagaataagaacagagggggggccaatgggaaagggaggcggggcagcctcaatgccagcggacgaaggacacccccaaattgtgctgctgaggatatcaaagccagcccttcctccaccaacaaaaggaaaaacaagcctccaatggagctggacctgaactccagctctgaggacaataagcctggaaagcgtgtccgcacaaattccagaagcactcccactacccctcaagggaaaccagagactacttttttggaccaaggctgctcttctccagtgttaatcgactgtccccacccaaactgcaacaaaaagtacaagcacattaacggcctgaggtaccaccaggctcatgcacacttagacccagaaaacaagctggagttcgagcctgacagtgaggacaagatctcggactgtgaggaaggattgagtaatgtggcacttgaatgcagtgagccaagcacaagtgtatctgcttatgaccagttgaaggcaccggcatcccctggtgctggaaacccacctgggaccccaaagggaaagagagagctgatgagcaatggcccaggttccattattggtgctaaagctgggaagaattctggcaaaaagaagggccttaacaatgaactgaacaaccttccagtaatctccaacatgacggctgcgttagacagttgctcggcagcagacggcagtttggctgctgagatgcctaaactggaagcagaaggattaattgacaagaaaaatttaggagataaagaaaagggcaaaaaagctaccaactgcaaaacggacaaaaacctctctaaactgaaaagtgcccggcccattgcccctgccccagcccccactcccccgcagctaatcgctatacccactgcaacctttacaacgaccaccactgggacaatacccggactgccctccctcacaacaactgttgttcaggctacaccaaagagtcctccgttaaaacccattcaaccaaagcccacaattatgggagagcccatcaccgtgaacccagctctggtgtcactcaaagacaaaaagaaaaaggagaagcgaaagctaaaggacaaagaagggaaagagacgggaagcccaaaaatggatgccaagctggggaaactagaggactccaagggggccagcaaagatttacctgggcattttttaaaggatcatctcaacaagaatgaagggctggcaaatggactgtcggagtctcaggagagccgcatggccagtatcaaagctgaggccgataaggtttacactttcacagacaacgctcccagcccttccatagggagcgcctcgaggctggaatgcagcactttggtgaacgggcaggcaccaatggcacctctgcatgtgttgacccagaatggggcagagagttcagctgcaaagacaagcagcccggcctattcagacatatctgatgctgctgacgatggtggttctgacagcaggtcggagggtatgagatcaaaggccagttccccatcagatattatttctagtaaggacagtgttgtaaaagggcattcttcaactacagcacaatcatctcaactgaaagagtcccattctccctattaccacagctatgatccttattattctccaagttacatgcaccctgggcaggtcggtgcccctgcagctggaaatagtgggagcacgcagggaatgaagatcaagaaggagtctgaggaagatgctgaaaagaaagacaaggcagagcagttagattctaagaaagtggaccacaattctgcatccttacagcctcagcaccagtcggtgatcacacaaagacatcctgccctggctcagtcactttattatggccagtatgcatatgggctctatatggaccagaagtctctgatggccaccagccctgcctatagacagcagtatgagaagtactatgaggaccagaggctggcagagcagaaaatggcccagactgggagaggagactgtgaaaggaaaagtgagctccccttgaaagagctgggcaaggaggaaactaaacagaaaaatatgccatcggccacaatctcaaaagctccctctactccggagcctaacaaaaaccattctaaactagggccatcagtgcctaataaaactgaggagacaggtaaatcgcagcttctctccaatcaccagcagcagcttcaggccgacagcttcaaagctaagcagatggaaaaccaccagcttattaaggaggctgtagaaatgaagtctgtcatggactctatgaagcagacaggtgtagacccaacctcgagatttaaacaagacccagattcaagaacatggcatcattatgtataccagcccaaatatctggatcagcaaaagtcagaagaacttgatagagagaagaaattaaaagaggatagtccgaggaaaactcctaataaagagagtggtgtgcccagccttcctgtatcgttaacaagcattaaagaggagcccaaagaggccaagcatcctgattctcaatcaatggaggagagcaagctgaaaaatgatgatcgaaagactcctgtgaactggaaggactctcggggaacaagagtggctgtctcctcacccatgagtcagcatcagtcatacatacagtacttgcatgcttatccttacccacagatgtacgaccccagccatcctgcataccgggctgtttctcccgtcctaatgcacagttatcctggggcatatctctctccaggatttcattatcctgtttatgggaagatgtcagggagagaagagacagagaaagtcaataccagccctagcgtcaacacgaaaacaaccactgaatctaaagcactggatttgctccagcagcatgctaaccaataccgcagcaagtctcctgctcctgtggaaaaggctacagctgagcgggaacgggaggcagaaagggaaagggatcgccactcccccttcggccagcggcacctgcacacgcaccaccacacccacgttggcatgggttacccgctaatcccgggtcaatatgacccttttcaaggcttgacctctgctgcccttgttgcctctcagcaggtggctgcccaggcatctgcatctggaatgtttcctggacaaagaagagaataacaagattggacatgtacattgtcatgtgactggatcacatggggaagcgctttatacagacatcagttccatggtgttaatttgaaatgccttaatggcaggcaaaaaccagtcatttcatttttgtaaattacagattttatcacagagtaacaaatgttgctgtaattaaacttctgttttatatatatatacgtatacatatctgtatatatacatatatatatatataaatataaatatattctttactttttgtatcagtaaccaggctcgcacacacagggtctgctgccacgtcgcaaaccactcagtaaaggaaattaaaaatgtatttgtcatgttaaaaagtgttagccacaaaaggctacttactttcttttccttttcctttaaaattgtaaataaataatgttatgtatcagtgtgcctgaaccttgcatatccttcacatatttcccataagcccctcagaaaggctaactgtgatgatgacactttggtacaatttagatgtctatttggtggctcctgttaaagacgcaccagtgtaaaatgttcctgtagtcactgtttgtacttgtgtattgtggaaaaagtacttttggaaggcatggggttgccagtaccacaaaaactgtgttgtatataatgtaaagattaaaatggggaaataatgagcatctgtgaataatgaggtgtcattttttgataatcttgaatggcaaataacccaatagcctgcgtaccagagacatctgtgattgttctattacttgaatagttctacagtctttttttttttttaatgtttacaattatccagttttagaagagagagactttaacgccattgcctggttacttgttttatgctgtaatctagtttattttatgtaaaatgtatattgaatgctttccttttttatacctgccttaaataatttggcaatcagaattaaaaagtttttttttttttaaata

SEQ ID NO: 203180 - DNA, 3190 bp, Homo sapiens
  Payload ID: 20068
  Gene Name: zinc finger protein 608
  ENST ID: ENST00000613878
  CDS Start-End: 124-1467
agaagaggaagattagaagattttttttttctttgagagaaagcccagcggagataaacgaatgtcccctcatctccaaagaaaagttcatcggatttttattctagagagctcatcttcaggatgtcagtgaacatttctactgcaggaaaaggtgtggatccaaatacagttgatacttatgacagtggcgatgattgggaaatcggggttggaaatttaataattgatttggacgctgatttggagaaggacagacagaaatttgagatgaataattccaccaccaccactagtagcagcaactccaaggattgtggaggtccggcctccagtggggctggtgctaccgcagccttagctgatggcctaaaatttgcttctgttcaggcctctgctccccaggggaattcacacaaagagaccagcaaatcaaaagtgaaaaggagtaaaacttctaaggatgctaataaatctctgccttctgctgccttgtatgggattcccgagatcagcagcactggcaagaggcaggaagtccaagggcgccctggagaggcaactggcatgaattcagcgctgggtcaaagtgtgagcagcggcggcagcggcaacccaaacagcaatagtaccagcaccagcacctctgccgccaccgcgggggcaggctcctgtgggaaaagcaaagaggagaagccaggtaaaagccagagcagccgaggcgccaagcgggataaggatgcggggaaatccaggaaggacaagcacgacctgcttcagggccaccagaatggcagtggcagccaggccccttccggggggcacctctatggctttggggccaagagcaatggaggtggcgcgagccccttccactgcgggggcactgggagtggcagcgtcgccgctgcaggggaagttagcaaaagtgccccggattcagggctcatgggaaactctatgttggtaaagaaggaagaggaggaggaggagagccacaggcgaatcaagaaactgaaaactgagaaggttgaccccctgtttacagtgccagcgccaccaccgccgatttccagcagtctcacgcctcagattctaccctcctacttttccccatcttcatccaatattgcagcaccggttgaacagcttttggttcggactcgttctgtgggtgtcaatacatgtgaagttggagtagtgacagagccagagtgtcttgggccctgtgaacctgggaccagtgtgaatttggaagggatcgtgtggcatgaaacagaagaaggtgtcctagtggtcaatgtcacgtggaggaacaaaacgtacgtgggaaccctactggactgcaccaagcacgactgggcccctcccaggacccagattcaagaacatggcatcattatgtataccagcccaaatatctggatcagcaaaagtcagaagaacttgatagagagaagaaattaaaagaggatagtccgaggaaaactcctaataaagagagtggtgtgcccagccttcctgtatcgttaacaagcattaaagaggagcccaaagaggccaagcatcctgattctcaatcaatggaggagagcaagctgaaaaatgatgatcgaaagactcctgtgaactggaaggactctcggggaacaagagtggctgtctcctcacccatgagtcagcatcagtcatacatacagtacttgcatgcttatccttacccacagatgtacgaccccagccatcctgcataccgggctgtttctcccgtcctaatgcacagttatcctggggcatatctctctccaggatttcattatcctgtttatgggaagatgtcagggagagaagagacagagaaagtcaataccagccctagcgtcaacacgaaaacaaccactgaatctaaagcactggatttgctccagcagcatgctaaccaataccgcagcaagtctcctgctcctgtggaaaaggctacagctgagcgggaacgggaggcagaaagggaaagggatcgccactcccccttcggccagcggcacctgcacacgcaccaccacacccacgttggcatgggttacccgctaatcccgggtcaatatgacccttttcaaggcttgacctctgctgcccttgttgcctctcagcaggtggctgcccaggcatctgcatctggaatgtttcctggacaaagaagagaataacaagattggacatgtacattgtcatgtgactggatcacatggggaagcgctttatacagacatcagttccatggtgttaatttgaaatgccttaatggcaggcaaaaaccagtcatttcatttttgtaaattacagattttatcacagagtaacaaatgttgctgtaattaaacttctgttttatatatatatacgtatacatatctgtatatatacatatatatatatataaatataaatatattctttactttttgtatcagtaaccaggctcgcacacacagggtctgctgccacgtcgcaaaccactcagtaaaggaaattaaaaatgtatttgtcatgttaaaaagtgttagccacaaaaggctacttactttcttttccttttcctttaaaattgtaaataaataatgttatgtatcagtgtgcctgaaccttgcatatccttcacatatttcccataagcccctcagaaaggctaactgtgatgatgacactttggtacaatttagatgtctatttggtggctcctgttaaagacgcaccagtgtaaaatgttcctgtagtcactgtttgtacttgtgtattgtggaaaaagtacttttggaaggcatggggttgccagtaccacaaaaactgtgttgtatataatgtaaagattaaaatggggaaataatgagcatctgtgaataatgaggtgtcattttttgataatcttgaatggcaaataacccaatagcctgcgtaccagagacatctgtgattgttctattacttgaatagttctacagtctttttttttttttaatgtttacaattatccagttttagaagagagagactttaacgccattgcctggttacttgttttatgctgtaatctagtttattttatgtaaaatgtatattgaatgctttccttttttatacctgccttaaataatttggcaatcagaattaaaaagtttttttttttttaaat

SEQ ID NO: 203181 - DNA, 8746 bp, Homo sapiens
  Payload ID: 20069
  Gene Name: zinc finger protein 609
  Uniprot ID: O15014
  ENST ID: ENST00000326648
  CDS Start-End: 129-4364
gcaatgatgttgtccactgggcatgtactgaccaatgtggcaggtctgagaacatagctgaagctgaaaataggaaagctgggggcaaggaagagccttgaatcttgaggtgggacgttgactctaagatgtccttgagcagtggagcctccggagggaaaggagtggatgcaaacccggttgagacatacgacagtggggatgaatgggacattggagtagggaatctcatcattgacctggacgccgatctggaaaaggaccagcagaaactggaaatgtcaggctcaaaggaggtggggataccggctcccaatgctgtggccacactaccagacaacatcaagtttgtgaccccagtgccaggtcctcaagggaaggaaggcaaatcaaaatccaaaaggagtaagagtggcaaagacactagcaaacccactccagggacttccctgttcactccaagtgagggggcagctagcaagaaagaggtgcaggggcgctcaggagatggtgccaatgctggaggcctggttgctgctattgctcccaagggctcagagaaggcggctaaggcatcccgcagtgtagccggttccaaaaaggagaaggagaacagctcatctaagagcaagaaggagagaagcgaaggagtggggacttgttcagaaaaggatcctggggtcctccagccagttcccttgggaggacggggtggtcagtatgatggaagtgcaggggtggatacaggagctgtggagccacttgggagtatagctattgagcctggggcagcgctcaatcctttgggaactaaaccggagccagaggaaggggagaatgagtgtcgcctgctaaagaaagtcaagtctgaaaagatggagtcccctgtttccacaccagcagtgctgccaatacaccttttggtgccagtggtcaacaatgacatctcatctccctgtgagcagatcatggttcgtacccgatcagttggggtcaacacatgtgatgtggctctggccacagagcctgagtgcttgggcccctgtgaacctggaactagcgtcaaccttgaaggcatcgtgtggcaggaaacagaagatgggatgttggtggtaaatgtaacgtggaggaacaagacatatgtaggtacactccttgactgcacacgacatgattgggcacccccaaggttctgtgactccccgaccagtgacctggaaatgcgcaatggccggggtagaggcaaacgcatgcgtcccaacagtaatacacctgtcaatgagacagccacagcctctgacagcaaagggaccagtaacagcagcaaaacccgggcaggagccaatagcaaaggccgtcggggcagccagaattcttcagagcaccgcccacctgccagcagcacttctgaggatgtcaaggccagcccttcctcagctaataagcggaaaaacaaacccctttcagacatggagctgaattctagctcagaggactccaaagggagcaagcgtgtccgtactaattccatgggctcagccactggcccccttcctgggacaaaggtagaacccactgttctggacagaaactgcccctcccccgtcctaattgactgtccccacccaaactgcaacaagaagtacaagcacatcaatggacttaagtaccaccaagctcatgcccatacagatgatgacagcaagccggaagcggatggggacagtgagtacggagaggaacctattctccatgcagatcttgggagctgcaacggtgcatctgtctcacaaaaaggttccttgtcccctgcccgctcagctacccccaaagttcgacttgtagagccccatagcccttctccttcaagcaaattcagcacaaaaggcctctgtaagaaaaagttgagtggggaaggggacacagaccttggggccttatccaatgatggctctgatgatggaccctcagtgatggatgaaacaagcaatgatgcctttgattctttagaaaggaagtgtatggaaaaagaaaaatgtaaaaaaccctctagtttaaaacctgaaaagattccttccaagagcctaaagtcagcccgtcccattgcccctgccatccccccacagcaaatctacaccttccagacagccaccttcacagcagcgagcccaggctcttcctcaggcttgaccgccacagtggcacaagccatgcccaacagtccccaactcaagcccattcagcccaagcccactgttatgggagaacctttcacagtcaaccctgccttgactccagccaaggacaagaaaaagaaagacaaaaaaaagaaggaatcttcaaaggaacttgaaagtcctctgacccctgggaaggtgtgtcgagcagaggaaggcaaaagcccattcagggaatcttcaggagatgggatgaaaatggaggggctcctaaatggctcatcagacccccaccaaagccgactggctagcatcaaggctgaagccgacaagatctacagtttcacggacaatgcccccagcccttccattggaggcagtagccgccttgaaaacactacccctactcagcccctgactcccttacatgtggtgacccagaatggagctgaagccagctcagtcaaaaccaacagccctgcatactctgacatctctgatgctggggaggatggggagggcaaggtagacagtgtcaaatcaaaggacgccgaacagttggttaaagaaggggctaagaaaactctttttccccctcagcctcagagcaaagactcaccatattaccaaggctttgagagttactattctccaagttatgcacagtccagccctggggctctgaaccccagcagccaggcaggagtggagagccaggccctgaagacaaaaagggatgaggaacctgagagcatagaagggaaagtgaagaacgatatctgtgaagaaaagaagcccgagctgagcagttccagtcagcagccctcggtcatccagcagcgtcccaatatgtacatgcagtccctgtactacaaccagtatgcctatgtacccccctatggctacagcgaccagagttaccacacccaccttctgagcactaacacggcttaccggcagcagtacgaagaacagcagaaacgccagagcttagagcagcagcagcggggagtggacaagaaggcagagatgggcctgaaggagcgggaggcagcactcaaggaagagtggaagcaaaagccgtcaattccaccaactctcaccaaggcccccagcctgacagacctggtgaaatcaggacctggcaaggccaaggagccaggggctgacccagccaaatcagtcatcattcccaagttagatgactcttcaaaactcccgggccaggcccctgaaggccttaaagtgaagctgagtgatgccagccacctaagcaaggaggcctctgaggccaagacaggtgctgagtgtggtcgacaggcagagatggatccaatactctggtaccgacaggaggcagagccccggatgtggacatatgtttatcctgccaagtactcagacatcaagtcagaggatgagcggtggaaggaggagcgggaccgcaaattgaaggaggaaaggagtcggagtaaggactctgtccccaaggaagatgggaaggaaagcacaagtagtgactgcaagctgcccacgtcagaggagtctcgccttgggagcaaggagccccggccaagtgtccatgtgcctgtgtcctccccacttacccagcaccagtcctacatcccctacatgcacggctattcctacagtcagtcctacgaccccaaccaccccagctaccggagcatgcctgctgtgatgatgcagaactacccaggttcctacctgccttccagctactctttttccccatatggcagcaaggtctcaggtggtgaagatgctgacaaggcacgagccagccccagtgtgacttgtaaatccagctcagagtccaaagccctggacatcttgcagcagcatgccagtcactacaagagcaagtctcccacgataagtgataaaacttctcaggagagagatcgaggaggctgtggggtggttgggggtggtggcagctgtagcagcgtcgggggagcaagtgggggtgaacggagtgttgaccggccccgcacctctccttcccagcgcctgatgtccacacaccaccaccaccaccacttggggtactcattgctcccagcacagtacaacttaccctatgcagcagggctttcttctacagccattgttgccagccaacaaggctcaactccctcactctacccaccccccaggaggtgagaatgacaccaagtgcccggataaagtcagcttcacgggcccggactggcttacccaaggaggtgctgaaggtgccgtttagacatcagttaaatggtgttgatcatcctgtttgccgtttccaccatgactgaaggcagacccttggctatctcacctccaccagacctccggactacctgaccctacctcttcctcaggagctggagagctggtacttagcaaaaatatttattctctcagccacagttatgactattgtggcctctgtggagatgaaggcacgggaagcaaccaggggaacatggcctcagcccagagaagccactgctctgttccccaagcccttggtctgctgctggagcagtaccagcccccccgcccaccagggagggacccccacccccaagcactgggtaaggtctgaagacagcacagcagccatacccctcaccatcattaccaccatcaccagattctgcatctccctagtgctttgcaccctgggaattggcagcatgtggaggaactagaatctcaggaaagaaattgggggttgttttctacataattgtgaaaacaaggtcttcaaatgtggagacttctccccatttacatgagcacatataaacgctcacaacctagcctggaaaggaagaccaaggcatctgccccaacatggccttgagctgcctgtgaggcagggggcaggggttccaacaccagcacagggctccccagggacactgggagcaagctggtgctggagcatgaatgacgtctgtgaagtagaacctgcgtccccactaagtcctgctgcttcttattccccaactccttgcccttttcccttccctcctaaccccttggtgcctttcccagggggatccccacactggtcttgcctcttcttttccactgcttggctcttaagcctcaggcagataaactagtattccccccagcttggggaaccttggagtctgccaggtcaccttagggcaaggcccagaaggcagcccctgggagcacccagcagttcttggagatgtcctgtcatctagccatctgatatcttcctcatttgaggccacagatatatacagcccaattcctctgtctacaagtacatgattttatatagctcagtctataacctccatgtgggccaatataagctgtgtttcttggtaacacatattttgtttgaggggccactggccatgggaggttatttgttccttagaccctggaataacacatccaagccattacttattagagtctcagaatgtactcagtggagctgtgctttgaggcagccaacatttctctgctctccttagaaatgcagtctcccaatggaagctttatactctttgtactgggaaagtgaggatgatttggtagctttattggggtcatgtcttccccaaggtgtggggagcttagcttacttggcttttgaggtatcatccctctgttctcccctcctatctttccatgaccctctggattgagagagagagataaagactgacagacaccagtgtaggctggaaaagggagtgtgtgaccagagtgccaaaagtgactaggagcaggaacttggctccgactcagtttggaaaatgggaaataggggacagtaagcacaatgcccagtagtagttgatttccaaggaccctggaaccctacacttgagaggcttagggtcaccatctgctcaagaggatcccctctgatctacaggccttttccctaggtttctgcctcctcgtttttgttcaagttgggttctgagtcctccccaaaaaccattgttttagacctcttggcagggccccaaaacagcctccctcatacccatcattccctctgccttctgctgccctcatgggcagtgctctgagcagtgacctccctttcctccgtggaagtagctagtgcagacaccgtcatcccaccccacctgagtcaccccaaccaagagggtgactgaatttcagcctgattatgccctcctggggctcctgtgaggtggagccaaggttccctctctgttcctgtttgtttttaaatattgttgtgtgttttgtatctgtggcactggcctgcagcatactctgtatatattgtaaagaaaccgttaggagtaattttcttttgcattgggcaggcatggccctgcattcctgccctttccactcattctgtaacacagaggacgaacttctgtattagctgggcagccttgggttctccagaagagaacaggtttttcttttcctttttaatttttcttcttaaacatttggctctttgatcctcatatccaagtctcccctgaagagtaggagctgctcagaagagcaggtgaaagccaccatggcagatcctgatgcctgccgggcctagtcttccctctgaaataacatgaagcagcagctgtggagattcttgacaagtgctgagtgaaagatttgctgcccacctctacatggggaggagaaacacaggtgggagctacctgtggcatccatgacctagtcagagggatgagatgctcagcaggggtccccatcctatcccaccccacaaacaaaggctggaaaaatttgctaccaagggccaagaccaccagaccaagcctgtttatgagccacccctgcccaggccctcacagacattgctcacggggcttcccatagaggagaagctaaagagggagggggcctcatccccagatagatcaggcaaggcttggagagctgctctttaggatccacatcaactacttcctcattttaaggtatggcagttcccttcatccccttttcctgccttgtacatgtacatgtatgaaatttccttctcttaccgaactctctccacacatcacaaggtcaaagaaccacacgcttagaagggtaagagggcaccctatgaaatgaaatggtgatttcttgagtctcttttttccacgtttaaggggccatggcaggacttagagttgcgagttaagactgcagagggctagagaattatttcatacaggctttgaggccacccatgtcacttatcccgtataccctctcaccatccccttgtctactctgatgcccccaagatgcaactgggcagctagttggccccataattctgggcctttgttgtttgttttaattacttgggcatcccaggaagctttccagtgatctcctaccatgggcccccctcctgggatcaagcccctcccaggccctgtccccagcccctcctgccccagcccacccgcttgccttggtgctcagccctcccattgggagcaggttggggcgagctggaggcccgggctggaggggcagtgttgctgttcatagattttgttccattggcgttgctctgttgaatttaatttcagtcttcctgattcttcccttctgtaaagtgtacattaccaagttccttgtttttttatatatatatataaatatatatatatacaaactgtactctttttgcctttgtacattcaggcaagaagagaaaataaatctttttaagagacaatcacaaatctgtgagggctgctggttatttctcctggagtttgctgctgagctgcctcttccttcctcccaattttcctgttctccctcagctctcctgatcttcctggccctgctccatatgcatcctcagcttcactttccctggctgatggcaagctgttgaatccagtgtccagactacctgccttgtaacccttttctgcccagcattgttttctggcttggccactggcttagcccaggagctttactctgtgccctggcctcccctctcttcacctttagatttccattcaccgaagtggctttggacccctgggtactctgggacctgtttcctggaggccctggcttgggacactcacctgtgaaactatgcagctgggagctctctgcctaagagtttgcactatttaaacctgcctgggagttaggacggatggttttaggaatgaccggaaaactacccctaaaactcccccgacattccagcctctagaatgctctgatccagagctcagtggatgattcccagctggtggactcctgtggctaccccatcagaacaagggctaagggtttatgggtcaagagtatttgatcagaattttaaagggtggtatactctgaaacacagcccaaccaaaccattgtttggccgctttctcttttcctctaccttcctcatccccacttttttccctttctctctacttcctcttcttaattggctttggaattgaaatatatttttaaattatttgttgtatttattgaataaagtttttaatgtccctgttcttaaa

SEQ ID NO: 203182 - DNA, 3863 bp, Homo sapiens
  Payload ID: 20069
  Gene Name: zinc finger protein 609
  ENST ID: ENST00000416172
  CDS Start-End: 225-1220
cgggaacggatggcggcctgggccccgtagcagcggcggctctacggcccggggccccgggcgggcggaggtggcggctcccgggaccggccgcgcgcaatgatgttgtccactgggcatgtactgaccaatgtggcaggtctgagaacatagctgaagctgaaaataggaaagctgggggcaaggaagagccttgaatcttgaggtgggacgttgactctaagatgtccttgagcagtggagcctccggagggaaaggagtggatgcaaacccggttgagacatacgacagtggggatgaatgggacattggagtagggaatctcatcattgacctggacgccgatctggaaaaggaccagcagaaactggaaatgtcaggctcaaaggaggtggggataccggctcccaatgctgtggccacactaccagacaacatcaagtttgtgaccccagtgccaggtcctcaagggaaggaaggcaaatcaaaatccaaaaggagtaagagtggcaaagacactagcaaacccactccagggacttccctgttcactccaagtgagggggcagctagcaagaaagaggtgcaggggcgctcaggagatggtgccaatgctggaggcctggttgctgctattgctcccaagggctcagagaaggcggctaaggcatcccgcagtgtagccggttccaaaaaggagaaggagaacagctcatctaagagcaagaaggagagaagcgaaggagtggggacttgttcagaaaaggatcctggggtcctccagccagttcccttgggaggacggggtggtcagtatgatggaagtgcaggggtggatacaggagctgtggagccacttgggagtatagctattgagcctggggcagcgctcaatcctttgggaactaaaccggagccagaggaaggggagaatgagtgtcgcctgctaaagaaagtcaagtctgaaaaggtaagaggtggccagatatggctgcccactgactgccagtcagaactgccctggactaactgccaaatactatgtgtactctgtgggaggctcattagtgtgtgggtaatgaccaattacaaggtcagagcagctggtaatgataatgtggttttcttccaaattagaggattcccctacagactcatttacagcaggcctggacattgtggaacaggatatttgttgttgggggcagctactttgtagaatgaactttctgtagtctgagttgagaccttcccaccttgtctttgcccacctcagacacttgttggtagagattggcatcagacctttatttgtttcccagcttgactggcatttcatcatcagactcataatagttgataaacaatacgcctttggtgataatgtagattgagtacggttcttgatgggataaatggtgctgttgggtctctggtagaacaaagggctaaatttcatggcatatctacgaagtgttctattgccggctaccaaagagcgaaggggcacattttgagggcaagaggtactcattgtactttgaggtacttagatcttatgagttattgttgtggttatgacagtttggcctaggaagagattggccattaaaggtgtagcttcatgccaggtatctcccacaactattaggaatcaaagtctcctcgtggtttaatagctgccaacagtgtaatgataccttgccttctgcttgacttggaaggacaggtgcctgcagccccaggaggggttagaactgagtccctcctctgggaagatgatcttagttcatgctttaggaaatggaacttgcagggctggaggagaatgggtgtgagtctagggtcagctcaggcagcattaaacttcagcagcttattcctgcaaaacagtggccttgtggtgagctgttcattggctcttgattttctgctctgtgctctgctcatcctgtgctttcagctgatcccagcagatgcagtataaattgatttctctgtaattagatcagctgcagcagggaatacctatttccatatgtaagtgttaataaataaaggctggatgtgtatgtttgggtggtggtgccctcttagtgcctgtattccagtggtagctcatgctttctttgctgtcggtattttggtctttgcctctggcacatctgtagctcttagcaacatctgggcttctccagtagcaggtctgtgagtttcttccactaataatacagtggctcattcccttttaccagtggcagctgccagagaggctgcctgtgtttaggtggcagatgctatagtccacttcagcagagtcaggttccagctggttactagcttggctcatcctgtgctggctgtgatttgctattttctctcgggtacagatggataatactgttttaaagaggcttaggagtactagcagttgttgcttctgttccaggcccattagactgttccctacatctggcttcaagaaactcttgccatatatccatattcataatcattattcttcctgtgctaaaaagtacttctgaggatgaccttcattctcctatctaaattttagagtacttatgttgcaaccttctaagcccagtgatagtctgtggatgaaaggattaatattgcttagctttatgttggatttaagtgtaaatgtccatgattgtctctaacagagaagcaaatggaacccattttctcacatagaggtgcagggactgattgggtggctgcccttcagattataattgggctgaaagatgcagtatgttcagctaagaatacatcctggtgccagggagttttgtcccttaataatgttgctttgccatataagctttgcctcccagggagactctgagaatggggcagcagaatgagaaagaaaagggaaagagactgtgcttcagtttttgaaagatagagaaaattgctggcaattacttttagaagcagaaaatttgctatacagtttcatgtaaccataagcaagaacctgctttctcaattccttcccctgttccctcaacccttttggacagtctggtcctgagggtgcctttccatattacctttggctattgaaataaataattatttaaataaatgtttggaagttgctaggagattaaaacatgctgtgcagggagagaacatttctggactgggaggagcagaagaggcaagttaaaggaaaggaagttaggaaccatgcagaggagcggtttttgagaaacaacaatctccggtttggggcataataggtgctcagtgagtatttgatgattagtactataatttataagcaaagtctttgaaaacttctttaaaattttctctctgagaaatgggcttgcctgtggtttgggacgtttctatgtagggataacaaacagaaccaaaatagcaaaacagatgttttgatataatctaagaattgcatcctctcaactgggaactgtcatgaagaggaagaactcataaaatttgggaagtttcttgactgaattctgtggtgcagagtagcagtgttgactactagccaatgaggaagatttgaatattgaaattactggctgggcctggtgattcatgcctgtaatcccagcactttgggaggcctaggtgggcagattgcttaagctcaggagtttgagaccagcctaggcaacatggtgaaaccctgtctctacaaaaattagccgggcattggtggtgtgcacccgtaatcccagctactggggaggctgaggtggaaggatagcttgagcctgcgaggtggaggttgcattgagctgagacggcaccactggactccagcctaggcaatagagccagaccttgtctc

SEQ ID NO: 203183 - DNA, 2150 bp, Homo sapiens
  Payload ID: 20070
  Gene Name: zinc finger protein 610
  Uniprot ID: Q8N9Z0
  ENST ID: ENST00000321287
  CDS Start-End: 407-1795
agacccggaagcggatcgcgtgggtagaaggtcacaccgcagcgcgtcagtttccctttgtttagattcaatctgggcttcccagctcccccgcgcttctgtacccgggatctgagagtcaacacagaccttgaaatccccgcaccgctccctccaccccgtgtaaattcaggcgtctccgtgagagtccggcgctcgcttccctgtgtgttaaaatcgctcggcgacgggtcctgtccccgctcgttctgccttgggccagacacaggagtgttgccatgttgtccaaactggtctcgaaattctggagtcaagcagtctgcctgcctcgttctccaaacgtgctgggattacaggcatgagccactacgcctggccaagtattcggattgacttataaacagtcatgctatgtgatgaagaagcccagaagaggaaagcaaaggagtcagggatggctcttcctcagggacgcttgacattcatggacgtggccatcgaattctctcaggaggagtggaaatccctggaccctggacagagggctttatacagggacgtgatgttggagaactacaggaacctggtctttctgggaatctgtcttcctgacctaagtattatttccatgttgaagcaaaggagagagcccttgattctgcaaagtcaagttaaaatagtaaaaaatacagatggaagggaatgtgtcagaagcgtgaacacagggaggagctgtgtattgggaagcaatgcagaaaacaagcctattaaaaatcaacttggattaacccttgaggcacatctgtctgaattgcagctgtttcaagccggaaggaaaatttacagaagtaatcaagttgaaaagtttacaaaccatcgttcctcagtttcaccacttcaaaaaatttcttctagtttcacaacacacatttttaataaatatagaaatgatcttattgatttcccattactcccacaagaagagaaagcatacattagaggaaaatcttatgaatatgaatgtagtgaagatggtgaagtttttagagtccgtgcaagccttactaaccatcaagtaatccatactgcagagaaaccttacaaatgtactgaatgtggcaaggtcttcagtcgcaattcacaccttgtagaacattggagaattcatactggacagaagccttacaaatgtagtgaatgtgacaaggtgtttaatcgcaattcaaaccttgcacgacatcaaagaattcatactggagagaagcctcacaaatgtaacgaatgtggcaaagcttttagagagtgttcgggacttactacccatcttgtaatccatactggagagaaaccttacaaatgtaatgagtgtggcaagaacttcaggcacaaattttctctaaccaatcatcagagaagtcacacggcggaaaaaccttacaaatgtaatgaatgtggcaaggtctttagtctgctttcataccttgcacggcatcaaataattcatagtacagagaagccctacaaatgtaacgaatgtggaagagcatttcacaagcgtccgggccttatggcccatcttctaatccatactggagagaaaccttacaaatgtaatgaatgtgacaaagtctttgggcgcaaattatacctaaccaaccatcagagaattcatactggagagagaccttacaagtgtaatgcatgtggcaaggtcttcaatcaaaatccacacctttcacgacatcggaaaattcatgctggagagaattcactgcgtaccttacagatggaatgaatgtggcaaaatctttagttagaattcacacctagcacaacattggaggactcaggagaaaaaccttacaaatatcataaatgtggcaaagaatttagtttgcattgaagcctcatcactcatctcttgatccacactgaaaggaaaccctacaaatgtaaagttaataacatatataaataatctataaagagagaacagttatatcagaatagagcatttaatgaaaactaccagtatagcatattcttgagtaggattcacatttaactgctggcaccgtaatttgtaactctttgatttagaatgtacatacttctcatgttttaagtaataaagtttaaagttttttttt

SEQ ID NO: 203184 - DNA, 1855 bp, Homo sapiens
  Payload ID: 20070
  Gene Name: zinc finger protein 610
  Uniprot ID: Q8N9Z0
  ENST ID: ENST00000327920
  CDS Start-End: 376-1764
aggcagctttaacctgggtgtgggtgaggatgacactgtgatgctcctagaggtggttcatgaggaatggacgaataagtggttggaactgatatgagaacacatagctgaagaagagacacaggagtgttgccatgttgtccaaactggtctcgaaattctggagtcaagcagtctgcctgcctcgttctccaaacgtgctgggattacaggcatgagccactacgcctggccaagtattcggtatttataaaatctacagtagtacacagttatgtcgtaggccatcacattcggtcaccacacactcactgactcatccagagcaatttctagtcctgcaagcgccattcatggattgacttataaacagtcatgctatgtgatgaagaagcccagaagaggaaagcaaaggagtcagggatggctcttcctcagggacgcttgacattcatggacgtggccatcgaattctctcaggaggagtggaaatccctggaccctggacagagggctttatacagggacgtgatgttggagaactacaggaacctggtctttctgggaatctgtcttcctgacctaagtattatttccatgttgaagcaaaggagagagcccttgattctgcaaagtcaagttaaaatagtaaaaaatacagatggaagggaatgtgtcagaagcgtgaacacagggaggagctgtgtattgggaagcaatgcagaaaacaagcctattaaaaatcaacttggattaacccttgaggcacatctgtctgaattgcagctgtttcaagccggaaggaaaatttacagaagtaatcaagttgaaaagtttacaaaccatcgttcctcagtttcaccacttcaaaaaatttcttctagtttcacaacacacatttttaataaatatagaaatgatcttattgatttcccattactcccacaagaagagaaagcatacattagaggaaaatcttatgaatatgaatgtagtgaagatggtgaagtttttagagtccgtgcaagccttactaaccatcaagtaatccatactgcagagaaaccttacaaatgtactgaatgtggcaaggtcttcagtcgcaattcacaccttgtagaacattggagaattcatactggacagaagccttacaaatgtagtgaatgtgacaaggtgtttaatcgcaattcaaaccttgcacgacatcaaagaattcatactggagagaagcctcacaaatgtaacgaatgtggcaaagcttttagagagtgttcgggacttactacccatcttgtaatccatactggagagaaaccttacaaatgtaatgagtgtggcaagaacttcaggcacaaattttctctaaccaatcatcagagaagtcacacggcggaaaaaccttacaaatgtaatgaatgtggcaaggtctttagtctgctttcataccttgcacggcatcaaataattcatagtacagagaagccctacaaatgtaacgaatgtggaagagcatttcacaagcgtccgggccttatggcccatcttctaatccatactggagagaaaccttacaaatgtaatgaatgtgacaaagtctttgggcgcaaattatacctaaccaaccatcagagaattcatactggagagagaccttacaagtgtaatgcatgtggcaaggtcttcaatcaaaatccacacctttcacgacatcggaaaattcatgctggagagaattcactgcgtaccttacagatggaatgaatgtggcaaaatctttagttagaattcacacctagcacaacattggaggactcaggagaaaaaccttacaaatatcataaatgtggcaaag

SEQ ID NO: 203185 - DNA, 2191 bp, Homo sapiens
  Payload ID: 20070
  Gene Name: zinc finger protein 610
  Uniprot ID: Q8N9Z0
  ENST ID: ENST00000403906
  CDS Start-End: 457-1845
agattcaatctgggcttcccagctcccccgcgcttctgtacccgggatctgagagtcaacacagaccttgaaatccccgcaccgctccctccaccccgtgtaaattcaggcgtctccgtgagagtccggcgctcgcttccctgtgtgttaaaatcgctcggcgacgggtcctgtccccgctcgttctgccttgggccagacacaggagtgttgccatgttgtccaaactggtctcgaaattctggagtcaagcagtctgcctgcctcgttctccaaacgtgctgggattacaggcatgagccactacgcctggccaagtattcggtatttataaaatctacagtagtacacagttatgtcgtaggccatcacattcggtcaccacacactcactgactcatccagagcaatttctagtcctgcaagcgccattcatggattgacttataaacagtcatgctatgtgatgaagaagcccagaagaggaaagcaaaggagtcagggatggctcttcctcagggacgcttgacattcatggacgtggccatcgaattctctcaggaggagtggaaatccctggaccctggacagagggctttatacagggacgtgatgttggagaactacaggaacctggtctttctgggaatctgtcttcctgacctaagtattatttccatgttgaagcaaaggagagagcccttgattctgcaaagtcaagttaaaatagtaaaaaatacagatggaagggaatgtgtcagaagcgtgaacacagggaggagctgtgtattgggaagcaatgcagaaaacaagcctattaaaaatcaacttggattaacccttgaggcacatctgtctgaattgcagctgtttcaagccggaaggaaaatttacagaagtaatcaagttgaaaagtttacaaaccatcgttcctcagtttcaccacttcaaaaaatttcttctagtttcacaacacacatttttaataaatatagaaatgatcttattgatttcccattactcccacaagaagagaaagcatacattagaggaaaatcttatgaatatgaatgtagtgaagatggtgaagtttttagagtccgtgcaagccttactaaccatcaagtaatccatactgcagagaaaccttacaaatgtactgaatgtggcaaggtcttcagtcgcaattcacaccttgtagaacattggagaattcatactggacagaagccttacaaatgtagtgaatgtgacaaggtgtttaatcgcaattcaaaccttgcacgacatcaaagaattcatactggagagaagcctcacaaatgtaacgaatgtggcaaagcttttagagagtgttcgggacttactacccatcttgtaatccatactggagagaaaccttacaaatgtaatgagtgtggcaagaacttcaggcacaaattttctctaaccaatcatcagagaagtcacacggcggaaaaaccttacaaatgtaatgaatgtggcaaggtctttagtctgctttcataccttgcacggcatcaaataattcatagtacagagaagccctacaaatgtaacgaatgtggaagagcatttcacaagcgtccgggccttatggcccatcttctaatccatactggagagaaaccttacaaatgtaatgaatgtgacaaagtctttgggcgcaaattatacctaaccaaccatcagagaattcatactggagagagaccttacaagtgtaatgcatgtggcaaggtcttcaatcaaaatccacacctttcacgacatcggaaaattcatgctggagagaattcactgcgtaccttacagatggaatgaatgtggcaaaatctttagttagaattcacacctagcacaacattggaggactcaggagaaaaaccttacaaatatcataaatgtggcaaagaatttagtttgcattgaagcctcatcactcatctcttgatccacactgaaaggaaaccctacaaatgtaaagttaataacatatataaataatctataaagagagaacagttatatcagaatagagcatttaatgaaaactaccagtatagcatattcttgagtaggattcacatttaactgctggcaccgtaatttgtaactctttgatttagaatgtacatacttctcatgttttaagtaataaagtttaaag

SEQ ID NO: 203186 - DNA, 581 bp, Homo sapiens
  Payload ID: 20070
  Gene Name: zinc finger protein 610
  ENST ID: ENST00000593698
  CDS Start-End: 327-581
tcgtgaaggaaggaggaacacactccaagttcttatcacagcacacaagtcattcatgtagcaaactatacacaggagtgttgccatgttgtccaaactggtctcgaaattctggagtcaagcagtctgcctgcctcgttctccaaacgtgctgggattacaggcatgagccactacgcctggccaagtattcggtatttataaaatctacagtagtacacagttatgtcgtaggccatcacattcggtcaccacacactcactgactcatccagagcaatttctagtcctgcaagcgccattcatggattgacttataaacagtcatgctatgtgatgaagaagcccagaagaggaaagcaaaggagtcagggatggctcttcctcagggacgcttgacattcatggacgtggccatcgaattctctcaggaggagtggaaatccctggaccctggacagagggctttatacagggacgtgatgttggagaactacaggaacctggtctttctgggaatctgtcttcctgacctaagtattatttccatgttgaagcaaaggagagagcccttgattctg

SEQ ID NO: 203187 - DNA, 2723 bp, Homo sapiens
  Payload ID: 20070
  Gene Name: zinc finger protein 610
  Uniprot ID: Q8N9Z0
  ENST ID: ENST00000601151
  CDS Start-End: 453-1712
tcaatctgggcttcccagctcccccgcgcttctgtacccgggatctgagagtcaacacagaccttgaaatccccgcaccgctccctccaccccgtgtaaattcaggcgtctccgtgagagtccggcgctcgcttccctgtgtgttaaaatcgctcggcgacgggtcctgtccccgctcgttctgccttgggccagacacaggagtgttgccatgttgtccaaactggtctcgaaattctggagtcaagcagtctgcctgcctcgttctccaaacgtgctgggattacaggcatgagccactacgcctggccaagtattcggtatttataaaatctacagtagtacacagttatgtcgtaggccatcacattcggtcaccacacactcactgactcatccagagcaatttctagtcctgcaagcgccattcatggattgacttataaacagtcatgctatgtgatgaagaagcccagaagaggaaagcaaaggagtcagggatggctcttcctcagggacgcttgacattcatggacgtggccatcgaattctctcaggaggagtggaaatccctggaccctggacagagggctttatacagggacgtgatgttggagaactacaggaacctggtctttctggggaggagctgtgtattgggaagcaatgcagaaaacaagcctattaaaaatcaacttggattaacccttgaggcacatctgtctgaattgcagctgtttcaagccggaaggaaaatttacagaagtaatcaagttgaaaagtttacaaaccatcgttcctcagtttcaccacttcaaaaaatttcttctagtttcacaacacacatttttaataaatatagaaatgatcttattgatttcccattactcccacaagaagagaaagcatacattagaggaaaatcttatgaatatgaatgtagtgaagatggtgaagtttttagagtccgtgcaagccttactaaccatcaagtaatccatactgcagagaaaccttacaaatgtactgaatgtggcaaggtcttcagtcgcaattcacaccttgtagaacattggagaattcatactggacagaagccttacaaatgtagtgaatgtgacaaggtgtttaatcgcaattcaaaccttgcacgacatcaaagaattcatactggagagaagcctcacaaatgtaacgaatgtggcaaagcttttagagagtgttcgggacttactacccatcttgtaatccatactggagagaaaccttacaaatgtaatgagtgtggcaagaacttcaggcacaaattttctctaaccaatcatcagagaagtcacacggcggaaaaaccttacaaatgtaatgaatgtggcaaggtctttagtctgctttcataccttgcacggcatcaaataattcatagtacagagaagccctacaaatgtaacgaatgtggaagagcatttcacaagcgtccgggccttatggcccatcttctaatccatactggagagaaaccttacaaatgtaatgaatgtgacaaagtctttgggcgcaaattatacctaaccaaccatcagagaattcatactggagagagaccttacaagtgtaatgcatgtggcaaggtcttcaatcaaaatccacacctttcacgacatcggaaaattcatgctggagagaattcactgcgtaccttacagatggaatgaatgtggcaaaatctttagttagaattcacacctagcacaacattggaggactcaggagaaaaaccttacaaatatcataaatgtggcaaagaatttagtttgcattgaagcctcatcactcatctcttgatccacactgaaaggaaaccctacaaatgtaaagttaataacatatataaataatctataaagagagaacagttatatcagaatagagcatttaatgaaaactaccagtatagcatattcttgagtaggattcacatttaactgctggcaccgtaatttgtaactctttgatttagaatgtacatacttctcatgttttaagtaataaagtttaaagtttttttttagttttttcttttttttttgagacgaagtctcgctgtattacccaggctggagtgcagtggcatgatcttggctcactgcaacctccgtctcccggattcaagcaattctcctgcctcagcctcctgagtagctgggattacaggcatgtgccactactgcccggctaatttttgtatttttagtcgagacggggtttccctccgttggccaggccggtttcaaactcctgacctcaagtgatccactggccttggcctcccaaagtgctgggattataggtgtgagccacagcgcccggcctagtttaaatttttcttagtgtgaatgaattacatcctttctaccagcgttgtttaatcttacctcaggaggatactttatagtagagaataataacccattatgattttaaggttgaagcagccagaaaagtgtgtgtgtgtgtatgtgtgtgagacataaaacaacatacgcttctgggtgcaatatacttaagtaagtatgatgttgagtaattacacttagtacttgagttagtttctctgtactctggtgtaggatgtttatgtgggtaaagtcaaaatcactttaatagtacaatttcagccttgtacaccctcaaatgtgtgtgagtgttaaagagtatgccctgta

SEQ ID NO: 203188 - DNA, 1643 bp, Homo sapiens
  Payload ID: 20070
  Gene Name: zinc finger protein 610
  Uniprot ID: Q8N9Z0
  ENST ID: ENST00000613461
  CDS Start-End: 29-1288
gacatttaggattgacttataaacagtcatgctatgtgatgaagaagcccagaagaggaaagcaaaggagtcagggatggctcttcctcagggacgcttgacattcatggacgtggccatcgaattctctcaggaggagtggaaatccctggaccctggacagagggctttatacagggacgtgatgttggagaactacaggaacctggtctttctggggaggagctgtgtattgggaagcaatgcagaaaacaagcctattaaaaatcaacttggattaacccttgaggcacatctgtctgaattgcagctgtttcaagccggaaggaaaatttacagaagtaatcaagttgaaaagtttacaaaccatcgttcctcagtttcaccacttcaaaaaatttcttctagtttcacaacacacatttttaataaatatagaaatgatcttattgatttcccattactcccacaagaagagaaagcatacattagaggaaaatcttatgaatatgaatgtagtgaagatggtgaagtttttagagtccgtgcaagccttactaaccatcaagtaatccatactgcagagaaaccttacaaatgtactgaatgtggcaaggtcttcagtcgcaattcacaccttgtagaacattggagaattcatactggacagaagccttacaaatgtagtgaatgtgacaaggtgtttaatcgcaattcaaaccttgcacgacatcaaagaattcatactggagagaagcctcacaaatgtaacgaatgtggcaaagcttttagagagtgttcgggacttactacccatcttgtaatccatactggagagaaaccttacaaatgtaatgagtgtggcaagaacttcaggcacaaattttctctaaccaatcatcagagaagtcacacggcggaaaaaccttacaaatgtaatgaatgtggcaaggtctttagtctgctttcataccttgcacggcatcaaataattcatagtacagagaagccctacaaatgtaacgaatgtggaagagcatttcacaagcgtccgggccttatggcccatcttctaatccatactggagagaaaccttacaaatgtaatgaatgtgacaaagtctttgggcgcaaattatacctaaccaaccatcagagaattcatactggagagagaccttacaagtgtaatgcatgtggcaaggtcttcaatcaaaatccacacctttcacgacatcggaaaattcatgctggagagaattcactgcgtaccttacagatggaatgaatgtggcaaaatctttagttagaattcacacctagcacaacattggaggactcaggagaaaaaccttacaaatatcataaatgtggcaaagaatttagtttgcattgaagcctcatcactcatctcttgatccacactgaaaggaaaccctacaaatgtaaagttaataacatatataaataatctataaagagagaacagttatatcagaatagagcatttaatgaaaactaccagtatagcatattcttgagtaggattcacatttaactgctggcaccgtaatttgtaactctttgatttagaatgtacatacttctcatgttttaagtaataaagtttaaagttttttttt

SEQ ID NO: 203189 - DNA, 1772 bp, Homo sapiens
  Payload ID: 20070
  Gene Name: zinc finger protein 610
  Uniprot ID: Q8N9Z0
  ENST ID: ENST00000616431
  CDS Start-End: 29-1417
gacatttaggattgacttataaacagtcatgctatgtgatgaagaagcccagaagaggaaagcaaaggagtcagggatggctcttcctcagggacgcttgacattcatggacgtggccatcgaattctctcaggaggagtggaaatccctggaccctggacagagggctttatacagggacgtgatgttggagaactacaggaacctggtctttctgggaatctgtcttcctgacctaagtattatttccatgttgaagcaaaggagagagcccttgattctgcaaagtcaagttaaaatagtaaaaaatacagatggaagggaatgtgtcagaagcgtgaacacagggaggagctgtgtattgggaagcaatgcagaaaacaagcctattaaaaatcaacttggattaacccttgaggcacatctgtctgaattgcagctgtttcaagccggaaggaaaatttacagaagtaatcaagttgaaaagtttacaaaccatcgttcctcagtttcaccacttcaaaaaatttcttctagtttcacaacacacatttttaataaatatagaaatgatcttattgatttcccattactcccacaagaagagaaagcatacattagaggaaaatcttatgaatatgaatgtagtgaagatggtgaagtttttagagtccgtgcaagccttactaaccatcaagtaatccatactgcagagaaaccttacaaatgtactgaatgtggcaaggtcttcagtcgcaattcacaccttgtagaacattggagaattcatactggacagaagccttacaaatgtagtgaatgtgacaaggtgtttaatcgcaattcaaaccttgcacgacatcaaagaattcatactggagagaagcctcacaaatgtaacgaatgtggcaaagcttttagagagtgttcgggacttactacccatcttgtaatccatactggagagaaaccttacaaatgtaatgagtgtggcaagaacttcaggcacaaattttctctaaccaatcatcagagaagtcacacggcggaaaaaccttacaaatgtaatgaatgtggcaaggtctttagtctgctttcataccttgcacggcatcaaataattcatagtacagagaagccctacaaatgtaacgaatgtggaagagcatttcacaagcgtccgggccttatggcccatcttctaatccatactggagagaaaccttacaaatgtaatgaatgtgacaaagtctttgggcgcaaattatacctaaccaaccatcagagaattcatactggagagagaccttacaagtgtaatgcatgtggcaaggtcttcaatcaaaatccacacctttcacgacatcggaaaattcatgctggagagaattcactgcgtaccttacagatggaatgaatgtggcaaaatctttagttagaattcacacctagcacaacattggaggactcaggagaaaaaccttacaaatatcataaatgtggcaaagaatttagtttgcattgaagcctcatcactcatctcttgatccacactgaaaggaaaccctacaaatgtaaagttaataacatatataaataatctataaagagagaacagttatatcagaatagagcatttaatgaaaactaccagtatagcatattcttgagtaggattcacatttaactgctggcaccgtaatttgtaactctttgatttagaatgtacatacttctcatgttttaagtaataaagtttaaagttttttttt

SEQ ID NO: 203190 - DNA, 3153 bp, Homo sapiens
  Payload ID: 20071
  Gene Name: zinc finger protein 611
  Uniprot ID: Q8N823
  ENST ID: ENST00000319783
  CDS Start-End: 318-2435
aatgctgtgtatttacttgaactcatacatcagaagatagtgatcttaacacattatgtttgggaagtttaaaatatctcttccaaatgcttgatgaaaaaggtgggaggatcacttgagccagggagttgaaggctgcagtgagccctgtttttgccaccacactccagcttggagaggtgaggggctgtcctctggatggcaattgatgaaggatgagtctgtgccctgaaggggagatcagtccagcccagctccccactgctgcctcgtgtgtggtggcttctccaggagagaggattgattcctaaagactcatgttacgtgaggaagcagctcagaagaggaaaggaaaggagccaggcatggctcttcctcagggacgcttgactttccgggatgtggctatagaattctcattggcagagtggaaatgcctgaacccttcacagagggctttgtacagggaagtgatgttggagaactacaggaacctggaggctgtggatatctcttccaaatgcatgatgaaggaggtcttgtcaacagggcaaggcaatacagaagtgatccacacagggacattgcaaagacatgaaagtcatcacattggagatttttgcttccaggaaattgagaaagaaattcatgacattgagtttcagtgtcaagaagatgaaagaaatggccttgaagcacccatgacaaaaataaaaaagttgactggtagcacagaccaacatgatcacaggcatgctggaaacaagcctattaaagatcagcttggatcaagcttttattcacatctgcctgaactccacatatttcagatcaaaggtgaaattggtaatcaacttgagaagtctactaatgatgctccctcagtttcaacattccaaagaatttcctgtaggccccaaacccagatttctaataactatgggaataatcccctgaattcttcattactcccacaaaaacaggaagtacacatgagagaaaaatctttccaatgtaataagagtggcaaagcctttaattgtagctcactcttaaggaaacaccagataccccatttaggagacaaacaatataaatgtgatgtatgtggcaagctctttaatcacgagcaataccttgcatgccatgatagatgtcacactgttgagaaaccttacaagtgtaaagagtgtggcaagaccttcagtcaggagtcatcccttacctgccatcgtagacttcatactggagtaaaacgttacaattgtaatgagtgtggcaagatctttggtcaaaattcagcccttctaattgataaggcaattgatactggagaaaatccttacaagtgtaatgaatgtgacaaggcttttaatcaacaatcacaactttcacatcatagaattcatactggagagaaaccttacaaatgtgaagaatgtgacaaagttttcagtcggaaatcaaccattgagacacataagagaattcatactggagagaaaccatacagatgtaaggtttgtgacacagctttcacgtggcattcacagctggctcgacatagaagaattcatactgcaaagaaaacttataaatgtaatgagtgtggcaagaccttcagtcacaagtcatcccttgtatgccatcatagacttcatggtggagagaaatcttacaaatgtaaggtttgtgacaaggcttttgtgtggagttcacaactggcaaaacatactagaattgactgtggagaaaaaccttacaagtgtaatgaatgtgggaagacctttggtcaaaattcagatcttttaattcataagtcaattcatactggggagcaaccttacaaatgtgatgaatgtgaaaaggttttcagtcgtaaatcaagccttgagacacataagataggtcatactggagagaaaccatacaaatgtaaggtttgtgacaaggcttttgcgtgtcattcctatctggcaaaacatactagaattcatagtggagagaaaccttacaagtgtaatgagtgcagcaagaccttcagtcacaggtcataccttgtatgccatcatagagttcatagtggtgagaaaccttacaagtgtaatgagtgcagcaagaccttcagtcgcaggtcatcccttcattgccatcgtagacttcatagtggtgagaaaccttacaagtgtaatgagtgtggcaataccttccgtcactgctcatcccttatataccatcgtagacttcatactggagagaaatcttacaaatgtacaatttgtgacaaggctttcgtgcgtaattcactcctgtcaagacataccagaattcacactgcagagaaaccttacaagtgtaatgaatgtgggaaggcttttaatcaacaatcacacctttcacgtcatcatagaattcatactggagagaaaccttagaaatgtgaagcatgtgacaaagtttccatttggaaatcacaccttaaagacataggagaatttatactggagagaaagcttacaaatgtaaggtttctgacaagacttgggagtgattcacacctggaacaacatactggacttcacactggagagaaaccttacaagtgtaatgagtgtggcaaagcctttggcaagcagtcaacacttattcaccatcaggcaattcatggtgtagggaaacttgactaatgtaatgattgtcacaaagtcttcagtaatgctacaacgattacaaatcattggagaatccataatgaagagagatcttacaagtgtaataaatgtggcaaatttttcagagatcgttcacatattgcaggtcatcggtgaactcatactggagagaaaccttacaaatgtcatgactgtgccaaggtcttcagtcaagcttcatcctatgcaaaacataggagaatttatacaggagagaaacctcacaagtgtgatgattgtggcaaagcctttgcttcacgttcacacgtcattagacatcagagaatctatactggacagaaatcttacaaatgtcatcagtgtggcaaggtcttcagtccaagatcactccatgcagaacatcagaaaattcatttttgagataaccgttcccaatgaaatgagtatagcaaaccatcaagcattaattgacattggagtc

SEQ ID NO: 203191 - DNA, 4517 bp, Homo sapiens
  Payload ID: 20071
  Gene Name: zinc finger protein 611
  Uniprot ID: Q8N823
  ENST ID: ENST00000543227
  CDS Start-End: 276-2393
agattaacgcaaacccggaagcggatcgggtggagtgtaggtcatatcgccgcgttgactagataacgaaggacaatgcatatatacaaaattgctgtattgcctggtgatatgcagctgtacctgtgacatcataattgcaccctccgacatgatatctcttccaaatgcttgatgaaaaaggtgggaggatcacttgagccagggagttgaaggctgcagtgagccctgtttttgccaccacactccagcttgggattgattcctaaagactcatgttacgtgaggaagcagctcagaagaggaaaggaaaggagccaggcatggctcttcctcagggacgcttgactttccgggatgtggctatagaattctcattggcagagtggaaatgcctgaacccttcacagagggctttgtacagggaagtgatgttggagaactacaggaacctggaggctgtggatatctcttccaaatgcatgatgaaggaggtcttgtcaacagggcaaggcaatacagaagtgatccacacagggacattgcaaagacatgaaagtcatcacattggagatttttgcttccaggaaattgagaaagaaattcatgacattgagtttcagtgtcaagaagatgaaagaaatggccttgaagcacccatgacaaaaataaaaaagttgactggtagcacagaccaacatgatcacaggcatgctggaaacaagcctattaaagatcagcttggatcaagcttttattcacatctgcctgaactccacatatttcagatcaaaggtgaaattggtaatcaacttgagaagtctactaatgatgctccctcagtttcaacattccaaagaatttcctgtaggccccaaacccagatttctaataactatgggaataatcccctgaattcttcattactcccacaaaaacaggaagtacacatgagagaaaaatctttccaatgtaataagagtggcaaagcctttaattgtagctcactcttaaggaaacaccagataccccatttaggagacaaacaatataaatgtgatgtatgtggcaagctctttaatcacgagcaataccttgcatgccatgatagatgtcacactgttgagaaaccttacaagtgtaaagagtgtggcaagaccttcagtcaggagtcatcccttacctgccatcgtagacttcatactggagtaaaacgttacaattgtaatgagtgtggcaagatctttggtcaaaattcagcccttctaattgataaggcaattgatactggagaaaatccttacaagtgtaatgaatgtgacaaggcttttaatcaacaatcacaactttcacatcatagaattcatactggagagaaaccttacaaatgtgaagaatgtgacaaagttttcagtcggaaatcaaccattgagacacataagagaattcatactggagagaaaccatacagatgtaaggtttgtgacacagctttcacgtggcattcacagctggctcgacatagaagaattcatactgcaaagaaaacttataaatgtaatgagtgtggcaagaccttcagtcacaagtcatcccttgtatgccatcatagacttcatggtggagagaaatcttacaaatgtaaggtttgtgacaaggcttttgtgtggagttcacaactggcaaaacatactagaattgactgtggagaaaaaccttacaagtgtaatgaatgtgggaagacctttggtcaaaattcagatcttttaattcataagtcaattcatactggggagcaaccttacaaatgtgatgaatgtgaaaaggttttcagtcgtaaatcaagccttgagacacataagataggtcatactggagagaaaccatacaaatgtaaggtttgtgacaaggcttttgcgtgtcattcctatctggcaaaacatactagaattcatagtggagagaaaccttacaagtgtaatgagtgcagcaagaccttcagtcacaggtcataccttgtatgccatcatagagttcatagtggtgagaaaccttacaagtgtaatgagtgcagcaagaccttcagtcgcaggtcatcccttcattgccatcgtagacttcatagtggtgagaaaccttacaagtgtaatgagtgtggcaataccttccgtcactgctcatcccttatataccatcgtagacttcatactggagagaaatcttacaaatgtacaatttgtgacaaggctttcgtgcgtaattcactcctgtcaagacataccagaattcacactgcagagaaaccttacaagtgtaatgaatgtgggaaggcttttaatcaacaatcacacctttcacgtcatcatagaattcatactggagagaaaccttagaaatgtgaagcatgtgacaaagtttccatttggaaatcacaccttaaagacataggagaatttatactggagagaaagcttacaaatgtaaggtttctgacaagacttgggagtgattcacacctggaacaacatactggacttcacactggagagaaaccttacaagtgtaatgagtgtggcaaagcctttggcaagcagtcaacacttattcaccatcaggcaattcatggtgtagggaaacttgactaatgtaatgattgtcacaaagtcttcagtaatgctacaacgattacaaatcattggagaatccataatgaagagagatcttacaagtgtaataaatgtggcaaatttttcagagatcgttcacatattgcaggtcatcggtgaactcatactggagagaaaccttacaaatgtcatgactgtgccaaggtcttcagtcaagcttcatcctatgcaaaacataggagaatttatacaggagagaaacctcacaagtgtgatgattgtggcaaagcctttgcttcacgttcacacgtcattagacatcagagaatctatactggacagaaatcttacaaatgtcatcagtgtggcaaggtcttcagtccaagatcactccatgcagaacatcagaaaattcatttttgagataaccgttcccaatgaaatgagtatagcaaaccatcaagcattaattgacattggagtcaattcagcattgacttgagtttgtgttgacttaacattgagttcaagcctttattgacattcaagtgtttatgttaagaggatggggccaggtgtggtggctccgacctgtaatcccagcacgtcgggaggccaaggcacataggtcacttgaggtcaggagtttgaaaccagcatggccaacagatgtgagccacttttctcagcctgttttttgtttcttattttctattatttttttgagccagtactttttaaagagatagtacttttttcagttagtactttttgaaagggatatatcatagtaatttttaaaagggatatgaggccaggcacggaggctcatgcctataatcccagcactttgggaggccgaggcaggcagatcacggggtcaggagatcgagactttcctggctaacagggtgaatccctgtctctactaaaaatacaaaaaattagctgggcatggtggctggcgcctgtagtcccagctactccagatgctgaggcaggagaatggcatgaacctgtgaggcggagcttgcagggagtcgagatcgcaccactgggctccagcctgggcgacagagtgagagtctatctcaaaaaaaaaaaaaaaaaaaaggatatcaaagcctcggtacgtggtggctcatccctgcaatcagagtactttggtcgacccatgtgaactggtcacctaaggtcacaatttcaaaagcaccctaacatggtgaaaccccatctctactaaaaatacaaaagttagccgggggtgttggtgtgcacctttagttccagctacttgggaggctggggcatgagaattgcttaaacctaggaggtagaagttgcagtgaaccaaaattgtgccactatactgcagcctgggtggcagagtgagtctccatctcaaacaaacaaaaaataacaaaaaaagacctcaaaaatgcttttcttctcgtataatggacttccttctttttctttctggttcctcttcatttctctctttattttttatttatttatttatttattttgcagtttgagtttgagataaatctaagttataaaagttgtatttcttaatacataatgacttctgaaagatgcctttgcagcatcctataatcagctcacatcattcgtttctgtacttgtatattttccagttattttccggttgaccccagaattcgttagatttttttaaaaaacaatttcaaaatagttgctgttttaaattagttgcatccagttcatatcaatgtctgcatgctttctagtctttgttatttattgaaaacctttggtacctaaacttaagtttgattgtttcagtgtgtacttggtaaatatgtcagtggccttttaactaaacatcaaaatgtactttaa

SEQ ID NO: 203192 - DNA, 4417 bp, Homo sapiens
  Payload ID: 20071
  Gene Name: zinc finger protein 611
  Uniprot ID: Q8N823
  ENST ID: ENST00000540744
  CDS Start-End: 176-2293
agattaacgcaaacccggaagcggatcgggtggagtgtaggtcatatcgccgcgatatctcttccaaatgcttgatgaaaaaggtgggaggatcacttgagccagggagttgaaggctgcagtgagccctgtttttgccaccacactccagcttgggattgattcctaaagactcatgttacgtgaggaagcagctcagaagaggaaaggaaaggagccaggcatggctcttcctcagggacgcttgactttccgggatgtggctatagaattctcattggcagagtggaaatgcctgaacccttcacagagggctttgtacagggaagtgatgttggagaactacaggaacctggaggctgtggatatctcttccaaatgcatgatgaaggaggtcttgtcaacagggcaaggcaatacagaagtgatccacacagggacattgcaaagacatgaaagtcatcacattggagatttttgcttccaggaaattgagaaagaaattcatgacattgagtttcagtgtcaagaagatgaaagaaatggccttgaagcacccatgacaaaaataaaaaagttgactggtagcacagaccaacatgatcacaggcatgctggaaacaagcctattaaagatcagcttggatcaagcttttattcacatctgcctgaactccacatatttcagatcaaaggtgaaattggtaatcaacttgagaagtctactaatgatgctccctcagtttcaacattccaaagaatttcctgtaggccccaaacccagatttctaataactatgggaataatcccctgaattcttcattactcccacaaaaacaggaagtacacatgagagaaaaatctttccaatgtaataagagtggcaaagcctttaattgtagctcactcttaaggaaacaccagataccccatttaggagacaaacaatataaatgtgatgtatgtggcaagctctttaatcacgagcaataccttgcatgccatgatagatgtcacactgttgagaaaccttacaagtgtaaagagtgtggcaagaccttcagtcaggagtcatcccttacctgccatcgtagacttcatactggagtaaaacgttacaattgtaatgagtgtggcaagatctttggtcaaaattcagcccttctaattgataaggcaattgatactggagaaaatccttacaagtgtaatgaatgtgacaaggcttttaatcaacaatcacaactttcacatcatagaattcatactggagagaaaccttacaaatgtgaagaatgtgacaaagttttcagtcggaaatcaaccattgagacacataagagaattcatactggagagaaaccatacagatgtaaggtttgtgacacagctttcacgtggcattcacagctggctcgacatagaagaattcatactgcaaagaaaacttataaatgtaatgagtgtggcaagaccttcagtcacaagtcatcccttgtatgccatcatagacttcatggtggagagaaatcttacaaatgtaaggtttgtgacaaggcttttgtgtggagttcacaactggcaaaacatactagaattgactgtggagaaaaaccttacaagtgtaatgaatgtgggaagacctttggtcaaaattcagatcttttaattcataagtcaattcatactggggagcaaccttacaaatgtgatgaatgtgaaaaggttttcagtcgtaaatcaagccttgagacacataagataggtcatactggagagaaaccatacaaatgtaaggtttgtgacaaggcttttgcgtgtcattcctatctggcaaaacatactagaattcatagtggagagaaaccttacaagtgtaatgagtgcagcaagaccttcagtcacaggtcataccttgtatgccatcatagagttcatagtggtgagaaaccttacaagtgtaatgagtgcagcaagaccttcagtcgcaggtcatcccttcattgccatcgtagacttcatagtggtgagaaaccttacaagtgtaatgagtgtggcaataccttccgtcactgctcatcccttatataccatcgtagacttcatactggagagaaatcttacaaatgtacaatttgtgacaaggctttcgtgcgtaattcactcctgtcaagacataccagaattcacactgcagagaaaccttacaagtgtaatgaatgtgggaaggcttttaatcaacaatcacacctttcacgtcatcatagaattcatactggagagaaaccttagaaatgtgaagcatgtgacaaagtttccatttggaaatcacaccttaaagacataggagaatttatactggagagaaagcttacaaatgtaaggtttctgacaagacttgggagtgattcacacctggaacaacatactggacttcacactggagagaaaccttacaagtgtaatgagtgtggcaaagcctttggcaagcagtcaacacttattcaccatcaggcaattcatggtgtagggaaacttgactaatgtaatgattgtcacaaagtcttcagtaatgctacaacgattacaaatcattggagaatccataatgaagagagatcttacaagtgtaataaatgtggcaaatttttcagagatcgttcacatattgcaggtcatcggtgaactcatactggagagaaaccttacaaatgtcatgactgtgccaaggtcttcagtcaagcttcatcctatgcaaaacataggagaatttatacaggagagaaacctcacaagtgtgatgattgtggcaaagcctttgcttcacgttcacacgtcattagacatcagagaatctatactggacagaaatcttacaaatgtcatcagtgtggcaaggtcttcagtccaagatcactccatgcagaacatcagaaaattcatttttgagataaccgttcccaatgaaatgagtatagcaaaccatcaagcattaattgacattggagtcaattcagcattgacttgagtttgtgttgacttaacattgagttcaagcctttattgacattcaagtgtttatgttaagaggatggggccaggtgtggtggctccgacctgtaatcccagcacgtcgggaggccaaggcacataggtcacttgaggtcaggagtttgaaaccagcatggccaacagatgtgagccacttttctcagcctgttttttgtttcttattttctattatttttttgagccagtactttttaaagagatagtacttttttcagttagtactttttgaaagggatatatcatagtaatttttaaaagggatatgaggccaggcacggaggctcatgcctataatcccagcactttgggaggccgaggcaggcagatcacggggtcaggagatcgagactttcctggctaacagggtgaatccctgtctctactaaaaatacaaaaaattagctgggcatggtggctggcgcctgtagtcccagctactccagatgctgaggcaggagaatggcatgaacctgtgaggcggagcttgcagggagtcgagatcgcaccactgggctccagcctgggcgacagagtgagagtctatctcaaaaaaaaaaaaaaaaaaaaggatatcaaagcctcggtacgtggtggctcatccctgcaatcagagtactttggtcgacccatgtgaactggtcacctaaggtcacaatttcaaaagcaccctaacatggtgaaaccccatctctactaaaaatacaaaagttagccgggggtgttggtgtgcacctttagttccagctacttgggaggctggggcatgagaattgcttaaacctaggaggtagaagttgcagtgaaccaaaattgtgccactatactgcagcctgggtggcagagtgagtctccatctcaaacaaacaaaaaataacaaaaaaagacctcaaaaatgcttttcttctcgtataatggacttccttctttttctttctggttcctcttcatttctctctttattttttatttatttatttatttattttgcagtttgagtttgagataaatctaagttataaaagttgtatttcttaatacataatgacttctgaaagatgcctttgcagcatcctataatcagctcacatcattcgtttctgtacttgtatattttccagttattttccggttgaccccagaattcgttagatttttttaaaaaacaatttcaaaatagttgctgttttaaattagttgcatccagttcatatcaatgtctgcatgctttctagtctttgttatttattgaaaacctttggtacctaaacttaagtttgattgtttcagtgtgtacttggtaaatatgtcagtggccttttaactaaacatcaaaatgtactttaa

SEQ ID NO: 203193 - DNA, 4380 bp, Homo sapiens
  Payload ID: 20071
  Gene Name: zinc finger protein 611
  Uniprot ID: Q8N823
  ENST ID: ENST00000453741
  CDS Start-End: 346-2256
aaacccggaagcggatcgggtggagtgtaggtcatatcgccgcgttgactagataacgaaggacaatgcatatatacaaaattgctgtattgcctggtgatatgcagctgtacctgtgacatcataattgcaccctccgacatgatatctcttccaaatgcttgatgaaaaaggtgggaggatcacttgagccagggagttgaaggctgcagtgagccctgtttttgccaccacactccagcttgggattgattcctaaagactcatgttacgtgaggaagcagctcagaagaggaaaggaaaggagccaggcatggctcttcctcagatatctcttccaaatgcatgatgaaggaggtcttgtcaacagggcaaggcaatacagaagtgatccacacagggacattgcaaagacatgaaagtcatcacattggagatttttgcttccaggaaattgagaaagaaattcatgacattgagtttcagtgtcaagaagatgaaagaaatggccttgaagcacccatgacaaaaataaaaaagttgactggtagcacagaccaacatgatcacaggcatgctggaaacaagcctattaaagatcagcttggatcaagcttttattcacatctgcctgaactccacatatttcagatcaaaggtgaaattggtaatcaacttgagaagtctactaatgatgctccctcagtttcaacattccaaagaatttcctgtaggccccaaacccagatttctaataactatgggaataatcccctgaattcttcattactcccacaaaaacaggaagtacacatgagagaaaaatctttccaatgtaataagagtggcaaagcctttaattgtagctcactcttaaggaaacaccagataccccatttaggagacaaacaatataaatgtgatgtatgtggcaagctctttaatcacgagcaataccttgcatgccatgatagatgtcacactgttgagaaaccttacaagtgtaaagagtgtggcaagaccttcagtcaggagtcatcccttacctgccatcgtagacttcatactggagtaaaacgttacaattgtaatgagtgtggcaagatctttggtcaaaattcagcccttctaattgataaggcaattgatactggagaaaatccttacaagtgtaatgaatgtgacaaggcttttaatcaacaatcacaactttcacatcatagaattcatactggagagaaaccttacaaatgtgaagaatgtgacaaagttttcagtcggaaatcaaccattgagacacataagagaattcatactggagagaaaccatacagatgtaaggtttgtgacacagctttcacgtggcattcacagctggctcgacatagaagaattcatactgcaaagaaaacttataaatgtaatgagtgtggcaagaccttcagtcacaagtcatcccttgtatgccatcatagacttcatggtggagagaaatcttacaaatgtaaggtttgtgacaaggcttttgtgtggagttcacaactggcaaaacatactagaattgactgtggagaaaaaccttacaagtgtaatgaatgtgggaagacctttggtcaaaattcagatcttttaattcataagtcaattcatactggggagcaaccttacaaatgtgatgaatgtgaaaaggttttcagtcgtaaatcaagccttgagacacataagataggtcatactggagagaaaccatacaaatgtaaggtttgtgacaaggcttttgcgtgtcattcctatctggcaaaacatactagaattcatagtggagagaaaccttacaagtgtaatgagtgcagcaagaccttcagtcacaggtcataccttgtatgccatcatagagttcatagtggtgagaaaccttacaagtgtaatgagtgcagcaagaccttcagtcgcaggtcatcccttcattgccatcgtagacttcatagtggtgagaaaccttacaagtgtaatgagtgtggcaataccttccgtcactgctcatcccttatataccatcgtagacttcatactggagagaaatcttacaaatgtacaatttgtgacaaggctttcgtgcgtaattcactcctgtcaagacataccagaattcacactgcagagaaaccttacaagtgtaatgaatgtgggaaggcttttaatcaacaatcacacctttcacgtcatcatagaattcatactggagagaaaccttagaaatgtgaagcatgtgacaaagtttccatttggaaatcacaccttaaagacataggagaatttatactggagagaaagcttacaaatgtaaggtttctgacaagacttgggagtgattcacacctggaacaacatactggacttcacactggagagaaaccttacaagtgtaatgagtgtggcaaagcctttggcaagcagtcaacacttattcaccatcaggcaattcatggtgtagggaaacttgactaatgtaatgattgtcacaaagtcttcagtaatgctacaacgattacaaatcattggagaatccataatgaagagagatcttacaagtgtaataaatgtggcaaatttttcagagatcgttcacatattgcaggtcatcggtgaactcatactggagagaaaccttacaaatgtcatgactgtgccaaggtcttcagtcaagcttcatcctatgcaaaacataggagaatttatacaggagagaaacctcacaagtgtgatgattgtggcaaagcctttgcttcacgttcacacgtcattagacatcagagaatctatactggacagaaatcttacaaatgtcatcagtgtggcaaggtcttcagtccaagatcactccatgcagaacatcagaaaattcatttttgagataaccgttcccaatgaaatgagtatagcaaaccatcaagcattaattgacattggagtcaattcagcattgacttgagtttgtgttgacttaacattgagttcaagcctttattgacattcaagtgtttatgttaagaggatggggccaggtgtggtggctccgacctgtaatcccagcacgtcgggaggccaaggcacataggtcacttgaggtcaggagtttgaaaccagcatggccaacagatgtgagccacttttctcagcctgttttttgtttcttattttctattatttttttgagccagtactttttaaagagatagtacttttttcagttagtactttttgaaagggatatatcatagtaatttttaaaagggatatgaggccaggcacggaggctcatgcctataatcccagcactttgggaggccgaggcaggcagatcacggggtcaggagatcgagactttcctggctaacagggtgaatccctgtctctactaaaaatacaaaaaattagctgggcatggtggctggcgcctgtagtcccagctactccagatgctgaggcaggagaatggcatgaacctgtgaggcggagcttgcagggagtcgagatcgcaccactgggctccagcctgggcgacagagtgagagtctatctcaaaaaaaaaaaaaaaaaaaaggatatcaaagcctcggtacgtggtggctcatccctgcaatcagagtactttggtcgacccatgtgaactggtcacctaaggtcacaatttcaaaagcaccctaacatggtgaaaccccatctctactaaaaatacaaaagttagccgggggtgttggtgtgcacctttagttccagctacttgggaggctggggcatgagaattgcttaaacctaggaggtagaagttgcagtgaaccaaaattgtgccactatactgcagcctgggtggcagagtgagtctccatctcaaacaaacaaaaaataacaaaaaaagacctcaaaaatgcttttcttctcgtataatggacttccttctttttctttctggttcctcttcatttctctctttattttttatttatttatttatttattttgcagtttgagtttgagataaatctaagttataaaagttgtatttcttaatacataatgacttctgaaagatgcctttgcagcatcctataatcagctcacatcattcgtttctgtacttgtatattttccagttattttccggttgaccccagaattcgttagatttttttaaaaaacaatttcaaaatagttgctgttttaaattagttgcatccagttcatatcaatgtctgcatgctttctagtctttgttatttattgaaaacctttggtacctaaacttaagtttgattgtttcagtgtgtacttggtaaatatgtcagtggccttttaactaaacatcaaaatgtactttaa

SEQ ID NO: 203194 - DNA, 538 bp, Homo sapiens
  Payload ID: 20071
  Gene Name: zinc finger protein 611
  ENST ID: ENST00000596702
  CDS Start-End: 266-412
aaacccggaagcggatcgggtggagtgtaggtcatatcgccgcgttgactagataacgaaggacaatgcatatatacaaaattgctgtattgcctggtgatatgcagctgtacctgtgacatcataattgcaccctccgacatgatatctcttccaaatgcttgatgaaaaaggtgggaggatcacttgagccagggagttgaaggctgcagtgagccctgtttttgccaccacactccagcttgggattgattcctaaagactcatgttacgtgaggaagcagctcagaagaggaaaggaaaggagccaggcatggctcttcctcaggtagagtctcactttgtcacccaggctggagtgcagtggtgtgatcctggctcactgcaacctctacctcccaggtttaagtgattcttgtgcttcagcctcctgaatagctgtgactacagatatctcttccaaatgcatgatgaaggaggtcttgtcaacagggcaaggcaatacagaagtgatccacacagggacattgcaaagaca

SEQ ID NO: 203195 - DNA, 560 bp, Homo sapiens
  Payload ID: 20071
  Gene Name: zinc finger protein 611
  ENST ID: ENST00000600943
  CDS Start-End: 170-397
acgcaaacccggaagcggatcgggtggagtgtaggtcatatcgccgcgatatctcttccaaatgcttgatgaaaaaggtgggaggatcacttgagccagggagttgaaggctgcagtgagccctgtttttgccaccacactccagcttgggattgattcctaaagactcatgttacgtgaggaagcagctcagaagaggaaaggaaaggagccaggcatggctcttcctcaggtagagtctcactttgtcacccaggctggagtgcagtggtgtgatcctggctcactgcaacctctacctcccagatatctcttccaaatgcatgatgaaggaggtcttgtcaacagggcaaggcaatacagaagtgatccacacagggacattgcaaagacatgaaagtcatcacattggagatttttgcttccaggaaattgagaaagaaattcatgacattgagtttcagtgtcaagaagatgaaagaaatggccttgaagcacccatgacaaaaataaaaaagttgactggtagcacagaccaacatgatcacaggcatgctgga

SEQ ID NO: 203196 - DNA, 2395 bp, Homo sapiens
  Payload ID: 20071
  Gene Name: zinc finger protein 611
  Uniprot ID: Q8N823
  ENST ID: ENST00000595798
  CDS Start-End: 280-2190
agccagggagttgaaggctgcagtgagccctgtttttgccaccacactccagcttggagaggtgaggggctgtcctctggatggcaattgatgaaggatgagtctgtgccctgaaggggagatcagtccagcccagctccccactgctgcctcgtgtgtggtggcttctccaggagagaggattgattcctaaagactcatgttacgtgaggaagcagctcagaagaggaaaggaaaggagccaggcatggctcttcctcagatatctcttccaaatgcatgatgaaggaggtcttgtcaacagggcaaggcaatacagaagtgatccacacagggacattgcaaagacatgaaagtcatcacattggagatttttgcttccaggaaattgagaaagaaattcatgacattgagtttcagtgtcaagaagatgaaagaaatggccttgaagcacccatgacaaaaataaaaaagttgactggtagcacagaccaacatgatcacaggcatgctggaaacaagcctattaaagatcagcttggatcaagcttttattcacatctgcctgaactccacatatttcagatcaaaggtgaaattggtaatcaacttgagaagtctactaatgatgctccctcagtttcaacattccaaagaatttcctgtaggccccaaacccagatttctaataactatgggaataatcccctgaattcttcattactcccacaaaaacaggaagtacacatgagagaaaaatctttccaatgtaataagagtggcaaagcctttaattgtagctcactcttaaggaaacaccagataccccatttaggagacaaacaatataaatgtgatgtatgtggcaagctctttaatcacgagcaataccttgcatgccatgatagatgtcacactgttgagaaaccttacaagtgtaaagagtgtggcaagaccttcagtcaggagtcatcccttacctgccatcgtagacttcatactggagtaaaacgttacaattgtaatgagtgtggcaagatctttggtcaaaattcagcccttctaattgataaggcaattgatactggagaaaatccttacaagtgtaatgaatgtgacaaggcttttaatcaacaatcacaactttcacatcatagaattcatactggagagaaaccttacaaatgtgaagaatgtgacaaagttttcagtcggaaatcaaccattgagacacataagagaattcatactggagagaaaccatacagatgtaaggtttgtgacacagctttcacgtggcattcacagctggctcgacatagaagaattcatactgcaaagaaaacttataaatgtaatgagtgtggcaagaccttcagtcacaagtcatcccttgtatgccatcatagacttcatggtggagagaaatcttacaaatgtaaggtttgtgacaaggcttttgtgtggagttcacaactggcaaaacatactagaattgactgtggagaaaaaccttacaagtgtaatgaatgtgggaagacctttggtcaaaattcagatcttttaattcataagtcaattcatactggggagcaaccttacaaatgtgatgaatgtgaaaaggttttcagtcgtaaatcaagccttgagacacataagataggtcatactggagagaaaccatacaaatgtaaggtttgtgacaaggcttttgcgtgtcattcctatctggcaaaacatactagaattcatagtggagagaaaccttacaagtgtaatgagtgcagcaagaccttcagtcacaggtcataccttgtatgccatcatagagttcatagtggtgagaaaccttacaagtgtaatgagtgcagcaagaccttcagtcgcaggtcatcccttcattgccatcgtagacttcatagtggtgagaaaccttacaagtgtaatgagtgtggcaataccttccgtcactgctcatcccttatataccatcgtagacttcatactggagagaaatcttacaaatgtacaatttgtgacaaggctttcgtgcgtaattcactcctgtcaagacataccagaattcacactgcagagaaaccttacaagtgtaatgaatgtgggaaggcttttaatcaacaatcacacctttcacgtcatcatagaattcatactggagagaaaccttagaaatgtgaagcatgtgacaaagtttccatttggaaatcacaccttaaagacataggagaatttatactggagagaaagcttacaaatgtaaggtttctgacaagacttgggagtgattcacacctggaacaacatactggacttcacactggagagaaaccttacaagtgtaatgagtgtggcaaagcctttggcaagcagtcaa

SEQ ID NO: 203197 - DNA, 531 bp, Homo sapiens
  Payload ID: 20071
  Gene Name: zinc finger protein 611
  ENST ID: ENST00000601643
  CDS Start-End: 144-531
aaacccggaagcggatcgggtggagtgtaggtcatatcgccgcggattgattcctaaagactcatgttacgtgaggaagcagctcagaagaggaaaggaaaggagccaggcatggctcttcctcagatatctcttccaaatgcatgatgaaggaggtcttgtcaacagggcaaggcaatacagaagtgatccacacagggacattgcaaagacatgaaagtcatcacattggagatttttgcttccaggaaattgagaaagaaattcatgacattgagtttcagtgtcaagaagatgaaagaaatggccttgaagcacccatgacaaaaataaaaaagttgactggtagcacagaccaacatgatcacaggcatgctggaaacaagcctattaaagatcagcttggatcaagcttttattcacatctgcctgaactccacatatttcagatcaaaggtgaaattggtaatcaacttgagaagtctactaatgatgctccctcagtttcaacattccaaagaatttcctgta

SEQ ID NO: 203198 - DNA, 860 bp, Homo sapiens
  Payload ID: 20071
  Gene Name: zinc finger protein 611
  ENST ID: ENST00000597343
  CDS Start-End: 240-434
gtaggtcatatcgccgcgttgactagataacgaaggacaatgcatatatacaaaattgctgtattgcctggtgatatgcagctgtacctgtgacatcataattgcaccctccgacatgatatctcttccaaatgcttgatgaaaaaggtgggaggatcacttgagccagggagttgaaggctgcagtgagccctgtttttgccaccacactccagcttgggattgattcctaaagactcatgttacgtgaggaagcagctcagaagaggaaaggaaaggagccaggcatggctcttcctcagggacgcttgactttccgggatgtggctatagaattctcattggcagagtggaaatgcctgaacccttcacagagggctttgtacagggaagtgatgttggagaactacaggaacctggaggctgtgggctgaagtgcaatggcacaatctgagttcaccgcaacctccacctcccggattcaaatggttctcctgcctcagcctcccgagaagctgggattacaggtagagtctcactttgtcacccaggctggagtgcagtggtgtgatcctggctcactgcaacctctacctcccaggtttaagtgattcttgtgcttcagcctcctgaatagctgtgactacagatatctcttccaaatgcatgatgaaggaggtcttgtcaacagggcaaggcaatacagaagtgatccacacagggacattgcaaagacatgaaagtcatcacattggagatttttgcttccaggaaattgagaaagaaattcatgacattgagtttcagtgtcaagaagatgaaagaaatggccttgaagcacccatgacaaaaataaaaaa

SEQ ID NO: 203199 - DNA, 4796 bp, Homo sapiens
  Payload ID: 20071
  Gene Name: zinc finger protein 611
  ENST ID: ENST00000595001
  CDS Start-End: 383-577
ggaagcggatcgggtggagtgtaggtcatatcgccgcgttgactagataacgaaggacaatgcatatatacaaaattgctgtattgcctggtgatatgcagctgtacctgtgacatcataattgcaccctccgacatgatatctcttccaaatgcttgatgaaaaaggtgggaggatcacttgagccagggagttgaaggctgcagtgagccctgtttttgccaccacactccagcttggagaggtgaggggctgtcctctggatggcaattgatgaaggatgagtctgtgccctgaaggggagatcagtccagcccagctccccactgctgcctcgtgtgtggtggcttctccaggagagaggattgattcctaaagactcatgttacgtgaggaagcagctcagaagaggaaaggaaaggagccaggcatggctcttcctcagggacgcttgactttccgggatgtggctatagaattctcattggcagagtggaaatgcctgaacccttcacagagggctttgtacagggaagtgatgttggagaactacaggaacctggaggctgtgggctgaagtgcaatggcacaatctgagttcaccgcaacctccacctcccggattcaaatggttctcctgcctcagcctcccgagaagctgggattacaggtagagtctcactttgtcacccaggctggagtgcagtggtgtgatcctggctcactgcaacctctacctcccagatatctcttccaaatgcatgatgaaggaggtcttgtcaacagggcaaggcaatacagaagtgatccacacagggacattgcaaagacatgaaagtcatcacattggagatttttgcttccaggaaattgagaaagaaattcatgacattgagtttcagtgtcaagaagatgaaagaaatggccttgaagcacccatgacaaaaataaaaaagttgactggtagcacagaccaacatgatcacaggcatgctggaaacaagcctattaaagatcagcttggatcaagcttttattcacatctgcctgaactccacatatttcagatcaaaggtgaaattggtaatcaacttgagaagtctactaatgatgctccctcagtttcaacattccaaagaatttcctgtaggccccaaacccagatttctaataactatgggaataatcccctgaattcttcattactcccacaaaaacaggaagtacacatgagagaaaaatctttccaatgtaataagagtggcaaagcctttaattgtagctcactcttaaggaaacaccagataccccatttaggagacaaacaatataaatgtgatgtatgtggcaagctctttaatcacgagcaataccttgcatgccatgatagatgtcacactgttgagaaaccttacaagtgtaaagagtgtggcaagaccttcagtcaggagtcatcccttacctgccatcgtagacttcatactggagtaaaacgttacaattgtaatgagtgtggcaagatctttggtcaaaattcagcccttctaattgataaggcaattgatactggagaaaatccttacaagtgtaatgaatgtgacaaggcttttaatcaacaatcacaactttcacatcatagaattcatactggagagaaaccttacaaatgtgaagaatgtgacaaagttttcagtcggaaatcaaccattgagacacataagagaattcatactggagagaaaccatacagatgtaaggtttgtgacacagctttcacgtggcattcacagctggctcgacatagaagaattcatactgcaaagaaaacttataaatgtaatgagtgtggcaagaccttcagtcacaagtcatcccttgtatgccatcatagacttcatggtggagagaaatcttacaaatgtaaggtttgtgacaaggcttttgtgtggagttcacaactggcaaaacatactagaattgactgtggagaaaaaccttacaagtgtaatgaatgtgggaagacctttggtcaaaattcagatcttttaattcataagtcaattcatactggggagcaaccttacaaatgtgatgaatgtgaaaaggttttcagtcgtaaatcaagccttgagacacataagataggtcatactggagagaaaccatacaaatgtaaggtttgtgacaaggcttttgcgtgtcattcctatctggcaaaacatactagaattcatagtggagagaaaccttacaagtgtaatgagtgcagcaagaccttcagtcacaggtcataccttgtatgccatcatagagttcatagtggtgagaaaccttacaagtgtaatgagtgcagcaagaccttcagtcgcaggtcatcccttcattgccatcgtagacttcatagtggtgagaaaccttacaagtgtaatgagtgtggcaataccttccgtcactgctcatcccttatataccatcgtagacttcatactggagagaaatcttacaaatgtacaatttgtgacaaggctttcgtgcgtaattcactcctgtcaagacataccagaattcacactgcagagaaaccttacaagtgtaatgaatgtgggaaggcttttaatcaacaatcacacctttcacgtcatcatagaattcatactggagagaaaccttagaaatgtgaagcatgtgacaaagtttccatttggaaatcacaccttaaagacataggagaatttatactggagagaaagcttacaaatgtaaggtttctgacaagacttgggagtgattcacacctggaacaacatactggacttcacactggagagaaaccttacaagtgtaatgagtgtggcaaagcctttggcaagcagtcaacacttattcaccatcaggcaattcatggtgtagggaaacttgactaatgtaatgattgtcacaaagtcttcagtaatgctacaacgattacaaatcattggagaatccataatgaagagagatcttacaagtgtaataaatgtggcaaatttttcagagatcgttcacatattgcaggtcatcggtgaactcatactggagagaaaccttacaaatgtcatgactgtgccaaggtcttcagtcaagcttcatcctatgcaaaacataggagaatttatacaggagagaaacctcacaagtgtgatgattgtggcaaagcctttgcttcacgttcacacgtcattagacatcagagaatctatactggacagaaatcttacaaatgtcatcagtgtggcaaggtcttcagtccaagatcactccatgcagaacatcagaaaattcatttttgagataaccgttcccaatgaaatgagtatagcaaaccatcaagcattaattgacattggagtcaattcagcattgacttgagtttgtgttgacttaacattgagttcaagcctttattgacattcaagtgtttatgttaagaggatggggccaggtgtggtggctccgacctgtaatcccagcacgtcgggaggccaaggcacataggtcacttgaggtcaggagtttgaaaccagcatggccaacagatgtgagccacttttctcagcctgttttttgtttcttattttctattatttttttgagccagtactttttaaagagatagtacttttttcagttagtactttttgaaagggatatatcatagtaatttttaaaagggatatgaggccaggcacggaggctcatgcctataatcccagcactttgggaggccgaggcaggcagatcacggggtcaggagatcgagactttcctggctaacagggtgaatccctgtctctactaaaaatacaaaaaattagctgggcatggtggctggcgcctgtagtcccagctactccagatgctgaggcaggagaatggcatgaacctgtgaggcggagcttgcagggagtcgagatcgcaccactgggctccagcctgggcgacagagtgagagtctatctcaaaaaaaaaaaaaaaaaaaaggatatcaaagcctcggtacgtggtggctcatccctgcaatcagagtactttggtcgacccatgtgaactggtcacctaaggtcacaatttcaaaagcaccctaacatggtgaaaccccatctctactaaaaatacaaaagttagccgggggtgttggtgtgcacctttagttccagctacttgggaggctggggcatgagaattgcttaaacctaggaggtagaagttgcagtgaaccaaaattgtgccactatactgcagcctgggtggcagagtgagtctccatctcaaacaaacaaaaaataacaaaaaaagacctcaaaaatgcttttcttctcgtataatggacttccttctttttctttctggttcctcttcatttctctctttattttttatttatttatttatttattttgcagtttgagtttgagataaatctaagttataaaagttgtatttcttaatacataatgacttctgaaagatgcctttgcagcatcctataatcagctcacatcattcgtttctgtacttgtatattttccagttattttccggttgaccccagaattcgttagatttttttaaaaaacaatttcaaaatagttgctgttttaaattagttgcatccagttcatatcaatgtctgcatgctttctagtctttgttatttattgaaaacctttggtacctaaacttaagtttgattgtttcagtgtgtacttggtaaatatgtcagtggccttttaactaaacatcaaaatgtactttaa

SEQ ID NO: 203200 - DNA, 2546 bp, Homo sapiens
  Payload ID: 20071
  Gene Name: zinc finger protein 611
  ENST ID: ENST00000601249
  CDS Start-End: 77-346
agccagggagttgaaggctgcagtgagccctgtttttgccaccacactccagcttgggattgattcctaaagactcatgttacgtgaggaagcagctcagaagaggaaaggaaaggagccaggcatggctcttcctcagggacgcttgactttccgggatgtggctatagaattctcattggcagagtggaaatgcctgaacccttcacagagggctttgtacagggaagtgatgttggagaactacaggaacctggaggctgtggagtctcactttgtcacccaggctggagtgcagtggtgtgatcctggctcactgcaacctctacctcccaggtttaagtgattcttgtgcttcagcctcctgaatagctgtgactacaggcatgggccaccatacctggctaatttttatatctcttccaaatgcatgatgaaggaggtcttgtcaacagggcaaggcaatacagaagtgatccacacagggacattgcaaagacatgaaagtcatcacattggagatttttgcttccaggaaattgagaaagaaattcatgacattgagtttcagtgtcaagaagatgaaagaaatggccttgaagcacccatgacaaaaataaaaaagttgactggtagcacagaccaacatgatcacaggcatgctggaaacaagcctattaaagatcagcttggatcaagcttttattcacatctgcctgaactccacatatttcagatcaaaggtgaaattggtaatcaacttgagaagtctactaatgatgctccctcagtttcaacattccaaagaatttcctgtaggccccaaacccagatttctaataactatgggaataatcccctgaattcttcattactcccacaaaaacaggaagtacacatgagagaaaaatctttccaatgtaataagagtggcaaagcctttaattgtagctcactcttaaggaaacaccagataccccatttaggagacaaacaatataaatgtgatgtatgtggcaagctctttaatcacgagcaataccttgcatgccatgatagatgtcacactgttgagaaaccttacaagtgtaaagagtgtggcaagaccttcagtcaggagtcatcccttacctgccatcgtagacttcatactggagtaaaacgttacaattgtaatgagtgtggcaagatctttggtcaaaattcagcccttctaattgataaggcaattgatactggagaaaatccttacaagtgtaatgaatgtgacaaggcttttaatcaacaatcacaactttcacatcatagaattcatactggagagaaaccttacaaatgtgaagaatgtgacaaagttttcagtcggaaatcaaccattgagacacataagagaattcatactggagagaaaccatacagatgtaaggtttgtgacacagctttcacgtggcattcacagctggctcgacatagaagaattcatactgcaaagaaaacttataaatgtaatgagtgtggcaagaccttcagtcacaagtcatcccttgtatgccatcatagacttcatggtggagagaaatcttacaaatgtaaggtttgtgacaaggcttttgtgtggagttcacaactggcaaaacatactagaattgactgtggagaaaaaccttacaagtgtaatgaatgtgggaagacctttggtcaaaattcagatcttttaattcataagtcaattcatactggggagcaaccttacaaatgtgatgaatgtgaaaaggttttcagtcgtaaatcaagccttgagacacataagataggtcatactggagagaaaccatacaaatgtaaggtttgtgacaaggcttttgcgtgtcattcctatctggcaaaacatactagaattcatagtggagagaaaccttacaagtgtaatgagtgcagcaagaccttcagtcacaggtcataccttgtatgccatcatagagttcatagtggtgagaaaccttacaagtgtaatgagtgcagcaagaccttcagtcgcaggtcatcccttcattgccatcgtagacttcatagtggtgagaaaccttacaagtgtaatgagtgtggcaataccttccgtcactgctcatcccttatataccatcgtagacttcatactggagagaaatcttacaaatgtacaatttgtgacaaggctttcgtgcgtaattcactcctgtcaagacataccagaattcacactgcagagaaaccttacaagtgtaatgaatgtgggaaggcttttaatcaacaatcacacctttcacgtcatcatagaattcatactggagagaaaccttagaaatgtgaagcatgtgacaaagtttccatttggaaatcacaccttaaagacataggagaatttatactggagagaaagcttacaaatgtaaggtttctgacaagacttgggagtgattcacacctggaacaacatactggacttcacactggagagaaaccttacaagtgtaatgagtgtggcaaagcctttggcaagcagtcaa

SEQ ID NO: 203201 - DNA, 3299 bp, Homo sapiens
  Payload ID: 20071
  Gene Name: zinc finger protein 611
  Uniprot ID: Q8N823
  ENST ID: ENST00000602162
  CDS Start-End: 62-1972
aaacccggaagcggatcgggtggagtgtaggtcatatcgccgcgatatctcttccaaatgcatgatgaaggaggtcttgtcaacagggcaaggcaatacagaagtgatccacacagggacattgcaaagacatgaaagtcatcacattggagatttttgcttccaggaaattgagaaagaaattcatgacattgagtttcagtgtcaagaagatgaaagaaatggccttgaagcacccatgacaaaaataaaaaagttgactggtagcacagaccaacatgatcacaggcatgctggaaacaagcctattaaagatcagcttggatcaagcttttattcacatctgcctgaactccacatatttcagatcaaaggtgaaattggtaatcaacttgagaagtctactaatgatgctccctcagtttcaacattccaaagaatttcctgtaggccccaaacccagatttctaataactatgggaataatcccctgaattcttcattactcccacaaaaacaggaagtacacatgagagaaaaatctttccaatgtaataagagtggcaaagcctttaattgtagctcactcttaaggaaacaccagataccccatttaggagacaaacaatataaatgtgatgtatgtggcaagctctttaatcacgagcaataccttgcatgccatgatagatgtcacactgttgagaaaccttacaagtgtaaagagtgtggcaagaccttcagtcaggagtcatcccttacctgccatcgtagacttcatactggagtaaaacgttacaattgtaatgagtgtggcaagatctttggtcaaaattcagcccttctaattgataaggcaattgatactggagaaaatccttacaagtgtaatgaatgtgacaaggcttttaatcaacaatcacaactttcacatcatagaattcatactggagagaaaccttacaaatgtgaagaatgtgacaaagttttcagtcggaaatcaaccattgagacacataagagaattcatactggagagaaaccatacagatgtaaggtttgtgacacagctttcacgtggcattcacagctggctcgacatagaagaattcatactgcaaagaaaacttataaatgtaatgagtgtggcaagaccttcagtcacaagtcatcccttgtatgccatcatagacttcatggtggagagaaatcttacaaatgtaaggtttgtgacaaggcttttgtgtggagttcacaactggcaaaacatactagaattgactgtggagaaaaaccttacaagtgtaatgaatgtgggaagacctttggtcaaaattcagatcttttaattcataagtcaattcatactggggagcaaccttacaaatgtgatgaatgtgaaaaggttttcagtcgtaaatcaagccttgagacacataagataggtcatactggagagaaaccatacaaatgtaaggtttgtgacaaggcttttgcgtgtcattcctatctggcaaaacatactagaattcatagtggagagaaaccttacaagtgtaatgagtgcagcaagaccttcagtcacaggtcataccttgtatgccatcatagagttcatagtggtgagaaaccttacaagtgtaatgagtgcagcaagaccttcagtcgcaggtcatcccttcattgccatcgtagacttcatagtggtgagaaaccttacaagtgtaatgagtgtggcaataccttccgtcactgctcatcccttatataccatcgtagacttcatactggagagaaatcttacaaatgtacaatttgtgacaaggctttcgtgcgtaattcactcctgtcaagacataccagaattcacactgcagagaaaccttacaagtgtaatgaatgtgggaaggcttttaatcaacaatcacacctttcacgtcatcatagaattcatactggagagaaaccttagaaatgtgaagcatgtgacaaagtttccatttggaaatcacaccttaaagacataggagaatttatactggagagaaagcttacaaatgtaaggtttctgacaagacttgggagtgattcacacctggaacaacatactggacttcacactggagagaaaccttacaagtgtaatgagtgtggcaaagcctttggcaagcagtcaacacttattcaccatcaggcaattcatggtgtagggaaacttgactaatgtaatgattgtcacaaagtcttcagtaatgctacaacgattacaaatcattggagaatccataatgaagagagatcttacaagtgtaataaatgtggcaaatttttcagagatcgttcacatattgcaggtcatcggtgaactcatactggagagaaaccttacaaatgtcatgactgtgccaaggtcttcagtcaagcttcatcctatgcaaaacataggagaatttatacaggagagaaacctcacaagtgtgatgattgtggcaaagcctttgcttcacgttcacacgtcattagacatcagagaatctatactggacagaaatcttacaaatgtcatcagtgtggcaaggtcttcagtccaagatcactccatgcagaacatcagaaaattcatttttgagataaccgttcccaatgaaatgagtatagcaaaccatcaagcattaattgacattggagtcaattcagcattgacttgagtttgtgttgacttaacattgagttcaagcctttattgacattcaagtgtttatgttaagaggatggggccaggtgtggtggctccgacctgtaatcccagcacgtcgggaggccaaggcacataggtcacttgaggtcaggagtttgaaaccagcatggccaacagatgtgagccacttttctcagcctgttttttgtttcttattttctattatttttttgagccagtactttttaaagagatagtacttttttcagttagtactttttgaaagggatatatcatagtaatttttaaaagggatatgaggccaggcacggaggctcatgcctataatcccagcactttgggaggccgaggcaggcagatcacggggtcaggagatcgagactttcctggctaacagggtgaatccctgtctctactaaaaatacaaaaaattagctgggcatggtggctggcgcctgtagtcccagctactccagatgctgaggcaggagaatggcatgaacctgtgaggcggagcttgcagggagtcgagatcgcaccactgggctccagcctgggcgacagagtgagagtctatctc

SEQ ID NO: 203202 - DNA, 738 bp, Homo sapiens
  Payload ID: 20071
  Gene Name: zinc finger protein 611
  ENST ID: ENST00000598639
  CDS Start-End: 156-398
gcggatcgggtggagtgtaggtcatatcgccgcgatatctcttccaaatgcttgatgaaaaaggtgggaggatcacttgagccagggagttgaaggctgcagtgagccctgtttttgccaccacactccagcttgggattgattcctaaagactcatgttacgtgaggaagcagctcagaagaggaaaggaaaggagccaggcatggctcttcctcagggacgcttgactttccgggatgtggctatagaattctcattggcagagtggaaatgcctgaacccttcacagagggctttgtacagggaagtgatgttggagaactacaggaacctggaggctgtggagacggggtttcactgtgttagccaggatggtctcaatctcctgacctcgtgatccgtctgactcggcctcccaaagtggtgggattacaggcttgagccaaggcgcctggcctaatgctgtgtattttcttggcctcatacatcagaagatatctcttccaaatgcatgatgaaggaggtcttgtcaacagggcaaggcaatacagaagtgatccacacagggacattgcaaagacatgaaagtcatcacattggagatttttgcttccaggaaattgagaaagaaattcatgacattgagtttcagtgtcaagaagatgaaagaaatggccttgaagcacccatgacaaaaataaaaaagttgactggtagcacagaccaacatgatcaca

SEQ ID NO: 203203 - DNA, 565 bp, Homo sapiens
  Payload ID: 20071
  Gene Name: zinc finger protein 611
  ENST ID: ENST00000598723
  CDS Start-End: 69-263
aacgcaaacccggaagcggatcgggtggagtgtaggtcatatcgccgcggattgattcctaaagactcatgttacgtgaggaagcagctcagaagaggaaaggaaaggagccaggcatggctcttcctcagggacgcttgactttccgggatgtggctatagaattctcattggcagagtggaaatgcctgaacccttcacagagggctttgtacagggaagtgatgttggagaactacaggaacctggaggctgtgggctgaagtgcaatggcacaatctgagttcaccgcaacctccacctcccggattcaaatggttctcctgcctcagcctcccgagaagctgggattacagatatctcttccaaatgcatgatgaaggaggtcttgtcaacagggcaaggcaatacagaagtgatccacacagggacattgcaaagacatgaaagtcatcacattggagatttttgcttccaggaaattgagaaagaaattcatgacattgagtttcagtgtcaagaagatgaaagaaatggccttgaagcacccatgacaaaaataaaa

SEQ ID NO: 203204 - DNA, 3419 bp, Homo sapiens
  Payload ID: 20072
  Gene Name: zinc finger protein 613
  Uniprot ID: Q6PF04
  ENST ID: ENST00000293471
  CDS Start-End: 680-2533
aaaataaatgaaacttgggcgcaggatttaggtgccaaaatatggagttcttcaccgtcccgcgctatccctgaatacttgggcagaaaaggtccactttaccttccgtacgtgcaggattcaaagatggctgcctccagtatccgtgacgagaggacgcgaacttactacctcccagtcgtccgtgctccgtacacctgcaacttcagaccttcctcggccgccgtaggccggcttggaggctgggggagggcccagaagtggaataattcaggaaagtgcaggttctgggaagtctcggtgggttccccgcaaaatcagagatggcatctcactatgttgcccaggctgatcttgaactcctgacctcaagtgatcctctctccttggcctcctaaagtgctgggattccaggtgtgagccacttcacccagccacatttatccatcttgtaaaatattgctttgttttttggtgcatttcaaacccacaggtcctgacttcaggagcaagacacttcaagtgaggtgaggaggaggttccaggacctggataccatcctttgcagggatgtaattcaccagagaccaagatttctagccagaaattgagggcagctcaaggagagactacagacacagcatcctacttactggctatttcccagtaacaaaagaaaatgatcaagtcccaggaatcactgaccctggaggatgtggctgtggagttcacttgggaggagtggcagctcctcggccctgctcagaaggacctgtaccgagacgtgatgttggagaactatagcaacctcgtgtcagtggggtatcaagccagcaaaccagatgcactcttcaagttggaacaaggagagccatggacagtagaaaatgaaatccacagccaaatctgtccagaaatcaagaaagttgacaatcatctacagatgcactcacaaaagcaaagatgtctgaagagagtggaacaatgccataaacataatgcatttggaaacatcattcatcagaggaaaagtgattttcctttaaggcaaaatcatgatacatttgacttacatgggaaaatactgaaatcaaatttaagtttagtcaaccagaacaaaaggtatgaaatcaagaattctgtgggggttaatggagatgggaaatccttccttcatgccaagcatgaacaatttcataatgaaatgaacttccccgaaggtggaaattctgtgaatacaaattcacaattcattaagcatcagcgaactcaaaacatagataaaccccatgtatgcactgagtgtgggaaggctttcctcaagaagtctcgcctcatctatcatcagagagttcacactggggagaaacctcatggatgcagtatatgtgggaaagccttctccagaaagtccgggctcactgaacaccagagaaaccacacaggagagaaaccctatgaatgcactgaatgtgacaaagcattccgctggaaatcacagctcaatgcacaccagaaaattcatacaggagagaagtcatatatatgcagtgattgtggaaaaggcttcatcaagaagtctcggctcattaatcatcagagagttcatacaggagagaaaccacatggatgcagcctgtgtgggaaggccttctccaaaaggtccaggctcactgaacaccagagaactcatacaggagagaaaccctatgaatgcactgaatgtgacaaagcattccgctggaaatcacagctcaatgcacatcagaaagctcacacaggagagaagtcatatatatgccgtgattgtggaaaaggcttcattcagaagggaaatctcattgtacatcagcgaattcatactggagaaaaaccctatatatgcaatgaatgtggaaaaggcttcatccaaaagggcaacctccttattcatcgacgtactcacactggagagaaaccctatgtatgcaatgaatgtgggaaaggcttcagccagaagacatgtttaatatcccatcagagatttcacacaggaaagacaccctttgtatgtactgagtgtggaaaatcctgctcacacaagtcaggtctcattaaccaccagagaattcacacaggagagaaaccctatacatgcagtgactgtgggaaagctttcagagataaatcatgtctcaacagacatcggagaactcatacaggggagagaccgtatggatgctctgattgtgggaaagctttctcccacttgtcatgccttgtttatcataagggaatgctgcatgcaagagagaaatgtgtaggttcagtcaaattggaaaatccttgctcagagagtcatagcttatcacatacacgtgatctcatacaggataaagactctgttaacatggtgactctgcagatgccttctgtggcagctcagacctcattaactaacagtgcgttccaagcagagagcaaagtagccattgtgagccagcctgttgccagaagttcagtctcagcagatagtagaatttgcacagaataaaaaccatatgaatgcagtgaatgtggtagtgctttcagtgatcaattacatcatatgtcacaaaaaacacagaggaacaaactgatatattcaaggtggaaagcccttgaataaaaccttatggctaataagcatatactcagagaaaaatagtatgaagtggagactgggaaattcttttatgggaagatagatcttctcatcagtgaccatagatcacatcttcagtgagcttatagttggtagaaatataatgatcatggaaaagtccttgttcagaaacagtacgccagtaggtatcagggggtttacacaggagagaaacttttggaagacctttgaaggctatgaatgtggcagggttgctagtggtacattctgccttatcctcagagggaatcatatagaaataaaactatgaaaatgtaactagaacatcttcatcaaaatatgaaagaacacacgaagcaaataagccctgtgaaaaggagtattttagagatttcgatcagaaatctaacatcattatatggcagataatatacaggatgtgtattttaggacaatataccttgaatcactagttgatatgtcaatgactaattaaaaggggttgtcagtgttacacatcattggttaaatttatagcacaatgtacctcttcccccttttttgataagagtcttctattcccaaccaagatcattatatgattagctcttgtgtttctttgattccaaatttcttcacttgttatttcagactactgaagctcttcaaaaggaaaaatgtatttaatttaataatgtaacacaacaagtttggatgtgtttaactttataaataatcaccccagaggaatgaagttcaaaacttgtgaataacc

SEQ ID NO: 203205 - DNA, 2225 bp, Homo sapiens
  Payload ID: 20072
  Gene Name: zinc finger protein 613
  Uniprot ID: Q6PF04
  ENST ID: ENST00000391794
  CDS Start-End: 465-2210
ctcggccgccgtaggccggcttggaggctgggggagggcccagaagtggaataattcaggaaagtgcaggttctgggaagtctcggtgggttccccgcaaaatcaggcttgagtgcagtggcgcaatcgtggctcactgcagcctccatctcccggggctcaggtgattttcccacctcagctttcccgagtagctgggactacagagatggcatctcactatgttgcccaggctgatcttgaactcctgacctcaagtgatcctctctccttggcctcctaaagtgctgggattccaggtgtgagccacttcacccagccacatttatccatcttgtaaaatattgctttgttttttggtgcatttcaaagaatcactgaccctggaggatgtggctgtggagttcacttgggaggagtggcagctcctcggccctgctcagaaggacctgtaccgagacgtgatgttggagaactatagcaacctcgtgtcagtggggtatcaagccagcaaaccagatgcactcttcaagttggaacaaggagagccatggacagtagaaaatgaaatccacagccaaatctgtccagaaatcaagaaagttgacaatcatctacagatgcactcacaaaagcaaagatgtctgaagagagtggaacaatgccataaacataatgcatttggaaacatcattcatcagaggaaaagtgattttcctttaaggcaaaatcatgatacatttgacttacatgggaaaatactgaaatcaaatttaagtttagtcaaccagaacaaaaggtatgaaatcaagaattctgtgggggttaatggagatgggaaatccttccttcatgccaagcatgaacaatttcataatgaaatgaacttccccgaaggtggaaattctgtgaatacaaattcacaattcattaagcatcagcgaactcaaaacatagataaaccccatgtatgcactgagtgtgggaaggctttcctcaagaagtctcgcctcatctatcatcagagagttcacactggggagaaacctcatggatgcagtatatgtgggaaagccttctccagaaagtccgggctcactgaacaccagagaaaccacacaggagagaaaccctatgaatgcactgaatgtgacaaagcattccgctggaaatcacagctcaatgcacaccagaaaattcatacaggagagaagtcatatatatgcagtgattgtggaaaaggcttcatcaagaagtctcggctcattaatcatcagagagttcatacaggagagaaaccacatggatgcagcctgtgtgggaaggccttctccaaaaggtccaggctcactgaacaccagagaactcatacaggagagaaaccctatgaatgcactgaatgtgacaaagcattccgctggaaatcacagctcaatgcacatcagaaagctcacacaggagagaagtcatatatatgccgtgattgtggaaaaggcttcattcagaagggaaatctcattgtacatcagcgaattcatactggagaaaaaccctatatatgcaatgaatgtggaaaaggcttcatccaaaagggcaacctccttattcatcgacgtactcacactggagagaaaccctatgtatgcaatgaatgtgggaaaggcttcagccagaagacatgtttaatatcccatcagagatttcacacaggaaagacaccctttgtatgtactgagtgtggaaaatcctgctcacacaagtcaggtctcattaaccaccagagaattcacacaggagagaaaccctatacatgcagtgactgtgggaaagctttcagagataaatcatgtctcaacagacatcggagaactcatacaggggagagaccgtatggatgctctgattgtgggaaagctttctcccacttgtcatgccttgtttatcataagggaatgctgcatgcaagagagaaatgtgtaggttcagtcaaattggaaaatccttgctcagagagtcatagcttatcacatacacgtgatctcatacaggataaagactctgttaacatggtgactctgcagatgccttctgtggcagctcagacctcattaactaacagtgcgttccaagcagagagcaaagtagccattgtgagccagcctgttgccagaagttcagtctcagcagatagtagaatttgcacagaataaaaaccatatgaatgc

SEQ ID NO: 203206 - DNA, 542 bp, Homo sapiens
  Payload ID: 20072
  Gene Name: zinc finger protein 613
  ENST ID: ENST00000600853
  CDS Start-End: 261-542
ccagaagtggaataattcaggaaagtgcaggttctgggaagtctcggtgggttccccgcaaaatcagcccacaggtcctgacttcaggagcaagacacttcaagtgaggtgaggaggaggttccaggacctggataccatcctttgcagggatgtaattcaccagagaccaagatttctagccagaaattgagggcagctcaaggagagactacagacacagcatcctacttactggctatttcccagtaacaaaagaaaatgatcaagtcccaggaatcactgaccctggaggatgtggctgtggagttcacttgggaggagtggcagctcctcggccctgctcagaaggacctgtaccgagacgtgatgttggagaactatagcaacctcgtgtcagtggggtatcaagccagcaaaccagatgcactcttcaagttggaacaaggagagccatggacagtagaaaatgaaatccacagccaaatctgtccagaaatcaagaaagttgacaatcatctacagatgcactcacaaaagcaa

SEQ ID NO: 203207 - DNA, 606 bp, Homo sapiens
  Payload ID: 20072
  Gene Name: zinc finger protein 613
  ENST ID: ENST00000599683
  CDS Start-End: 352-606
ggccggcttggaggctgggggagggcccagaagtggaataattcaggaaagtgcaggttctgggaagtctcggtgggttccccgcaaaatcagagatggcatctcactatgttgcccaggctgatcttgaactcctgacctcaagtgatcctctctccttggcctcctaaagtgctgggattccaggtgtgagccacttcacccagccacatttatccatcttgtaaaatattgctttgttttttggtgcatttcaaagaatcactgaccctggaggatgtggctgtggagttcacttgggaggagtggcagctcctcggccctgctcagaaggacctgtaccgagacgtgatgttggagaactatagcaacctcgtgtcagtggggtatcaagccagcaaaccagatgcactcttcaagttggaacaaggagagccatggacagtagaaaatgaaatccacagccaaatctgtccagaaatcaagaaagttgacaatcatctacagatgcactcacaaaagcaaagatgtctgaagagagtggaacaatgccataaacataatgcatttggaaacatcattcatcagaggaaaagtgattttcct

SEQ ID NO: 203208 - DNA, 2100 bp, Homo sapiens
  Payload ID: 20072
  Gene Name: zinc finger protein 613
  Uniprot ID: Q6PF04
  ENST ID: ENST00000613007
  CDS Start-End: 228-2081
aactggtgctttgttttttgaacctggagttcagcccacaggtcctgacttcaggagcaagacacttcaagtgaggtgaggaggaggttccaggacctggataccatcctttgcagggatgtaattcaccagagaccaagatttctagccagaaattgagggcagctcaaggagagactacagacacagcatcctacttactggctatttcccagtaacaaaagaaaatgatcaagtcccaggaatcactgaccctggaggatgtggctgtggagttcacttgggaggagtggcagctcctcggccctgctcagaaggacctgtaccgagacgtgatgttggagaactatagcaacctcgtgtcagtggggtatcaagccagcaaaccagatgcactcttcaagttggaacaaggagagccatggacagtagaaaatgaaatccacagccaaatctgtccagaaatcaagaaagttgacaatcatctacagatgcactcacaaaagcaaagatgtctgaagagagtggaacaatgccataaacataatgcatttggaaacatcattcatcagaggaaaagtgattttcctttaaggcaaaatcatgatacatttgacttacatgggaaaatactgaaatcaaatttaagtttagtcaaccagaacaaaaggtatgaaatcaagaattctgtgggggttaatggagatgggaaatccttccttcatgccaagcatgaacaatttcataatgaaatgaacttccccgaaggtggaaattctgtgaatacaaattcacaattcattaagcatcagcgaactcaaaacatagataaaccccatgtatgcactgagtgtgggaaggctttcctcaagaagtctcgcctcatctatcatcagagagttcacactggggagaaacctcatggatgcagtatatgtgggaaagccttctccagaaagtccgggctcactgaacaccagagaaaccacacaggagagaaaccctatgaatgcactgaatgtgacaaagcattccgctggaaatcacagctcaatgcacaccagaaaattcatacaggagagaagtcatatatatgcagtgattgtggaaaaggcttcatcaagaagtctcggctcattaatcatcagagagttcatacaggagagaaaccacatggatgcagcctgtgtgggaaggccttctccaaaaggtccaggctcactgaacaccagagaactcatacaggagagaaaccctatgaatgcactgaatgtgacaaagcattccgctggaaatcacagctcaatgcacatcagaaagctcacacaggagagaagtcatatatatgccgtgattgtggaaaaggcttcattcagaagggaaatctcattgtacatcagcgaattcatactggagaaaaaccctatatatgcaatgaatgtggaaaaggcttcatccaaaagggcaacctccttattcatcgacgtactcacactggagagaaaccctatgtatgcaatgaatgtgggaaaggcttcagccagaagacatgtttaatatcccatcagagatttcacacaggaaagacaccctttgtatgtactgagtgtggaaaatcctgctcacacaagtcaggtctcattaaccaccagagaattcacacaggagagaaaccctatacatgcagtgactgtgggaaagctttcagagataaatcatgtctcaacagacatcggagaactcatacaggggagagaccgtatggatgctctgattgtgggaaagctttctcccacttgtcatgccttgtttatcataagggaatgctgcatgcaagagagaaatgtgtaggttcagtcaaattggaaaatccttgctcagagagtcatagcttatcacatacacgtgatctcatacaggataaagactctgttaacatggtgactctgcagatgccttctgtggcagctcagacctcattaactaacagtgcgttccaagcagagagcaaagtagccattgtgagccagcctgttgccagaagttcagtctcagcagatagtagaatttgcacagaataaaaaccatatgaatgcagtg

SEQ ID NO: 203209 - DNA, 4818 bp, Homo sapiens
  Payload ID: 20073
  Gene Name: zinc finger protein 614
  Uniprot ID: Q8N883
  ENST ID: ENST00000270649
  CDS Start-End: 546-2303
gtgttggccttggctgggcacccgactcttgagtgtcccttgcaacgaagagagaaaggcactgaggtgactaagagtgattcccacagccattatggccgctcctgtcagaaacgctgcgatgggcgcagccctgtgacctcatagagcggcgcccgcagtctgaactcgcgatcccgggcaggctccgtggtcctcgcctcgcttcacggtctttaccgctcagcttcccggagtccgcgcaggagcgcgtctgaataggaagcgttttcggacgtggatgcggcgttttgtcgctgccagtggtgtctggagaggttcgggctcggtcctcaggtcctggctcccagaagcaaaataactcaagtgaagcaatgaaggaagaagaaggaggttgctggccttggatatcataatttctggggacaactttaagtggacactaatatttctgactaggaaaacttcaaaaacttcatggcaaatgcagaagagacaaagacgtatagtccatgttatccactattttctgagcacagaagaaaatgatcaagacccaggaatcactgaccctggaggatgtggctgtggaattcagctgggaggagtggcagctcctggacactgctcagaagaacctgtaccgggatgtgatggtggagaactataaccacctagtatcactggggtatcaaactagcaaaccagatgtactctccaagttggcacatggacaagaaccatggacaacagatgctaaaattcagaataaaaattgtccaggaatcgggaaagttgacagtcatctgcaagagcactctccaaaccaaagacttctgaagagcgtgcagcaatgcaatggacagaatacacttagaaatattgtacatctcagcaagacacattttcctatagtgcaaaatcatgatacatttgacttgtacagaaaaaatttgaaatcaagtttaagtttaatcaaccagaagagaagacatggaataaataaccctgttgagtttattggaggtgagaaaacacttctacatggtaagcatgaacgtacgcatactaaaactagattttctgaaaatgcaaaatgtatccatactaaattccaagtcttcaagcatcagaggactcagaaaattgagaaaccccatgcatgcattgaatgtgagcaaaccttccttaggaagtctcagctcatttaccatgagaacatttgtatacaagagaatcctggaagtggtcaatgtgagaaattatccagaagtgtcctgttcactaagcatctgaaaactaatacaacagacaaaatctgtatacccaatgaatatagaaaaggctctactgtgaagagtagtctcattacacatcaacaaacccatacagaagagaaatcctatatgtgcagtgagtgtggaaagggctttacaatgaagcgctatctaattgctcatcagcgaactcatagtggagagaaaccttatgtgtgcaaagaatgtggaaaaggtttcactgtgaagagcaatctcattgtacatcagcgaactcatacaggggagaaaccctatatatgcagtgaatgtggaaaaggcttcaccatgaagcgctatcttgttgtacatcagcgaactcatactggagagaaaccctatatgtgcagtgaatgtggaaaaggctttaccgtgaagagcaatctcattgtacatcagcgctcccacacaggagaaaaatcttacatatgcagcgaatgtggaaaaggcttcactgtcaaacgcactctcgttatacatcagcgaactcatacaggagagaaatcttacatatgcaatgaatgtggtaaaggcttcaccacaaagcgcactcttattatacatcagcgaactcatacaggagaaaaaccctatgaatgcaatgaatgtggtaaagccttcagccagaaaatatgcctcatacaacatgagagatgtcatacaggaaagactccctttgtatgtaccgagtgcggaaaatcctattcacacaaatatggcctcattacccatcagagaattcacacaggagagaaaccttatgagtgcaatgaatgtggaaaagccttcaccacaaagtcagtactcaatgtacatcaaagaacgcatacaggagagaggccgtatggatgcagtgattgtgagaaagccttctcccacttatcaaaccttgtcaaacataagaaaatgcacacaagagaaatgggtagaatcagtcaagttgaaaactcctgtaatggagagtcacagctccttccttataagtgaactcatgcagaagaaaaccctactagtgccgtgactatggaaatgccttttgtggcaactcagacttcattaaacatcagtgtgtttctagccaattggaacataaacatggtgctgcctgttgacagatgtgtgtctgtcctcaggaggtgaaataatttgccctagagatcaatttgatgaatacagtaaataaggtagtgcctttagtggtcttttacctcatattttctgtcaatgaaaatacgttgaataaactatattaatgtggagatgttttgagcaataatttctgctcatatgtctgaaaagtatacagagataaattctgtgaatacaaagactaagaaaagtcttctgtggaaagatagactttattatcaggtttcatcatagatttcaacgtaagtgagcttattgttgatagaaacatgatgaccatgacaaagtctttactcagaaatatgacctcagtgagtgtcaaagtttacactggaaaataactttaaggtgacagtattgatggcaggatttcagcgacgcactctgcttcatcatttgtcaggagatcacatagaaagtaaaattgttccgaacatgctatcaaataaatgtggaacacctttagcaaactatcaacagctcatgaaggcatgaaatgtggtgaaaatgatgaatatttgagtgctttttcttaataagtataaccttaaacatcagctaatacacctggtgtgcattttcagtcaggataccttaatcctcatttctagttgccttgccaatgattccataatatactgtctcattactgtttatttttactgttgtgtaaaattgtggtataatgagaaatacatttggtctttgttcctggttcctggcatagagctcctaaaacgcttagaatttcatgagtgataagagttttttggttttgttttgtttttgctgttgttgttattcatagcactgcccttttaattacacctgattatactactgaagtgacttatggttgctcccctagacagcctcagaatggggctgttctctaggaagatcaagtaactagaggatggagactttgtgccccatttctcccacctcctggaaggggaggggtgctggagattagattagacaatgagattaagagaactccaaatagcccaagagggtggtgcacccccaacttcataggggtagaggctcctgagattaggagaaccctttttaggctttactctatgtacctcttcatttgagtgttcatttgcgtcctttataaccagtaaaacaaagtacgctgttttcttgagttttgtgagccctgtagcaaattatcaaacctgagtagggcagtgggaactcggaatttatcaccattcagaactgcaggttgtccttgtgagtggcatctgatgtgggggaagtcttggactgagccccttaacttgtggagtctgcactaatttagactgcactaactaacttgcactgcactaacttggactgcactaacttgtggagtctgcactaacttggagaagttagtgtcagaattgaattatagaacacccagttgttcagaattgaattgtagaacacccaattggtgtgggagaattagagaatttatttgtgtcagaaaatactccagaacaaccaccccatattatgattagctcttttcctttctttggctctgagcttaattgtacattaagcaaacttaagtagaaaagaaactgaatatgttaaatatattaacaacatatttggacttgcttaactaagattatagagatgatcagtttataaaaccaccttcaacttaaataaatttgaactcgaaattgcaaaagcagtctagaggctttgctagtatccttcaaccaatttctagtaaaaatatcctatataaccataattatcaaaaccagaaaaacaacattggtaggatactataaagtactaatcttattttggatttgacgaatttttacatgtttttttcttttttagtttgtactctaagaagttgtattacatgtacagattcgtgtaaccactgcaaccacataaaactaatgaacacaaagtccctcatgctacctttttatgcttacactccatccaaacctaactctgccaaccacttttctcctatcagtataatttcatcatttcatgaatatgataaaaataaaattgtttttgtaaatggtttttataaattttatataaataagttatatgaatttttattgatagagagtatgtaagcttttggcatttttgtcactcagcaaattactcctaaggtttatatgagttgatgaatagttgttttattatttttttttaccaccatgtatctaaccagatgaaagttgtttatatttgagagtagtatacatatttgatgtagtagtttatccattcacctatgagatatatttgcactgttttcctggttttaagtgctataaataaagatgctgtgaaatct

SEQ ID NO: 203210 - DNA, 1293 bp, Homo sapiens
  Payload ID: 20073
  Gene Name: zinc finger protein 614
  Uniprot ID: Q8N883
  ENST ID: ENST00000356322
  CDS Start-End: 325-921
ctcagcttcccggagtccgcgcaggagcgcgtctgaataggaagcgttttcggacgtggatgcggcgttttgtcgctgccagtggtgtctggagaggttcgggctcggtcctcaggtcctggctcccagaagcaaaataactcaagtgaagcaatgaaggaagaagaaggaggttgctggccttggatatcataatttctggggacaactttaagtggacactaatatttctgactaggaaaacttcaaaaacttcatggcaaatgcagaagagacaaagacgtatagtccatgttatccactattttctgagcacagaagaaaatgatcaagacccaggaatcactgaccctggaggatgtggctgtggaattcagctgggaggagtggcagctcctggacactgctcagaagaacctgtaccgggatgtgatggtggagaactataaccacctagtatcactggggtatcaaactagcaaaccagatgtactctccaagttggcacatggacaagaaccatggacaacagatgctaaaattcagaataaaaattgtccaggaatcgggaaagttgacagtcatctgcaagagcactctccaaaccaaagacttctgaagagcgtgcagcaatgcaatggacagaatacacttagaaatattgtacatctcagcaagacacattttcctatagtgcaaaatcatgatacatttgacttgtacagaaaaaatttgaaatcaagtttaagtttaatcaaccagaagagaagacatggaataaataaccctgttgagtttattggagagacagggtctcttgagaggccgaggcaggcggatcacttgaggtcagaagttcaagaccagcctggccaacgtggcgaaaccctgtgtctactaaaaatacacacaaaaaattagctgggtatggtgctgggctgttgggagccgaaggcccatgggatgtgaccaactcagcattccactggaggctatatgatcaaacagcaaactttatcatgaatgcacgatgtgggcaaactcatgactgcttccgctgccagaaggtttgctgagggcaatcgcttcctggtgctgagctccttgaggttatctactgggacatctagagaatgccatcttgcaaaccctactctggactgagtagctgaccccttcttccacccgccttctcactatctcttttgcctaataaatatggagggctgtgtaaagctcagggcccttgtccactagaggcaaggtgtcccctgatcccttcttccaaatata

SEQ ID NO: 203211 - DNA, 718 bp, Homo sapiens
  Payload ID: 20073
  Gene Name: zinc finger protein 614
  ENST ID: ENST00000597952
  CDS Start-End: 602-718
cttcttaaatttgaacatctctgccctaaattgtggattggtgctcccatcaccattcccacactgtaacaggatggattcagggcagattgtctccagcaatgaatcagacaaaagtgctccaccaaccaggcccttgaatcaccttccttgtcccgtgaatcagcacagcctgccacggcaaagttttatcagcccactcctggaaatgatcagtgaaggtcccatcatgggctgctcatagtcctgtggaccaggtgctaaacttacctaccagagattaacattccagatgaacggggctgaaatttaatcctggatggaatatgttataacactcaagaaatacgaacatgaaattcttattctctagaaattacaaaactcctcaggtcctggctcccagaagcaaaataactcaagtgaagcaatgaaggaagaagaaggaggttgctggccttggatatcataatttctggggacaactttaagtggacactaatatttctgactaggaaaacttcaaaaacttcatggcaaatgcagaagagacaaagacgtatagtccatgttatccactattttctgagcacagaagaaaatgatcaagacccaggaatcactgaccctggaggatgtggctgtggaattcagctgggaggagtggcagctcctggacactgctcagaagaacctgtaccgggatgtgatggtggag

SEQ ID NO: 203212 - DNA, 1031 bp, Homo sapiens
  Payload ID: 20073
  Gene Name: zinc finger protein 614
  ENST ID: ENST00000595189
  CDS Start-End: 313-555
gagtccgcgcaggagcgcgtctgaataggaagcgttttcggacgtggatgcggcgttttgtcgctgccagtggtgtctggagaggttcgggctcggtcctcaggtcctggctcccagaagcaaaataactcaagtgaagcaatgaaggaagaagaaggaggttgctggccttggatatcataatttctggggacaactttaagtggacactaatatttctgactaggaaaacttcaaaaacttcatggcaaatgcagaagagacaaagacgtatagtccatgttatccactattttctgagcacagaagaaaatgatcaagacccaggaatcactgaccctggaggatgtggctgtggaattcagctgggaggagtggcagctcctggacactgctcagaagaacctgtaccgggatgtgatggtggagaactataaccacctagtatcactggggtatcaaactagcaaaccagatgtactctccaagttggcacatggacaagaaccatggacaacagatgctaaaattcagaataaaaattgtccagactgagtctcgctctatcacccaggctggagtgcaatggcccaatctcggcttgctgcaacctcgtcctcctgggatcaagtgattctcctgcctcagcctcctgaatagctgggattacaggaatcgggaaagttgacagtcatctgcaagagcactctccaaaccaaagacttctgaagagcgtgcagcaatgcaatggacagaatacacttagaaatattgtacatctcagcaagacacattttcctatagtgcaaaatcatgatacatttgacttgtacagaaaaaatttgaaatcaagtttaagtttaatcaaccagaagagaagacatggaataaataaccctgttgagtttattggaggtgagaaaacacttctacatggtaagcatgaacgtacgcatactaaaactagattttctgaaaatgcaaaatgtatccatactaaattccaagtcttcaagcatcagaggactcag

SEQ ID NO: 203213 - DNA, 4048 bp, Homo sapiens
  Payload ID: 20074
  Gene Name: zinc finger protein 615
  Uniprot ID: Q8N8J6
  ENST ID: ENST00000376716
  CDS Start-End: 318-2513
aaacgctgggaacgcctccgaccctggatagtcgccgtcaggcactgaggaggccgagagatgaggccggagcccaccaagttctgggaagttctttctgacacaagtaagataacatctctgccatgcccacaggtgctgagaacaagagaaatcaagtgaaggaaggaggcggagtttccaagacttgggtgtcatcatttctggggacatccttgattggagattgaagtttttgaaccgaaatttagagctgattcagaagagacaaatacagaacgtccaagttagcagtcatttcccaaatttaggagacaatgatgcaggcccaggaatccctaacactggaggatgtggctgtggacttcacctgggaggagtggcagttcctgagccctgctcagaaggacctgtaccgggacgtgatgttggagaactacagcaacctggtggcagtggggtatcaagccagcaaaccagatgcactctccaaattggaacgaggagaagaaacttgcacaacagaagatgaaatctactctcgaatctgttctgaaatcaggaaaattgatgatcctctgcagcatcacttgcaaaatcaaagtattcagaagagtgtgaaacagtgccatgaacagaatatgtttggaaatattgttaatcagaacaaaggtcatttcctgctgaagcaagattgtgatacgtttgacttacatgaaaaacctttaaaatcaaatttaagttttgaaaaccagaaaaggagctctggcctaaagaactctgctgagtttaatagagatgggaaatccctttttcatgctaaccataaacaattttatactgaaatgaagtttcctgcaattgcaaaacctattaataagtcccagttcattaagcaacagagaactcacaacatagagaatgcccatgtatgcagtgaatgtgggaaagccttcctcaagttgtctcagtttattgatcatcagagagttcacactggagaaaaacctcatgtatgcagtatgtgtgggaaagctttctccagaaaatccagactaatggaccatcagagaactcatacagaactgaaacattatgaatgcactgaatgtgacaaaaccttcctcaagaaatcacagctcaatatacatcagaaaactcatatgggagggaaaccttacacatgtagccaatgtgggaaagccttcatcaagaagtgtcggctcatttatcatcaacgaactcatacaggagagaaaccccatggatgcagtgtatgtgggaaggccttctctacaaagttcagtctcactacacatcagaaaactcatacaggagaaaaaccttatatatgtagtgaatgtggaaaaggcttcattgagaagaggcgtcttactgcacatcatcgaactcatactggtgagaaaccctttatatgcaataaatgtgggaaaggcttcaccttgaagaacagtcttatcacacatcagcaaactcatacaggagagaaattatatacatgtagtgaatgtggaaaaggcttttcaatgaagcactgtctcatggtacatcaacgaactcatactggagagaaaccttataaatgcaatgagtgtggaaagggcttcgctttgaagagcccactcatcagacatcagcgaacacatactggagagaaaccctatgtatgcaccgaatgtcgaaaaggtttcaccatgaagagtgacctcattgtacatcagcgaactcatactgcagagaagccatatatatgcaatgattgtggaaaaggcttcactgtgaagagccgccttattgtgcatcagcgaactcatactggagaaaaaccctatgtatgtggtgagtgtggaaaaggctttccagcaaagatccggctaatgggacatcaacgaactcatacaggagagaaaccttatatttgcaatgagtgtggaaaaggcttcactgagaagagtcatctcaatgtacatcggcgcactcatacaggagagaaaccctatgtatgcagtgaatgtggcaaaggcttaactgggaaaagcatgctcattgcacatcagcgaactcatactggggagaaaccttatatatgcaatgaatgtggaaagggcttcaccatgaagagtactctcagtatacatcagcaaactcatactggagagaagccatacaaatgcaatgaatgtgataaaaccttcaggaagaagacatgcctcatacaacatcagcgatttcacacaggaaagacttcctttgcatgtactgaatgtggaaaattctctttgcgcaaaaatgatcttattacacatcagagaattcacacaggagagaaaccgtacaaatgcagtgactgcgggaaagccttcactacaaaatcagggctcaatgttcatcaaagaaaacatacaggagagaggccctatggatgtagtgattgtgggaaagcttttgcgcacttgtctatccttgttaaacacaggagaattcacaggtagtcattttgggaaagcctcttgccagatgtaggcccttaagatatctgcaaagaagagtaatttcatgaatgcagactacatggttgtttatttagtgatcagttacttcatgttttgtgtcagagaaaacatgtacaaaacatttgagaaaatattttaggacattatgtctaaaaattgtatactgagaaaaatcctatgaatgtggcagactataaaagcctttggtgggaagataaaccccctcagaagtgatcatagatcatgaataaactactaattcgtggaaatgtaataattataggaacgtctttgcccaaaaataaaacttcaacagattgagagagttcacactggagaaatactttcctctggcaaacccctgtggcagggttttcagtaaaatgttttgcctcatcgtgtgctaggaaataatgcagaaaaaacttatgaaaacattcaatgtagaagacttttaggaaaatatcagagaatttaatgaaggaaagaagccttggcaaaatgatggatgagagctttctgtcacaattctaaccttaacagataatatgcctcatgtgcatttgggaacaggatagcttgagccatattcctagttgccttgtcactgattttatacattttaaattgtgacttcctctaatcacgaactaaaatttaatattgtatataataccggagtattttatgcctgcctcattttattatatgattagctcctgcatttctttggttctaagtttgtgttatttcagaataactaaagtacttcagaatgaaactggatacagtatattcagttcataagtgtaattgaccatacttgaatatgtttaagtttataagtaacatcaggtgttatgaaattaatataaataagatgtttttgtaagtttttattttgaaataagtttagattcacaaaatcttaccaaaatattccagagttcttgcccttaacccagcttcttccaaagataacaacttacataagcatagttcattaccaaatacaggaaagtgaaattgttacaatactgttaactacagaatttatttggaaatcaccagttttaacatgcatgcatttttgtttgttttttatatgtagctttaagaaatcttaacacatatattgattcatgtcaccaccaccgtaatcgagattcagaatgttgcatcaatgcaaactccctcatgctccttgtttatagtcacaacctctcctcagccctaacccttggcaatcagaaatcttttcatctttagttttgtcattagtagcatgttataaaaatggaatcatacagcatgtacccttttggtattggctatttcaactaaagcagattaacctgaaatccatccaagttgttctgcatatcattgttctgtttttattggccactaataatctatgatacgaatataccactatttgtttattcacccactgaaggacattagttttgttcccggtttttcttactgttacaaataaaaatcctatgaac

SEQ ID NO: 203214 - DNA, 2698 bp, Homo sapiens
  Payload ID: 20074
  Gene Name: zinc finger protein 615
  ENST ID: ENST00000391795
  CDS Start-End: 61-2271
aaacgctgggaacgcctccgaccctggatagtcgccgtcaggcactgaggaggccgagagatgaggccggagcccaccaagttctgggaagaatccctaacactggaggatgtggctgtggacttcacctgggaggagtggcagttcctgagccctgctcagaaggacctgtaccgggacgtgatgttggagaactacagcaacctggtggcagtggggtatcaagccagcaaaccagatgcactctccaaattggaacgaggagaagaaacttgcacaacagaagatgaaatctactctcgaatctgttctgaaatcaggaaaattgatgatcctctgcagcatcacttgcaaaatcaaagtattcagaagagtgtgaaacagtgccatgaacagaatatgtttggaaatattgttaatcagaacaaaggtcatttcctgctgaagcaagattgtgatacgtttgacttacatgaaaaacctttaaaatcaaatttaagttttgaaaaccagaaaaggagctctggcctaaagaactctgctgagtttaatagagatgggaaatccctttttcatgctaaccataaacaattttatactgaaatgaagtttcctgcaattgcaaaacctattaataagtcccagttcattaagcaacagagaactcacaacatagagaatgcccatgtatgcagtgaatgtgggaaagccttcctcaagttgtctcagtttattgatcatcagagagttcacactggagaaaaacctcatgtatgcagtatgtgtgggaaagctttctccagaaaatccagactaatggaccatcagagaactcatacagaactgaaacattatgaatgcactgaatgtgacaaaaccttcctcaagaaatcacagctcaatatacatcagaaaactcatatgggagggaaaccttacacatgtagccaatgtgggaaagccttcatcaagaagtgtcggctcatttatcatcaacgaactcatacaggagagaaaccccatggatgcagtgtatgtgggaaggccttctctacaaagttcagtctcactacacatcagaaaactcatacaggagaaaaaccttatatatgtagtgaatgtggaaaaggcttcattgagaagaggcgtcttactgcacatcatcgaactcatactggtgagaaaccctttatatgcaataaatgtgggaaaggcttcaccttgaagaacagtcttatcacacatcagcaaactcatacaggagagaaattatatacatgtagtgaatgtggaaaaggcttttcaatgaagcactgtctcatggtacatcaacgaactcatactggagagaaaccttataaatgcaatgagtgtggaaagggcttcgctttgaagagcccactcatcagacatcagcgaacacatactggagagaaaccctatgtatgcaccgaatgtcgaaaaggtttcaccatgaagagtgacctcattgtacatcagcgaactcatactgcagagaagccatatatatgcaatgattgtggaaaaggcttcactgtgaagagccgccttattgtgcatcagcgaactcatactggagaaaaaccctatgtatgtggtgagtgtggaaaaggctttccagcaaagatccggctaatgggacatcaacgaactcatacaggagagaaaccttatatttgcaatgagtgtggaaaaggcttcactgagaagagtcatctcaatgtacatcggcgcactcatacaggagagaaaccctatgtatgcagtgaatgtggcaaaggcttaactgggaaaagcatgctcattgcacatcagcgaactcatactggggagaaaccttatatatgcaatgaatgtggaaagggcttcaccatgaagagtactctcagtatacatcagcaaactcatactggagagaagccatacaaatgcaatgaatgtgataaaaccttcaggaagaagacatgcctcatacaacatcagcgatttcacacaggaaagacttcctttgcatgtactgaatgtggaaaattctctttgcgcaaaaatgatcttattacacatcagagaattcacacaggagagaaaccgtacaaatgcagtgactgcgggaaagccttcactacaaaatcagggctcaatgttcatcaaagaaaacatacaggagagaggccctatggatgtagtgattgtgggaaagcttttgcgcacttgtctatccttgttaaacacaggagaattcacaggtagtcattttgggaaagcctcttgccagatgtaggcccttaagatatctgcaaagaagagtaatttcatgaatgcagactacatggttgtttatttagtgatcagttacttcatgttttgtgtcagagaaaacatgtacaaaacatttgagaaaatattttaggacattatgtctaaaaattgtatactgagaaaaatcctatgaatgtggcagactataaaagcctttggtgggaagataaaccccctcagaagtgatcatagatcatgaataaactactaattcgtggaaatgtaataattataggaacgtctttgcccaaaaataaaacttcaacagattgagagagttcacactggagaaatactttcctctggcaaacccctgtggcagggttttcagtaaaatgttttgcctcatcgtgtgcta

SEQ ID NO: 203215 - DNA, 4122 bp, Homo sapiens
  Payload ID: 20074
  Gene Name: zinc finger protein 615
  ENST ID: ENST00000599177
  CDS Start-End: 265-561
ctccgaccctggatagtcgccgtcaggcactgaggaggccgagagatgaggccggagcccaccaagttctgggaacccacaggtgctgagaacaagagaaatcaagtgaaggaaggaggcggagtttccaagacttgggtgtcatcatttctggggacatccttgattggagattgaagtttttgaaccgaaatttagagctgattcagaagagacaaatacagaacgtccaagttagcagtcatttcccaaatttaggagacaatgatgcaggcccaggaatccctaacactggaggatgtggctgtggacttcacctgggaggagtggcagttcctgagccctgctcagaaggacctgtaccgggacgtgatgttggagaactacagcaacctggtggcagtggggtatcaagccagcaaaccagatgcactctccaaattggaacgaggagaagaaacttgcacaacagaagatgaaatctactctcgaatctgttctgattcaggaggtgcatcaggaggtgcatatgcaggtttgtctcatggatatattgcctgatgccgaggattcactagaagctcaatcctgtcacccaagtagtgaacatagtaccaaatagaaatcaggaaaattgatgatcctctgcagcatcacttgcaaaatcaaagtattcagaagagtgtgaaacagtgccatgaacagaatatgtttggaaatattgttaatcagaacaaaggtcatttcctgctgaagcaagattgtgatacgtttgacttacatgaaaaacctttaaaatcaaatttaagttttgaaaaccagaaaaggagctctggcctaaagaactctgctgagtttaatagagatgggaaatccctttttcatgctaaccataaacaattttatactgaaatgaagtttcctgcaattgcaaaacctattaataagtcccagttcattaagcaacagagaactcacaacatagagaatgcccatgtatgcagtgaatgtgggaaagccttcctcaagttgtctcagtttattgatcatcagagagttcacactggagaaaaacctcatgtatgcagtatgtgtgggaaagctttctccagaaaatccagactaatggaccatcagagaactcatacagaactgaaacattatgaatgcactgaatgtgacaaaaccttcctcaagaaatcacagctcaatatacatcagaaaactcatatgggagggaaaccttacacatgtagccaatgtgggaaagccttcatcaagaagtgtcggctcatttatcatcaacgaactcatacaggagagaaaccccatggatgcagtgtatgtgggaaggccttctctacaaagttcagtctcactacacatcagaaaactcatacaggagaaaaaccttatatatgtagtgaatgtggaaaaggcttcattgagaagaggcgtcttactgcacatcatcgaactcatactggtgagaaaccctttatatgcaataaatgtgggaaaggcttcaccttgaagaacagtcttatcacacatcagcaaactcatacaggagagaaattatatacatgtagtgaatgtggaaaaggcttttcaatgaagcactgtctcatggtacatcaacgaactcatactggagagaaaccttataaatgcaatgagtgtggaaagggcttcgctttgaagagcccactcatcagacatcagcgaacacatactggagagaaaccctatgtatgcaccgaatgtcgaaaaggtttcaccatgaagagtgacctcattgtacatcagcgaactcatactgcagagaagccatatatatgcaatgattgtggaaaaggcttcactgtgaagagccgccttattgtgcatcagcgaactcatactggagaaaaaccctatgtatgtggtgagtgtggaaaaggctttccagcaaagatccggctaatgggacatcaacgaactcatacaggagagaaaccttatatttgcaatgagtgtggaaaaggcttcactgagaagagtcatctcaatgtacatcggcgcactcatacaggagagaaaccctatgtatgcagtgaatgtggcaaaggcttaactgggaaaagcatgctcattgcacatcagcgaactcatactggggagaaaccttatatatgcaatgaatgtggaaagggcttcaccatgaagagtactctcagtatacatcagcaaactcatactggagagaagccatacaaatgcaatgaatgtgataaaaccttcaggaagaagacatgcctcatacaacatcagcgatttcacacaggaaagacttcctttgcatgtactgaatgtggaaaattctctttgcgcaaaaatgatcttattacacatcagagaattcacacaggagagaaaccgtacaaatgcagtgactgcgggaaagccttcactacaaaatcagggctcaatgttcatcaaagaaaacatacaggagagaggccctatggatgtagtgattgtgggaaagcttttgcgcacttgtctatccttgttaaacacaggagaattcacaggtagtcattttgggaaagcctcttgccagatgtaggcccttaagatatctgcaaagaagagtaatttcatgaatgcagactacatggttgtttatttagtgatcagttacttcatgttttgtgtcagagaaaacatgtacaaaacatttgagaaaatattttaggacattatgtctaaaaattgtatactgagaaaaatcctatgaatgtggcagactataaaagcctttggtgggaagataaaccccctcagaagtgatcatagatcatgaataaactactaattcgtggaaatgtaataattataggaacgtctttgcccaaaaataaaacttcaacagattgagagagttcacactggagaaatactttcctctggcaaacccctgtggcagggttttcagtaaaatgttttgcctcatcgtgtgctaggaaataatgcagaaaaaacttatgaaaacattcaatgtagaagacttttaggaaaatatcagagaatttaatgaaggaaagaagccttggcaaaatgatggatgagagctttctgtcacaattctaaccttaacagataatatgcctcatgtgcatttgggaacaggatagcttgagccatattcctagttgccttgtcactgattttatacattttaaattgtgacttcctctaatcacgaactaaaatttaatattgtatataataccggagtattttatgcctgcctcattttattatatgattagctcctgcatttctttggttctaagtttgtgttatttcagaataactaaagtacttcagaatgaaactggatacagtatattcagttcataagtgtaattgaccatacttgaatatgtttaagtttataagtaacatcaggtgttatgaaattaatataaataagatgtttttgtaagtttttattttgaaataagtttagattcacaaaatcttaccaaaatattccagagttcttgcccttaacccagcttcttccaaagataacaacttacataagcatagttcattaccaaatacaggaaagtgaaattgttacaatactgttaactacagaatttatttggaaatcaccagttttaacatgcatgcatttttgtttgttttttatatgtagctttaagaaatcttaacacatatattgattcatgtcaccaccaccgtaatcgagattcagaatgttgcatcaatgcaaactccctcatgctccttgtttatagtcacaacctctcctcagccctaacccttggcaatcagaaatcttttcatctttagttttgtcattagtagcatgttataaaaatggaatcatacagcatgtacccttttggtattggctatttcaactaaagcagattaacctgaaatccatccaagttgttctgcatatcattgttctgtttttattggccactaataatctatgatacgaatataccactatttgtttattcacccactgaaggacattagttttgttcccggtttttcttactgttacaaataaaaatcctatgaacatttgta

SEQ ID NO: 203216 - DNA, 704 bp, Homo sapiens
  Payload ID: 20074
  Gene Name: zinc finger protein 615
  ENST ID: ENST00000597747
  CDS Start-End: 213-509
cggagcccaccaagttctgggaacccacaggtgctgagaacaagagaaatcaagtgaaggaaggaggcggagtttccaagacttgggtgtcatcatttctggggacatccttgattggagattgaagtttttgaaccgaaatttagagctgattcagaagagacaaatacagaacgtccaagttagcagtcatttcccaaatttaggagacaatgatgcaggcccaggaatccctaacactggaggatgtggctgtggacttcacctgggaggagtggcagttcctgagccctgctcagaaggacctgtaccgggacgtgatgttggagaactacagcaacctggtggcagtggggtatcaagccagcaaaccagatgcactctccaaattggaacgaggagaagaaacttgcacaacagaagatgaaatctactctcgaatctgttctgattcaggaggtgcatcaggaggtgcatatgcaggtttgtctcatggatatattgcctgatgccgaggattcactagaagctcaatcctgtcacccaagtagtgaacatagtaccaaataggtggttcttcaacccttgccttcctcccttcttcctcttggagtccccagtgtctattgttcctgtcttgatgtccctgtgttcccaatgtttagctcttgcctacaagtgagaatacacagtatttggttttc

SEQ ID NO: 203217 - DNA, 535 bp, Homo sapiens
  Payload ID: 20074
  Gene Name: zinc finger protein 615
  ENST ID: ENST00000599115
  CDS Start-End: 32-343
agtcgccgtcaggcactgaggaggccgagagatgaggccggagcccaccaagttctgggaagaatccctaacactggaggatgtggctgtggacttcacctgggaggagtggcagttcctgagccctgctcagaaggacctgtaccgggacgtgatgttggagaactacagcaacctggtggcagtggggtatcaagccagcaaaccagatgcactctccaaattggaacgaggagaagaaacttgcacaacagaagatgaaatctactctcgaatctgttctgattcaggaggtgcatcaggaggtgcatatgcaggtttgtctcatggatatattgcctgatgccgaggattcactagaagctcaatcctgtcacccaagtagtgaacatagtaccaaatagaaatcaggaaaattgatgatcctctgcagcatcacttgcaaaatcaaagtattcagaagagtgtgaaacagtgccatgaacagaatatgtttggaaatattgttaatcagaacaaaggtcatttcctgctg

SEQ ID NO: 203218 - DNA, 2654 bp, Homo sapiens
  Payload ID: 20074
  Gene Name: zinc finger protein 615
  Uniprot ID: Q8N8J6
  ENST ID: ENST00000598071
  CDS Start-End: 290-2518
tagtcgccgtcaggcactgaggaggccgagagatgaggccggagcccaccaagttctgggaagttctttctgacacaagtaagataacatctctgccatgcccacaggtgctgagaacaagagaaatcaagtgaaggaaggaggcggagtttccaagacttgggtgtcatcatttctggggacatccttgattggagattgaagtttttgaaccgaaatttagagctgattcagaagagacaaatacagaacgtccaagttagcagtcatttcccaaatttaggagacaatgatgcaggcccaggaatccctaacactggaggatgtggctgtggacttcacctgggaggagtggcagttcctgagccctgctcagaaggacctgtaccgggacgtgatgttggagaactacagcaacctggtggcagtggggtatcaagccagcaaaccagatgcactctccaaattggaacgaggagaagaaacttgcacaacagaagatgaaatctactctcgaatctgttctgattcaggaggtgcatcaggaggtgcatatgcagaaatcaggaaaattgatgatcctctgcagcatcacttgcaaaatcaaagtattcagaagagtgtgaaacagtgccatgaacagaatatgtttggaaatattgttaatcagaacaaaggtcatttcctgctgaagcaagattgtgatacgtttgacttacatgaaaaacctttaaaatcaaatttaagttttgaaaaccagaaaaggagctctggcctaaagaactctgctgagtttaatagagatgggaaatccctttttcatgctaaccataaacaattttatactgaaatgaagtttcctgcaattgcaaaacctattaataagtcccagttcattaagcaacagagaactcacaacatagagaatgcccatgtatgcagtgaatgtgggaaagccttcctcaagttgtctcagtttattgatcatcagagagttcacactggagaaaaacctcatgtatgcagtatgtgtgggaaagctttctccagaaaatccagactaatggaccatcagagaactcatacagaactgaaacattatgaatgcactgaatgtgacaaaaccttcctcaagaaatcacagctcaatatacatcagaaaactcatatgggagggaaaccttacacatgtagccaatgtgggaaagccttcatcaagaagtgtcggctcatttatcatcaacgaactcatacaggagagaaaccccatggatgcagtgtatgtgggaaggccttctctacaaagttcagtctcactacacatcagaaaactcatacaggagaaaaaccttatatatgtagtgaatgtggaaaaggcttcattgagaagaggcgtcttactgcacatcatcgaactcatactggtgagaaaccctttatatgcaataaatgtgggaaaggcttcaccttgaagaacagtcttatcacacatcagcaaactcatacaggagagaaattatatacatgtagtgaatgtggaaaaggcttttcaatgaagcactgtctcatggtacatcaacgaactcatactggagagaaaccttataaatgcaatgagtgtggaaagggcttcgctttgaagagcccactcatcagacatcagcgaacacatactggagagaaaccctatgtatgcaccgaatgtcgaaaaggtttcaccatgaagagtgacctcattgtacatcagcgaactcatactgcagagaagccatatatatgcaatgattgtggaaaaggcttcactgtgaagagccgccttattgtgcatcagcgaactcatactggagaaaaaccctatgtatgtggtgagtgtggaaaaggctttccagcaaagatccggctaatgggacatcaacgaactcatacaggagagaaaccttatatttgcaatgagtgtggaaaaggcttcactgagaagagtcatctcaatgtacatcggcgcactcatacaggagagaaaccctatgtatgcagtgaatgtggcaaaggcttaactgggaaaagcatgctcattgcacatcagcgaactcatactggggagaaaccttatatatgcaatgaatgtggaaagggcttcaccatgaagagtactctcagtatacatcagcaaactcatactggagagaagccatacaaatgcaatgaatgtgataaaaccttcaggaagaagacatgcctcatacaacatcagcgatttcacacaggaaagacttcctttgcatgtactgaatgtggaaaattctctttgcgcaaaaatgatcttattacacatcagagaattcacacaggagagaaaccgtacaaatgcagtgactgcgggaaagccttcactacaaaatcagggctcaatgttcatcaaagaaaacatacaggagagaggccctatggatgtagtgattgtgggaaagcttttgcgcacttgtctatccttgttaaacacaggagaattcacaggtagtcattttgggaaagcctcttgccagatgtaggcccttaagatatctgcaaagaagagtaatttcatgaatgcagactacatggttgtttatttagtgatcagttacttcatgttttgtgtcagagaaaacatgtac

SEQ ID NO: 203219 - DNA, 577 bp, Homo sapiens
  Payload ID: 20074
  Gene Name: zinc finger protein 615
  ENST ID: ENST00000593650
  CDS Start-End: 96-577
gtcgccgtcaggcactgaggaggccgagagatgaggccggagcccaccaagttctgggaagttctttctgacacaagtaagataacatctctgccatggaatccctaacactggaggatgtggctgtggacttcacctgggaggagtggcagttcctgagccctgctcagaaggacctgtaccgggacgtgatgttggagaactacagcaacctggtggcagtggggtatcaagccagcaaaccagatgcactctccaaattggaacgaggagaagaaacttgcacaacagaagatgaaatctactctcgaatctgttctgattcaggaggtgcatcaggaggtgcatatgcagaaatcaggaaaattgatgatcctctgcagcatcacttgcaaaatcaaagtattcagaagagtgtgaaacagtgccatgaacagaatatgtttggaaatattgttaatcagaacaaaggtcatttcctgctgaagcaagattgtgatacgtttgacttacatgaaaaacctttaaaatcaaatttaagttttgaaaaccagaaaaggagctctggcctaaagaa

SEQ ID NO: 203220 - DNA, 4020 bp, Homo sapiens
  Payload ID: 20074
  Gene Name: zinc finger protein 615
  Uniprot ID: Q8N8J6
  ENST ID: ENST00000594083
  CDS Start-End: 246-2474
ccgtcaggcactgaggaggccgagagatgaggccggagcccaccaagttctgggaacccacaggtgctgagaacaagagaaatcaagtgaaggaaggaggcggagtttccaagacttgggtgtcatcatttctggggacatccttgattggagattgaagtttttgaaccgaaatttagagctgattcagaagagacaaatacagaacgtccaagttagcagtcatttcccaaatttaggagacaatgatgcaggcccaggaatccctaacactggaggatgtggctgtggacttcacctgggaggagtggcagttcctgagccctgctcagaaggacctgtaccgggacgtgatgttggagaactacagcaacctggtggcagtggggtatcaagccagcaaaccagatgcactctccaaattggaacgaggagaagaaacttgcacaacagaagatgaaatctactctcgaatctgttctgattcaggaggtgcatcaggaggtgcatatgcagaaatcaggaaaattgatgatcctctgcagcatcacttgcaaaatcaaagtattcagaagagtgtgaaacagtgccatgaacagaatatgtttggaaatattgttaatcagaacaaaggtcatttcctgctgaagcaagattgtgatacgtttgacttacatgaaaaacctttaaaatcaaatttaagttttgaaaaccagaaaaggagctctggcctaaagaactctgctgagtttaatagagatgggaaatccctttttcatgctaaccataaacaattttatactgaaatgaagtttcctgcaattgcaaaacctattaataagtcccagttcattaagcaacagagaactcacaacatagagaatgcccatgtatgcagtgaatgtgggaaagccttcctcaagttgtctcagtttattgatcatcagagagttcacactggagaaaaacctcatgtatgcagtatgtgtgggaaagctttctccagaaaatccagactaatggaccatcagagaactcatacagaactgaaacattatgaatgcactgaatgtgacaaaaccttcctcaagaaatcacagctcaatatacatcagaaaactcatatgggagggaaaccttacacatgtagccaatgtgggaaagccttcatcaagaagtgtcggctcatttatcatcaacgaactcatacaggagagaaaccccatggatgcagtgtatgtgggaaggccttctctacaaagttcagtctcactacacatcagaaaactcatacaggagaaaaaccttatatatgtagtgaatgtggaaaaggcttcattgagaagaggcgtcttactgcacatcatcgaactcatactggtgagaaaccctttatatgcaataaatgtgggaaaggcttcaccttgaagaacagtcttatcacacatcagcaaactcatacaggagagaaattatatacatgtagtgaatgtggaaaaggcttttcaatgaagcactgtctcatggtacatcaacgaactcatactggagagaaaccttataaatgcaatgagtgtggaaagggcttcgctttgaagagcccactcatcagacatcagcgaacacatactggagagaaaccctatgtatgcaccgaatgtcgaaaaggtttcaccatgaagagtgacctcattgtacatcagcgaactcatactgcagagaagccatatatatgcaatgattgtggaaaaggcttcactgtgaagagccgccttattgtgcatcagcgaactcatactggagaaaaaccctatgtatgtggtgagtgtggaaaaggctttccagcaaagatccggctaatgggacatcaacgaactcatacaggagagaaaccttatatttgcaatgagtgtggaaaaggcttcactgagaagagtcatctcaatgtacatcggcgcactcatacaggagagaaaccctatgtatgcagtgaatgtggcaaaggcttaactgggaaaagcatgctcattgcacatcagcgaactcatactggggagaaaccttatatatgcaatgaatgtggaaagggcttcaccatgaagagtactctcagtatacatcagcaaactcatactggagagaagccatacaaatgcaatgaatgtgataaaaccttcaggaagaagacatgcctcatacaacatcagcgatttcacacaggaaagacttcctttgcatgtactgaatgtggaaaattctctttgcgcaaaaatgatcttattacacatcagagaattcacacaggagagaaaccgtacaaatgcagtgactgcgggaaagccttcactacaaaatcagggctcaatgttcatcaaagaaaacatacaggagagaggccctatggatgtagtgattgtgggaaagcttttgcgcacttgtctatccttgttaaacacaggagaattcacaggtagtcattttgggaaagcctcttgccagatgtaggcccttaagatatctgcaaagaagagtaatttcatgaatgcagactacatggttgtttatttagtgatcagttacttcatgttttgtgtcagagaaaacatgtacaaaacatttgagaaaatattttaggacattatgtctaaaaattgtatactgagaaaaatcctatgaatgtggcagactataaaagcctttggtgggaagataaaccccctcagaagtgatcatagatcatgaataaactactaattcgtggaaatgtaataattataggaacgtctttgcccaaaaataaaacttcaacagattgagagagttcacactggagaaatactttcctctggcaaacccctgtggcagggttttcagtaaaatgttttgcctcatcgtgtgctaggaaataatgcagaaaaaacttatgaaaacattcaatgtagaagacttttaggaaaatatcagagaatttaatgaaggaaagaagccttggcaaaatgatggatgagagctttctgtcacaattctaaccttaacagataatatgcctcatgtgcatttgggaacaggatagcttgagccatattcctagttgccttgtcactgattttatacattttaaattgtgacttcctctaatcacgaactaaaatttaatattgtatataataccggagtattttatgcctgcctcattttattatatgattagctcctgcatttctttggttctaagtttgtgttatttcagaataactaaagtacttcagaatgaaactggatacagtatattcagttcataagtgtaattgaccatacttgaatatgtttaagtttataagtaacatcaggtgttatgaaattaatataaataagatgtttttgtaagtttttattttgaaataagtttagattcacaaaatcttaccaaaatattccagagttcttgcccttaacccagcttcttccaaagataacaacttacataagcatagttcattaccaaatacaggaaagtgaaattgttacaatactgttaactacagaatttatttggaaatcaccagttttaacatgcatgcatttttgtttgttttttatatgtagctttaagaaatcttaacacatatattgattcatgtcaccaccaccgtaatcgagattcagaatgttgcatcaatgcaaactccctcatgctccttgtttatagtcacaacctctcctcagccctaacccttggcaatcagaaatcttttcatctttagttttgtcattagtagcatgttataaaaatggaatcatacagcatgtacccttttggtattggctatttcaactaaagcagattaacctgaaatccatccaagttgttctgcatatcattgttctgtttttattggccactaataatctatgatacgaatataccactatttgtttattcacccactgaaggacattagttttgttcccggtttttcttactgttacaaataaaaatcctatgaacatttgtacaca

SEQ ID NO: 203221 - DNA, 561 bp, Homo sapiens
  Payload ID: 20074
  Gene Name: zinc finger protein 615
  ENST ID: ENST00000601178
  CDS Start-End: 273-561
gggaacgcctccgaccctggatagtcgccgtcaggcactgaggaggccgagagatgaggccggagcccaccaagttctgggaacccacaggtgctgagaacaagagaaatcaagtgaaggaaggaggcggagtttccaagacttgggtgtcatcatttctggggacatccttgattggagattgaagtttttgaaccgaaatttagagctgattcagaagagacaaatacagaacgtccaagttagcagtcatttcccaaatttaggagacaatgatgcaggcccaggaatccctaacactggaggatgtggctgtggacttcacctgggaggagtggcagttcctgagccctgctcagaaggacctgtaccgggacgtgatgttggagaactacagcaacctggtggcagtggggtatcaagccagcaaaccagatgcactctccaaattggaacgaggagaagaaacttgcacaacagaagatgaaatctactctcgaatctgttctgattcaggaggtgcatcaggagaaatcaggaaaattgatgatcctctgcagc

SEQ ID NO: 203222 - DNA, 581 bp, Homo sapiens
  Payload ID: 20074
  Gene Name: zinc finger protein 615
  ENST ID: ENST00000599631
  CDS Start-End: 558-581
agtcgccgtcaggcactgaggaggccgagagatgaggccggagcccaccaagttctgggaaaatactttgcaagtatcaagatgtggatggcggccgggtgcagtggctcatgcctgtagtcccagcactttgggaggctgagatgggtggatcagttgagctcaggagttcaagaccagcctggccaacatggtgaaaccccgtttctactaaaagtacaaaaattagcagcgcatgtggcgttcacctgtaatcccagcttctcaggcggctgaagcaggagaatcgcttgaacccaggagatggaggttgcagtgaacagagatcacgccactggagtcttactcactccagcctgggcaacagacccacaggtgctgagaacaagagaaatcaagtgaaggaaggaggcggagtttccaagacttgggtgtcatcatttctggggacatccttgattggagattgaagtttttgaaccgaaatttagagctgattcagaagagacaaatacagaacgtccaagttagcagtcatttcccaaatttaggagacaatgatgcaggcccaggaatcccta

SEQ ID NO: 203223 - DNA, 4094 bp, Homo sapiens
  Payload ID: 20074
  Gene Name: zinc finger protein 615
  Uniprot ID: Q8N8J6
  ENST ID: ENST00000602063
  CDS Start-End: 351-2546
gggcgtgttcgtggacagtggtgatggactggtatctgtcggcgccagcgtttggcgacgccagtggaattctttcaggagcttagcgtgggtccgattcctatcgcaggggaactacaagaggttctttctgacacaagtaagataacatctctgccatgcccacaggtgctgagaacaagagaaatcaagtgaaggaaggaggcggagtttccaagacttgggtgtcatcatttctggggacatccttgattggagattgaagtttttgaaccgaaatttagagctgattcagaagagacaaatacagaacgtccaagttagcagtcatttcccaaatttaggagacaatgatgcaggcccaggaatccctaacactggaggatgtggctgtggacttcacctgggaggagtggcagttcctgagccctgctcagaaggacctgtaccgggacgtgatgttggagaactacagcaacctggtggcagtggggtatcaagccagcaaaccagatgcactctccaaattggaacgaggagaagaaacttgcacaacagaagatgaaatctactctcgaatctgttctgaaatcaggaaaattgatgatcctctgcagcatcacttgcaaaatcaaagtattcagaagagtgtgaaacagtgccatgaacagaatatgtttggaaatattgttaatcagaacaaaggtcatttcctgctgaagcaagattgtgatacgtttgacttacatgaaaaacctttaaaatcaaatttaagttttgaaaaccagaaaaggagctctggcctaaagaactctgctgagtttaatagagatgggaaatccctttttcatgctaaccataaacaattttatactgaaatgaagtttcctgcaattgcaaaacctattaataagtcccagttcattaagcaacagagaactcacaacatagagaatgcccatgtatgcagtgaatgtgggaaagccttcctcaagttgtctcagtttattgatcatcagagagttcacactggagaaaaacctcatgtatgcagtatgtgtgggaaagctttctccagaaaatccagactaatggaccatcagagaactcatacagaactgaaacattatgaatgcactgaatgtgacaaaaccttcctcaagaaatcacagctcaatatacatcagaaaactcatatgggagggaaaccttacacatgtagccaatgtgggaaagccttcatcaagaagtgtcggctcatttatcatcaacgaactcatacaggagagaaaccccatggatgcagtgtatgtgggaaggccttctctacaaagttcagtctcactacacatcagaaaactcatacaggagaaaaaccttatatatgtagtgaatgtggaaaaggcttcattgagaagaggcgtcttactgcacatcatcgaactcatactggtgagaaaccctttatatgcaataaatgtgggaaaggcttcaccttgaagaacagtcttatcacacatcagcaaactcatacaggagagaaattatatacatgtagtgaatgtggaaaaggcttttcaatgaagcactgtctcatggtacatcaacgaactcatactggagagaaaccttataaatgcaatgagtgtggaaagggcttcgctttgaagagcccactcatcagacatcagcgaacacatactggagagaaaccctatgtatgcaccgaatgtcgaaaaggtttcaccatgaagagtgacctcattgtacatcagcgaactcatactgcagagaagccatatatatgcaatgattgtggaaaaggcttcactgtgaagagccgccttattgtgcatcagcgaactcatactggagaaaaaccctatgtatgtggtgagtgtggaaaaggctttccagcaaagatccggctaatgggacatcaacgaactcatacaggagagaaaccttatatttgcaatgagtgtggaaaaggcttcactgagaagagtcatctcaatgtacatcggcgcactcatacaggagagaaaccctatgtatgcagtgaatgtggcaaaggcttaactgggaaaagcatgctcattgcacatcagcgaactcatactggggagaaaccttatatatgcaatgaatgtggaaagggcttcaccatgaagagtactctcagtatacatcagcaaactcatactggagagaagccatacaaatgcaatgaatgtgataaaaccttcaggaagaagacatgcctcatacaacatcagcgatttcacacaggaaagacttcctttgcatgtactgaatgtggaaaattctctttgcgcaaaaatgatcttattacacatcagagaattcacacaggagagaaaccgtacaaatgcagtgactgcgggaaagccttcactacaaaatcagggctcaatgttcatcaaagaaaacatacaggagagaggccctatggatgtagtgattgtgggaaagcttttgcgcacttgtctatccttgttaaacacaggagaattcacaggtagtcattttgggaaagcctcttgccagatgtaggcccttaagatatctgcaaagaagagtaatttcatgaatgcagactacatggttgtttatttagtgatcagttacttcatgttttgtgtcagagaaaacatgtacaaaacatttgagaaaatattttaggacattatgtctaaaaattgtatactgagaaaaatcctatgaatgtggcagactataaaagcctttggtgggaagataaaccccctcagaagtgatcatagatcatgaataaactactaattcgtggaaatgtaataattataggaacgtctttgcccaaaaataaaacttcaacagattgagagagttcacactggagaaatactttcctctggcaaacccctgtggcagggttttcagtaaaatgttttgcctcatcgtgtgctaggaaataatgcagaaaaaacttatgaaaacattcaatgtagaagacttttaggaaaatatcagagaatttaatgaaggaaagaagccttggcaaaatgatggatgagagctttctgtcacaattctaaccttaacagataatatgcctcatgtgcatttgggaacaggatagcttgagccatattcctagttgccttgtcactgattttatacattttaaattgtgacttcctctaatcacgaactaaaatttaatattgtatataataccggagtattttatgcctgcctcattttattatatgattagctcctgcatttctttggttctaagtttgtgttatttcagaataactaaagtacttcagaatgaaactggatacagtatattcagttcataagtgtaattgaccatacttgaatatgtttaagtttataagtaacatcaggtgttatgaaattaatataaataagatgtttttgtaagtttttattttgaaataagtttagattcacaaaatcttaccaaaatattccagagttcttgcccttaacccagcttcttccaaagataacaacttacataagcatagttcattaccaaatacaggaaagtgaaattgttacaatactgttaactacagaatttatttggaaatcaccagttttaacatgcatgcatttttgtttgttttttatatgtagctttaagaaatcttaacacatatattgattcatgtcaccaccaccgtaatcgagattcagaatgttgcatcaatgcaaactccctcatgctccttgtttatagtcacaacctctcctcagccctaacccttggcaatcagaaatcttttcatctttagttttgtcattagtagcatgttataaaaatggaatcatacagcatgtacccttttggtattggctatttcaactaaagcagattaacctgaaatccatccaagttgttctgcatatcattgttctgtttttattggccactaataatctatgatacgaatataccactatttgtttattcacccactgaaggacattagttttgttcccggtttttcttactgttacaaataaaaatcctatgaacatttgtacacaca

SEQ ID NO: 203224 - DNA, 2229 bp, Homo sapiens
  Payload ID: 20074
  Gene Name: zinc finger protein 615
  Uniprot ID: Q8N8J6
  ENST ID: ENST00000618487
  CDS Start-End: 1-2229
atgatgcaggcccaggaatccctaacactggaggatgtggctgtggacttcacctgggaggagtggcagttcctgagccctgctcagaaggacctgtaccgggacgtgatgttggagaactacagcaacctggtggcagtggggtatcaagccagcaaaccagatgcactctccaaattggaacgaggagaagaaacttgcacaacagaagatgaaatctactctcgaatctgttctgattcaggaggtgcatcaggaggtgcatatgcagaaatcaggaaaattgatgatcctctgcagcatcacttgcaaaatcaaagtattcagaagagtgtgaaacagtgccatgaacagaatatgtttggaaatattgttaatcagaacaaaggtcatttcctgctgaagcaagattgtgatacgtttgacttacatgaaaaacctttaaaatcaaatttaagttttgaaaaccagaaaaggagctctggcctaaagaactctgctgagtttaatagagatgggaaatccctttttcatgctaaccataaacaattttatactgaaatgaagtttcctgcaattgcaaaacctattaataagtcccagttcattaagcaacagagaactcacaacatagagaatgcccatgtatgcagtgaatgtgggaaagccttcctcaagttgtctcagtttattgatcatcagagagttcacactggagaaaaacctcatgtatgcagtatgtgtgggaaagctttctccagaaaatccagactaatggaccatcagagaactcatacagaactgaaacattatgaatgcactgaatgtgacaaaaccttcctcaagaaatcacagctcaatatacatcagaaaactcatatgggagggaaaccttacacatgtagccaatgtgggaaagccttcatcaagaagtgtcggctcatttatcatcaacgaactcatacaggagagaaaccccatggatgcagtgtatgtgggaaggccttctctacaaagttcagtctcactacacatcagaaaactcatacaggagaaaaaccttatatatgtagtgaatgtggaaaaggcttcattgagaagaggcgtcttactgcacatcatcgaactcatactggtgagaaaccctttatatgcaataaatgtgggaaaggcttcaccttgaagaacagtcttatcacacatcagcaaactcatacaggagagaaattatatacatgtagtgaatgtggaaaaggcttttcaatgaagcactgtctcatggtacatcaacgaactcatactggagagaaaccttataaatgcaatgagtgtggaaagggcttcgctttgaagagcccactcatcagacatcagcgaacacatactggagagaaaccctatgtatgcaccgaatgtcgaaaaggtttcaccatgaagagtgacctcattgtacatcagcgaactcatactgcagagaagccatatatatgcaatgattgtggaaaaggcttcactgtgaagagccgccttattgtgcatcagcgaactcatactggagaaaaaccctatgtatgtggtgagtgtggaaaaggctttccagcaaagatccggctaatgggacatcaacgaactcatacaggagagaaaccttatatttgcaatgagtgtggaaaaggcttcactgagaagagtcatctcaatgtacatcggcgcactcatacaggagagaaaccctatgtatgcagtgaatgtggcaaaggcttaactgggaaaagcatgctcattgcacatcagcgaactcatactggggagaaaccttatatatgcaatgaatgtggaaagggcttcaccatgaagagtactctcagtatacatcagcaaactcatactggagagaagccatacaaatgcaatgaatgtgataaaaccttcaggaagaagacatgcctcatacaacatcagcgatttcacacaggaaagacttcctttgcatgtactgaatgtggaaaattctctttgcgcaaaaatgatcttattacacatcagagaattcacacaggagagaaaccgtacaaatgcagtgactgcgggaaagccttcactacaaaatcagggctcaatgttcatcaaagaaaacatacaggagagaggccctatggatgtagtgattgtgggaaagcttttgcgcacttgtctatccttgttaaacacaggagaattcacaggtag

SEQ ID NO: 203225 - DNA, 2284 bp, Homo sapiens
  Payload ID: 20074
  Gene Name: zinc finger protein 615
  ENST ID: ENST00000618049
  CDS Start-End: 39-2261
cgtccaagttagcagtcatttcccaaatttaggagacaatgatgcaggcccaggaatccctaacactggaggatgtggctgtggacttcacctgggaggagtggcagttcctgagccctgctcagaaggacctgtaccgggacgtgatgttggagaactacagcaacctggtggcagtggggtatcaagccagcaaaccagatgcactctccaaattggaacgaggagaagaaacttgcacaacagaagatgaaatctactctcgaatctgttctggtagaggagcaccaggtggacagccagaaatcaggaaaattgatgatcctctgcagcatcacttgcaaaatcaaagtattcagaagagtgtgaaacagtgccatgaacagaatatgtttggaaatattgttaatcagaacaaaggtcatttcctgctgaagcaagattgtgatacgtttgacttacatgaaaaacctttaaaatcaaatttaagttttgaaaaccagaaaaggagctctggcctaaagaactctgctgagtttaatagagatgggaaatccctttttcatgctaaccataaacaattttatactgaaatgaagtttcctgcaattgcaaaacctattaataagtcccagttcattaagcaacagagaactcacaacatagagaatgcccatgtatgcagtgaatgtgggaaagccttcctcaagttgtctcagtttattgatcatcagagagttcacactggagaaaaacctcatgtatgcagtatgtgtgggaaagctttctccagaaaatccagactaatggaccatcagagaactcatacagaactgaaacattatgaatgcactgaatgtgacaaaaccttcctcaagaaatcacagctcaatatacatcagaaaactcatatgggagggaaaccttacacatgtagccaatgtgggaaagccttcatcaagaagtgtcggctcatttatcatcaacgaactcatacaggagagaaaccccatggatgcagtgtatgtgggaaggccttctctacaaagttcagtctcactacacatcagaaaactcatacaggagaaaaaccttatatatgtagtgaatgtggaaaaggcttcattgagaagaggcgtcttactgcacatcatcgaactcatactggtgagaaaccctttatatgcaataaatgtgggaaaggcttcaccttgaagaacagtcttatcacacatcagcaaactcatacaggagagaaattatatacatgtagtgaatgtggaaaaggcttttcaatgaagcactgtctcatggtacatcaacgaactcatactggagagaaaccttataaatgcaatgagtgtggaaagggcttcgctttgaagagcccactcatcagacatcagcgaacacatactggagagaaaccctatgtatgcaccgaatgtcgaaaaggtttcaccatgaagagtgacctcattgtacatcagcgaactcatactgcagagaagccatatatatgcaatgattgtggaaaaggcttcactgtgaagagccgccttattgtgcatcagcgaactcatactggagaaaaaccctatgtatgtggtgagtgtggaaaaggctttccagcaaagatccggctaatgggacatcaacgaactcatacaggagagaaaccttatatttgcaatgagtgtggaaaaggcttcactgagaagagtcatctcaatgtacatcggcgcactcatacaggagagaaaccctatgtatgcagtgaatgtggcaaaggcttaactgggaaaagcatgctcattgcacatcagcgaactcatactggggagaaaccttatatatgcaatgaatgtggaaagggcttcaccatgaagagtactctcagtatacatcagcaaactcatactggagagaagccatacaaatgcaatgaatgtgataaaaccttcaggaagaagacatgcctcatacaacatcagcgatttcacacaggaaagacttcctttgcatgtactgaatgtggaaaattctctttgcgcaaaaatgatcttattacacatcagagaattcacacaggagagaaaccgtacaaatgcagtgactgcgggaaagccttcactacaaaatcagggctcaatgttcatcaaagaaaacatacaggagagaggccctatggatgtagtgattgtgggaaagcttttgcgcacttgtctatccttgttaaacacaggagaattcacaggtagtcattttgggaaagcctcttgcc

SEQ ID NO: 203226 - DNA, 2563 bp, Homo sapiens
  Payload ID: 20075
  Gene Name: zinc finger protein 616
  ENST ID: ENST00000330123
  CDS Start-End: 92-316
ggcacttctccccacgtttgatgtgtgaataattacattgactgagaaagaaacccagaagaggaagaagaggaaggaaaaggagtcagtgatggctactcaggggcatttgacattcaaggatgtagccatagaattctctcaggaggagtggaaatgcctggagcctgtgcagaaagctttgtacaaggatgtgatgttggagaactataggaacctggtcttcctaggctggagaataatggcgcgatctcacctcactgcaacctccgtctcccaggttcaagcgattctcctgcctcagcctcctgagtagctgggattacaggtatctctcctaaatgtgtgatcaaggaattaccaccaacagagaacagtaatacaggagaaaggttccaaacagtggcactggaaagacatcaaagctatgatattgaaaatttatacttcagggaaatacagaaacatctacatgaccttgaatttcaatggaaagatggtgaaacaaatgataaagaagtgccagtgccccatgaaaacaatcttactggtaaaagagatcaacatagtcaaggggatgtagaaaacaatcatattgaaaaccagcttacatcaaactttgagtcacgtctggctgaactgcagaaagttcaaactgaagggagactttatgaatgtaatgaaacggagaagacaggtaataatggttgtttagtttctccacacattagggaaaaaacgtatgtatgtaatgaatgtggcaaagcctttaaagcgtcttccagccttattaatcatcagaggatacatactacagagaaaccttacaaatgcaatgagtgtggcaaagcctttcatcgggcctcactactaactgtacacaaggtagtccatacaagagggaaatcatatcaatgtgatgtatgtggcaagatcttcagaaaaaattcatattttgtaagacaccaaaggagtcacactggacagaaaccctacatatgtaatgaatgtggcaagtcctttagtaaaagttcccaccttgcagttcatcagagaattcataccggtgaaaaaccttacaaatgtaatctgtgtgggaaatcctttagtcagcgtgtccatcttagacttcatcagacagttcatactggagagagacccttcaaatgtaatgagtgtggcaaaacctttaaacggagctcaaacctcactgtacatcaggtaatccatgcaggaaagaaaccatataaatgtgatgtatgtggcaaggcattcagacatagatcaaatcttgtatgtcaccggagaatccacagtggagagaaacaatacaaatgcaatgaatgtggcaaggtcttcagtaaacgttcaagtcttgcagtgcatcgacgaattcacactgtagagaaaccttgcaaatgcaatgaatgtggcaaggtcttcagtaaacgttcaagtcttgcagtgcatcagagaattcatactggacagaaaacttacaaatgcaataaatgtggcaaggtgtacagtaagcattcacatcttgcagtgcattggagaattcataccggcgagaaagcttataaatgcaatgaatgtggcaaagttttcagcatacattcacgacttgcagctcatcagagaattcatactggagagaaaccttacaaatgcaatgaatgtggcaaggtcttcagtcaacattcacgtcttgcagtgcatcggagaattcatactggagagaaaccttacaaatgcaaagaatgtggcaaggtcttcagtgaccgttcagcttttgcaaggcatcggagaattcatactggagagaagccttacaaatgcaaagaatgtggcaaggtcttcagtcaatgttcacgtcttacagtgcatcggagaattcatagtggagagaaaccttacaaatgcaatgaatgcggcaaggtctacagtcagtattcacatcttgtagggcatcgaagagttcatactggagagaaaccatacaaatgtcatgaatgtggcaaagcctttaatcagggctccacactcaatagacatcagagaattcataccggagagaaaccttacaaatgcaatcagtgtgggaattcctttagtcagcgtgtccatcttagacttcatcagactgttcatactggagacagaccttacaaatgtaatgagtgtggcaaaacctttaaacggagctcaaacctcactgcacatcagataattcatgcaggaaagaaaccatataaatgtgatgaatgtggcaaggtattcaggcatagttcacatcttgtaagtcaccagagaatccacactggagagaaaagatacaaatgtattgaatgtggcaaagcctttgggcggttgttttccctcagcaaacaccaaagaattcattctggcaaaaaaccttataaatgtaatgagtgtgggaaatcttttatttgtcgctcaggcctcactaaacatcgaataagacatactggagagagccttacaactaaactcaatgtgacaaggccttagacgttgtcctagtttctggaatcaccga

SEQ ID NO: 203227 - DNA, 556 bp, Homo sapiens
  Payload ID: 20075
  Gene Name: zinc finger protein 616
  ENST ID: ENST00000600282
  CDS Start-End: 439-556
agagggagaaccacagcaaggaggaagcctaggaagttgggggtgctagagagtgggaacaaaggagatgtaacagggaaaagggaatttaacagggaagagggattttaacagggagagcagacagggagctcagatgggggaaaagaggcaggaatacgtggcggctggggacaatgggaaagtttggggagaaagagcaacaagaggtgaaataaatttcgaagcattgggcagaatagacataaaagagggaataaagaaaggggagaaaaacagcaaagggaaaaaagacgtgcagaatgagagcgggaaacacatagtagtgaagagagtgggcgaggaccccacccagatgagctgtttgatgtgtgaataattacattgactgagaaagaaacccagaagaggaagaagaggaaggaaaaggagtcagtgatggctactcaggggcatttgacattcaaggatgtagccatagaattctctcaggaggagtggaaatgcctggagcctgtgcagaaagctttgtacaaggatgtgatgttggagaact

SEQ ID NO: 203228 - DNA, 568 bp, Homo sapiens
  Payload ID: 20075
  Gene Name: zinc finger protein 616
  ENST ID: ENST00000596290
  CDS Start-End: 268-477
tgcgccagggaaaggccttatcgctgtgtgtgtgtttcagtctacgtggattaaacattacttcgctccgtctgcctggattaaacgtgcactttgcagtcctcacttctccgtaccagtgatctggggatcgctacggaccttaaaatacccatagccccttcgcccctgcaacaggcacttctccccacgtttgatgtgtgaataattacattgactgagaaagaaacccagaagaggaagaagaggaaggaaaaggagtcagtgatggctactcaggggcatttgacattcaaggatgtagccatagaattctctcaggaggagtggaaatgcctggagcctgtgcagaaagctttgtacaaggatgtgatgttggagaactataggaacctggtcttcctaggctggagaataatggcgcgatctcacctcactgcaacctccgtctcccaggtatctctcctaaatgtgtgatcaaggaattaccaccaacagagaacagtaatacaggagaaaggttccaaacagtggcactggaaagacatcaaagctatgatattgaaaa

SEQ ID NO: 203229 - DNA, 4335 bp, Homo sapiens
  Payload ID: 20075
  Gene Name: zinc finger protein 616
  Uniprot ID: Q08AN1
  ENST ID: ENST00000600228
  CDS Start-End: 263-2608
cagggaaaggccttatcgctgtgtgtgtgtttcagtctacgtggattaaacattacttcgctccgtctgcctggattaaacgtgcactttgcagtcctcacttctccgtaccagtgatctggggatcgctacggaccttaaaatacccatagccccttcgcccctgcaacaggcacttctccccacgtttgatgtgtgaataattacattgactgagaaagaaacccagaagaggaagaagaggaaggaaaaggagtcagtgatggctactcaggggcatttgacattcaaggatgtagccatagaattctctcaggaggagtggaaatgcctggagcctgtgcagaaagctttgtacaaggatgtgatgttggagaactataggaacctggtcttcctaggtatctctcctaaatgtgtgatcaaggaattaccaccaacagagaacagtaatacaggagaaaggttccaaacagtggcactggaaagacatcaaagctatgatattgaaaatttatacttcagggaaatacagaaacatctacatgaccttgaatttcaatggaaagatggtgaaacaaatgataaagaagtgccagtgccccatgaaaacaatcttactggtaaaagagatcaacatagtcaaggggatgtagaaaacaatcatattgaaaaccagcttacatcaaactttgagtcacgtctggctgaactgcagaaagttcaaactgaagggagactttatgaatgtaatgaaacggagaagacaggtaataatggttgtttagtttctccacacattagggaaaaaacgtatgtatgtaatgaatgtggcaaagcctttaaagcgtcttccagccttattaatcatcagaggatacatactacagagaaaccttacaaatgcaatgagtgtggcaaagcctttcatcgggcctcactactaactgtacacaaggtagtccatacaagagggaaatcatatcaatgtgatgtatgtggcaagatcttcagaaaaaattcatattttgtaagacaccaaaggagtcacactggacagaaaccctacatatgtaatgaatgtggcaagtcctttagtaaaagttcccaccttgcagttcatcagagaattcataccggtgaaaaaccttacaaatgtaatctgtgtgggaaatcctttagtcagcgtgtccatcttagacttcatcagacagttcatactggagagagacccttcaaatgtaatgagtgtggcaaaacctttaaacggagctcaaacctcactgtacatcaggtaatccatgcaggaaagaaaccatataaatgtgatgtatgtggcaaggcattcagacatagatcaaatcttgtatgtcaccggagaatccacagtggagagaaacaatacaaatgcaatgaatgtggcaaggtcttcagtaaacgttcaagtcttgcagtgcatcgacgaattcacactgtagagaaaccttgcaaatgcaatgaatgtggcaaggtcttcagtaaacgttcaagtcttgcagtgcatcagagaattcatactggacagaaaacttacaaatgcaataaatgtggcaaggtgtacagtaagcattcacatcttgcagtgcattggagaattcataccggcgagaaagcttataaatgcaatgaatgtggcaaagttttcagcatacattcacgacttgcagctcatcagagaattcatactggagagaaaccttacaaatgcaatgaatgtggcaaggtcttcagtcaacattcacgtcttgcagtgcatcggagaattcatactggagagaaaccttacaaatgcaaagaatgtggcaaggtcttcagtgaccgttcagcttttgcaaggcatcggagaattcatactggagagaagccttacaaatgcaaagaatgtggcaaggtcttcagtcaatgttcacgtcttacagtgcatcggagaattcatagtggagagaaaccttacaaatgcaatgaatgcggcaaggtctacagtcagtattcacatcttgtagggcatcgaagagttcatactggagagaaaccatacaaatgtcatgaatgtggcaaagcctttaatcagggctccacactcaatagacatcagagaattcataccggagagaaaccttacaaatgcaatcagtgtgggaattcctttagtcagcgtgtccatcttagacttcatcagactgttcatactggagacagaccttacaaatgtaatgagtgtggcaaaacctttaaacggagctcaaacctcactgcacatcagataattcatgcaggaaagaaaccatataaatgtgatgaatgtggcaaggtattcaggcatagttcacatcttgtaagtcaccagagaatccacactggagagaaaagatacaaatgtattgaatgtggcaaagcctttgggcggttgttttccctcagcaaacaccaaagaattcattctggcaaaaaaccttataaatgtaatgagtgtgggaaatcttttatttgtcgctcaggcctcactaaacatcgaataagacatactggagagagccttacaactaaactcaatgtgacaaggccttagacgttgtcctagtttctggaatcaccgaataattcctacttactgatataccttgtatatttaccccttctcttgaaatccctgtggaattgtaatctccagtattggaggtggggcccattgggaggtgattgaatcatggaagtggatttctcaaactgagaaagatgtagcgtcatccccttggtgctgtcctggcaatagtgacttctcttgaggtctggctgtttagaagtgcatagcacttccctgtcgcttgccctcattctcaccatgtgaaataccgacacccgctttgccttccaccatgattttaaccttcctgaggcttccctagagggtgatcagatgccagcaccatgttttcatttaagccttcagaaatatgagccaattaaactcttttctttatacattagccagcctcaggtttttttttgtagcaatgcagttatgacctaatacatttacacatgcagtaaatatacctaagttttaagctagtattcactactcactaggtgtaagaatttgtatatatattccaggatgtatacatcctggagaaaaatcacagaagtgtaatacgtgtggcaagaattctactcaaaagccagaacttgtaaatctaggtaattaaaagggcatagatgtatgaaatgaaatgagggtggcaaaacctttactagagttcaatcactacttgtcataagagagtttatactgaaaggaaatcatataaatgtatgtgtcagaggctttccccaggcattggaactcactaggcatcagaatatacatctttgagaggaaccacagaaatgtaatgtgcatgctaaggtttttacccgaacatcaaaatggaaagagtattcatactagagacaaccttccaaataaatggttttaaaaaatgaaatgttcaaagacctggaatcaacccaaatgcttatcagtgatagactgaataaagaaaatgtggtacatatacaccatgggatactatgcagccatagaaaggaatgagatcatgtccattgcagcgatgtggatggagctggaagccattatcctcaggaaactaacacaggaacagaaaatcaaacagcacatgttctcacttaaaagtggaagctgaacaatgagaacacatatacccagggaggggagcaacacacactggggcctgctgatgggggtgggaagggcagggaagtggagcatcaggacaaatagctaatgcatttttgccttaataccaggtgatgggttggtagatgcagcaaaccaccatggcacacattttcctatgtaacaaatttgcaaattgtgcacatgtacccagaacttaaagtgagacaaaaccaatgtccacgcctttgcagtttgattgaacgtataaaggagaaaaatcctgtaagtatgctgaacatgaaaggacctggaagcagtagtgtgtcttcagcctttaccaaattatccctacttgagagaaaacttggaaatgtaatcaatgtggcacaaatttcaaccagttttttaaacagactacacatctttgaaatcatactagggataaccaaatctgcttctccaagattggcctggaatattattacagaataactaccagacaacatttgttaaaactcaggacagtatgtattttaaaggagcaagtgcatgtgtgaaaatggctcattcagtttataaaatattacattaaa

SEQ ID NO: 203230 - DNA, 577 bp, Homo sapiens
  Payload ID: 20075
  Gene Name: zinc finger protein 616
  ENST ID: ENST00000597013
  CDS Start-End: 250-474
tatcgctgtgtgtgtgtttcagtctacgtggattaaacattacttcgctccgtctgcctggattaaacgtgcactttgcagtcctcacttctccgtaccagtgatctggggatcgctacggaccttaaaatacccatagccccttcgcccctgcaacaggcacttctccccacgtttgatgtgtgaataattacattgactgagaaagaaacccagaagaggaagaagaggaaggaaaaggagtcagtgatggctactcaggggcatttgacattcaaggatgtagccatagaattctctcaggaggagtggaaatgcctggagcctgtgcagaaagctttgtacaaggatgtgatgttggagaactataggaacctggtcttcctaggctggagaataatggcgcgatctcacctcactgcaacctccgtctcccaggttcaagcgattctcctgcctcagcctcctgagtagctgggattacaggcatgtgccaccacacctggctaattttgtatttttagtagagatggggtttctccatattggtcaggctgatcttgaactcccgacctca

SEQ ID NO: 203231 - DNA, 9109 bp, Homo sapiens
  Payload ID: 20076
  Gene Name: zinc finger protein 618
  Uniprot ID: Q5T7W0
  ENST ID: ENST00000288466
  CDS Start-End: 100-2685
ggcggcggcggcggcggcggcggcggcattgtgcgcgcaccagcagcccggcccgggaggagcaggacgcgccggggccgcctcctcccgcacggacccatgaaccagccgggcggcgcggcggctccgcaggctgacggagccagtgcagccggaaggaaaagcactgcgagcagggagcgcttgaagcgcagccagaagagcaccaaggtggagggcccagagccagtgccagccgaggcctcgctgagtgccgagcaaggaacgatgacggaggtgaaggtgaagacagagctgcccgatgactacatccaggaggtgatctggcagggcgaggccaaggaggagaagaaggcggtcagcaaggatgggaccagcgacgtgcctgccgagatctgcgtggtgatcggcggcgtccgcaaccagcagacccttgggtcttacgaatgcggaatctgtggcaagaagtacaagtattacaactgcttccagacccacgtgcgggcgcaccgagacaccgaagccacctcaggggagggagcctcccaaagcaacaatttcaggtacacatgtgatatctgcgggaagaagtacaaatactacagctgtttccaagagcaccgagacctgcacgcagtggatgtgtttagtgtggaaggggcccctgagaaccgggcagaccccttcgaccaaggtgtcgtggccacggacgaggtgaaggaggagcccccggagccattccagaaaatcgggccaatgaacaatattacatcagacatttttaagaagaaagaagttaggcagtgccaaaagagagaaactggcaattacacctgtgaattctgcggcaaacagtacaagtactacactccctaccaggagcatgtggccttacacgcccccatcaaaagcgctttcagtcggagagtagaaggcaaagcacaaaaccactttgaagagacgaacagcagttcgcagaactccagcgaaccctacacctgcggcgcctgtgggatccagttccagttctacaacaacctgttggagcacatgcagtcccatgcagctgacaatgaaaacaacattgcctccaaccagtcccgatcgccacctgctgttgtagaagagaagtggaaacctcaggcccagaggaacagtgccaataacaccactaccagtggtttaacacccaacagcatgatccccgaaaaggagcggcagaacatcgcagagcggctgttgagggtcatgtgtgccgacctgggtgcactgagcgtggtcagcgggaaggagttcctgaagttggcccagaccttagtagacagtggtgcccgctatggggccttctcggtcactgaaatcctgggcaacttcaacacgctggcgctgaagcacctgccacgcatgtacaaccaggtgaaggtgaaagtgacctgtgccttgggcagcaatgcctgcctaggcatcggtgtcacctgccactcccagagtgttggccctgactcctgctacatcctcacagcctaccaggccgagggcaaccacatcaagagctatgtgcttggtgtgaagggtgcggacattcgcgacagcggtgaccttgtgcaccactgggtgcagaacgtgctgtcggagttcgtgatgtcggagatcaggacagtgtacgtgacggattgccgggtgagcacgtccgccttctccaaggccggcatgtgccttcgctgctcagcctgtgccttgaactcggtggtgcagagcgtgctgagcaagcggacactgcaggcccgcagcatgcacgaggtcatcgagctgctcaacgtgtgcgaggacctggcgggctccacgggcctggccaaggagaccttcgggtcgctggaggagacgtctccaccaccctgctggaactcggtgacggactcactgttgctggtgcatgagcgctatgagcagatctgcgagttctacagccgggccaagaagatgaacctcatccagagcctcaacaagcacctgctcagcaacctggcggccatcctgacgccggtgaagcaggcagtcatcgagctgagcaacgagagccagcccaccctgcagctggtgctgcccacctacgtcaggctggagaagctgttcacggccaaggccaacgacgcaggcactgtcagcaagctctgccacctcttcctggaggcgctcaaggagaacttcaaggtgcacccggcccacaaggtggccatgatcctggacccgcagcagaagctgcggcctgtgccaccctaccagcacgaggagatcatcggcaaggtctgtgagctcatcaacgaggtgaaggagtcctgggccgaggaggccgacttcgagcccgctgccaagaagccccgctctgctgccgtcgagaaccccgcagctcaggaagatgatcggctaggcaaaaatgaagtgtacgattacctgcaggagcccctcttccaggctacccctgatctcttccagtactggtcgtgcgttacccaaaagcacacaaaactcgccaagctcgccttctggctcctggcggttccggccgtgggcgccagaagcgggtgtgtaaatatgtgtgaacaagcgcttctaatcaaacggaggcggctgctcagtccagaagatatgaataaactcatgtttctgaaatccaacatgctttaagacttgacttcgggggaaaaaaaaagaaaaagagaagataacattagaaaaaaaccacacaacactgtcacaaagaaaaggaatttaagttctaaacactgtggacctcattataaatgccccctggaaacttaagtgctttttttatatgtgtgtgtgtgcgtgtatgtacacagccacacgtgtgtgcacgtgtctgaacacgtgctgtggttgtgggggtgtgggggggtctctgtgctcatctccatggccagagaaactttgcacacacgcacacacacacacacacacacacacacacacacgaccctggtgcgtgtacatacgcctgtgcttggacgggtgtgcattgaactgggcgtgtcaggaaagctgagcgattgggaaagagggagatgtttcacctccttttctcagtaagggggctttagaagactccgctttcaggtgtgcagattggcagaaagctgatgttgtgaaatgttcaggcagctgagatctgaagtgacttgacgctctctgtccttcaccccggtcctccttttccctctttgaccctcttccagccctcctaccctcctgatcccattgtgcacccccccacacactcggctgctctgctgtggactctccacactgcatcagatggacggtttctgcactggactttgtttcttgttcaccttcagggcattgagctgctgcctttgagataccccttgggtgtcccggggcagccgccttagaaacacacctatctatctccccaaatcaggaaaggagacttaaagagtataaagctgacattttgctttttaatataagagaggagaaaaagacatttttcagagaagtatagatactgtctccactccctaataatttctctccctaacattttagcaatttttaccttgtttgggggttcattttgtttcttcagatttgatttagactctgctaggaggcactgaatgtctataacttatgttttggagttttgtttttttacttgccccttttgttcctcaagtcacactgtaaactagctcatctctgtggtgtactcagtatcctacagtctttcttggccttccctgtacagttcagttttcacatattcgaacggccaagaccaggttcttggctgtgctatttggagaccaggcgttggggaggattcacgggttccacagctgcggggtttggtggccgtaggggaagcagtggtttgggagttctgaatgtaagcgccagagctgccctcctggtccgctgtgcgtggtacccagtgtgcatcacactactcaccccctcccggaccctggcagtccacagcgactccgaagtcagcccatagtcacatccaccacacctcagacctgccacagcctctcctcacttcccaggaccctgaggcttccaggagctctgctgcccacagccctcggggtcctcactcacacctccgacttccaggacggcagtgagcatggtgccttgtggccccaacagttgatgttccgagggtgggatggtgtttggccatgttcgactcgatgctgtgaaagatgtcttcaggcttttctctcctgttcccccagctgtgagcaaattaggttctacacacacagttcggatgccaagggtgacaccccattcccttcacaagaggcggttctgtcacaaatcagcactccacccccaccacacctctcagtgaatgaagtgctggtggtctcactcccctggtgacccttagccgtgggatggggtggttacactaaggcttcaagctgagaatggccatcatggcgggaggctgtttgcaaaggcaccttctgtcatcctggggttggctaagtcaactccaccccttcccaataataaagcatcactcaactgtgagatacctcgactacaaaaagcactgtaccacagccctctccccctgggtccatgacaggagcagggagtaaagttgattgcaaacctcatgaaggcttaggatcatggacctggaacatagtgtttgggggccaagcctgcacactttgcctcatgagaactcacccagctctccccttgaaacttggacacactgaaatggatcaaagtgggccatttccacatttgctccagcaaactgtggtctcaggaactaccatgccatttcctctcctggagaagttctaggtattacctccacaacatttccaactgggggactgagcccacttatcagagaagagccgccatccacactggagcaggaacagggagaaatccagacaggaacctcatgtcacttcctagggaatatgggaagaaacatcagcagactttatgatgtcagttgggcctttggaggcattctggaaggtggcctcagcatcactgatgattgacagatgctacagcaaaaggtccctctagcgttgcttgactgctggggaagggacagtgaccggcactttgacccacacaaggataggagctgcctactttgtgtggtaggtgagagcagagcctgggagcccatcctccctctacttggagcaaagttgtgctggtgatgccccattattgggccagttgattagaaaataggcatttcactttcttggaaagccatcggactaagcccagatgtgcatttagagcactcagcattcttctctttgaagcatgggatgtctgtcctccaggaagagatttgatcttaggttgttacctccctttcacttcttttccacctcaattcaatacttaggggttggcttgcctctgcaggtttgatgtgaatgccactgggtactcagaaagctgtcctctggggctgccttgtccagttagataacaagatagcagatgattgtttcttgcaacctctggttccctccggaaactggtgtcaccaacaggaaaggctgtaccaaggtgccctcttctcagacaggctgttctcagagtgcaaatcctgctgcaactaacagcttaataaaacccaaagatctcacaggtccagccactggcccctttatctccaacaatatccacctcaccaaattctagttcagccaaaggattgagacaggctcttccagttcatctcctggtgtccagcctgaccttcacatctggaaggattttgtcgtctgcctcccagttctgggtccactgtaggtctttccatcacaagcctttgggggatctgggaccaggaatttgggccgtttctaccatattctcagcagcctaaggtggtggcctgctgatgtggagactactcaccttgagccatgtggtccccaggacagaaatggcctttgttttgacatacatggacccaaaaggggaggtgaagaaaacacacctccacctggcaagtttttctccctcatctgaggtcagttgcttcaccaacaaagcccaagccaagaactgcagcgttgagggttgtccctcggagtggagtagcccaaggaatctcaggtccaccaagagcattggtaccatctgggccacgggtggatgcctttgttctggcacagttctccacttcccgattcctggctcagccagccaggcctccctctaatggcatttagtaaccaggaaacaaaacacatgccacctgagcaaaactgcctgcacttcatctctggaggttcgctgcacagaggccacctgccgcatcaccagtgaggaagctttgccaccatcctgcttggcagcttcacacttgacatctgaggattggtttttggctggaaaaagggtaccagggtttcctggcaaggacaggagagcagtgcagtgacacagatgagaagctgtgagtctccaggattcaaggaagccaccaggtgtgcaggctgggaagagacatctctttcagtttgaccctttatctcctgcacttttaaagaaacaccagagaaaaaatctacaaggcgtgtttccactgaagctgaacctctgcctttaggagtcccctatatttgagcaaggccacctgcttcccctggacttgagctggactccttgaagagtgggcttctggagagatgttaggaatatagcacatgctctctgggggccacagggtcattgggaaggtttgaaatgaagatgggatgtggctggaacagcctgtgagatggctccattggggacactcccctcatcttgtcatcacgatggatatgctggaagaggaggtgtcccagtgagccgcccgaagttcatagctttgccctcgccttggcaacagcggcaatgcctctatctctgggatgcatcttaaggagggctcctaacaaggccgatgatttagacagaacaagagactaagtaaggtccggctatcccgtggagccagtagtaggtgggagctcctgtccccgccagccctgctccagcccccgtgtccagctgggccagtggaagaactgggaaggaggaagcccctccctttcactgtggctaatgtttgctaggccagttatggtgaaccaatgatacagtgttttccctcttaacgttcccctcctggttttgccttttcagggttttctgggggattttgttgtagtagttgcttttcttcctctctcatttgggtttgaggattgtggtcgggggagccctggctttcaccaaaggagcccagtggtttctgtggaagaggcgcccactcccactttaatgagggtgaagattgtcaggtcactgtttgacatattcatgccccgtcccttccccccccacccccccgcccacccaccacgggtgtcgctttaaagagtcaattcttgtacagagaaggatttgctaggtttgcatttgggtgttagcatcacgacccacgagggccctgcccaaccgtgcgtcccatggggcaccttgactcttcaaaccaaaattccttaaaggggcacagcccagccttgtccgcaacctcaggggcctgggattcctgtggcgcttcctgaattccaggttggcacagatgatgaggtctgagaccagccggaaggaggggctcctgccataacccaggtgccagccggtctccgcctaggaccttccctcccgcccagccagggtgggcggcatcctacgcggtgaaacgagctcatggactgacccggggctgggcctcgccagccaggagagagcgagggccgcacggcagggctggcccaggcagctcgtccagggccattcagatcccaagcatcaggaaatcattttgtacaaccacccgaagcagagatattttttaagaagcgtaaattattttcagttgttttctgatcctgcctttttcttttccccacaacttcacgccagtgagtcgttcacatcaggtaaatcttgagaaagccttggtgccctcctccccaccccccactcagtaaccacgtgcgtgcacccccgcatcctttctcagtagttaagacgttctaggcaataccatagacacatctgactgtgtctctctctttgagtgcaagaaactcaagtcatcttaaaaaaaaaaaaatacaaaaaaaatttacaaaaaaacaaacacaaaaaaaatatcttttttaggccagagttttctacaggtattaatgaatatttttcttaatccttataagttttatgtgtttaatatttcttaataccggtagcattaatttatacttttgtagcaacacaatatttttataaacagccggtgcttggctcaagtcttcacgaggggtttaggcagggccatcttggggaccctgtgtaccatgtactgtatttaaaaaaaaaaaaagttacctattgtcacacttgctgtgttaattaacaaaagatgttgtgtgcggtctcctgtatcggtgtggatccaacagctctccagggagtcacattgcatgggggttgagttgacggttcttgtgatatgtaaacccccgagaccaaacttgagggtttatttagggttttctgtttgtcctttgggtttttgtttcactttgttttggtgccgtttctccatttacagccaaatcagtttcatgatgttcaaaacatttactgatgtcaaatggaggaaaggaacagaaaaaaagatttttacaaagtaataaaatttaaaactgagctgtttaatgttgctgtttttacctgtctgttcttgtccaaaagtggaacattcccagggagaagaggaaggttccactcggttctttaagtcgccaaaagccccagcccgggattcagtacctcccctgccccccgaattcttgcagcactatttcccagttggttgatgccaaggcaaaaagataacttttaacagttagagaggatcagttgcttaaatgatttcatgtcagtgttgtatttatggttttacaataaaacaacctttagg

SEQ ID NO: 203232 - DNA, 1156 bp, Homo sapiens
  Payload ID: 20076
  Gene Name: zinc finger protein 618
  ENST ID: ENST00000374124
  CDS Start-End: 32-1156
gcgccggggccgcctcctcccgcacggacccatgaaccagccgggcggcgcggcggctccgcaggctgacggagccagtgcagccggaaggaaaagcactgcgagcagggagcgcttgaagcgcagccagaagagcaccaaggtggagggcccagagccagtgccagccgaggcctcgctgagtgccgagcaaggaacgatgacggaggtgaaggtgaagacagagctgcccgatgactacatccaggaggtgatctggcagggcgaggccaaggaggagaagaaggcggtcagcaaggatgggaccagcgacgtgcctgccgagatctgcgtggtgatcggcggcgtccgcaaccagcagacccttgggtcttacgaatgcggaatctgtggcaagaagtacaagtattacaactgcttccagacccacgtgcgggcgcaccgagacaccgaagccacctcaggggagggagcctcccaaagcaacaatttcaggtacacatgtgatatctgcgggaagaagtacaaatactacagctgtttccaagagcaccgagacctgcacgcagtggatgtgtttagtgtggaaggggcccctgagaaccgggcagaccccttcgaccaaggtgtcgtggccacggacgaggtgaaggaggagcccccggagccattccagaaaatcgggccaatgaacaatattacatcagacatttttaagaagaaagaagttaggcagtgccaaaagagagaaactggcaattacacctgtgaattctgcggcaaacagtacaagtactacactccctaccaggagcatgtggccttacacgcccccatcagtactgcccccgggtgggagccaccggatgatccagacacgggctctgagtgttcacatccagaggtctccccatctccacgcttcgtggcagcgaagacccagacgaaccagtcggggaaaaaagctccggcctccgtggtccgatgtgccaccctcttacaccgcacccctccagccacccaaacccagacgttccgcactccaaattcgggatctccggcgagcaaggcaaccgcagaaagcgctttcagtcggagagtagaaggcaaagcacaaaaccactttgaagagacgaacagcagttcgcagaactcc

SEQ ID NO: 203233 - DNA, 3018 bp, Homo sapiens
  Payload ID: 20076
  Gene Name: zinc finger protein 618
  Uniprot ID: Q5T7W0
  ENST ID: ENST00000374126
  CDS Start-End: 100-2964
ggcggcggcggcggcggcggcggcggcattgtgcgcgcaccagcagcccggcccgggaggagcaggacgcgccggggccgcctcctcccgcacggacccatgaaccagccgggcggcgcggcggctccgcaggctgacggagccagtgcagccggaaggaaaagcactgcgagcagggagcgcttgaagcgcagccagaagagcaccaaggtggagggcccagagccagtgccagccgaggcctcgctgagtgccgagcaaggaacgatgacggaggtgaaggtgaagacagagctgcccgatgactacatccaggaggtgatctggcagggcgaggccaaggaggagaagaaggcggtcagcaaggatgggaccagcgacgtgcctgccgagatctgcgtggtgatcggcggcgtccgcaaccagcagacccttgatggaaaagcgcccgaaggcagcccccacggtggatctgtgcgaagccggtattcagggacctggatttttgaccaagcattgagatatgcatctgggtcttacgaatgcggaatctgtggcaagaagtacaagtattacaactgcttccagacccacgtgcgggcgcaccgagacaccgaagccacctcaggggagggagcctcccaaagcaacaatttcaggtacacatgtgatatctgcgggaagaagtacaaatactacagctgtttccaagagcaccgagacctgcacgcagtggatgtgtttagtgtggaaggggcccctgagaaccgggcagaccccttcgaccaaggtgtcgtggccacggacgaggtgaaggaggagcccccggagccattccagaaaatcgggccaaaaactggcaattacacctgtgaattctgcggcaaacagtacaagtactacactccctaccaggagcatgtggccttacacgcccccatcagtactgcccccgggtgggagccaccggatgatccagacacgggctctgagtgttcacatccagaggtctccccatctccacgcttcgtggcagcgaagacccagacgaaccagtcggggaaaaaagctccggcctccgtggtccgatgtgccaccctcttacaccgcacccctccagccacccaaacccagacgttccgcactccaaattcgggatctccggcgagcaaggcaaccgcagcagaaagcgctttcagtcggagagtagaaggcaaagcacaaaaccactttgaagagacgaacagcagttcgcagaactccagcgaaccctacacctgcggcgcctgtgggatccagttccagttctacaacaacctgttggagcacatgcagtcccatgcagctgacaatgaaaacaacattgcctccaaccagtcccgatcgccacctgctgttgtagaagagaagtggaaacctcaggcccagaggaacagtgccaataacaccactaccagtggtttaacacccaacagcatgatccccgaaaaggagcggcagaacatcgcagagcggctgttgagggtcatgtgtgccgacctgggtgcactgagcgtggtcagcgggaaggagttcctgaagttggcccagaccttagtagacagtggtgcccgctatggggccttctcggtcactgaaatcctgggcaacttcaacacgctggcgctgaagcacctgccacgcatgtacaaccaggtgaaggtgaaagtgacctgtgccttgggcagcaatgcctgcctaggcatcggtgtcacctgccactcccagagtgttggccctgactcctgctacatcctcacagcctaccaggccgagggcaaccacatcaagagctatgtgcttggtgtgaagggtgcggacattcgcgacagcggtgaccttgtgcaccactgggtgcagaacgtgctgtcggagttcgtgatgtcggagatcaggacagtgtacgtgacggattgccgggtgagcacgtccgccttctccaaggccggcatgtgccttcgctgctcagcctgtgccttgaactcggtggtgcagagcgtgctgagcaagcggacactgcaggcccgcagcatgcacgaggtcatcgagctgctcaacgtgtgcgaggacctggcgggctccacgggcctggccaaggagaccttcgggtcgctggaggagacgtctccaccaccctgctggaactcggtgacggactcactgttgctggtgcatgagcgctatgagcagatctgcgagttctacagccgggccaagaagatgaacctcatccagagcctcaacaagcacctgctcagcaacctggcggccatcctgacgccggtgaagcaggcagtcatcgagctgagcaacgagagccagcccaccctgcagctggtgctgcccacctacgtcaggctggagaagctgttcacggccaaggccaacgacgcaggcactgtcagcaagctctgccacctcttcctggaggcgctcaaggagaacttcaaggtgcacccggcccacaaggtggccatgatcctggacccgcagcagaagctgcggcctgtgccaccctaccagcacgaggagatcatcggcaaggtctgtgagctcatcaacgaggtgaaggagtcctgggccgaggaggccgacttcgagcccgctgccaagaagccccgctctgctgccgtcgagaaccccgcagctcaggaagatgatcggctaggcaaaaatgaagtgtacgattacctgcaggagcccctcttccaggctacccctgatctcttccagtactggtcgtgcgttacccaaaagcacacaaaactcgccaagctcgccttctggctcctggcggttccggccgtgggcgccagaagcgggtgtgtaaatatgtgtgaacaagcgcttctaatcaaacggaggcggctgctcagtccagaagatatgaataaactcatgtttctgaaatccaacatgctttaagacttgacttcgggggaaaaaaaaagaaaaagagaagataacattagaaaaaaa

SEQ ID NO: 203234 - DNA, 942 bp, Homo sapiens
  Payload ID: 20076
  Gene Name: zinc finger protein 618
  ENST ID: ENST00000452710
  CDS Start-End: 32-942
gcgccggggccgcctcctcccgcacggacccatgaaccagccgggcggcgcggcggctccgcaggctgacggagccagtgcagccggaaggaaaagcactgcgagcagggagcgcttgaagcgcagccagaagagcaccaaggtggagggcccagagccagtgccagccgaggcctcgctgagtgccgagcaaggaacgatgacggaggtgaaggtgaagacagagctgcccgatgactacatccaggaggtgatctggcagggcgaggccaaggaggagaagaaggcggtcagcaaggatgggaccagcgacgtgcctgccgagatctgcgtggtgatcggcggcgtccgcaaccagcagacccttgggtcttacgaatgcggaatctgtggcaagaagtacaagtattacaactgcttccagacccacgtgcgggcgcaccgagacaccgaagccacctcaggggagggagcctcccaaagcaacaatttcaggtacacatgtgatatctgcgggaagaagtacaaatactacagctgtttccaagagcaccgagacctgcacgcagtggatgaccccttcgaccaaggtgtcgtggccacggacgaggtgaaggaggagcccccggagccattccagaaaatcgggccaatgaacaatattacatcagacatttttaagaagaaagaagttaggcagtgccaaaagagagaaactggcaattacacctgtgaattctgcggcaaacagtacaagtactacactccctaccaggagcatgtggccttacacgcccccatcaccacccaaacccagacgttccgcactccaaattcgggatctccggcgagcaaggcaaccgcagaaagcgctttcagtcggagagtagaaggcaaagcacaaaaccactttgaagagacgaacagcagttcgcagaactc

SEQ ID NO: 203235 - DNA, 9289 bp, Homo sapiens
  Payload ID: 20076
  Gene Name: zinc finger protein 618
  Uniprot ID: Q5T7W0
  ENST ID: ENST00000615615
  CDS Start-End: 100-2865
ggcggcggcggcggcggcggcggcggcattgtgcgcgcaccagcagcccggcccgggaggagcaggacgcgccggggccgcctcctcccgcacggacccatgaaccagccgggcggcgcggcggctccgcaggctgacggagccagtgcagccggaaggaaaagcactgcgagcagggagcgcttgaagcgcagccagaagagcaccaaggtggagggcccagagccagtgccagccgaggcctcgctgagtgccgagcaaggaacgatgacggaggtgaaggtgaagacagagctgcccgatgactacatccaggaggtgatctggcagggcgaggccaaggaggagaagaaggcggtcagcaaggatgggaccagcgacgtgcctgccgagatctgcgtggtgatcggcggcgtccgcaaccagcagacccttgggtcttacgaatgcggaatctgtggcaagaagtacaagtattacaactgcttccagacccacgtgcgggcgcaccgagacaccgaagccacctcaggggagggagcctcccaaagcaacaatttcaggtacacatgtgatatctgcgggaagaagtacaaatactacagctgtttccaagagcaccgagacctgcacgcagtggatgtgtttagtgtggaaggggcccctgagaaccgggcagaccccttcgaccaaggtgtcgtggccacggacgaggtgaaggaggagcccccggagccattccagaaaatcgggccaaaaactggcaattacacctgtgaattctgcggcaaacagtacaagtactacactccctaccaggagcatgtggccttacacgcccccatcagtactgcccccgggtgggagccaccggatgatccagacacgggctctgagtgttcacatccagaggtctccccatctccacgcttcgtggcagcgaagacccagacgaaccagtcggggaaaaaagctccggcctccgtggtccgatgtgccaccctcttacaccgcacccctccagccacccaaacccagacgttccgcactccaaattcgggatctccggcgagcaaggcaaccgcagaaagcgctttcagtcggagagtagaaggcaaagcacaaaaccactttgaagagacgaacagcagttcgcagaactccagcgaaccctacacctgcggcgcctgtgggatccagttccagttctacaacaacctgttggagcacatgcagtcccatgcagctgacaatgaaaacaacattgcctccaaccagtcccgatcgccacctgctgttgtagaagagaagtggaaacctcaggcccagaggaacagtgccaataacaccactaccagtggtttaacacccaacagcatgatccccgaaaaggagcggcagaacatcgcagagcggctgttgagggtcatgtgtgccgacctgggtgcactgagcgtggtcagcgggaaggagttcctgaagttggcccagaccttagtagacagtggtgcccgctatggggccttctcggtcactgaaatcctgggcaacttcaacacgctggcgctgaagcacctgccacgcatgtacaaccaggtgaaggtgaaagtgacctgtgccttgggcagcaatgcctgcctaggcatcggtgtcacctgccactcccagagtgttggccctgactcctgctacatcctcacagcctaccaggccgagggcaaccacatcaagagctatgtgcttggtgtgaagggtgcggacattcgcgacagcggtgaccttgtgcaccactgggtgcagaacgtgctgtcggagttcgtgatgtcggagatcaggacagtgtacgtgacggattgccgggtgagcacgtccgccttctccaaggccggcatgtgccttcgctgctcagcctgtgccttgaactcggtggtgcagagcgtgctgagcaagcggacactgcaggcccgcagcatgcacgaggtcatcgagctgctcaacgtgtgcgaggacctggcgggctccacgggcctggccaaggagaccttcgggtcgctggaggagacgtctccaccaccctgctggaactcggtgacggactcactgttgctggtgcatgagcgctatgagcagatctgcgagttctacagccgggccaagaagatgaacctcatccagagcctcaacaagcacctgctcagcaacctggcggccatcctgacgccggtgaagcaggcagtcatcgagctgagcaacgagagccagcccaccctgcagctggtgctgcccacctacgtcaggctggagaagctgttcacggccaaggccaacgacgcaggcactgtcagcaagctctgccacctcttcctggaggcgctcaaggagaacttcaaggtgcacccggcccacaaggtggccatgatcctggacccgcagcagaagctgcggcctgtgccaccctaccagcacgaggagatcatcggcaaggtctgtgagctcatcaacgaggtgaaggagtcctgggccgaggaggccgacttcgagcccgctgccaagaagccccgctctgctgccgtcgagaaccccgcagctcaggaagatgatcggctaggcaaaaatgaagtgtacgattacctgcaggagcccctcttccaggctacccctgatctcttccagtactggtcgtgcgttacccaaaagcacacaaaactcgccaagctcgccttctggctcctggcggttccggccgtgggcgccagaagcgggtgtgtaaatatgtgtgaacaagcgcttctaatcaaacggaggcggctgctcagtccagaagatatgaataaactcatgtttctgaaatccaacatgctttaagacttgacttcgggggaaaaaaaaagaaaaagagaagataacattagaaaaaaaccacacaacactgtcacaaagaaaaggaatttaagttctaaacactgtggacctcattataaatgccccctggaaacttaagtgctttttttatatgtgtgtgtgtgcgtgtatgtacacagccacacgtgtgtgcacgtgtctgaacacgtgctgtggttgtgggggtgtgggggggtctctgtgctcatctccatggccagagaaactttgcacacacgcacacacacacacacacacacacacacacacacgaccctggtgcgtgtacatacgcctgtgcttggacgggtgtgcattgaactgggcgtgtcaggaaagctgagcgattgggaaagagggagatgtttcacctccttttctcagtaagggggctttagaagactccgctttcaggtgtgcagattggcagaaagctgatgttgtgaaatgttcaggcagctgagatctgaagtgacttgacgctctctgtccttcaccccggtcctccttttccctctttgaccctcttccagccctcctaccctcctgatcccattgtgcacccccccacacactcggctgctctgctgtggactctccacactgcatcagatggacggtttctgcactggactttgtttcttgttcaccttcagggcattgagctgctgcctttgagataccccttgggtgtcccggggcagccgccttagaaacacacctatctatctccccaaatcaggaaaggagacttaaagagtataaagctgacattttgctttttaatataagagaggagaaaaagacatttttcagagaagtatagatactgtctccactccctaataatttctctccctaacattttagcaatttttaccttgtttgggggttcattttgtttcttcagatttgatttagactctgctaggaggcactgaatgtctataacttatgttttggagttttgtttttttacttgccccttttgttcctcaagtcacactgtaaactagctcatctctgtggtgtactcagtatcctacagtctttcttggccttccctgtacagttcagttttcacatattcgaacggccaagaccaggttcttggctgtgctatttggagaccaggcgttggggaggattcacgggttccacagctgcggggtttggtggccgtaggggaagcagtggtttgggagttctgaatgtaagcgccagagctgccctcctggtccgctgtgcgtggtacccagtgtgcatcacactactcaccccctcccggaccctggcagtccacagcgactccgaagtcagcccatagtcacatccaccacacctcagacctgccacagcctctcctcacttcccaggaccctgaggcttccaggagctctgctgcccacagccctcggggtcctcactcacacctccgacttccaggacggcagtgagcatggtgccttgtggccccaacagttgatgttccgagggtgggatggtgtttggccatgttcgactcgatgctgtgaaagatgtcttcaggcttttctctcctgttcccccagctgtgagcaaattaggttctacacacacagttcggatgccaagggtgacaccccattcccttcacaagaggcggttctgtcacaaatcagcactccacccccaccacacctctcagtgaatgaagtgctggtggtctcactcccctggtgacccttagccgtgggatggggtggttacactaaggcttcaagctgagaatggccatcatggcgggaggctgtttgcaaaggcaccttctgtcatcctggggttggctaagtcaactccaccccttcccaataataaagcatcactcaactgtgagatacctcgactacaaaaagcactgtaccacagccctctccccctgggtccatgacaggagcagggagtaaagttgattgcaaacctcatgaaggcttaggatcatggacctggaacatagtgtttgggggccaagcctgcacactttgcctcatgagaactcacccagctctccccttgaaacttggacacactgaaatggatcaaagtgggccatttccacatttgctccagcaaactgtggtctcaggaactaccatgccatttcctctcctggagaagttctaggtattacctccacaacatttccaactgggggactgagcccacttatcagagaagagccgccatccacactggagcaggaacagggagaaatccagacaggaacctcatgtcacttcctagggaatatgggaagaaacatcagcagactttatgatgtcagttgggcctttggaggcattctggaaggtggcctcagcatcactgatgattgacagatgctacagcaaaaggtccctctagcgttgcttgactgctggggaagggacagtgaccggcactttgacccacacaaggataggagctgcctactttgtgtggtaggtgagagcagagcctgggagcccatcctccctctacttggagcaaagttgtgctggtgatgccccattattgggccagttgattagaaaataggcatttcactttcttggaaagccatcggactaagcccagatgtgcatttagagcactcagcattcttctctttgaagcatgggatgtctgtcctccaggaagagatttgatcttaggttgttacctccctttcacttcttttccacctcaattcaatacttaggggttggcttgcctctgcaggtttgatgtgaatgccactgggtactcagaaagctgtcctctggggctgccttgtccagttagataacaagatagcagatgattgtttcttgcaacctctggttccctccggaaactggtgtcaccaacaggaaaggctgtaccaaggtgccctcttctcagacaggctgttctcagagtgcaaatcctgctgcaactaacagcttaataaaacccaaagatctcacaggtccagccactggcccctttatctccaacaatatccacctcaccaaattctagttcagccaaaggattgagacaggctcttccagttcatctcctggtgtccagcctgaccttcacatctggaaggattttgtcgtctgcctcccagttctgggtccactgtaggtctttccatcacaagcctttgggggatctgggaccaggaatttgggccgtttctaccatattctcagcagcctaaggtggtggcctgctgatgtggagactactcaccttgagccatgtggtccccaggacagaaatggcctttgttttgacatacatggacccaaaaggggaggtgaagaaaacacacctccacctggcaagtttttctccctcatctgaggtcagttgcttcaccaacaaagcccaagccaagaactgcagcgttgagggttgtccctcggagtggagtagcccaaggaatctcaggtccaccaagagcattggtaccatctgggccacgggtggatgcctttgttctggcacagttctccacttcccgattcctggctcagccagccaggcctccctctaatggcatttagtaaccaggaaacaaaacacatgccacctgagcaaaactgcctgcacttcatctctggaggttcgctgcacagaggccacctgccgcatcaccagtgaggaagctttgccaccatcctgcttggcagcttcacacttgacatctgaggattggtttttggctggaaaaagggtaccagggtttcctggcaaggacaggagagcagtgcagtgacacagatgagaagctgtgagtctccaggattcaaggaagccaccaggtgtgcaggctgggaagagacatctctttcagtttgaccctttatctcctgcacttttaaagaaacaccagagaaaaaatctacaaggcgtgtttccactgaagctgaacctctgcctttaggagtcccctatatttgagcaaggccacctgcttcccctggacttgagctggactccttgaagagtgggcttctggagagatgttaggaatatagcacatgctctctgggggccacagggtcattgggaaggtttgaaatgaagatgggatgtggctggaacagcctgtgagatggctccattggggacactcccctcatcttgtcatcacgatggatatgctggaagaggaggtgtcccagtgagccgcccgaagttcatagctttgccctcgccttggcaacagcggcaatgcctctatctctgggatgcatcttaaggagggctcctaacaaggccgatgatttagacagaacaagagactaagtaaggtccggctatcccgtggagccagtagtaggtgggagctcctgtccccgccagccctgctccagcccccgtgtccagctgggccagtggaagaactgggaaggaggaagcccctccctttcactgtggctaatgtttgctaggccagttatggtgaaccaatgatacagtgttttccctcttaacgttcccctcctggttttgccttttcagggttttctgggggattttgttgtagtagttgcttttcttcctctctcatttgggtttgaggattgtggtcgggggagccctggctttcaccaaaggagcccagtggtttctgtggaagaggcgcccactcccactttaatgagggtgaagattgtcaggtcactgtttgacatattcatgccccgtcccttccccccccacccccccgcccacccaccacgggtgtcgctttaaagagtcaattcttgtacagagaaggatttgctaggtttgcatttgggtgttagcatcacgacccacgagggccctgcccaaccgtgcgtcccatggggcaccttgactcttcaaaccaaaattccttaaaggggcacagcccagccttgtccgcaacctcaggggcctgggattcctgtggcgcttcctgaattccaggttggcacagatgatgaggtctgagaccagccggaaggaggggctcctgccataacccaggtgccagccggtctccgcctaggaccttccctcccgcccagccagggtgggcggcatcctacgcggtgaaacgagctcatggactgacccggggctgggcctcgccagccaggagagagcgagggccgcacggcagggctggcccaggcagctcgtccagggccattcagatcccaagcatcaggaaatcattttgtacaaccacccgaagcagagatattttttaagaagcgtaaattattttcagttgttttctgatcctgcctttttcttttccccacaacttcacgccagtgagtcgttcacatcaggtaaatcttgagaaagccttggtgccctcctccccaccccccactcagtaaccacgtgcgtgcacccccgcatcctttctcagtagttaagacgttctaggcaataccatagacacatctgactgtgtctctctctttgagtgcaagaaactcaagtcatcttaaaaaaaaaaaaatacaaaaaaaatttacaaaaaaacaaacacaaaaaaaatatcttttttaggccagagttttctacaggtattaatgaatatttttcttaatccttataagttttatgtgtttaatatttcttaataccggtagcattaatttatacttttgtagcaacacaatatttttataaacagccggtgcttggctcaagtcttcacgaggggtttaggcagggccatcttggggaccctgtgtaccatgtactgtatttaaaaaaaaaaaaagttacctattgtcacacttgctgtgttaattaacaaaagatgttgtgtgcggtctcctgtatcggtgtggatccaacagctctccagggagtcacattgcatgggggttgagttgacggttcttgtgatatgtaaacccccgagaccaaacttgagggtttatttagggttttctgtttgtcctttgggtttttgtttcactttgttttggtgccgtttctccatttacagccaaatcagtttcatgatgttcaaaacatttactgatgtcaaatggaggaaaggaacagaaaaaaagatttttacaaagtaataaaatttaaaactgagctgtttaatgttgctgtttttacctgtctgttcttgtccaaaagtggaacattcccagggagaagaggaaggttccactcggttctttaagtcgccaaaagccccagcccgggattcagtacctcccctgccccccgaattcttgcagcactatttcccagttggttgatgccaaggcaaaaagataacttttaacagttagagaggatcagttgcttaaatgatttcatgtcagtgttgtatttatggttttacaataaaacaacctttagg

SEQ ID NO: 203236 - DNA, 2233 bp, Homo sapiens
  Payload ID: 20077
  Gene Name: zinc finger protein 619
  Uniprot ID: Q8N2I2
  ENST ID: ENST00000314686
  CDS Start-End: 406-2088
agagaggctgtagggaccgacggccggccagctaatgcttccgtcttggccaccttgcgagcgctcgggttgagtttcccgggcttccctgactcggctacctgttctggaggtcaggctttgggcccttgcagaggtcgccgaggggcccgcgccgccgccagagcctgggcccagtccccagtcttcagagacgccctcgaccttcctgctccgaggagctggcctgatgtcctcgggtcgcgctccgcaggttcttactttttcaaacctagagggcagtgcatgaagccaggggtcatcagccatgctccagacagtgtggttccagggcttgggcaggaacctgttgtttcaggagccagtaacctttgaggatgtggctgtgtacttcacccagaatgaatgggccagcctgcaccctacgcagagggccctatacagggaggtgatgctggagaattatgcaaatgtgacttccttgtcagcatttccattccccaaaccagatctgatattccagctggagcaaggagaagcagcatggggcccagatccctggacacttgctgggggagaggccctgagaggcatgtgcacaggctggagtgcaatggcgtgatcttcactcaccgcaacctctgccttccaggtggtaaaaccaagactgagaatgaggaaaaaactgcacagctaaacatttctaaagaatcagagtcccacagactgatagtggagggactgctgatggacgttccccagcaccctgacttcaaggacaggttagagaagtcacagctacatgatacagggaataaaacaaagataggggattgcacagatttgacagtccaggatcatgaatcttccaccactgaaagggaggagatagccaggaaattggaagaaagtagtgtcagcacacatctcattacaaagcagggttttgccaaagaacaggtgttttataaatgtggtgagtgtggcagttactacaacccacattcagactttcacctgcatcagagagttcacactaatgagaagccctacacatgcaaagaatgtgggaaaaccttcagatataactcaaaactgtcacggcatcagaaaatccacactggagagaaaccatactcatgtgaggaatgtggacaagccttcagtcaaaattcccaccttcttcagcatcagaagctccatggtggacagaggccctatgaatgtactgactgtggtaaaaccttcagttataattcaaaactgattcggcatcagagaatccatactggggagaagccctttaaatgtaaggaatgtgggaaagccttcagttgtagctatgactgcatcatccatgaacgaattcacaatggggagaagccctatgaatgtaaggagtgtgggaagagtttgagttctaattcagttctgattcagcatcagagaatccacactggggagaaaccttatgaatgtaaagagtgtggcaaggccttccaccgcagttcggtatttcttcagcaccagaggttccacactggggaacaactctacaaatgtaatgaatgttggaaaactttcagctgtagctcccgcttcatagtgcatcagagaatccacaatggggagaaaccctatgaatgccaggaatgtgggaagacattcagtcaaaagatcactctggttcagcatcagcgagttcacactggggagaaaccttatgagtgtaaggagtgcgggaaagccttcagatggaatgcaagtttcatccagcatcagaagtggcatactaggaagaaactcatcaatggaacagggctatccgcagttaagccctactgtccctgcgccatcctctctcctctgcctccccaacatacctgctctgccctagccccaccagggcctcccttatcttcttcacatgcagtggtacttcctccctctgtgcctttcttcctgctgcttccctcatctgaaaaggccaacccttcacctgtccaaatagcacatttttttcaggatctcgcttttcctgggaagtcatcccttcagagcccgaatcctttgtctcactccctgtaagccccgtcacgttctcaaaatcctttgcacctcaagttagggattccactggtctcctgattgtgtctattgatattcctctggtcttgtcttgtataagttgttactgttttcctaacttcattttaaattctcacgcttaagg

SEQ ID NO: 203237 - DNA, 1749 bp, Homo sapiens
  Payload ID: 20077
  Gene Name: zinc finger protein 619
  Uniprot ID: Q8N2I2
  ENST ID: ENST00000432264
  CDS Start-End: 1-1731
atgctccagacagtgtggttccagggcttgggcaggaacctgttgtttcaggagccagtaacctttgaggatgtggctgtgtacttcacccagaatgaatgggccagcctgcaccctacgcagagggccctatacagggaggtgatgctggagaattatgcaaatgtgacttccttgtcagcatttccattccccaaaccagatctgatattccagctggagcaaggagaagcagcatggggcccagatccctggacacttgctgggggagaggccctgagaggcatgtgcacaggtggtaaaaccaagactgagaatgaggaaaaaactgcacagctaaacatttctaaagaatcagagtcccacagactgatagtggagggactgctgatggacgttccccagcaccctgacttcaaggacaggttagagaagtcacagctacatgatacagggaataaaacaaagataggggattgcacagatttgacagtccaggatcatgaatcttccaccactgaaagggaggagatagccaggaaattggaagaaagtagtgtcagcacacatctcattacaaagcagggttttgccaaagaacaggtgttttataaatgtggtgagtgtggcagttactacaacccacattcagactttcacctgcatcagagagttcacactaatgagaagccctacacatgcaaagaatgtgggaaaaccttcagatataactcaaaactgtcacggcatcagaaaatccacactggagagaaaccatactcatgtgaggaatgtggacaagccttcagtcaaaattcccaccttcttcagcatcagaagctccatggtggacagaggccctatgaatgtactgactgtggtaaaaccttcagttataattcaaaactgattcggcatcagagaatccatactggggagaagccctttaaatgtaaggaatgtgggaaagccttcagttgtagctatgactgcatcatccatgaacgaattcacaatggggagaagccctatgaatgtaaggagtgtgggaagagtttgagttctaattcagttctgattcagcatcagagaatccacactggggagaaaccttatgaatgtaaagagtgtggcaaggccttccaccgcagttcggtatttcttcagcaccagaggttccacactggggaacaactctacaaatgtaatgaatgttggaaaactttcagctgtagctcccgcttcatagtgcatcagagaatccacaatggggagaaaccctatgaatgccaggaatgtgggaagacattcagtcaaaagatcactctggttcagcatcagcgagttcacactggggagaaaccttatgagtgtaaggagtgcgggaaagccttcagatggaatgcaagtttcatccagcatcagaagtggcatactaggaagaaactcatcaatggaacagggctatccgcagttaagccctactgtccctgcgccatcctctctcctctgcctccccaacatacctgctctgccctagccccaccagggcctcccttatcttcttcacatgcagtggtacttcctccctctgtgcctttcttcctgctgcttccctcatctgaaaaggccaacccttcacctgtccaaatagcacatttttttcaggatctcgcttttcctgggaagtcatcccttcagagcccgaatcctttgtctcactccctgtaagccccgtcacgttctcaa

SEQ ID NO: 203238 - DNA, 2192 bp, Homo sapiens
  Payload ID: 20077
  Gene Name: zinc finger protein 619
  Uniprot ID: Q8N2I2
  ENST ID: ENST00000456778
  CDS Start-End: 257-1855
agctaatgcttccgtcttggccaccttgcgagcgctcgggttgagtttcccgggcttccctgactcggctacctgttctggaggtcaggctttgggcccttgcagaggtcgccgaggggcccgcgccgccgccagagcctgggcccagtccccagtcttcagagacgccctcgaccttcctgctccgaggagctggcctgatgtcctcgggtcgcgctccgcaggttcttactttttcaaacctagagggcagtgcatgaagccaggggtcatcagccatgctccagacagtgtggttccagcagcatttccattccccaaaccagatctgatattccagctggagcaaggagaagcagcatggggcccagatccctggacacttgctgggggagaggccctgagaggcatgtgcacaggtggtaaaaccaagactgagaatgaggaaaaaactgcacagctaaacatttctaaagaatcagagtcccacagactgatagtggagggactgctgatggacgttccccagcaccctgacttcaaggacaggttagagaagtcacagctacatgatacagggaataaaacaaagataggggattgcacagatttgacagtccaggatcatgaatcttccaccactgaaagggaggagatagccaggaaattggaagaaagtagtgtcagcacacatctcattacaaagcagggttttgccaaagaacaggtgttttataaatgtggtgagtgtggcagttactacaacccacattcagactttcacctgcatcagagagttcacactaatgagaagccctacacatgcaaagaatgtgggaaaaccttcagatataactcaaaactgtcacggcatcagaaaatccacactggagagaaaccatactcatgtgaggaatgtggacaagccttcagtcaaaattcccaccttcttcagcatcagaagctccatggtggacagaggccctatgaatgtactgactgtggtaaaaccttcagttataattcaaaactgattcggcatcagagaatccatactggggagaagccctttaaatgtaaggaatgtgggaaagccttcagttgtagctatgactgcatcatccatgaacgaattcacaatggggagaagccctatgaatgtaaggagtgtgggaagagtttgagttctaattcagttctgattcagcatcagagaatccacactggggagaaaccttatgaatgtaaagagtgtggcaaggccttccaccgcagttcggtatttcttcagcaccagaggttccacactggggaacaactctacaaatgtaatgaatgttggaaaactttcagctgtagctcccgcttcatagtgcatcagagaatccacaatggggagaaaccctatgaatgccaggaatgtgggaagacattcagtcaaaagatcactctggttcagcatcagcgagttcacactggggagaaaccttatgagtgtaaggagtgcgggaaagccttcagatggaatgcaagtttcatccagcatcagaagtggcatactaggaagaaactcatcaatggaacagggctatccgcagttaagccctactgtccctgcgccatcctctctcctctgcctccccaacatacctgctctgccctagccccaccagggcctcccttatcttcttcacatgcagtggtacttcctccctctgtgcctttcttcctgctgcttccctcatctgaaaaggccaacccttcacctgtccaaatagcacatttttttcaggatctcgcttttcctgggaagtcatcccttcagagcccgaatcctttgtctcactccctgtaagccccgtcacgttctcaaaatcctttgcacctcaagttagggattccactggtctcctgattgtgtctattgatattcctctggtcttgtcttgtataagttgttactgttttcctaacttcattttaaattctcacgcttaaggaccatgtttgattagtttcttttatcccccggtaggaaatggcagtacttattctttatcgtgtccacatttgggctgtattatcagtctgcatctctcttctggggctactggagttggaagagtttgcagaacattttggggtttagggcatatggcattatgattatgatgagatggggcattataatt

SEQ ID NO: 203239 - DNA, 4104 bp, Homo sapiens
  Payload ID: 20077
  Gene Name: zinc finger protein 619
  ENST ID: ENST00000429348
  CDS Start-End: 406-2109
agagaggctgtagggaccgacggccggccagctaatgcttccgtcttggccaccttgcgagcgctcgggttgagtttcccgggcttccctgactcggctacctgttctggaggtcaggctttgggcccttgcagaggtcgccgaggggcccgcgccgccgccagagcctgggcccagtccccagtcttcagagacgccctcgaccttcctgctccgaggagctggcctgatgtcctcgggtcgcgctccgcaggttcttactttttcaaacctagagggcagtgcatgaagccaggggtcatcagccatgctccagacagtgtggttccagggcttgggcaggaacctgttgtttcaggagccagtaacctttgaggatgtggctgtgtacttcacccagaatgaatgggccagcctgcaccctacgcagagggccctatacagggaggtgatgctggagaattatgcaaatgtgacttccttgtcagcatttccattccccaaaccagatctgatattccagctggagcaaggagaagcagcatggggcccagatccctggacacttgctgggggagaggccctgagaggcatgtgcacagagtttcacttttgttgcccaggctggagtgcaatggcgtgatcttcactcaccgcaacctctgccttccaggtggtaaaaccaagactgagaatgaggaaaaaactgcacagctaaacatttctaaagaatcagagtcccacagactgatagtggagggactgctgatggacgttccccagcaccctgacttcaaggacaggttagagaagtcacagctacatgatacagggaataaaacaaagataggggattgcacagatttgacagtccaggatcatgaatcttccaccactgaaagggaggagatagccaggaaattggaagaaagtagtgtcagcacacatctcattacaaagcagggttttgccaaagaacaggtgttttataaatgtggtgagtgtggcagttactacaacccacattcagactttcacctgcatcagagagttcacactaatgagaagccctacacatgcaaagaatgtgggaaaaccttcagatataactcaaaactgtcacggcatcagaaaatccacactggagagaaaccatactcatgtgaggaatgtggacaagccttcagtcaaaattcccaccttcttcagcatcagaagctccatggtggacagaggccctatgaatgtactgactgtggtaaaaccttcagttataattcaaaactgattcggcatcagagaatccatactggggagaagccctttaaatgtaaggaatgtgggaaagccttcagttgtagctatgactgcatcatccatgaacgaattcacaatggggagaagccctatgaatgtaaggagtgtgggaagagtttgagttctaattcagttctgattcagcatcagagaatccacactggggagaaaccttatgaatgtaaagagtgtggcaaggccttccaccgcagttcggtatttcttcagcaccagaggttccacactggggaacaactctacaaatgtaatgaatgttggaaaactttcagctgtagctcccgcttcatagtgcatcagagaatccacaatggggagaaaccctatgaatgccaggaatgtgggaagacattcagtcaaaagatcactctggttcagcatcagcgagttcacactggggagaaaccttatgagtgtaaggagtgcgggaaagccttcagatggaatgcaagtttcatccagcatcagaagtggcatactaggaagaaactcatcaatggaacagggctatccgcagttaagccctactgtccctgcgccatcctctctcctctgcctccccaacatacctgctctgccctagccccaccagggcctcccttatcttcttcacatgcagtggtacttcctccctctgtgcctttcttcctgctgcttccctcatctgaaaaggccaacccttcacctgtccaaatagcacatttttttcaggatctcgcttttcctgggaagtcatcccttcagagcccgaatcctttgtctcactccctgtaagccccgtcacgttctcaaaatcctttgcacctcaagttagggattccactggtctcctgattgtgtctattgatattcctctggtcttgtcttgtataagttgttactgttttcctaacttcattttaaattctcacgcttaaggaccatgtttgattagtttcttttatcccccggtaggaaatggcagtacttattctttatcgtgtccacatttgggctgtattatcagtctgcatctctcttctggggctactggagttggaagagtttgcagaacattttggggtttagggcatatggcattatgattatgatgagatggggcattataattagagactaggagaaatgcaaagcctatgggagaacataatcagataaagtgtccaatgattgctttcaagagcttttttttttttagggggtggggggtggtgccggagtttcactcttgtcacccaggctgtttgcagtggtgtgatcttggctcactgcaacctctgcctccagggttcaagtgattctcatgcctcagcctcccgagtagctgggaccacaggcatgcaccaccacgccccgctaattttgtatttttagtagagacagggtttcaccatgttggccaggctggtctcaaaatcctgacctcaggtgattcacctgcctcagtctcccaagtgctgggattacaggcatgagccactgcatctggcctgctttcaggagttaaggagggccatttggtggaccaggggcaaggctcactgaaagaatgtaagacttggaattttttattaccttgatagtataaaaaattatgagggtccttttatgcaaaaagaaaatgaagtgatgagttggcattgatagcaataatgtaaaattatgtctttgagctttattggaaggggatatggtttttcaatttgggttccttctctattttcattttccttttttttttgagacaggttcttgttctgtcatccaggctggattgcagtagtgcgatcatggatcactgcagtgtgttgaccttccaggctcaagcaatcctcccacctcagcttcccaagaagctgggaggtagtgcagcctcccagtttctcagagggctgaggtgggaggattgcttgagccctgggggcatacaccaccacacccagctaatttttgtattttttgtagagacagagttttgccatgttgcccaggctggtctcaaaactcctggactcaaatgatcctcccacttcagcctcccaaagtgctgggattacaggcttgagccaccatgtccagcctctattccttttcatatctgttgaatttcagtacccactcatatatgtaggtacaaaaagtgacttggacttgtaccctttagggtagatgcctgagtatagtaatctctaaagctgtacatggatggaacttgttggcatcacactggtgagcaccagaggcaaagaagagaaacctgaccatgacttgctgtagtttctcagaagtgagtccattcctgatgagttactatgcaggcccttggatatgtcctcacacctactccagatttccctatgattaaatctgaattttattggtggcacttttaaattagttttataaagaactgttttgatgacaccaagaaatgttttcagtgtgcagattgctattgtttgaatatccccagcaaaattcttgttgaaacttaatccccattgtaacagtactgggtggggggtctttaagaggtgatcaggattagccaagttcatcagggtggagcctccatgatgggactggtggctttatgaggagaggaagagcaactggaactgggacacatgcttgctctgtcttgccttttgatgcctcctgccatgtcatgatgcagcaagtaagcccttaccagatgcctgcacctttatattggacttcttagccttcagaactgtgaactaaataaacctctattctgtataaatt

SEQ ID NO: 203240 - DNA, 4153 bp, Homo sapiens
  Payload ID: 20077
  Gene Name: zinc finger protein 619
  Uniprot ID: Q8N2I2
  ENST ID: ENST00000447116
  CDS Start-End: 308-2158
agagaggctgtagggaccgacggccggccagctaatgcttccgtcttggccaccttgcgagcgctcgggttgagtttcccgggcttccctgactcggctacctgttctggaggtcaggctttgggcccttgcagaggtcgccgaggggcccgcgccgccgccagagcctgggcccagtccccagtcttcagagacgccctcgaccttcctgctccgaggagctggcctgatgtcctcgggtcgcgctccgcaggttcttactttttcaaacctagagggcagtgcatgaagccaggggtcatcagccatgctccagacagtgtggttccagggcttgggcaggaacctgttgtttcaggagccagtaacctttgaggatgtggctgtgtacttcacccagaatgaatgggccagcctgcaccctacgcagagggccctatacagggaggtgatgctggagaattatgcaaatgtgacttccttgtacccaactgcagggggctttcctctggatacagagagaactgagaaggttcctggtgcactgtcttcattccttccatcttccagttccctggagctgatcttggccctattgcctatgtcagcatttccattccccaaaccagatctgatattccagctggagcaaggagaagcagcatggggcccagatccctggacacttgctgggggagaggccctgagaggcatgtgcacaggtggtaaaaccaagactgagaatgaggaaaaaactgcacagctaaacatttctaaagaatcagagtcccacagactgatagtggagggactgctgatggacgttccccagcaccctgacttcaaggacaggttagagaagtcacagctacatgatacagggaataaaacaaagataggggattgcacagatttgacagtccaggatcatgaatcttccaccactgaaagggaggagatagccaggaaattggaagaaagtagtgtcagcacacatctcattacaaagcagggttttgccaaagaacaggtgttttataaatgtggtgagtgtggcagttactacaacccacattcagactttcacctgcatcagagagttcacactaatgagaagccctacacatgcaaagaatgtgggaaaaccttcagatataactcaaaactgtcacggcatcagaaaatccacactggagagaaaccatactcatgtgaggaatgtggacaagccttcagtcaaaattcccaccttcttcagcatcagaagctccatggtggacagaggccctatgaatgtactgactgtggtaaaaccttcagttataattcaaaactgattcggcatcagagaatccatactggggagaagccctttaaatgtaaggaatgtgggaaagccttcagttgtagctatgactgcatcatccatgaacgaattcacaatggggagaagccctatgaatgtaaggagtgtgggaagagtttgagttctaattcagttctgattcagcatcagagaatccacactggggagaaaccttatgaatgtaaagagtgtggcaaggccttccaccgcagttcggtatttcttcagcaccagaggttccacactggggaacaactctacaaatgtaatgaatgttggaaaactttcagctgtagctcccgcttcatagtgcatcagagaatccacaatggggagaaaccctatgaatgccaggaatgtgggaagacattcagtcaaaagatcactctggttcagcatcagcgagttcacactggggagaaaccttatgagtgtaaggagtgcgggaaagccttcagatggaatgcaagtttcatccagcatcagaagtggcatactaggaagaaactcatcaatggaacagggctatccgcagttaagccctactgtccctgcgccatcctctctcctctgcctccccaacatacctgctctgccctagccccaccagggcctcccttatcttcttcacatgcagtggtacttcctccctctgtgcctttcttcctgctgcttccctcatctgaaaaggccaacccttcacctgtccaaatagcacatttttttcaggatctcgcttttcctgggaagtcatcccttcagagcccgaatcctttgtctcactccctgtaagccccgtcacgttctcaaaatcctttgcacctcaagttagggattccactggtctcctgattgtgtctattgatattcctctggtcttgtcttgtataagttgttactgttttcctaacttcattttaaattctcacgcttaaggaccatgtttgattagtttcttttatcccccggtaggaaatggcagtacttattctttatcgtgtccacatttgggctgtattatcagtctgcatctctcttctggggctactggagttggaagagtttgcagaacattttggggtttagggcatatggcattatgattatgatgagatggggcattataattagagactaggagaaatgcaaagcctatgggagaacataatcagataaagtgtccaatgattgctttcaagagcttttttttttttagggggtggggggtggtgccggagtttcactcttgtcacccaggctgtttgcagtggtgtgatcttggctcactgcaacctctgcctccagggttcaagtgattctcatgcctcagcctcccgagtagctgggaccacaggcatgcaccaccacgccccgctaattttgtatttttagtagagacagggtttcaccatgttggccaggctggtctcaaaatcctgacctcaggtgattcacctgcctcagtctcccaagtgctgggattacaggcatgagccactgcatctggcctgctttcaggagttaaggagggccatttggtggaccaggggcaaggctcactgaaagaatgtaagacttggaattttttattaccttgatagtataaaaaattatgagggtccttttatgcaaaaagaaaatgaagtgatgagttggcattgatagcaataatgtaaaattatgtctttgagctttattggaaggggatatggtttttcaatttgggttccttctctattttcattttccttttttttttgagacaggttcttgttctgtcatccaggctggattgcagtagtgcgatcatggatcactgcagtgtgttgaccttccaggctcaagcaatcctcccacctcagcttcccaagaagctgggaggtagtgcagcctcccagtttctcagagggctgaggtgggaggattgcttgagccctgggggcatacaccaccacacccagctaatttttgtattttttgtagagacagagttttgccatgttgcccaggctggtctcaaaactcctggactcaaatgatcctcccacttcagcctcccaaagtgctgggattacaggcttgagccaccatgtccagcctctattccttttcatatctgttgaatttcagtacccactcatatatgtaggtacaaaaagtgacttggacttgtaccctttagggtagatgcctgagtatagtaatctctaaagctgtacatggatggaacttgttggcatcacactggtgagcaccagaggcaaagaagagaaacctgaccatgacttgctgtagtttctcagaagtgagtccattcctgatgagttactatgcaggcccttggatatgtcctcacacctactccagatttccctatgattaaatctgaattttattggtggcacttttaaattagttttataaagaactgttttgatgacaccaagaaatgttttcagtgtgcagattgctattgtttgaatatccccagcaaaattcttgttgaaacttaatccccattgtaacagtactgggtggggggtctttaagaggtgatcaggattagccaagttcatcagggtggagcctccatgatgggactggtggctttatgaggagaggaagagcaactggaactgggacacatgcttgctctgtcttgccttttgatgcctcctgccatgtcatgatgcagcaagtaagcccttaccagatgcctgcacctttatattggacttcttagccttcagaactgtgaactaaataaacctctattctgtataaatt

SEQ ID NO: 203241 - DNA, 2030 bp, Homo sapiens
  Payload ID: 20077
  Gene Name: zinc finger protein 619
  ENST ID: ENST00000522736
  CDS Start-End: 309-2012
ttgcaacatcccatgaatcagtggagagggtgaatgacagcagctagtgtgccaagaatatctgcaatgctagtggcaggagacagaggggaagaggcggcaagtgtaggagacgagacagatcagtctcattgtggttctctcttagctccgcaggttcttactttttcaaacctagagggcagtgcatgaagccaggggtcatcagccatgctccagacagtgtggttccagggcttgggcaggaacctgttgtttcaggagccagtaacctttgaggatgtggctgtgtacttcacccagaatgaatgggccagcctgcaccctacgcagagggccctatacagggaggtgatgctggagaattatgcaaatgtgacttccttgtcagcatttccattccccaaaccagatctgatattccagctggagcaaggagaagcagcatggggcccagatccctggacacttgctgggggagaggccctgagaggcatgtgcacagagtttcacttttgttgcccaggctggagtgcaatggcgtgatcttcactcaccgcaacctctgccttccaggtggtaaaaccaagactgagaatgaggaaaaaactgcacagctaaacatttctaaagaatcagagtcccacagactgatagtggagggactgctgatggacgttccccagcaccctgacttcaaggacaggttagagaagtcacagctacatgatacagggaataaaacaaagataggggattgcacagatttgacagtccaggatcatgaatcttccaccactgaaagggaggagatagccaggaaattggaagaaagtagtgtcagcacacatctcattacaaagcagggttttgccaaagaacaggtgttttataaatgtggtgagtgtggcagttactacaacccacattcagactttcacctgcatcagagagttcacactaatgagaagccctacacatgcaaagaatgtgggaaaaccttcagatataactcaaaactgtcacggcatcagaaaatccacactggagagaaaccatactcatgtgaggaatgtggacaagccttcagtcaaaattcccaccttcttcagcatcagaagctccatggtggacagaggccctatgaatgtactgactgtggtaaaaccttcagttataattcaaaactgattcggcatcagagaatccatactggggagaagccctttaaatgtaaggaatgtgggaaagccttcagttgtagctatgactgcatcatccatgaacgaattcacaatggggagaagccctatgaatgtaaggagtgtgggaagagtttgagttctaattcagttctgattcagcatcagagaatccacactggggagaaaccttatgaatgtaaagagtgtggcaaggccttccaccgcagttcggtatttcttcagcaccagaggttccacactggggaacaactctacaaatgtaatgaatgttggaaaactttcagctgtagctcccgcttcatagtgcatcagagaatccacaatggggagaaaccctatgaatgccaggaatgtgggaagacattcagtcaaaagatcactctggttcagcatcagcgagttcacactggggagaaaccttatgagtgtaaggagtgcgggaaagccttcagatggaatgcaagtttcatccagcatcagaagtggcatactaggaagaaactcatcaatggaacagggctatccgcagttaagccctactgtccctgcgccatcctctctcctctgcctccccaacatacctgctctgccctagccccaccagggcctcccttatcttcttcacatgcagtggtacttcctccctctgtgcctttcttcctgctgcttccctcatctgaaaaggccaacccttcacctgtccaaatagcacatttttttcaggatctcgcttttcctgggaagtcatcccttcagagcccgaatcctttgtctcactccctgtaagccccgtcacgttctcaa

SEQ ID NO: 203242 - DNA, 2309 bp, Homo sapiens
  Payload ID: 20077
  Gene Name: zinc finger protein 619
  ENST ID: ENST00000494154
  CDS Start-End: 237-416
gagtttcccgggcttccctgactcggctacctgttctggaggtcaggctttgggcccttgcagaggtcgccgaggggcccgcgccgccgccagagcctgggcccagtccccagtcttcagagacgccctcgaccttcctgctccgaggagctggcctgatgtcctcgggtcgcgctccgcaggttcttactttttcaaacctagagggcagtgcatgaagccaggggtcatcagccatgctccagacagtgtggttccagggcttgggcaggaacctgttgtttcaggagccagtaacctttgaggatgtggctgtgtacttcacccagaatgaatgggccagcctgcaccctacgcagagggccctatacagggaggtgatgctggagaattatgcaaatgtgacttccttgtgacttttctcttccctggttcctaatggagacccaactgcagggggctttcctctggatacagagagaactgagaaggttcctggtgcactgtcttcattccttccatcttccagttccctggagctgatcttggccctattgcctatgtcagcatttccattccccaaaccagatctgatattccagctggagcaaggagaagcagcatggggcccagatccctggacacttgctgggggagaggccctgagaggcatgtgcacaggtggtaaaaccaagactgagaatgaggaaaaaactgcacagctaaacatttctaaagaatcagagtcccacagactgatagtggagggactgctgatggacgttccccagcaccctgacttcaaggacaggttagagaagtcacagctacatgatacagggaataaaacaaagataggggattgcacagatttgacagtccaggatcatgaatcttccaccactgaaagggaggagatagccaggaaattggaagaaagtagtgtcagcacacatctcattacaaagcagggttttgccaaagaacaggtgttttataaatgtggtgagtgtggcagttactacaacccacattcagactttcacctgcatcagagagttcacactaatgagaagccctacacatgcaaagaatgtgggaaaaccttcagatataactcaaaactgtcacggcatcagaaaatccacactggagagaaaccatactcatgtgaggaatgtggacaagccttcagtcaaaattcccaccttcttcagcatcagaagctccatggtggacagaggccctatgaatgtactgactgtggtaaaaccttcagttataattcaaaactgattcggcatcagagaatccatactggggagaagccctttaaatgtaaggaatgtgggaaagccttcagttgtagctatgactgcatcatccatgaacgaattcacaatggggagaagccctatgaatgtaaggagtgtgggaagagtttgagttctaattcagttctgattcagcatcagagaatccacactggggagaaaccttatgaatgtaaagagtgtggcaaggccttccaccgcagttcggtatttcttcagcaccagaggttccacactggggaacaactctacaaatgtaatgaatgttggaaaactttcagctgtagctcccgcttcatagtgcatcagagaatccacaatggggagaaaccctatgaatgccaggaatgtgggaagacattcagtcaaaagatcactctggttcagcatcagcgagttcacactggggagaaaccttatgagtgtaaggagtgcgggaaagccttcagatggaatgcaagtttcatccagcatcagaagtggcatactaggaagaaactcatcaatggaacagggctatccgcagttaagccctactgtccctgcgccatcctctctcctctgcctccccaacatacctgctctgccctagccccaccagggcctcccttatcttcttcacatgcagtggtacttcctccctctgtgcctttcttcctgctgcttccctcatctgaaaaggccaacccttcacctgtccaaatagcacatttttttcaggatctcgcttttcctgggaagtcatcccttcagagcccgaatcctttgtctcactccctgtaagccccgtcacgttctcaaaatcctttgcacctcaagttagggattccactggtctcctgattgtgtctattgatattcctctggtcttgtcttgtataagttgttactgttttcctaacttcattttaaattctcacgcttaaggaccatgtttgattagtttcttttatcccccggtaggaaatggcagta

SEQ ID NO: 203243 - DNA, 1869 bp, Homo sapiens
  Payload ID: 20077
  Gene Name: zinc finger protein 619
  Uniprot ID: Q8N2I2
  ENST ID: ENST00000521353
  CDS Start-End: 1-1851
atgctccagacagtgtggttccagggcttgggcaggaacctgttgtttcaggagccagtaacctttgaggatgtggctgtgtacttcacccagaatgaatgggccagcctgcaccctacgcagagggccctatacagggaggtgatgctggagaattatgcaaatgtgacttccttgtacccaactgcagggggctttcctctggatacagagagaactgagaaggttcctggtgcactgtcttcattccttccatcttccagttccctggagctgatcttggccctattgcctatgtcagcatttccattccccaaaccagatctgatattccagctggagcaaggagaagcagcatggggcccagatccctggacacttgctgggggagaggccctgagaggcatgtgcacaggtggtaaaaccaagactgagaatgaggaaaaaactgcacagctaaacatttctaaagaatcagagtcccacagactgatagtggagggactgctgatggacgttccccagcaccctgacttcaaggacaggttagagaagtcacagctacatgatacagggaataaaacaaagataggggattgcacagatttgacagtccaggatcatgaatcttccaccactgaaagggaggagatagccaggaaattggaagaaagtagtgtcagcacacatctcattacaaagcagggttttgccaaagaacaggtgttttataaatgtggtgagtgtggcagttactacaacccacattcagactttcacctgcatcagagagttcacactaatgagaagccctacacatgcaaagaatgtgggaaaaccttcagatataactcaaaactgtcacggcatcagaaaatccacactggagagaaaccatactcatgtgaggaatgtggacaagccttcagtcaaaattcccaccttcttcagcatcagaagctccatggtggacagaggccctatgaatgtactgactgtggtaaaaccttcagttataattcaaaactgattcggcatcagagaatccatactggggagaagccctttaaatgtaaggaatgtgggaaagccttcagttgtagctatgactgcatcatccatgaacgaattcacaatggggagaagccctatgaatgtaaggagtgtgggaagagtttgagttctaattcagttctgattcagcatcagagaatccacactggggagaaaccttatgaatgtaaagagtgtggcaaggccttccaccgcagttcggtatttcttcagcaccagaggttccacactggggaacaactctacaaatgtaatgaatgttggaaaactttcagctgtagctcccgcttcatagtgcatcagagaatccacaatggggagaaaccctatgaatgccaggaatgtgggaagacattcagtcaaaagatcactctggttcagcatcagcgagttcacactggggagaaaccttatgagtgtaaggagtgcgggaaagccttcagatggaatgcaagtttcatccagcatcagaagtggcatactaggaagaaactcatcaatggaacagggctatccgcagttaagccctactgtccctgcgccatcctctctcctctgcctccccaacatacctgctctgccctagccccaccagggcctcccttatcttcttcacatgcagtggtacttcctccctctgtgcctttcttcctgctgcttccctcatctgaaaaggccaacccttcacctgtccaaatagcacatttttttcaggatctcgcttttcctgggaagtcatcccttcagagcccgaatcctttgtctcactccctgtaagccccgtcacgttctcaa

SEQ ID NO: 203244 - DNA, 3291 bp, Homo sapiens
  Payload ID: 20078
  Gene Name: zinc finger protein 620
  Uniprot ID: Q6ZNG0
  ENST ID: ENST00000314529
  CDS Start-End: 150-1418
aagctttccccggtgtcggcggcaggtggaatttccacgctttatctgcgcctgcgccgcgcgggattcgcggtccgagctgaagaggttcgcggtccggtttcacttctccgaaccctgaggcagtgtgtgaagctgggacgccagccatgttccagaccgcttggcgccaggaaccagtgacctttgaggatgtggctgtgtacttcacccagaatgaatgggccagcctggactctgtgcagagggccctgtacagggaagtgatgctggagaattatgcaaatgtggcttccctggcattcccattcaccacgcctgttctggtctcccagctggagcaaggggaactgccatggggcctcgatccctgggaacctatgggcagggaggctctcagaggtatctgtccaggggatgaggccagaactgagaaggaaggattaactccaaaggatcatgtgtccaaagaaacagagtccttcagactgatggtggggggcctgccagggaatgtttcccagcaccttgactttgggagcagcctagagcagccacaaggtcattggataattaagacaaagtcaaagaggagacatttcacagatacctcagccaggcaccatgaggcctatgaggtcaagaatggagagaagtttgagaaattaggaaaaaatattagcgtcagcacacaactcactacaaatcagacaaatcctagtggtcagatatcttatgaatgtggacaatgtggcagatatttcattcaaatggcagacttccaccgacatgagaaatgtcacactggtgaaaagtcttttgaatgcaaagaatgtggaaaatacttcagatataactcattacttattcggcatcagataattcacactggaaagaaaccatttaaatgtaaagaatgtggaaaaggtttaagttcagacacagccttgattcagcatcagagaatccacactggagaaaagccctatgaatgtaaggagtgcggcaaggccttcagtagcagctctgtcttcctccagcaccagaggttccacactggggagaagctctatgaatgtaacgaatgttggaaaactttcagttgcagctcaagtttcactgtccatcagcgaatgcacactggggagaaaccttatgaatgtaaagagtgtggaaaacgattaagctccaacacagccttgactcagcatcagcgaattcacactggggagaagccctttgaatgtaaggagtgtgggaaggcattcaatcagaaaataaccctgattcagcaccagcgagttcacactggcgagaaaccttatgagtgtaaagtgtgtggtaaaaccttcagctggtgtggaagattcattctgcatcagaaactacacactcagaagacacctgtccaagcatagggctatccatagttaggcccactgtgcctctccttttttctctttattttcatgctttttatcagtgtcctcgctgtccttcctggttagacacttggctttcatcatgaactcttctttaagttttttgaacctgtttccccaacatgaagtctctttatggttagagaagaccaaaaaacaaacaaacaaacttagaaacataaaaggaaatgtaagtttccagatttaaaggacatgctgggtgcccagcaggatggattcaagggaaacctacattaaggaaaattgctgtgaattatgaaaacaccaagtttgaataagaggatcatggagaaaaaatgagaccctaaaaagtttctagagagagaaaacaaaagatcagaaatgaaagcggggccaggcgcggtggctcgtgcctgtaatcccagcactttgggaggctgaggcgggtggatcatgaggtcaggagttcgagaccagcccgcccaatatggtgaaaccccgtctctcctgaaaaaaaaaaacacaaaaattagccaggcatggtggcgcatgcctgtaatcccagctactagagaggctgaggcaggagaatcacttgaatccctgaggcagaggttgcagtgagctgagatcgcaccactgcactccagcctgggcgacagagtgagactttgtctcaaaaacagtaaaaaatgaaaatggcattagatttttcaagagcaaccttcaaagtcagatgacaatgtgtatgccttcagacttctcatggaaaatgttttcccctgcaattctatactccaaagtataagtatagaataaaggcatttcagaccctttaaatctgaaatctttatctcccatgcatcctttctcatatgtgcaacactacacaaggagtaaaccagtaaataaaaagacagatatatggattccctattgcagtccgtacgtcagaagtctcctaaattcaaaaacgggccctgtccatgtggagccaaatgcatcttggaagacattcctagtagggtgcaaacttccagagacctatctcaggttcagtgtccacccaccctacttattcttcagtttgtcttcactagacagttgtactctgtgcctttgcaaaagtcaggatgtatatactctttgagtcaggtgcaaggcaccatttgtcttaaatttattctcattgctgtttcaagtgacctcaaagcaggcagcattttcttgcaattccatctagttattttttatgatcatggaagaacctaccattattgctgttacctgtggaaatgagggaagatgtaaatgtgttaggttttagcatcccctctggcagccagcttgattttgcaggaagcagagagtagtgattaataatacagagccaggcagactttggtttgagtccaggtgtttgtccttggttaagttacaaaaactgcactagtttccttatctgtaaaatgaggatgacagttaatctacctcataggtttgtgttggggattaaatgcattatttgtagaagtgtttcaaacagtgactacatataataaaagtattacctattattggccgggcacagtggctcatgcctgtaatcccagcactttgggaggctgaggtgggcagatcacaaggtcaggagatcaagaccatcctgctaacacactgaaaccctgtctctactaaaagtacaaaaaattagctgggcgtggggtgacatgtgcctgtagtcccagctacttgggaggctgaggcaggagcccagggaggcagaggttgcagtgagccaagatcatgccactgcactccagtctgggtgacagattgagactccgtctcaaaaaaaaaaaaaaaa

SEQ ID NO: 203245 - DNA, 2022 bp, Homo sapiens
  Payload ID: 20078
  Gene Name: zinc finger protein 620
  Uniprot ID: Q6ZNG0
  ENST ID: ENST00000418905
  CDS Start-End: 250-1176
agctttccccggtgtcggcggcaggtggaatttccacgctttatctgcgcctgcgccgcgcgggattcgcggtccgagctgaagaggttcgcggtccggtttcacttctccgaaccctgaggcagtgtgtgaagctgggacgccagccatgttccagaccgcttggcgccaggggatgaggccagaactgagaaggaaggattaactccaaaggatcatgtgtccaaagaaacagagtccttcagactgatggtggggggcctgccagggaatgtttcccagcaccttgactttgggagcagcctagagcagccacaaggtcattggataattaagacaaagtcaaagaggagacatttcacagatacctcagccaggcaccatgaggcctatgaggtcaagaatggagagaagtttgagaaattaggaaaaaatattagcgtcagcacacaactcactacaaatcagacaaatcctagtggtcagatatcttatgaatgtggacaatgtggcagatatttcattcaaatggcagacttccaccgacatgagaaatgtcacactggtgaaaagtcttttgaatgcaaagaatgtggaaaatacttcagatataactcattacttattcggcatcagataattcacactggaaagaaaccatttaaatgtaaagaatgtggaaaaggtttaagttcagacacagccttgattcagcatcagagaatccacactggagaaaagccctatgaatgtaaggagtgcggcaaggccttcagtagcagctctgtcttcctccagcaccagaggttccacactggggagaagctctatgaatgtaacgaatgttggaaaactttcagttgcagctcaagtttcactgtccatcagcgaatgcacactggggagaaaccttatgaatgtaaagagtgtggaaaacgattaagctccaacacagccttgactcagcatcagcgaattcacactggggagaagccctttgaatgtaaggagtgtgggaaggcattcaatcagaaaataaccctgattcagcaccagcgagttcacactggcgagaaaccttatgagtgtaaagtgtgtggtaaaaccttcagctggtgtggaagattcattctgcatcagaaactacacactcagaagacacctgtccaagcatagggctatccatagttaggcccactgtgcctctccttttttctctttattttcatgctttttatcagtgtcctcgctgtccttcctggttagacacttggctttcatcatgaactcttctttaagttttttgaacctgtttccccaacatgaagtctctttatggttagagaagaccaaaaaacaaacaaacaaacttagaaacataaaaggaaatgtaagtttccagatttaaaggacatgctgggtgcccagcaggatggattcaagggaaacctacattaaggaaaattgctgtgaattatgaaaacaccaagtttgaataagaggatcatggagaaaaaatgagaccctaaaaagtttctagagagagaaaacaaaagatcagaaatgaaagcggggccaggcgcggtggctcgtgcctgtaatcccagcactttgggaggctgaggcgggtggatcatgaggtcaggagttcgagaccagcccgcccaatatggtgaaaccccgtctctcctgaaaaaaaaaaacacaaaaattagccaggcatggtggcgcatgcctgtaatcccagctactagagaggctgaggcaggagaatcacttgaatccctgaggcagaggttgcagtgagctgagatcgcaccactgcactccagcctgggcgacagagtgagactttgtctcaaaaacagtaaaaaatgaaaatggcattagatttttcaagagcaaccttcaaagtcagatgacaatgtgtatgccttcagacttctcatggaaaatgttttcccctgcaattctatactccaaagtataagtatagaataaaggcatttcagaccctttaaa

SEQ ID NO: 203246 - DNA, 533 bp, Homo sapiens
  Payload ID: 20078
  Gene Name: zinc finger protein 620
  ENST ID: ENST00000420891
  CDS Start-End: 184-533
tcctagagaggaggggcatggaaaacgcacttccggcggagggtctcaagctttccccggtgtcggcggcaggtggaatttccacgctttatctgcgcctgcgccgcgcgggattcgcggtccgagctgaagagtttcacttctccgaaccctgaggcagtgtgtgaagctgggacgccagccatgttccagaccgcttggcgccaggaaccagtgacctttgaggatgtggctgtgtacttcacccagaatgaatgggccagcctggactctgtgcagagggccctgtacagggaagtgatgctggagaattatgcaaatgtggcttccctggcattcccattcaccacgcctgttctggtctcccagctggagcaaggggaactgccatggggcctcgatccctgggaacctatgggcagggaggctctcagaggtatctgtccaggggatgaggccagaactgagaaggaaggattaactccaaaggatcatgtgtccaaagaaacagagtccttcagactgatggtggg

SEQ ID NO: 203247 - DNA, 421 bp, Homo sapiens
  Payload ID: 20078
  Gene Name: zinc finger protein 620
  ENST ID: ENST00000433723
  CDS Start-End: 81-215
gcggtccgagctgaagaggttcgcggtccggtttcacttctccgaaccctgaggcagtgtgtgaagctgggacgccagccatgttccagaccgcttggcgccagagacaatcttactctgtctcccaggctgagtgcagtggtgcaatcacagctcactgcagcctccacctcccaggcctaagtgatcctcccaaggagttgagactaagttgagactacaggaaccagtgacctttgaggatgtggctgtgtacttcacccagaatgaatgggccagcctggactctgtgcagagggccctgtacagggaagtgatgctggagaattatgcaaatgtggcttccctggcattcccattcaccacgcctgttctggtctcccagctggagcaaggggaactgccatggggcctcgatccc

SEQ ID NO: 203248 - DNA, 2404 bp, Homo sapiens
  Payload ID: 20079
  Gene Name: zinc finger protein 621
  Uniprot ID: Q6ZSS3
  ENST ID: ENST00000310898
  CDS Start-End: 460-933
gaaaggcggggcgggtctggccacggggcgaccgagatggcggcctccgggggcctagagggaccctgggcgtgcactcgcccttccggctcggcctttagttagtgaccagctcctcggcgttctgcagagcgtgggtttcagcgagttctacgtgccaggtccgcccggtgccggcttcctcgctgcccctggcggctcgtcagcccccactacccctgaacttggtcccaatggcggcccgcccctccttcacccggaccgtgggcatctgggcctcgccgaagccgtcaaggtggctgctcgggcttctagagcccgtgtccagccctttgccaccgaggcctgatcctcttttctgccctaaagaacttgccctgacagcctctggctcccgctcttgaggatcttgcttgtccaaacccagaagacagtgcatgaagccaggggacatccgccatgctccaaacaacttggcctcaggagtcagtgacctttgaggatgtggctgtttacttcacccagaatcaatgggccagcctcgaccctgcgcagagggccctgtacggggaggtgatgctggagaattatgcaaatgtggcttctctggtagcgtttccattccccaaacctgctctgatctcccacctggagagaggggaagcaccatggggcccagatccctgggacaccgagattctgagaggcatcagtcaaggtggtgagtcctggatcaaaaatgaagggctagttataaagcaggaagcctctgaagaaacagagttgcacagaatgccagtaggaggacttctcaggaacgtttctcagcactttgattttaaaaggaaggcactgaagcagactttcaatctaaatccaaatctgatacttcgaggtggatcagttgaggtcaggagtttgagaccagcctgaccaacatggagaaaccctatctctactaaaaatacaaaaattagctggatgtggtggtgtgtgcctgtaatcccagctacttgggaggctgaggcaggagaattgcttgaatccagaggcagaggttgcagtgagctgaggttgcaccactgtgcttcagcctgggtaacagagtgagactgtctcaaaaaaaaaaaaaatttagttccaaatattactgctcgttgataatgtgtctggtcacccaagagttctgatggagatgtacaaagagattaatgtttttatgtctgctaaacaacatccattctgcaggatccattactccatgggtcaaggagtaattttgactttcaagtattatttaaggaatacattttgtaaggctgtggctgccatagtggttgttctgtacaaagtaacttgaaaaccttctggaaaggattcatcattctagatgccattaaggacatttgtgattcatgggagaaggtcaaaatatcaacattaacaggagttcagaagacattgacctcaaccctgatggatgatcttgaggggttcaagacttcagtggacgaagtaactgcagatgtggtggaaatagcaagataactagacttagaagtggaacctgcatatgtgactgaattgctgcaatctcatgataaaacgtgaacaaatgaggagttgcttctaatataagagccacaaaagtggtttcttgagatggaaactactcctggtgaagatcctgtgaccattgttgaaatgacaacaaaggacttagaatattacataaacttagttgataaaacagcagcagagtttgagaggattgacttcaattttgaagaatgttccactgtgggtaaaaggctatccaacagcaacacatgctacagataaatctttcggaaaggaagagtcagttgatgttgcagccttccttgttgtctcatttaaagaaatctctagagccacactaaccttcagcaaccaccacaccgatcattcagcagccatcaacagtgaggcaagactgtcttccagcaacaaagactcactgaagacttagattatcgttaacatcttttagcaataaaatatttttaaattaaagtatgtacattgtcagatataatgctattgcaaacttaatagactataatatagattaaacataacttttataggtactggaaaataaaaataattgtgtgactccctttattgtgttaaacattttattacagttgtctggaagcaaacctgcaatatctccaagatatgcctgtatttttcaaaatgtggtcttttaacattgctatgaagtttatcagtaataatatcttatttcatggttgtccagaagttacataacttgtcttaatctaaaaatcatatcatttaaaaagcctgatgatttaatatttttcataaagaaaacttttgacaatttgtttttaag

SEQ ID NO: 203249 - DNA, 6378 bp, Homo sapiens
  Payload ID: 20079
  Gene Name: zinc finger protein 621
  Uniprot ID: Q6ZSS3
  ENST ID: ENST00000339296
  CDS Start-End: 453-1772
ggggcgggtctggccacggggcgaccgagatggcggcctccgggggcctagagggaccctgggcgtgcactcgcccttccggctcggcctttagttagtgaccagctcctcggcgttctgcagagcgtgggtttcagcgagttctacgtgccaggtccgcccggtgccggcttcctcgctgcccctggcggctcgtcagcccccactacccctgaacttggtcccaatggcggcccgcccctccttcacccggaccgtgggcatctgggcctcgccgaagccgtcaaggtggctgctcgggcttctagagcccgtgtccagccctttgccaccgaggcctgatcctcttttctgccctaaagaacttgccctgacagcctctggctcccgctcttgaggatcttgcttgtccaaacccagaagacagtgcatgaagccaggggacatccgccatgctccaaacaacttggcctcaggagtcagtgacctttgaggatgtggctgtttacttcacccagaatcaatgggccagcctcgaccctgcgcagagggccctgtacggggaggtgatgctggagaattatgcaaatgtggcttctctggtagcgtttccattccccaaacctgctctgatctcccacctggagagaggggaagcaccatggggcccagatccctgggacaccgagattctgagaggcatcagtcaaggtggtgagtcctggatcaaaaatgaagggctagttataaagcaggaagcctctgaagaaacagagttgcacagaatgccagtaggaggacttctcaggaacgtttctcagcactttgattttaaaaggaaggcactgaagcagactttcaatctaaatccaaatctgatacttcgaggtggaatgaagttctatgaatgtaaagaatgtgggaaaatcttccgatataactcaaagcttattcggcatcagatgagtcatactggggaaaagccctttaagtgtaaggagtgtggcaaagctttcaagtccagctatgattgtattgtacatgagaaaaaccacattggagaagggccctatgaatgtaaggagtgtggcaaaggtttgagttccaacacagccttgactcaacatcagaggatccacactggagagaaaccctatgaatgtaaagagtgtggaaaggctttccgtaggagtgcggcatacctgcagcatcagagattacacacgggagagaaactctataaatgtaaggaatgttggaaagctttcggttgtaggtcactttttattgtccatcagagaattcatactggggagaaaccttatcaatgtaaggagtgtggcaaagccttcacccagaaaatagcctccattcagcatcagagagttcacactggggagaagccttatgaatgtaaggtgtgtgggaaagccttcaaatggtatggaagttttgttcagcatcagaaattgcaccctgtggagaagaagccagtcaaggtccttgggccatccctggtcagtccccagtgctcctctccagccatacctcctgttcttctccagggatcctgttctgcttcagccgtagctgtgccttcactgacctttccacatgctgtgctcattcctacctctgggaattttttcatgctgctgcctacatctggaataccttcttcatctgcccaaatagtgcgtgtcttccagggtcttactcccactgtgaaaccttccccagttattctcaccccttcttctcactcctcatgagctttatcttggcagtcttacggctcttatgcctagcaaatctccagcctaattttatatatttttttgagaaagggtcttgctctgtcacccaggctagagtgcggtggtgtgatcttggctcactgcaacctccccctcctgggttcaagcgattctcctccttcagactctcgaatagctgggattacaggcacgcctcaccacgcccagctaatttctgtatttttagaagagatggggtttcgccatcttggccaggctggtctcaaacacctgacctcaagtgatccgcctgccttggccccccaaagtgctgggattacaggagtgagccactgtgcccagcctccaacctaatttgagtttcatttgtatttttttcatcaccttacatgtgttaacagctgtttcaacataaactccattataatctatatacatttaaagaccgtgtttacataatctcttctgggtagaaaatggaaatacttaacctttgcattggtccctttcaggcttgaacaacagtggctgtatctgcatcgtggggttgctggtggtagaacactttggtgttaggaaagtttggaaaagaggatatccctgtattaggccattatgattagagataagcagcctgggagaaacatacaagacctgtggctactggtagagaattggaataagcttccaacaatggactgtagagattaatggagattgtttagtgggcccatggctaggtggggtattaatacagttgaagttatgttgcccttggcacagatctttgagaatctcatacatctgtgaaaaagataatgtgaaataaacagtaaaaaaaaaaagtatgttgatggcagtgagagtaatcatgtctttaaacgtgaagtttttttttctttagttttgctcttgatagctagatgtttcttttaacttttatttcgtaagtaaatatacacaaaggcattcatctttgttgaatctgttgtgcagatttttcttgatgagcattctgtttttttttctttgtgagcactggcttctatattttatttcatatttatgaattataaatatgaatttaattactaaagaaataaaaataatggtgtaaagccaactcgaggggaatctgaataagcttccaaaatttttttttttaagaaataaagggagctgtgtagtgggtcagtggctaggtaggttagtgaagtggaatttggggttgctcttggaagtggccttgatgaggatcctttacaactattcagaggactgtgtgaagtagttactggaaaaagaacttgaattatgcatttattggcattaatgtaaacagtaagtcctaagctttgatggaagggtccatacattttttttttttttttgctgatgttgctatctagatgtttctctatagcaattaatagcaaaacctttacattcttggtttttaaactttaccatgtgtctgaattacatagtgtgcttgtaaaaagaagagttttctctcttgcacaaattctgattttggctatctgtggtgatggccagatctttagcatggaccatactttgagagatatgcttcaaacagaaaatgcccacccctcctcctttacccagcataaactctatggttaattcttaaaataatgccttacagtctccattaactcccttgcccttctcttgctttgtcatgctcgcttggcaaaacctcatctctgactaaatgcagttctttgccttctctgttcctgcaccaaaaatgatcaggagaaagcatattaccaggctgaactgtcactttaaattcatgaccagtaacttcatggaggcccttaacgtttcctgatggtcatactacaatttttggagtccacttaactcccctgctttcctaggccactactttatactttctctcttctgtaacttccaaagcatccctctcagttctcatgctcagctgatggttatgtttctgccttcggcgagagaacagcaagctccagaaagtggctgcgccttcagccccgtgctagaatgagaacatatggagccaacttgagttcggaagggctgtggccacctcgtttcgcccatctacttttcaccttgccgtatctgattcttcaccaccgtattctcagtcacttccactaaacagtgccagtgttttaaggttctgtcacactcagtaacccacttctggttcctcattccgtgtcagtgatcagcagtagactgaagaatctaccttagatttgctccatactattaattagcttacaaaatgtctaagaggagctaagctgggatgccacataggcagaagccaggaaaaatgaccaaccacagaaccaagtggttccagtggaaactcagcagctgctggtgcctgctactggactgccaccccccattgaagagactggaccaccaggaaggtcgtttcacattctgtagtaaaaatacccctacaatcattttggtagggtcttctgtcttcagccagggtgtacctgctcggtgggagttggttatatatgtatgtccaagttgcaggggcttctgggaaatacaggttttggattctgcctgggaagagagtcatagtatgaagaagtctgaaaatggggaagggattttcagaatatgttgagcagctgtaaaatatcagatacccattataggcattgaaggttacctaaatgacagaaggatgcactatattcatgggtaggaaagattagtttcatcaagatttcaatttttatcaattcataaattaaaaacaatataaaaattccagaggggtgtgtgtatagagaggcaaaggacacagagtagctaacctagttttgaagaacaagatggggggttttatgctaccagatattatatacaatgatcatcaaacacagaacaaagcaaaaaacaaactccccaaacccaagttgaaacaaaaaaaacccccagactgtaatagtattattattattttttaagatggaatcttgctctgttgctcaggctggagtgcagtggtgcaatcttggctcactgcaacctacacctcccgggttcaagtgattctcttgcctcagcctcctgagtagtgtgtgccaccacgcccagctaattttttaatttttagtagagacagggtttcaccatgttggccaggctggtcttgaactcctggcagcctcaagtgatccacccacctcggtctcccaaagtgttgggattacaggcgtgagccactgcacctggcctgtaacatgatttgctgaaatttttaaaaatcttaaataatgtactgtttagaaatatacatattttatacaaaattataaagaaagcatagagaggtaagcattagtggcacagctgagaaaatataaaaggtagttctgtctctatcctgtctcctttattctgctactgctctcattctgtctcatcccaggaatccagtcccaagtgctgcctgccaatcgtccagcaccctccacctttgccacctatttcttgttgtaaaacagatgtttgtttctaaaatataatgaattaatgattatcaaagtacaggcatacctcattttattgcagtttgttttattgtgtcttgcggatattgcattttttacaaactgaaggtttgtggcaggcctgtgttgagcaagactatcagtgccattttttttcaacagcatgtgctcatttcatttttctgtgtcttacacagaaacttaaaatatttcaaacttttcattatatgtgttttggtgattagtgacttttatgtttctattgtaattgttttggggtgccacagactgcatccatctaagacagtgagcttagttgatgtgtgtgtgtgtgttctgattactccactaactgatggttccccatctctctccctctcctcagacctcactattctctcagacacaacagtattgaaattagaccaattgataaccttacaaacacctttaagtgtttaagtgaaaaagtcacatgcctctcactttaaatcaaaagctagaaatgattaagcttagtgaggaaggctaatgtcaacagctgagataggccaaaagctagactgcttctgccaaacagtcaagttgtgaatgcaaaagaaaagttcttgaaggaaatgaaaagtacttctccagggaacacatgaacgataataaagtggccaggtgcagtggctgacacctagaatcccagcacttcggggagccaaagcgggaggatcccctgaagccaggagtccgagaccagcttgggccacaaagtgagacccctgtctctacaaaaaattaaaaatttagctgggtgtggttgtgcatgcctgtagtccgatctacttgggaggctgaagtgagaggatccctttagccagggagttcgagactgcagtgagctatgattgtgccactgcactctagcctgtgtgacagaatgaaaccaaaaaaagtgaaacagcattattactgatatggagaaagttttaggggtctggatcaaaccaaccacaaattcccttaagccaaaacctaatccagagcaa

SEQ ID NO: 203250 - DNA, 1979 bp, Homo sapiens
  Payload ID: 20079
  Gene Name: zinc finger protein 621
  Uniprot ID: Q6ZSS3
  ENST ID: ENST00000403205
  CDS Start-End: 224-1543
gaaaggcggggcgggtctggccacggggcgaccgagatggcggcctccgggggcctagagggaccctgggcgtgcactcgcccttccggctcggcctttagttagtgaccagctcctcggcgttctgcagagcgtgggtttcagcgagttctacgtgccagctcttgaggatcttgcttgtccaaacccagaagacagtgcatgaagccaggggacatccgccatgctccaaacaacttggcctcaggagtcagtgacctttgaggatgtggctgtttacttcacccagaatcaatgggccagcctcgaccctgcgcagagggccctgtacggggaggtgatgctggagaattatgcaaatgtggcttctctggtagcgtttccattccccaaacctgctctgatctcccacctggagagaggggaagcaccatggggcccagatccctgggacaccgagattctgagaggcatcagtcaaggtggtgagtcctggatcaaaaatgaagggctagttataaagcaggaagcctctgaagaaacagagttgcacagaatgccagtaggaggacttctcaggaacgtttctcagcactttgattttaaaaggaaggcactgaagcagactttcaatctaaatccaaatctgatacttcgaggtggaatgaagttctatgaatgtaaagaatgtgggaaaatcttccgatataactcaaagcttattcggcatcagatgagtcatactggggaaaagccctttaagtgtaaggagtgtggcaaagctttcaagtccagctatgattgtattgtacatgagaaaaaccacattggagaagggccctatgaatgtaaggagtgtggcaaaggtttgagttccaacacagccttgactcaacatcagaggatccacactggagagaaaccctatgaatgtaaagagtgtggaaaggctttccgtaggagtgcggcatacctgcagcatcagagattacacacgggagagaaactctataaatgtaaggaatgttggaaagctttcggttgtaggtcactttttattgtccatcagagaattcatactggggagaaaccttatcaatgtaaggagtgtggcaaagccttcacccagaaaatagcctccattcagcatcagagagttcacactggggagaagccttatgaatgtaaggtgtgtgggaaagccttcaaatggtatggaagttttgttcagcatcagaaattgcaccctgtggagaagaagccagtcaaggtccttgggccatccctggtcagtccccagtgctcctctccagccatacctcctgttcttctccagggatcctgttctgcttcagccgtagctgtgccttcactgacctttccacatgctgtgctcattcctacctctgggaattttttcatgctgctgcctacatctggaataccttcttcatctgcccaaatagtgcgtgtcttccagggtcttactcccactgtgaaaccttccccagttattctcaccccttcttctcactcctcatgagctttatcttggcagtcttacggctcttatgcctagcaaatctccagcctaattttatatatttttttgagaaagggtcttgctctgtcacccaggctagagtgcggtggtgtgatcttggctcactgcaacctccccctcctgggttcaagcgattctcctccttcagactctcgaatagctgggattacaggcacgcctcaccacgcccagctaatttctgtatttttagaagagatggggtttcgccatcttggccaggctggtctcaaacacctgacctcaagtgatccgcctgccttggccccccaaagtgctgggattacaggagtgagccactgtgcccagcctccaacctaatttgagtttcatttgtatttttttcatcaccttacatgtgttaacagctgtttcaacataaactccattataatct

SEQ ID NO: 203251 - DNA, 565 bp, Homo sapiens
  Payload ID: 20079
  Gene Name: zinc finger protein 621
  ENST ID: ENST00000453351
  CDS Start-End: 108-565
ctcttctcctgaggttctttcttttgggtccacgtcatcgtccctctcttgaggatcttgcttgtccaaacccagaagacagtgcatgaagccaggggacatccgccatgctccaaacaacttggcctcaggagtcagtgacctttgaggatgtggctgtttacttcacccagaatcaatgggccagcctcgaccctgcgcagagggccctgtacggggaggtgatgctggagaattatgcaaatgtggcttctctggtagcgtttccattccccaaacctgctctgatctcccacctggagagaggggaagcaccatggggcccagatccctgggacaccgagattctgagaggcatcagtcaaggtggtgagtcctggatcaaaaatgaagggctagttataaagcaggaagcctctgaagaaacagagttgcacagaatgccagtaggaggacttctcaggaacgtttctcagcactttgattttaaaaggaaggcactgaagcagactttcaatctaaatccaaatctgatacttcgaggtggaatgaagttctatgaatg

SEQ ID NO: 203252 - DNA, 2613 bp, Homo sapiens
  Payload ID: 20079
  Gene Name: zinc finger protein 621
  ENST ID: ENST00000431278
  CDS Start-End: 646-1632
ccacggggcgaccgagatggcggcctccgggggcctagagggaccctgggcgtgcactcgcccttccggctcggcctttagttagtgaccagctcctcggcgttctgcagagcgtgggtttcagcgagttctacgtgccaggtccgcccggtgccggcttcctcgctgcccctggcggctcgtcagcccccactacccctgaacttggtcccaatggcggcccgcccctccttcacccggaccgtgggcatctgggcctcgccgaagccgtcaaggtggctgctcgggcttctagagcccgtgtccagccctttgccaccgaggcctgatcctcttttctgccctaaagaacttgccctgacagcctctggctcccgctcttgaggatcttgcttgtccaaacccagaagacagtgcatgaagccaggggacatccgccatgctccaaacaacttggcctcagtagcgtttccattccccaaacctgctctgatctcccacctggagagaggggaagcaccatggggcccagatccctgggacaccgagattctgagaggcatcagtcaaggtggtgagtcctggatcaaaaatgaagggctagttataaagcaggaagcctctgaagaaacagagttgcacagaatgccagtaggaggacttctcaggaacgtttctcagcactttgattttaaaaggaaggcactgaagcagactttcaatctaaatccaaatctgatacttcgaggtggaatgaagttctatgaatgtaaagaatgtgggaaaatcttccgatataactcaaagcttattcggcatcagatgagtcatactggggaaaagccctttaagtgtaaggagtgtggcaaagctttcaagtccagctatgattgtattgtacatgagaaaaaccacattggagaagggccctatgaatgtaaggagtgtggcaaaggtttgagttccaacacagccttgactcaacatcagaggatccacactggagagaaaccctatgaatgtaaagagtgtggaaaggctttccgtaggagtgcggcatacctgcagcatcagagattacacacgggagagaaactctataaatgtaaggaatgttggaaagctttcggttgtaggtcactttttattgtccatcagagaattcatactggggagaaaccttatcaatgtaaggagtgtggcaaagccttcacccagaaaatagcctccattcagcatcagagagttcacactggggagaagccttatgaatgtaaggtgtgtgggaaagccttcaaatggtatggaagttttgttcagcatcagaaattgcaccctgtggagaagaagccagtcaaggtccttgggccatccctggtcagtccccagtgctcctctccagccatacctcctgttcttctccagggatcctgttctgcttcagccgtagctgtgccttcactgacctttccacatgctgtgctcattcctacctctgggaattttttcatgctgctgcctacatctggaataccttcttcatctgcccaaatagtgcgtgtcttccagggtcttactcccactgtgaaaccttccccagttattctcaccccttcttctcactcctcatgagctttatcttggcagtcttacggctcttatgcctagcaaatctccagcctaattttatatatttttttgagaaagggtcttgctctgtcacccaggctagagtgcggtggtgtgatcttggctcactgcaacctccccctcctgggttcaagcgattctcctccttcagactctcgaatagctgggattacaggcacgcctcaccacgcccagctaatttctgtatttttagaagagatggggtttcgccatcttggccaggctggtctcaaacacctgacctcaagtgatccgcctgccttggccccccaaagtgctgggattacaggagtgagccactgtgcccagcctccaacctaatttgagtttcatttgtatttttttcatcaccttacatgtgttaacagctgtttcaacataaactccattataatctatatacatttaaagaccgtgtttacataatctcttctgggtagaaaatggaaatacttaacctttgcattggtccctttcaggcttgaacaacagtggctgtatctgcatcgtggggttgctggtggtagaacactttggtgttaggaaagtttggaaaagaggatatccctgtattaggccattatgattagagataagcagcctgggagaaacatacaagacctgtggctactggtagagaattggaataagcttccaacaatggactgtagagattaatggagattgtttagtgggcccatggctaggtggggtattaatacagttgaagttatgttgcccttggcacagatctttgagaatctcatacatctgtgaaaaagataatgtgaaataaacagtaaaaaaaaaaagtatgttgatggcagtgagagtaatcatgtctttaaacgtgaagtttttttttctttagttttgctcttgatagctagatgtttcttttaacttttatttcgtaagtaaatatacacaaaggcattcatc

SEQ ID NO: 203253 - DNA, 1699 bp, Homo sapiens
  Payload ID: 20080
  Gene Name: zinc finger protein 622
  Uniprot ID: Q969S3
  ENST ID: ENST00000308683
  CDS Start-End: 128-1561
tcaggaagtcggcgtgtcgagtggctcttcctggctgctgaggcgggttaaggtctgagggtcttgtggggccacggcgctgatcaccaggtgtttggcttggtcggttcttatttctcgcctggcaatggcgacgtacacctgcataacttgccgggtggcgttccgcgacgcggacatgcagcgggcccactataagacggactggcaccgctacaacctgcggcggaaggtggccagcatggccccagtgaccgccgagggcttccaggagcgagtgcgggcgcagcgggccgtcgcggaggaggagagcaagggctcggccacctactgcaccgtttgcagtaagaagtttgcctctttcaacgcctacgagaaccacctcaagtcccggcgtcacgttgagctggagaagaaggccgtgcaggcagtgaatcggaaagtggagatgatgaatgaaaagaacttggagaaaggactgggcgtggacagtgtggacaaggatgccatgaacgcggccatccagcaggccatcaaggcccagccgtccatgtctcccaagaaggcgcccccagcgcctgcaaaggaggccaggaatgtcgtggccgtgggtactggtggccgtgggacccacgaccgagacccgagtgagaaaccaccccggctccagtggtttgaacagcaggcgaagaagttggcaaagcagcaggaggaggacagcgaggaggaggaagaggacctggatggagacgattgggaagatattgattctgatgaagaattggaatgtgaggatactgaagcaatggacgatgtggtggagcaggatgcagaggaggaagaggctgaggaaggcccaccccttggtgccatccctatcacggactgcttattttgttcccatcattccagctcgctgatgaagaatgtggctcacatgaccaaagaccacagtttctttattcctgatatagaatatctttcagatattaagggactgattaaatacttgggagagaaagttggtgttggcaagatttgcttgtggtgcaacgagaaagggaagtccttctactccacagaagctgtacaggcacatatgaatgacaaaagccactgtaagctcttcacagatggcgatgctgctttggaatttgcagacttctatgattttaggagtagctatccagatcacaaggaaggggaggaccccaataaggctgaggagttgccctcagaaaagaacttggaatatgatgatgaaaccatggaattgattctgccttctggtgccagagtgggtcatcgctccttgatgagatactacaaacagcgatttggcttgtcaagagctgtggcagttgccaaaaatcggaaggccgtgggccgagtacttcagcagtacagagccctgggatggactggcagcacaggagcggctcttatgcgagagcgagacatgcagtatgtccaaaggatgaaatcaaaatggatgctgaagacaggaatgaagaacaatgccaccaagcagatgcactttcgggtccaagtgagattctgagagtctgctgggattgagcaatcatctcctgcccaagtttcctccttgccctgaggaccagtgaaagacagatcataggagagacccttttgctgctacttcattcgttctgacctaataataaaagttagaaccata

SEQ ID NO: 203254 - DNA, 2733 bp, Homo sapiens
  Payload ID: 20081
  Gene Name: zinc finger protein 623
  ENST ID: ENST00000458270
  CDS Start-End: 350-1840
ggacgggggcgggcaacgccttagccgcagccccggctggctccggagcccggccgccttgccagggcacagtccgccgagagggccgggcggggtccgcaggccgctgcccgccccgctagggcgtccaggagcggggccttggctagtcagtctcccggacgcagccacggccgcccccgcgaggctgcggcgtctctccagcgagcccgcctcgggcccgagcctggggtcttgtccctgaggagcgccgtattctaatgtaggaactggtgagaagaaggtgactgaagcctggatttctgaggatgaaaactcacataggacgacgtcagacagactcacggtgatggagctcccctctcccgagtctgaggaagtccacgagcccagattaggggagctcttgggaaatccagaaggtcagagcctggggagttccccctctcaggacaggggctgcaagcaggtgacagtgacccattggaagatccagacaggagagacagctcaagtgtgcaccaagtcaggaagaaaccatattctgaactcagaccttcttctgcttcagagagagctcatagagggggaagccaatccttgcgatatctgtggcaaaaccttcacgtttaattcggacctagttaggcatcggatttcgcatgctggggagaaaccttacacgtgcgatcagtgtgggaaaggctttggccagagctcacaccttatggagcatcagagaattcacactggagagagactctacgtctgtaatgtgtgtgggaaagacttcattcactattcaggtctcattgagcatcagcgcgttcattcaggagaaaagcccttcaaatgtgcgcagtgtgggaaggcgttttgtcacagttcagacctgattaggcaccagagagttcacaccagagagagaccttttgaatgcaaagagtgtgggaaaggcttcagtcagagctccttacttattcgccatcagaggattcacacgggagaaaggccctatgagtgcaatgaatgtgggaaatccttcataaggagctcgagcctcattcgccattatcagatccacacagaagtgaaacagtatgaatgcaaagaatgtgggaaggcattccgtcatcgctcagaccttattgaacaccagagaattcacaccggagagagaccctttgaatgcaatgagtgtgggaaagcctttattcggagttcaaagctcattcagcatcagaggatccatactggggagaggccttacgtatgcaatgagtgtgggaagcgcttcagccagacgtcaaacttcacccagcatcagagaattcacactggagagaaactctatgaatgtaacgagtgtgggaaagctttctttctgagttcataccttattcgacaccagaaaatccacactggagagagagtgtatgaatgtaaggaatgtgggaaagcgtttctccagaaagcccatctcactgagcaccagaagatccactctggggacaggcccttcgaatgtaaagactgtgggaaagccttcatccagagctccaagctgcttctgcaccagattattcacactggagaaaagccctatgtgtgcagttattgtgggaaaggctttattcagaggtcaaacttccttcaacaccagaaaattcatactgaagagaagctctatgaatgtagtcagtatgggagagattttaactcaactacaaacgttaaaaataatcaaagggttcaccaagagggactctccttgagtaaggcccccatacatttgggtgagaggtctgtagataagggggaacacacaggtaacttataaaataattactttcccgcccagtgagtgatgtttggaaatgcgtggaattaggattcatgtggtttctaagatttggacatgtcagaattttgtgagtcatggatggggctgcttttgcagtgggtgccacctgccactgtgcagccctactcggctcagcccttctcctcagctgtgagcactgtcctcaggagagtcacagggcttgacacctgactctgagctggaacagtaggggcagggagaagacaggtctcaagaaaaggtttttaagaagtttcatccccagttaagcagagtccatccttgacttaaatcccttattacagcacaactgtgtatctaatcttacgatttaggagaatgttacctaggacattttgatgtgttaagttgaagaaaggtaactcgtgtatgaaccccgagccatttccctgttgtcctgaggaggaactccaggcctcccatcgtgtgccctaaggcctcctgcgtcctggagccctgcctcccactgcctgacttcctgccacacggttaatgctgcagcaacaccgactgcttcatcttccctgtgctccacgtggcttcctacctctctcgcctttgttcttgttgaagggtctcttctcagctaattaactctgaatcatggttcaagacaagcctcaggcatcatgtcaatgggtgtttccctcaagcttagttggcagcactctccacacttctgtggctcagtgattactgctattactatatttacttgcatatgtcagaatgatgtgatagactatctctgtcactatgctgttgggttcctgaggacagtgatcatatctgattgatttccatgtgtccactgtctagcacagggcaataaaaaatacacccctaaa

SEQ ID NO: 203255 - DNA, 2612 bp, Homo sapiens
  Payload ID: 20081
  Gene Name: zinc finger protein 623
  ENST ID: ENST00000526926
  CDS Start-End: 229-1719
tctcgcgacttccggtcgcggcgggctggcggcggtgcaggctttgtcggctgatctgtggggcccgcgccggcggggtccagtcagcggctgcagggtcgggctcgcgccgtcctctccccgcccgcgccggattctaatgtaggaactggtgagaagaaggtgactgaagcctggatttctgaggatgaaaactcacataggacgacgtcagacagactcacggtgatggagctcccctctcccgagtctgaggaagtccacgagcccagattaggggagctcttgggaaatccagaaggtcagagcctggggagttccccctctcaggacaggggctgcaagcaggtgacagtgacccattggaagatccagacaggagagacagctcaagtgtgcaccaagtcaggaagaaaccatattctgaactcagaccttcttctgcttcagagagagctcatagagggggaagccaatccttgcgatatctgtggcaaaaccttcacgtttaattcggacctagttaggcatcggatttcgcatgctggggagaaaccttacacgtgcgatcagtgtgggaaaggctttggccagagctcacaccttatggagcatcagagaattcacactggagagagactctacgtctgtaatgtgtgtgggaaagacttcattcactattcaggtctcattgagcatcagcgcgttcattcaggagaaaagcccttcaaatgtgcgcagtgtgggaaggcgttttgtcacagttcagacctgattaggcaccagagagttcacaccagagagagaccttttgaatgcaaagagtgtgggaaaggcttcagtcagagctccttacttattcgccatcagaggattcacacgggagaaaggccctatgagtgcaatgaatgtgggaaatccttcataaggagctcgagcctcattcgccattatcagatccacacagaagtgaaacagtatgaatgcaaagaatgtgggaaggcattccgtcatcgctcagaccttattgaacaccagagaattcacaccggagagagaccctttgaatgcaatgagtgtgggaaagcctttattcggagttcaaagctcattcagcatcagaggatccatactggggagaggccttacgtatgcaatgagtgtgggaagcgcttcagccagacgtcaaacttcacccagcatcagagaattcacactggagagaaactctatgaatgtaacgagtgtgggaaagctttctttctgagttcataccttattcgacaccagaaaatccacactggagagagagtgtatgaatgtaaggaatgtgggaaagcgtttctccagaaagcccatctcactgagcaccagaagatccactctggggacaggcccttcgaatgtaaagactgtgggaaagccttcatccagagctccaagctgcttctgcaccagattattcacactggagaaaagccctatgtgtgcagttattgtgggaaaggctttattcagaggtcaaacttccttcaacaccagaaaattcatactgaagagaagctctatgaatgtagtcagtatgggagagattttaactcaactacaaacgttaaaaataatcaaagggttcaccaagagggactctccttgagtaaggcccccatacatttgggtgagaggtctgtagataagggggaacacacaggtaacttataaaataattactttcccgcccagtgagtgatgtttggaaatgcgtggaattaggattcatgtggtttctaagatttggacatgtcagaattttgtgagtcatggatggggctgcttttgcagtgggtgccacctgccactgtgcagccctactcggctcagcccttctcctcagctgtgagcactgtcctcaggagagtcacagggcttgacacctgactctgagctggaacagtaggggcagggagaagacaggtctcaagaaaaggtttttaagaagtttcatccccagttaagcagagtccatccttgacttaaatcccttattacagcacaactgtgtatctaatcttacgatttaggagaatgttacctaggacattttgatgtgttaagttgaagaaaggtaactcgtgtatgaaccccgagccatttccctgttgtcctgaggaggaactccaggcctcccatcgtgtgccctaaggcctcctgcgtcctggagccctgcctcccactgcctgacttcctgccacacggttaatgctgcagcaacaccgactgcttcatcttccctgtgctccacgtggcttcctacctctctcgcctttgttcttgttgaagggtctcttctcagctaattaactctgaatcatggttcaagacaagcctcaggcatcatgtcaatgggtgtttccctcaagcttagttggcagcactctccacacttctgtggctcagtgattactgctattactatatttacttgcatatgtcagaatgatgtgatagactatctctgtcactatgctgttgggttcctgaggacagtgatcatatctgattgatttccatgtgtccactgtctagcacagggcaataaaaaatacacccctaaa

SEQ ID NO: 203256 - DNA, 6759 bp, Homo sapiens
  Payload ID: 20081
  Gene Name: zinc finger protein 623
  Uniprot ID: O75123
  ENST ID: ENST00000501748
  CDS Start-End: 214-1824
gcaccacagaccagtctgtcctggtgttggatgttaaaagtggagccacaaagaagccatcttatgtgggacaggcttgggtgtgagaccagagctgtgggtagcagcatgttgggtcaggatgaggggcagaggaaacactttccacctcttggatatggattttatcctgccctgattcaggagatccccatctgttaagtaaggggaaagatgattttgttgtcttttgtttcagattctaatgtaggaactggtgagaagaaggtgactgaagcctggatttctgaggatgaaaactcacataggacgacgtcagacagactcacggtgatggagctcccctctcccgagtctgaggaagtccacgagcccagattaggggagctcttgggaaatccagaaggtcagagcctggggagttccccctctcaggacaggggctgcaagcaggtgacagtgacccattggaagatccagacaggagagacagctcaagtgtgcaccaagtcaggaagaaaccatattctgaactcagaccttcttctgcttcagagagagctcatagagggggaagccaatccttgcgatatctgtggcaaaaccttcacgtttaattcggacctagttaggcatcggatttcgcatgctggggagaaaccttacacgtgcgatcagtgtgggaaaggctttggccagagctcacaccttatggagcatcagagaattcacactggagagagactctacgtctgtaatgtgtgtgggaaagacttcattcactattcaggtctcattgagcatcagcgcgttcattcaggagaaaagcccttcaaatgtgcgcagtgtgggaaggcgttttgtcacagttcagacctgattaggcaccagagagttcacaccagagagagaccttttgaatgcaaagagtgtgggaaaggcttcagtcagagctccttacttattcgccatcagaggattcacacgggagaaaggccctatgagtgcaatgaatgtgggaaatccttcataaggagctcgagcctcattcgccattatcagatccacacagaagtgaaacagtatgaatgcaaagaatgtgggaaggcattccgtcatcgctcagaccttattgaacaccagagaattcacaccggagagagaccctttgaatgcaatgagtgtgggaaagcctttattcggagttcaaagctcattcagcatcagaggatccatactggggagaggccttacgtatgcaatgagtgtgggaagcgcttcagccagacgtcaaacttcacccagcatcagagaattcacactggagagaaactctatgaatgtaacgagtgtgggaaagctttctttctgagttcataccttattcgacaccagaaaatccacactggagagagagtgtatgaatgtaaggaatgtgggaaagcgtttctccagaaagcccatctcactgagcaccagaagatccactctggggacaggcccttcgaatgtaaagactgtgggaaagccttcatccagagctccaagctgcttctgcaccagattattcacactggagaaaagccctatgtgtgcagttattgtgggaaaggctttattcagaggtcaaacttccttcaacaccagaaaattcatactgaagagaagctctatgaatgtagtcagtatgggagagattttaactcaactacaaacgttaaaaataatcaaagggttcaccaagagggactctccttgagtaaggcccccatacatttgggtgagaggtctgtagataagggggaacacacaggtaacttataaaataattactttcccgcccagtgagtgatgtttggaaatgcgtggaattaggattcatgtggtttctaagatttggacatgtcagaattttgtgagtcatggatggggctgcttttgcagtgggtgccacctgccactgtgcagccctactcggctcagcccttctcctcagctgtgagcactgtcctcaggagagtcacagggcttgacacctgactctgagctggaacagtaggggcagggagaagacaggtctcaagaaaaggtttttaagaagtttcatccccagttaagcagagtccatccttgacttaaatcccttattacagcacaactgtgtatctaatcttacgatttaggagaatgttacctaggacattttgatgtgttaagttgaagaaaggtaactcgtgtatgaaccccgagccatttccctgttgtcctgaggaggaactccaggcctcccatcgtgtgccctaaggcctcctgcgtcctggagccctgcctcccactgcctgacttcctgccacacggttaatgctgcagcaacaccgactgcttcatcttccctgtgctccacgtggcttcctacctctctcgcctttgttcttgttgaagggtctcttctcagctaattaactctgaatcatggttcaagacaagcctcaggcatcatgtcaatgggtgtttccctcaagcttagttggcagcactctccacacttctgtggctcagtgattactgctattactatatttacttgcatatgtcagaatgatgtgatagactatctctgtcactatgctgttgggttcctgaggacagtgatcatatctgattgatttccatgtgtccactgtctagcacagggcaataaaaaatacacccctaaatctatgtgtaattggcatctctcttgctttgtcctttctatactgccattctaaaaattttcagctgttggctgttttttttgttgtttgttcattttgtatcagtataatctacgattctgttagaagtatcttctcagccctgctactgtctgctgctcctacttagaagttgcaggcaatatcctgtgcacatccacgccctcctgtgtgccaccttacagctcatgcagaactgtctacttgatctggagggcattgacacctggctcagctggaacagtggggacaggaggaggcaggtctcaagagaaggtctttacttacttgtctgtatctttctgtctcactcgaaaggcacagtctcaatgcgctacgtaactcttctgttgtagcagttctgaggttgaactgagctcttgtcattttccatgctctctggctcattgtgtcatttcaaaatgtattgatatctataaggaatagtcctcaatgttgggaaaacagatgagcaacccactaccctgaagtcatccaccgtgtagtggggaagacggagatcacagtagggtgagttaagtatgtgccctcaggtgtgaaggagcacaggtgagggggtgcctgctgtggcacagagctgggaaggccttacagaagaggtgacatttcagctgggccagagatcagtagagagcagctgaagaagaaaatagggtccaggagaggaatctgcagaaacatggagccatgacagatggctttttggctaggactgttcgaaagcaggcgaggtaaatggacagtggacagccgcctcgccaaactgttagtctttacctctgaatttcatctggacatgaaccccaaagtccagttttgtaacgatataatttttttctcatgaggccatattttgagttcttaaatactaccaaccctgaacgtctcaggacaaataattcaaaaaagagatctacattttctggaaaatcagcattactagagatgtttcaaatgtagattttaccagaccattttaatcaactttattgagattcaattttcatatagtaaaacgcctatttaagtgtacaaggttttgaaaaatctatacacctgtgtaaccaccaccacctgtgtaaccaccaccgccagaaccaaaaacgtttctgtcacccaaagaagttcccttttgccttttcctagttaagcccactccagccccagataaccactttctatcctcatagattagtgttgcttggtttagagcctcatacaaatggattcatttactatgtgttcttttgcgtctgatgtctcactttggcatgtttttagactcatccaagctgttttgtgtttcagtagttctccttgctgaatagtattccattgtgtggataagccatcatttgtttattcatccatgtgttaatgggtttccagtctcggctcttaaaactatgagcatttgtgtaaaagtatgtatttgcacatgtgtttttatttctcttgggtaagtacctaggactttaattgctgtgttgtaagtgtcttagttcattcaggctgccataacaaaataccatcaactgggaggcttataaacaacagaaatttatgttttacagttctggaggctgggaagtccaagatgagggtgtcaacatttggtgtctagtgagggcctgcttccttttaagtagatgtctttttactgtgactgcacgtggtggaaagggactagcaagcttaccccattcatgagggctctccccttgtgattctgtcccctccccaagaccccacctcatatcatcttatgggttaggaatttgacatgaattgtgcaaggatgtaaacattcagtccattgcaatacgtgtttctaacttcctaagaaattgtcacacagccctctgtagtggttgaatcattttacactattactacattatgggaagattccagttgctccatatctttgctaacacttggcattgtcagtctcttaaaatttaatccactctagcctccttatgattttaatttgtatttgcccactgaataatgtatgtctatgatttcatctgcttattgcttttccgtgtcgtcttttgtgatgtgtctgttcgtgccttttgcctgtttttaagttgggatgcttattgttgactcaagttctttccatattctgcatgaaaaacatacatgtaatatatagaattctttgtctccatttgtgacaaatattgtgaatattttcatgtttggtttgcctgttcattttcttaatggtgtcttttgaatattttttattaagcctaatttatcaaagatttgggtgtggtggctcatgtctgtaatcccagcactttgggaggccaaggtaggcagatcacctgaggccagaagtttgagaccagcctggccaacgtggtgaaaccccgtctctactaaaaatacaaaaattatctgggcgggtggcacacccctgtagtccctgctactcgggaggctgaggcaggagaatcacttgaacccaggaggcagaggttgcagtaaaccaagataataataataatgatttatgatattttataataatttgagtttaagaaatttgcctactcaaaggacatgattttttcctatgttttttatttttatggaacttttatagttttaccttttacatttaagtctgtgatccattttgagttcatttttgtgtaccatatgtgataagggtcaagattcacttttttatctgtgtggttggttggttcggttctatttgttgagactctactttcccaatgaccaagtcttcacaggtttgtaaaaactgaagtgacatagaagtggtctgttctggacaccattcttcttgtgtgtataactttacaccaatatgacactatattgattactgtagttttatttgaggcagaaatctcattctgttgcccaggctggagcgtagtggcacaatcacagctaatgtaacctcgaacatccgggctcaagtgagcctctttccttagcctcccaagtagttgggactgtaggcatgcatcaccacatcttgctaattttttatatttttttgtagagatgggggtctcactatgttgaccaggctggtcttgaactcctggcctcaagggatcctcctgcctcagcctcccaaagggattacaggtgtgagccaccactcctggccaactgtagttgaactcaggtattggaagggcttccgttttgttcttttcccatttttttttttttgacttctagatcctttgcattttcgtataaaatttgaagtcaacttctatcaacttcaggccaggcccgtggctcatgcctgtataatcccagcactttgggaggccgaggcaggcggatcacttgaggtcaggagttcaaaaccagcctggccaagatggtgaaaccccatctctactaaaaatacaaaaaaattagccaggcgtggtggcaggcgcctgtagaatcccagctactcgggaggctgaggcaggagaattgcttgaacctgggaggtggaggtttcagtgagctgagatcgtggcattgcactctagcctgggcaaccaagagtgaaactgtctcaaaaaacaacttttatcaatgtctgcaaaaagaaagtcttctgggatttatagatcaatttagggagaaatgacattttaacaattctgagttttccaattgttgaacatggtgtactgccccatttatttagatctgttaatttctctcagtttgcagctctcacattttgttaaattcatgtatttaatatttctgcatgctattgcaagtggtaaggttttcaaaaagctgttttctagttattgctagtatatagaaatgcattagacttgtacattgatcttgtatcaagcaacttagatcagttaacttattctagtagcttttttctagattctttagcattttctatgtagataatcatgtcatctgtgaataaagtattttacttttccaattt

SEQ ID NO: 203257 - DNA, 2733 bp, Homo sapiens
  Payload ID: 20081
  Gene Name: zinc finger protein 623
  ENST ID: ENST00000618766
  CDS Start-End: 350-1840
ggacgggggcgggcaacgccttagccgcagccccggctggctccggagcccggccgccttgccagggcacagtccgccgagagggccgggcggggtccgcaggccgctgcccgccccgctagggcgtccaggagcggggccttggctagtcagtctcccggacgcagccacggccgcccccgcgaggctgcggcgtctctccagcgagcccgcctcgggcccgagcctggggtcttctccctgaggagcgccgtattctaatgtaggaactggtgagaagaaggtgactgaagcctggatttctgaggatgaaaactcacataggacgacgtcagacagactcacggtgatggagctcccctctcccgagtctgaggaagtccacgagcccagattaggggagctcttgggaaatccagaaggtcagagcctggggagttccccctctcaggacaggggctgcaagcaggtgacagtgacccattggaagatccagacaggagagacagctcaagtgtgcaccaagtcaggaagaaaccatattctgaactcagaccttcttctgcttcagagagagctcatagagggggaagccaatccttgcgatatctgtggcaaaaccttcacgtttaattcggacctagttaggcatcggatttcgcatgctggggagaaaccttacacgtgcgatcagtgtgggaaaggctttggccagagctcacaccttatggagcatcagagaattcacactggagagagactctacgtctgtaatgtgtgtgggaaagacttcattcactattcaggtctcattgagcatcagcgcgttcattcaggagaaaagcccttcaaatgtgcgcagtgtgggaaggcgttttgtcacagttcagacctgattaggcaccagagagttcacaccagagagagaccttttgaatgcaaagagtgtgggaaaggcttcagtcagagctccttacttattcgccatcagaggattcacacgggagaaaggccctatgagtgcaatgaatgtgggaaatccttcataaggagctcgagcctcattcgccattatcagatccacacagaagtgaaacagtatgaatgcaaagaatgtgggaaggcattccgtcatcgctcagaccttattgaacaccagagaattcacaccggagagagaccctttgaatgcaatgagtgtgggaaagcctttattcggagttcaaagctcattcagcatcagaggatccatactggggagaggccttacgtatgcaatgagtgtgggaagcgcttcagccagacgtcaaacttcacccagcatcagagaattcacactggagagaaactctatgaatgtaacgagtgtgggaaagctttctttctgagttcataccttattcgacaccagaaaatccacactggagagagagtgtatgaatgtaaggaatgtgggaaagcgtttctccagaaagcccatctcactgagcaccagaagatccactctggggacaggcccttcgaatgtaaagactgtgggaaagccttcatccagagctccaagctgcttctgcaccagattattcacactggagaaaagccctatgtgtgcagttattgtgggaaaggctttattcagaggtcaaacttccttcaacaccagaaaattcatactgaagagaagctctatgaatgtagtcagtatgggagagattttaactcaactacaaacgttaaaaataatcaaagggttcaccaagagggactctccttgagtaaggcccccatacatttgggtgagaggtctgtagataagggggaacacacaggtaacttataaaataattactttcccgcccagtgagtgatgtttggaaatgcgtggaattaggattcatgtggtttctaagatttggacatgtcagaattttgtgagtcatggatggggctgcttttgcagtgggtgccacctgccactgtgcagccctactcggctcagcccttctcctcagctgtgagcactgtcctcaggagagtcacagggcttgacacctgactctgagctggaacagtaggggcagggagaagacaggtctcaagaaaaggtttttaagaagtttcatccccagttaagcagagtccatccttgacttaaatcccttattacagcacaactgtgtatctaatcttacgatttaggagaatgttacctaggacattttgatgtgttaagttgaagaaaggtaactcgtgtatgaaccccgagccatttccctgttgtcctgaggaggaactccaggcctcccatcgtgtgccctaaggcctcctgcgtcctggagccctgcctcccactgcctgacttcctgccacacggttaatgctgcagcaacaccgactgcttcatcttccctgtgctccacgtggcttcctacctctctcgcctttgttcttgttgaagggtctcttctcagctaattaactctgaatcatggttcaagacaagcctcaggcatcatgtcaatgggtgtttccctcaagcttagttggcagcactctccacacttctgtggctcagtgattactgctattactatatttacttgcatatgtcagaatgatgtgatagactatctctgtcactatgctgttgggttcctgaggacagtgatcatatctgattgatttccatgtgtccactgtctagcacagggcaataaaaaatacacccctaaa

SEQ ID NO: 203258 - DNA, 2612 bp, Homo sapiens
  Payload ID: 20081
  Gene Name: zinc finger protein 623
  ENST ID: ENST00000620499
  CDS Start-End: 229-1719
tctcgcgacttccggtcgcggcgggctggcggcggtgcaggctttgtcggctgatctgtggggcccgcgcccgcggggtccagtcagcggctgcagggtcgggctcgcgccgtcctctccccgcccgcgccggattctaatgtaggaactggtgagaagaaggtgactgaagcctggatttctgaggatgaaaactcacataggacgacgtcagacagactcacggtgatggagctcccctctcccgagtctgaggaagtccacgagcccagattaggggagctcttgggaaatccagaaggtcagagcctggggagttccccctctcaggacaggggctgcaagcaggtgacagtgacccattggaagatccagacaggagagacagctcaagtgtgcaccaagtcaggaagaaaccatattctgaactcagaccttcttctgcttcagagagagctcatagagggggaagccaatccttgcgatatctgtggcaaaaccttcacgtttaattcggacctagttaggcatcggatttcgcatgctggggagaaaccttacacgtgcgatcagtgtgggaaaggctttggccagagctcacaccttatggagcatcagagaattcacactggagagagactctacgtctgtaatgtgtgtgggaaagacttcattcactattcaggtctcattgagcatcagcgcgttcattcaggagaaaagcccttcaaatgtgcgcagtgtgggaaggcgttttgtcacagttcagacctgattaggcaccagagagttcacaccagagagagaccttttgaatgcaaagagtgtgggaaaggcttcagtcagagctccttacttattcgccatcagaggattcacacgggagaaaggccctatgagtgcaatgaatgtgggaaatccttcataaggagctcgagcctcattcgccattatcagatccacacagaagtgaaacagtatgaatgcaaagaatgtgggaaggcattccgtcatcgctcagaccttattgaacaccagagaattcacaccggagagagaccctttgaatgcaatgagtgtgggaaagcctttattcggagttcaaagctcattcagcatcagaggatccatactggggagaggccttacgtatgcaatgagtgtgggaagcgcttcagccagacgtcaaacttcacccagcatcagagaattcacactggagagaaactctatgaatgtaacgagtgtgggaaagctttctttctgagttcataccttattcgacaccagaaaatccacactggagagagagtgtatgaatgtaaggaatgtgggaaagcgtttctccagaaagcccatctcactgagcaccagaagatccactctggggacaggcccttcgaatgtaaagactgtgggaaagccttcatccagagctccaagctgcttctgcaccagattattcacactggagaaaagccctatgtgtgcagttattgtgggaaaggctttattcagaggtcaaacttccttcaacaccagaaaattcatactgaagagaagctctatgaatgtagtcagtatgggagagattttaactcaactacaaacgttaaaaataatcaaagggttcaccaagagggactctccttgagtaaggcccccatacatttgggtgagaggtctgtagataagggggaacacacaggtaacttataaaataattactttcccgcccagtgagtgatgtttggaaatgcgtggaattaggattcatgtggtttctaagatttggacatgtcagaattttgtgagtcatggatggggctgcttttgcagtgggtgccacctgccactgtgcagccctactcggctcagcccttctcctcagctgtgagcactgtcctcaggagagtcacagggcttgacacctgactctgagctggaacagtaggggcagggagaagacaggtctcaagaaaaggtttttaagaagtttcatccccagttaagcagagtccatccttgacttaaatcccttattacagcacaactgtgtatctaatcttacgatttaggagaatgttacctaggacattttgatgtgttaagttgaagaaaggtaactcgtgtatgaaccccgagccatttccctgttgtcctgaggaggaactccaggcctcccatcgtgtgccctaaggcctcctgcgtcctggagccctgcctcccactgcctgacttcctgccacacggttaatgctgcagcaacaccgactgcttcatcttccctgtgctccacgtggcttcctacctctctcgcctttgttcttgttgaagggtctcttctcagctaattaactctgaatcatggttcaagacaagcctcaggcatcatgtcaatgggtgtttccctcaagcttagttggcagcactctccacacttctgtggctcagtgattactgctattactatatttacttgcatatgtcagaatgatgtgatagactatctctgtcactatgctgttgggttcctgaggacagtgatcatatctgattgatttccatgtgtccactgtctagcacagggcaataaaaaatacacccctaaa

SEQ ID NO: 203259 - DNA, 6757 bp, Homo sapiens
  Payload ID: 20081
  Gene Name: zinc finger protein 623
  ENST ID: ENST00000633071
  CDS Start-End: 214-1824
gcaccacagaccagtctgtcctggtgttggatgttaaaagtggagccacaaagaagccatcttatgtgggacaggcttgggtgtgagaccagagctgtgggtagcagcatgttgggtcaggatgaggggcagaggaaacactttccacctcttggatatggattttatcctgccctgattcaggagatccccatctattaagtaaggggaaagatgattttgttgtcttttgtttcagattctaatgtaggaactggtgagaagaaggtgactgaagcctggatttctgaggatgaaaactcacataggacgacgtcagacagactcacggtgatggagctcccctctcccgagtctgaggaagtccacgagcccagattaggggagctcttgggaaatccagaaggtcagagcctggggagttccccctctcaggacaggggctgcaagcaggtgacagtgacccattggaagatccagacaggagagacagctcaagtgtgcaccaagtcaggaagaaaccatattctgaactcagaccttcttctgcttcagagagagctcatagagggggaagccaatccttgcgatatctgtggcaaaaccttcacgtttaattcggacctagttaggcatcggatttcgcatgctggggagaaaccttacacgtgcgatcagtgtgggaaaggctttggccagagctcacaccttatggagcatcagagaattcacactggagagagactctacgtctgtaatgtgtgtgggaaagacttcattcactattcaggtctcattgagcatcagcgcgttcattcaggagaaaagcccttcaaatgtgcgcagtgtgggaaggcgttttgtcacagttcagacctgattaggcaccagagagttcacaccagagagagaccttttgaatgcaaagagtgtgggaaaggcttcagtcagagctccttacttattcgccatcagaggattcacacgggagaaaggccctatgagtgcaatgaatgtgggaaatccttcataaggagctcgagcctcattcgccattatcagatccacacagaagtgaaacagtatgaatgcaaagaatgtgggaaggcattccgtcatcgctcagaccttattgaacaccagagaattcacaccggagagagaccctttgaatgcaatgagtgtgggaaagcctttattcggagttcaaagctcattcagcatcagaggatccatactggggagaggccttacgtatgcaatgagtgtgggaagcgcttcagccagacgtcaaacttcacccagcatcagagaattcacactggagagaaactctatgaatgtaacgagtgtgggaaagctttctttctgagttcataccttattcgacaccagaaaatccacactggagagagagtgtatgaatgtaaggaatgtgggaaagcgtttctccagaaagcccatctcactgagcaccagaagatccactctggggacaggcccttcgaatgtaaagactgtgggaaagccttcatccagagctccaagctgcttctgcaccagattattcacactggagaaaagccctatgtgtgcagttattgtgggaaaggctttattcagaggtcaaacttccttcaacaccagaaaattcatactgaagagaagctctatgaatgtagtcagtatgggagagattttaactcaactacaaacgttaaaaataatcaaagggttcaccaagagggactctccttgagtaaggcccccatacatttgggtgagaggtctgtagataagggggaacacacaggtaacttataaaataattactttcccgcccagtgagtgatgtttggaaatgcgtggaattaggattcatgtggtttctaagatttggacatgtcagaattttgtgagtcatggatggggctgcttttgcagtgggtgccacctgccactgtgcagccctactcggctcagcccttctcctcagctgtgagcactgtcctcaggagagtcacagggcttgacacctgactctgagctggaacagtaggggcagggagaagacaggtctcaagaaaaggtttttaagaagtttcatccccagttaagcagagtccatccttgacttaaatcccttattacagcacaactgtgtatctaatcttacgatttaggagaatgttacctaggacattttgatgtgttaagttgaagaaaggtaactcgtgtatgaaccccgagccatttccctgttgtcctgaggaggaactccaggcctcccatcgtgtgccctaaggcctcctgcgtcctggagccctgcctcccactgcctgacttcctgccacacggttaatgctgcagcaacaccgactgcttcatcttccctgtgctccacgtggcttcctacctctctcgcctttgttcttgttgaagggtctcttctcagctaattaactctgaatcatggttcaagacaagcctcaggcatcatgtcaatgggtgtttccctcaagcttagttggcagcactctccacacttctgtggctcagtgattactgctattactatatttacttgcatatgtcagaatgatgtgatagactatctctgtcactatgctgttgggttcctgaggacagtgatcatatctgattgatttccatgtgtccactgtctagcacagggcaataaaaaatacacccctaaatctatgtgtaattggcatctctcttgctttgtcctttctatactgccattctaaaaattttcagctgttggctgttttttttgttgtttgttcattttgtatcagtataatctacgattctgttagaagtatcttctcagccctgctactgtctgctgctcctacttagaagttgcaggcaatatcctgtgcacatccacgccctcctgtgtgccaccttacagctcatgcagaactgtctacttgatctggagggcattgacacctggctcagctggaacagtggggacaggaggaggcaggtctcaagagaaggtctttacttacttgtctgtatctttctgtctcactcgaaaggcacagtctcaatgcgctacgtaactcttctgttgtagcagttctgaggttgaactgagctcttgtcattttccatgctctctggctcattgtgtcatttcaaaatgtattgatatctataaggaatagtcctcaatgttgggaaaacagatgagcaacccactaccctgaagtcatccaccgtgtagtggggaagacggagatcacagtagggtgagttaagtatgtgccctcaggtgtgaaggagcacaggtgagggggtgcctgctgtggcacagagctgggaaggccttacagaagaggtgacatttcagctgggccagagatcagtagagagcagctgaagaagaaaatagggtccaggagaggaatctgcagaaacatggagccatgacagatggctttttggctaggactgttcgaaagcaggcgaggtaaatggacagtggacagccgcctcgccaaactgttagtctttacctctgaatttcatctggacatgaaccccaaagtccagttttgtaacgatataatttttttctcatgaggccatattttgagttcttaaatactaccaaccctgaacgtctcaggacaaataattcaaaaaagagatctacattttctggaaaatcagcattactagagatgtttcaaatgtagattttaccagaccattttaatcaactttattgagattcaattttcatatagtaaaacgcctatttaagtgtacaaggttttgaaaaatctatacacctgtgtaaccaccaccacctgtgtaaccaccaccgccagaaccaaaaacgtttctgtcacccaaagaagttcccttttgccttttcctagttaagcccactccagccccagataaccactttctatcctcatagattagtgttgcttggtttagagcctcatacaaatggattcatttactatgtgttcttttgcgtctgatgtctcactttggcatgtttttagactcatccaagctgttttgtgtttcagtagttctccttgctgaatagtattccattgtgtggataagccatcatttgtttattcatccacgtgttaatgggtttccagtctcggctcttaaaactatgagcatttgtgtaaaagtatgtatttgcacatgtgtttttatttctcttgggtaagtacctaggactttaattgctgtgttgtaagtgtcttagttcattcaggctgccataacaaaataccatcaactgggaggcttataaacaacagaaatttatgttttacagttctggaggctgggaagtccaagatgagggtgtcaacatttggtgtctagtgagggcctgcttccttttaagtagatgtctttttactgtgactgcacgtggtggaaagggactagcaagcttaccccattcatgagggctctccccttgtgattctgtcccctccccaagaccccacctcatatcatcttatgggttaggaatttgacatgaattgtgcaaggatgtaaacattcagtccattgcaatacgtgtttctaacttcctaagaaattgtcacacagccctctgtagtggttgaatcattttacactattactacattatgggaagattccagttgctccatatctttgctaacacttggcattgtcagtctcttaaaatttaatccactctagcctccttatgattttaatttgtatttgcccactgaataatgtatgtctatgatttcatctgcttattgcttttccgtgtcgtcttttgtgatgtgtctgttcgtgccttttgcctgtttttaagttgggatgcttattgttgactcaagttctttccatattctgcatgaaaaacatacatgtaatatatagaattctttgtctccatttgtgacaaatattgtgaatattttcatgtttggtttgcctgttcattttcttaatggtgtcttttgaatattttttattaagcctaatttatcaaagatttgggtgtggtggctcatgtctgtaatcccagcactttgggaggccaaggtaggcagatcacctgaggccagaagtttgagaccagcctggccaacgtggtgaaaccccgtctctactaaaaatacaaaaattatctgggcgggtggcacacccctgtagtccctgctactcgggaggctgaggcaggagaatcacttgaacccaggaggcagaggttgcagtaaaccaagataataataataatgatttatgatattttataataatttgagtttaagaaatttgcctactcaaaggacatgattttttcctatgttttttatttttatggaacttttatagttttaccttttacatttaagtctgtgatccattttgagttcatttttgtgtaccatatgtgataagggtcaagattcacttttttatctgtgtggttggttggttcggttctatttgttgagactctactttcccaatgaccaagtcttcacaggtttgtaaaaactgaagtgacatagaagtggtctgttctggacaccattcttcttgtgtgtataactttacaccaatatgacactatattgattactgtagttttatttgaggcagaaatctcattctgttgcccaggctggagcgtagtggcacaatcacagctaatgtaacctcgaacatccgggctcaagtgagcctctttccttagcctcccaagtagttgggactgtaggcatgcatcaccacatcttgctaattttttatatttttttgtagagatgggggtctcactatgttgaccaggctggtcttgaactcctggcctcaagggatcctcctgcctcagcctcccaaagggattacaggtgtgagccaccactcctggccaactgtagttgaactcaggtattggaagggcttccgttttgttcttttcccatttttttttttgacttctagatcctttgcattttcgtataaaatttgaagtcaacttctatcaacttcaggccaggcccgtggctcatgcctgtataatcccagcactttgggaggccgaggcaggcggatcacttgaggtcaggagttcaaaaccagcctggccaagatggtgaaaccccatctctactaaaaatacaaaaaaattagccaggcgtggtggcaggcgcctgtagaatcccagctactcgggaggctgaggcaggagaattgcttgaacctgggaggtggaggtttcagtgagctgagatcgtggcattgcactctagcctgggcaaccaagagtgaaactgtctcaaaaaacaacttttatcaatgtctgcaaaaagaaagtcttctgggatttatagatcaatttagggagaaatgacattttaacaattctgagttttccaattgttgaacatggtgtactgccccatttatttagatctgttaatttctctcagtttgcagctctcacattttgttaaattcatgtatttaatatttctgcatgctattgcaagtggtaaggttttcaaaaagctgttttctagttattgctagtatatagaaatgcattagacttgtacattgatcttgtatcaagcaacttagatcagttaacttattctagtagcttttttctagattctttagcattttctatgtagataatcatgtcatctgtgaataaagtattttacttttccaattt

SEQ ID NO: 203260 - DNA, 4241 bp, Homo sapiens
  Payload ID: 20082
  Gene Name: zinc finger protein 624
  Uniprot ID: Q9P2J8
  ENST ID: ENST00000311331
  CDS Start-End: 93-2690
gaggccggcaccgccgagccgccgccattgctggaagcgttcccgccctgctctgcgagttccctcagttgtcctcagttcggccgccaggtatgtctttgcaagactccactctttccagagaggggaaaccagagggagagattatggctgctgtgtttttctcagttggacgcctgagccctgaagttacccagccagatgaagatcttcaccttcaggcagaagaaacacaattggtaaaggaatcggtgacatttaaggatgtggctatagacttcacattggaggagtggaggttgatggaccctacacagaggaacctgcacaaggatgtgatgctagagaattacaggaatctggtctccctggggcttgcagtttccaaaccagacatgatatctcatttggagaatgggaaaggaccatgggtgacggtgagagaaatttcaagaattccctatcctgacatggagcccaaacctgcaaccaagaaggctacacgaacaaaggctatttctgaagatttatcacaggaggccatactagagaaacttacagagaatggtctgtgggattccagaatggaagggttatggaaatggaatgataggatattgagattacaaaataatcaggagaatcatttgagtcaaagaataattccactcaagaagactcccactagtcaaagaggctttagatttgaatctattcttattccagaaccaggcattgccacagaagagcttcacagcagatgccaaacacaagaggaaaatttcacagagaatttaaatttgattacagatacccatttggggaagataatttgcaaggagatgaaaggcagcaaagccataaggcagacttcagaactaactttggggaaaaaatccaataataaggaaaaaccctacaaatgtagtacatgcgaaaaggcctttcattatagatcattgctcattcaacatcaaagaactcatactaaagaaaaaccttatgaatgtaatgaatgtgggaaaacattcagccagccttcatatctcagtcagcacaaaaaaatccacactggagaaaaaccctataaatgtaatgaatgtggaaaggccttcattgcttcttcatcacttatggtacatcagagaattcacactaaagagaaaccttatcagtgtaatgtgtgtgggaaatcttttagccagtgtgcccgtcttaatcagcaccagagaattcaaactggagagaaaccctataaatgtagtgaatgcgggaaagcttttagtgataaatcaaaacttgcaagacatcaggaaactcacaatggtgagaaaccctacaaatgtgatgattgtgggaaagcctttaggaacaagtcatatcttagtgtacatcagaagacccacactgaagagaaaccatatcagtgcaacgagtgtgggaagtcttttaagaataccacaatttttaatgtgcatcagaggattcatactggagagaaaccttttagatgtaacgaatgtggaaaagcctatagaagtaattcaagccttatcgtacatataagaactcacactggggaaaaaccctatgaatgtaatgaatgtgggaaagcattcaaccgcatcgcaaatttcacagaacatcagcgaattcacacaggagaaaaaccctataaatgtaatgaatgtgggaaagcattcattaattattcatgccttactgtacaccacagaatgcatacaggagagaaaccttataaatgtactgaatgtggaaaggccttcatgcgttcttcttctctaattatacatcagcgtattcatactgaagagaaaccttatctgtgcaatgaatgtggggagtctttcagaataaaatcacacttaactgtacatcagagaattcacactggagagaaaccatataaatgtactgactgcgagagggcattcaccaaaatggtaaatctcaaggagcatcagaaaattcatactggagtgaaaccctataaatgttatgactgtggaaagtcctttaggactaaatcataccttattgtacatcagaggacccatactggagaaaaaccatataaatgtaatgaatgtgagaaagccttcactaatacatcacagcttaccgtgcaccaacgaaggcatactggagagaagccctataaatgcaatgaatgtggaaaggttttcacaagtaactcaggctttaatacacatcaaagaacacatactggagagaaaccatttaaatgtaatgactgtgggaaagcatttagccagatggtacatgtcacagaacatcagaaaatccatagtggagagaagccctataagtgtgatgtctgtggaaaagccttcaggaggggttcttaccttacagtgcattggagaacacacactggagaaaaaccctacacctgtaaggaatgtggaaagggttgtattactctatcacagctaaccctacatcagagaattcatactggggagaggccctataaatgtgaagaatgtggaaaagccttcagaactaactcagactttactgtacacttgaggatgcatactggagaaaaaccctataaatgtaatgaatgtggaaaagccttcaggagtagttcgagccttactgtacatcaaagaatacatcaaagagaaactcagttaatataaagaacaataagtcattcacctagatgtcaactccacaagatgaatcttataaactatattttatgaatataggaaaatcttcattaggaatttatcagaaagtatacagagaaactataagcaattatgtgggaaatcatttaataatattaaatcttagaagttataaggaaactctcactagaggaaaataatgaacaaatgaaagtgttcatccagatttcatactttactcatttaacaaattatctttagttaattgcctatatatgtatttgcctatttttctattcatttatctgtcttttcttataaacctggaggtgctttttatatatttttgatattaatcctttgtcattatgtagcagatgtttttcttaatctagcatttgtctttatactttatagtaatgcacaacatttttataggaaaatatttgtatcatttcctttttagattttttattttactcattttacttaaaagagatctccttaatccctaggttatacgtagtatcctaaatgtgtttttaagatttttatgattttattttttacacttaagtctttaatccctctggactggatggttcttcataggagagcaactgtaggtgatcattatcctgtgaaaatattttgaacctaaaaagcactcagggaaatgcaaattgaaatgctcagtgagatgaaacttccccttcatggatctggcaaaaattaagagatcttttgctagctattggggtttgggaaaccatgtactattacttaaaggttgtgtaacatacttccaccagcagtccaacaatatatgtttaaaaatttaaaacatatatactcttagacccagcagtctcacttttggaatctgtccgttagaaataaaagcagcatcaatgcataagaatgtaaataaacatgtttgttgaagtactgtttgtagaggggggcaaagccccaactgcaaacaaagtgaatgcccattaatagggaactggttagataaattgtgacatacccatattatggaacagtgtgagagtaattttaaaaacgacttatatctatgctagctgatttcaatgtatttccacaatgtattgataaataattgctttataacaaatgtatatatacaatatatcatttttgttaaaataatcacacccatttattttgtgtttatgtgtgtgtgtgtggttagatgcacatggagacaggtatggaagaatatacaccaggctgttaatattgattaccttgaggggagtgagaaaaggagaagtagagataagggaaggggagactgtaaaaacagaaaaatgtaaatgctgcctttatggtataaaactgtaaatgtaatattatgtaattatgtgaacttttgagagagatgaaaggatggtctccaaaaaattaatgatggttatttctgttttagtggttcatcaattttttgttttttactttcttttctgtgtttttaagttaattttttccttgcaatgaacctgtaatatttacattaaaaggaaaaatatt

SEQ ID NO: 203261 - DNA, 605 bp, Homo sapiens
  Payload ID: 20082
  Gene Name: zinc finger protein 624
  ENST ID: ENST00000423860
  CDS Start-End: 274-605
gagccgccgccattgctggaagcgttcccgccctgctctgcgagttccctcagttgtcctcagttcggccgccaggtactcgttgtcccgggcgcctggcctcggttgcccgccgcccctcccttggcgcttggctcccggcggcgtccggggcgtggccgttccctctagagcccctgtccctgagcggacccgcccactcctgagaggcgattggggctgggcctccttcccgagtgtgggttcagtctccagctggcctccctcacaggtatgtctttgcaagactccactctttccagagaggggaaaccagagggagagattatggctgctgtgtttttctcagttggacgcctgagccctgaagttacccagccagatgaagatcttcaccttcaggcagaagaaacacaattggtaaaggaatcggtgacatttaaggatgtggctatagacttcacattggaggagtggaggttgatggaccctacacagaggaacctgcacaaggatgtgatgctagagaattacaggaatctggtctccctggggcttgcagtttccaaaccagacatgatatctcatttggagaatgggaaagg

SEQ ID NO: 203262 - DNA, 548 bp, Homo sapiens
  Payload ID: 20082
  Gene Name: zinc finger protein 624
  ENST ID: ENST00000583766
  CDS Start-End: 173-548
ctggaggccggcaccgccgagccgccgccattgctggaagcgttcccgccctgctctgcgagttccctcaagcccctgtccctgagcggacccgcccactcctgagaggcgattggggctgggcctccttcccgagtgtgggttcagtctccagctggcctccctcacaggtatgtctttgcaagactccactctttccagagaggggaaaccagagggagagattatggctgctgtgtttttctcagttggacgcctgagccctgaagttacccagccagatgaagatcttcaccttcaggcagaagaaacacaattggtaaaggaatcggtgacatttaaggatgtggctatagacttcacattggaggagtggaggttgatggaccctacacagaggaacctgcacaaggatgtgatgctagagaattacaggaatctggtctccctggggcttgcagtttccaaaccagacatgatatctcatttggagaatgggaaaggaccatgggtgacggtgagagaaatttcaagaattccctatcctg

SEQ ID NO: 203263 - DNA, 1322 bp, Homo sapiens
  Payload ID: 20083
  Gene Name: zinc finger protein 625
  Uniprot ID: Q96I27
  ENST ID: ENST00000439556
  CDS Start-End: 172-1290
tttcctgactcccaggcgtcttgcaccaaagggaggtcgggatctcggttttccggccccgagagggaccaggtgcctccgccatagcttctgtcgctccatcgcccgcactgtgactggactgttagagggatccgtggagaggaggccaggacacctggaagccgggaaatggattcagtggtctttgaggatgtagatgtgaacttcacccaggaggagtgggctttgctggatccttcccagaagaatctctacagagatgtgatgcaggaaaccttcaggaacctggcttctgtaggaaaaaaatggaaagatcagaaaattgaagatgagtacaaaaatcccaggagaaacctaagaggtcttatgggagagagactcttagaaagtaagaaagatcatcagcatggagaaattttgacccaggttccagatgacatgctgaagaagaaaactccccgagtaaaatcatgtggagaagtcagcgtgggtcatgcatcccttaataggcaccacagagctgacactggacacaagccatatgagtatcaggaatatggacagaagccatataaatgtacatactgtaagaaagccttcagtgatctcccctactttcgaacacatgaatgggctcacactggggggaaaccttatgattgtgaggaatgtggaaaaagctttatttcccgttcaagcattcgaagacacaggataatgcacagtggagatggaccctacaaatgtaacttttgtgggaaagccttgatgtgtctcagtttgtatcttatccacaaacgaactcacactggagagaaaccatatgaatgtaaacagtgtggtaaagcctttagtcattctggtagccttcgaatacatgaaagaactcacactggagagaagccttatgaatgcagtgagtgtgggaaagcattccatagttccacatgcctccatgcacataaaataactcacactggggagaagccgtatgaatgtaaacagtgtgggaaagcctttgtttctttcaattccgttcgatatcatgaaagaactcacactggagagaagccctatgaatgtaagcaatgtgggaaagccttcagatctgcctcgcaccttcgaacacatggaaggactcacactggagagaaaccctatgaatgtaaacaatgtggtaaagcctttggatgtgcctcgagcgttaaaatccatgaaaggactcacactggagaaaaaccctgtagctccaacacttcgaaaggccaaggcgagaagattgcttaattcacataagattcctagaagccaccgaatcc

SEQ ID NO: 203264 - DNA, 1678 bp, Homo sapiens
  Payload ID: 20083
  Gene Name: zinc finger protein 625
  ENST ID: ENST00000455799
  CDS Start-End: 157-342
gcgtcttgcaccaaagggaggtcgggatctcggttttccggccccgagagggaccaggtgcctccgccatagcttctgtcgctccatcgcccgcactgtgactggactgttagagggatccgtggagaggaggccaggacacctggaagccgggaaatggattcagtggtctttgaggatgtagatgtgaacttcacccaggaggagtgggctttgctggatccttcccagaagaatctctacagagatgtgatgcaggaaaccttcaggaacctggcttctgaaaaaaatggaaagatcagaaaattgaagatgagtacaaaaatcccaggagaaacctaagaggtcttatgggagagagactcttagaaagtaagaaagatcatcagcatggagaaattttgacccaggttccagatgacatgctgaagaagaaaactccccgagtaaaatcatgtggagaagtcagcgtgggtcatgcatcccttaataggcaccacagagctgacactggacacaagccatatgagtatcaggaatatggacagaagccatataaatgtacatactgtaagaaagccttcagtgatctcccctactttcgaacacatgaatgggctcacactggggggaaaccttatgattgtgaggaatgtggaaaaagctttatttcccgttcaagcattcgaagacacaggataatgcacagtggagatggaccctacaaatgtaacttttgtgggaaagccttgatgtgtctcagtttgtatcttatccacaaacgaactcacactggagagaaaccatatgaatgtaaacagtgtggtaaagcctttagtcattctggtagccttcgaatacatgaaagaactcacactggagagaagccttatgaatgcagtgagtgtgggaaagcattccatagttccacatgcctccatgcacataaaataactcacactggggagaagccgtatgaatgtaaacagtgtgggaaagcctttgtttctttcaattccgttcgatatcatgaaagaactcacactggagagaagccctatgaatgtaagcaatgtgggaaagccttcagatctgcctcgcaccttcgaacacatggaaggactcacactggagagaaaccctatgaatgtaaacaatgtggtaaagcctttggatgtgcctcgagcgttaaaatccatgaaaggactcacactggagaaaaaccctgtagctccaacacttcgaaaggccaaggcgagaagattgcttaattcacataagattcctagaagccaccgaatccaatcatggtaaaaatgtgtttccctcaaatcatgggaaccatcgcaaaattattctgaagcttctgcagtcactgtcatttgacagcattcagaaataaatgccagtagcccaggagcaaaaatttttgggagtagtttagctggggcctcactcagatacctaggacacagagttggaaataactcttaagagagacacacctccagtaagaccttaagacagttctgtcataaaaaaaatacgaggtttggccgggtgcagtggctcatgcctataatcccagcactttgggaggccgaggcaggcggaccacgaggtcagtagttcgagaccagcctggtcaatatggtgaaaccccatctctactaaaaaa

SEQ ID NO: 203265 - DNA, 695 bp, Homo sapiens
  Payload ID: 20083
  Gene Name: zinc finger protein 625
  ENST ID: ENST00000414892
  CDS Start-End: 1-315
gattcagtggtctttgaggatgtagatgtgaacttcacccaggaggagtgggctttgctggatccttcccagaagaatctctacagagatgtgatgcaggaaaccttcaggaacctggcttctgtaggaaaaaaatggaaagatcagaaaattgaagatgagtacaaaaatcccaggagaaacctaagtcttagaaagtggagttggtcgctgtacgcaagacagacattggggctggactcaccatcagtggccccgaaaagaactcatgggcagatgaacccatccacaaactcccctgccacatccagatgatgcttagtgaaaagaaacaccttgttccaaaagcagaaaaggaggatgcacggaagaaaaagataccccagaagaaacataaacttaagagacaaacaaattcagccaaaagaaaatgcaaataaaagttcaaaacaaaacaaaacaaaaaaacctctaaaattcataaaacacaaaatgacaaactctattaaatatgcccctatgatatctcttagataaaagttggccgtaatagagaaaatgaagataggtgttggtgactggcagattctgggtctacgatgaatcagagaaggatggttttcactttgttttacatttttttaatgcttgatgttgacttggtagaaagatgataataaagagattcttctgtc

SEQ ID NO: 203266 - DNA, 1123 bp, Homo sapiens
  Payload ID: 20084
  Gene Name: zinc finger protein 626
  Uniprot ID: Q68DY1
  ENST ID: ENST00000291750
  CDS Start-End: 151-429
ggtttccgggtttggtgcggcctttgtctctcgctgcagtcagagctccaggtctggttcttctcctaaaggcccaggctgtgtggccccgtgtcctgcaggtattgggagatccacagctaagacaccgggacctcctggaagccaaaaatgggaccattgcaatttagagatgtggccatagaattctctctggaggagtggcattgcctggacactgcacagcggaatttatataggaatgtgatgttagagaactacagtaacctggtcttccttggtattactgtttctaagccagacctgatcacctgtctggagcaaggaagaaaacctttgaccatgaagagaaatgagatgatagccaaaccctcagtgagcttccttcaagttcacagtgagagccaaagtcctcttcatgacatataagagactgcacagtgtggctgcttttccataatttttgggacgcacaaatgtctgcatgattttgagaaactaaaattactctcaaagttctctttgcatcagatctgaaatgtctgagagtaatagtttctgttgaatttttttttgttcatttttctgcacagtccattctgtttttattactatctaggcttgaaatatatagtttgaaattatgacatccttcctctttgttattttcctcatgattgctttggctattcaaagtttattttagtttcatgtaaatttttgaattgtattttccattattgtgaaaatagtaccactgcaattttaataggaagtttattgaatctatagattactttggataatatggcacttcaataatattcatgttttcaattcatagacaaaatattttaaaatttatttgtatcttttctaacttttcctttttttattgtaaagatttacctccttggttaatattttcctcagaaatttattatttaaggtatagtcaataaaattttcttcctctattttgtcagatagtttaagtgtatgaaaccatagatatacttgtatgttaattttatattttgctaatttactgagtgtatttattagtttagagaggttttaatgtactgtttatggttttttaaatataagattacttattttt

SEQ ID NO: 203267 - DNA, 501 bp, Homo sapiens
  Payload ID: 20084
  Gene Name: zinc finger protein 626
  ENST ID: ENST00000595405
  CDS Start-End: 97-501
cttctcctaaaggcccaggctgtgtggccccgtgtcctgcaggtattgggagatccacagctaagacaccgggacctcctggaagccaaaaatgtaatgtgttctcattttgcccaagacctttggccagagcagagcatgaaagattctttccaaaaagtggtactgagaagatatgaaaaatgtgaacatgacaatttacagttaaaaaaaggatgtataagtgtggatgagtgtaaggtgcacaaagaaggttataatgaacttaaccaatgtttgacaactaccccaagaaaaatatgtcaatgtgataaatatgtgaaagtccttcatcaatttccaaattcaaacggacaaaagagaggacatactgggaaaaaacctttcaaatatatagaatgtggcaaagcttttaagcagttctcaactcttactacacataagaaaattcatactggagggaaaccctacaaatgtgaagaatgtggcaaagcctttaac

SEQ ID NO: 203268 - DNA, 5963 bp, Homo sapiens
  Payload ID: 20084
  Gene Name: zinc finger protein 626
  Uniprot ID: Q68DY1
  ENST ID: ENST00000601440
  CDS Start-End: 148-1734
ttccgggtttggtgcggcctttgtctctcgctgcagtcagagctccaggtctggttcttctcctaaaggcccaggctgtgtggccccgtgtcctgcaggtattgggagatccacagctaagacaccgggacctcctggaagccaaaaatgggaccattgcaatttagagatgtggccatagaattctctctggaggagtggcattgcctggacactgcacagcggaatttatataggaatgtgatgttagagaactacagtaacctggtcttccttggtattactgtttctaagccagacctgatcacctgtctggagcaaggaagaaaacctttgaccatgaagagaaatgagatgatagccaaaccctcagtaatgtgttctcattttgcccaagacctttggccagagcagagcatgaaagattctttccaaaaagtggtactgagaagatatgaaaaatgtgaacatgacaatttacagttaaaaaaaggatgtataagtgtggatgagtgtaaggtgcacaaagaaggttataatgaacttaaccaatgtttgacaactaccccaagaaaaatatgtcaatgtgataaatatgtgaaagtccttcatcaatttccaaattcaaacggacaaaagagaggacatactgggaaaaaacctttcaaatatatagaatgtggcaaagcttttaagcagttctcaactcttactacacataagaaaattcatactggagggaaaccctacaaatgtgaagaatgtggcaaagcctttaaccactcttgtagccttactagacataagaaaattcatactggagagaaaccctacaaatgtgaagaatgtggcaaagcctttaagcactcctccactcttactacacataagagaaatcatactggagagaaaccctacaagtgtgataaatgtggcaaagcctttatgtcatcctcaacccttagtaaacatgagataattcatacggaaaagaaaccctacaaatgtgaagaatgtggcaaagccttcaaccggtcctcaacccttactacacataagataattcatactggagaaaaaccctacaaatgtgaagaatgtgacaaagcctttaagtactcctatacccttactacacataaaagaattcatactgaagacaaaccctacaaatgtgaagaatgtggcaaagcctttaagtactcctctacccttactacacataagagaattcatactggagagaaaccctacaaatgtgaagaatgtggcaaagccttcaagcggtcttcagaccttactacgcataagataattcatactggagagaaaccctacaaatgtgaagaatgtggcaaagcttttaagtactcctctaaccttactacacataagaaaattcatactggagagagaccctacaaatgtgaagaatgtggcaaagccttcaaccagtcctcaatccttactacacataggagaattcatactggagagaaattctacaaatgtgaagaatgtggcaaagcttttaagtgctcctctaaccttactacacataagaaaattcatactggagagagaccctacaaatgtgaagaatgtggcaaagccttcaaccagtcctcaatccttactacacatgagagaatcatactggagagaaattctacaaatgtgaagaatgtggcaaagccttcaagcggtcctcacaccttactacacataagataattcatactggagagaaattctacaaatgtgaagaatgtgacaaagcttttaagcatttctctaaccttactacacataagaaaattcatactggaaaaaaaccctacagatgtgaagaatgtggcaaagcctttaagcactcctctaaacttactacacataagagatttcatactggagagaaaccctacagatgtgaataatgtggtaaagcttttcacctatcctcacaccttactgcacataagataattcatactggagagaaaccatgtgaatgtgatgaatggggaaaatcttttaaccagccctcaatttctaactaagaattgatatgaaatataaactctacaaatataaagaatgtgacagattttttaaggaacttctcaacctttattacacataattcatactggaaagaaaccctacaagtgtgaagaatgtggcaaagcatataacaagttctgtctttttttttttttttttgagatggagtttcaactcttgtcacccagtctggtgtgcaatagcacagtctcggctcactgcaacctccgccttctgggttcaatccattctcctgcctcaacctcccaagtaagggggattacaggtgcccacccccatgcccagctaacttttgtatttttagtagagacaaggttacaccatgtttgtcaggctggtatccaacccctgacctcacatgatccacccacctcagcctcctaaagtgttgcaattacaggcatgagccaccatgcctggccacaagttcttactattaagagacatggtgataattcattctgaagaggaactctacaaacctgaaagatgtgacagtgcttttttcaacacttccatcctttctatacataaaaaatttatactagtgtgaaaccctagaaatatataaaatgtgaaacagcctttatatggttgccacatttgatagtaagataattcatactggcaaaattcctacaagcatgaagaatgtggcaaaacctttaatcaatgtgtacatcttattttgcaggaaagctattatccttgagaaaaattgtacaaatataaagaatatggaaaacccattaatgcctactcacatcttactcaacataagaaggttcatagttaatgaaagcattaaaagtgcaattactgtcaaaaaatctttcagaaaatataagcctttaaagtgaagaagagtatttattctgaagacaaccattacaaatatacaggaggtttattacacacattttgtactagaggaaaatcctgaagcagttgctcaagctttgctcaacatcagagaacttatattggagaagggtcctgcaaatgtaatgaatttggaaacactttaaaaaaaaaaaactacagcttagaaaacagcagagtttatactaaaatatatttttgcagatgcagtaaacatgaaaaaatatttaattcaaaattaattgtatgtaaatatcagaatttacagaataactaaggcactgacacttcagacattacattaaataagagtgttgagtatataaatgaattcacaactaaagttgttaaatttgtatataagtttgtataaattagtatataactttaaaaggagattttttgaagctttgtatttacattgaaagtatatttgtttccttgaaaacaatttttttgaaaagtgaatgatgtaatacagctttcaaattatgctgttactttattatattcacgtgaaagtatgtgatcaattgttgctgcatcagagatattagagattctttatgagttgggcattctttatgaccttttctataaaacagtaaggacattaaaatgtaagatgcatgacgaaaatataagtggagaggctcattgtagttaacctatattaagtaatgtttaaggtaggtgttcagagtaatacttttctacattatactgagagaaagaaattataaattaaagtatatcaattattttactaattttactgttacgtaataaaatgcaatatatttaaaaattgttagatgatgtgtgaacttaacttatattttatttacttacttaacttttcttttgagatggagtcttgctctgtcacccaggctggagggcagcagtgcagtctcagcacaatgactgcaacctccacctcccaagttcaagaaattctcctgcctcagcctcccgagtagtggggactacaggtgcgtgacaccacgcctggctaatttttatatttttaatagacatggggtttccccatattggtcaggctagtctcaaactcctgagctcaagcgatccacccacctcaggctctcaaagtgttgggattataggtgtgagccaatatgtccagcctaattttattttattttttaccatcttaaaactattgtgcatttaatgaagcattattatgccactaactttaacctatccggccttactcaaatggtgtaagcaaaagatggaagaagtatactatttggtatgtagtggaatgtcatcactagtaatcactttgccagtaaactgcaaatgaagaatattgttcccgttagttaaatttttaatcttttttcttaatttattattactatctgtgagtatatagtatgtgtatatatgtcttatagagaatattttgattcaggcatacaatatgtagtaattacattagggtaaataaggtatctgtcacctctagcatttatcctttctaatccaaacagtgtaattatacacttttagttacttttaaatgtccaattaaattgtaattgactacagggtgatttttatggtcataataaaaattatacagaaatataaatagaatatgggctggacgcagtggctcatgcctgtaatcccagcactttggtaggcgacgtcgggcagatcatgaggtcaggagttcaagaccagcctgaccaacattgtgaaactctctactaaaacaacaaaaattagttgggcatggtggtgcacccgtattcctagctactcgggaagctgaggcaggagaatggcttgaacctgggaggtggaggtttcagtgagctgagatagcaccactgcactccagcctgggtgacagacggacactccatctcaaaaagaaagaaaaaagccaggacagtggcttacacctgtaatcccagcactttgggaggcccaggcaggtggatcatgaggtcaggagatcaagaccatcctggctaacacgttgaaaccctgtctctactaaaaataaattagctgggcgtggtggtgggcgcctgtagtcccagctactccagaggctgaggcgggagaatggtgtaacccaggaggcagaggttgcagtgagccgagatcgtgccactgcactccagcctgggcaacagagcaagactccgtcacaaaaaaaaaaagaaaaaatacggccatgtgcagtgcctcatgcctattatcccagcaatttcggaggctgaggcaggtgtgttgcttgagctcaggagttcaagaccagcctcgccaatgtggtgaaaccctgtctctactaaaaatagaaaaattagccagtcatggtggcgcacacctggaggctgaggtaggagaatcacttgaacttgggaggtggagattgcagtgagccaagattgtgctgctgcactccagcctgggtgacagagtgatgagactcctcaaaggaaaaaaaattacatttctgagtcctgaaaaattattaataaatatttgttatatagtttctttgaacatgtggtcactctgcctgcaaacgtaaagacttttaattttcatagagtgaaatatacacatattcctctgaagataaaccttaggtgtaagaaaattatgaaatgagtgtttggtaaatatgcatttgtacatattttcagaagaaaacgcaattattggaacaaaataagtttttaggtgattaatggaaaactaaacaccttgaatatgctgaaagcaaatgtatactttctgctttgtatggaatttattaatataaaattttatggcttatggctcggattctccccagaatccgtgtattaaagcacaggcaactttgtctccagaaataacactcttgagtacaacaataaaagccctcttcaaacacactcaaaaaattatttttaacgcttattttaataaaaatttaaccaaaattgaataattggata

SEQ ID NO: 203269 - DNA, 4404 bp, Homo sapiens
  Payload ID: 20084
  Gene Name: zinc finger protein 626
  ENST ID: ENST00000612591
  CDS Start-End: 62-1684
cgtgtcctgcaggtattgggagatccacagctaagacaccgggacctcctggaagccaaaaatgggaccattgcaatttagagatgtggccatagaattctctctggaggagtggcattgcctggacactgcacagcggaatttatataggaatgtgatgttagagaactacagtaacctggtcttccttggtattactgtttctaagccagacctgatcacctgtctggagcaaggaagaaaacctttgaccatgaagagaaatgagatgatagccaaaccctcagtaatgtgttctcattttgcccaagacctttggccagagcagagcatgaaagattctttccaaaaagtggtactgagaagatatgaaaaatgtgaacatgacaatttacagttaaaaaaaggatgtataagtgtggatgagtgtaaggtgcacaaagaaggttataatgaacttaaccaatgtttgacaactaccccaagaaaaatatgtcaatgtgataaatatgtgaaagtccttcatcaatttccaaattcaaacggacaaaagagaggacatactgggaaaaaacctttcaaatatatagaatgtggcaaagcttttaagcagttctcaactcttactacacataagaaaattcatactggagggaaaccctacaaatgtgaagaatgtggcaaagcctttaaccactcttgtagccttactagacataagaaaattcatactggagagaaaccctacaaatgtgaagaatgtggcaaagcctttaagcactcctccactcttactacacataagagaaatcatactggagagaaaccctacaagtgtgataaatgtggcaaagcctttatgtcatcctcaacccttagtaaacatgagataattcatacggaaaagaaaccctacaaatgtgaagaatgtggcaaagccttcaaccggtcctcaacccttactacacataagataattcatactggagaaaaaccctacaaatgtgaagaatgtgacaaagcctttaagtactcctatacccttactacacataaaagaattcatactgaagacaaaccctacaaatgtgaagaatgtggcaaagcctttaagtactcctctacccttactacacataagagaattcatactggagagaaaccctacaaatgtgaagaatgtggcaaagccttcaagcggtcttcagaccttactacgcataagataattcatactggagagaaaccctacaaatgtgaagaatgtggcaaagcttttaagtactcctctaaccttactacacataagaaaattcatactggagagagaccctacaaatgtgaagaatgtggcaaagccttcaaccagtcctcaatccttactacacataggagaattcatactggagagaaattctacaaatgtgaagaatgtggcaaagccttcaagcggtcctcacaccttactacacataagataattcatactggagagaaattctacaaatgtgaagaatgtgacaaagcttttaagcatttctctaaccttactacacataagaaaattcatactggaaaaaaaccctacagatgtgaagaatgtggcaaagcctttaagcactcctctaaacttactacacataagagatttcatactggagagaaaccctacagatgtgaataatgtggtaaagcttttcacctatcctcacaccttactgcacataagataattcatactggagagaaaccatgtgaatgtgatgaatggggaaaatcttttaaccagccctcaatttctaactaagaattgatatgaaatataaactctacaaatataaagaatgtgacagattttttaaggaacttctcaacctttattacacataattcatactggaaagaaaccctacaagtgtgaagaatgtggcaaagcatataacaagttctgtctttttttttttttttttgagatggagtttcaactcttgtcacccagtctggtgtgcaatagcacagtctcggctcactgcaacctccgccttctgggttcaatccattctcctgcctcaacctcccaagtaagggggattacaggtgcccacccccatgcccagctaacttttgtatttttagtagagacaaggttacaccatgtttgtcaggctggtatccaacccctgacctcacatgatccacccacctcagcctcctaaagtgttgcaattacaggcatgagccaccatgcctggccacaagttcttactattaagagacatggtgataattcattctgaagaggaactctacaaacctgaaagatgtgacagtgcttttttcaacacttccatcctttctatacataaaaaatttatactagtgtgaaaccctagaaatatataaaatgtgaaacagcctttatatggttgccacatttgatagtaagataattcatactggcaaaattcctacaagcatgaagaatgtggcaaaacctttaatcaatgtgtacatcttattttgcaggaaagctattatccttgagaaaaattgtacaaatataaagaatatggaaaacccattaatgcctactcacatcttactcaacataagaaggttcatagttaatgaaagcattaaaagtgcaattactgtcaaaaaatctttcagaaaatataagcctttaaagtgaagaagagtatttattctgaagacaaccattacaaatatacaggaggtttattacacacattttgtactagaggaaaatcctgaagcagttgctcaagctttgctcaacatcagagaacttatattggagaagggtcctgcaaatgtaatgaatttggaaacactttaaaaaaaaaaaactacagcttagaaaacagcagagtttatactaaaatatatttttgcagatgcagtaaacatgaaaaaatatttaattcaaaattaattgtatgtaaatatcagaatttacagaataactaaggcactgacacttcagacattacattaaataagagtgttgagtatataaatgaattcacaactaaagttgttaaatttgtatataagtttgtataaattagtatataactttaaaaggagattttttgaagctttgtatttacattgaaagtatatttgtttccttgaaaacaatttttttgaaaagtgaatgatgtaatacagctttcaaattatgctgttactttattatattcacgtgaaagtatgtgatcaattgttgctgcatcagagatattagagattctttatgagttgggcattctttatgaccttttctataaaacagtaaggacattaaaatgtaagatgcatgacgaaaatataagtggagaggctcattgtagttaacctatattaagtaatgtttaaggtaggtgttcagagtaatacttttctacattatactgagagaaagaaattataaattaaagtatatcaattattttactaattttactgttacgtaataaaatgcaatatatttaaaaattgttagatgatgtgtgaacttaacttatattttatttacttacttaacttttcttttgagatggagtcttgctctgtcacccaggctggagggcagcagtgcagtctcagcacaatgactgcaacctccacctcccaagttcaagaaattctcctgcctcagcctcccgagtagtggggactacaggtgcgtgacaccacgcctggctaatttttatatttttaatagacatggggtttccccatattggtcaggctagtctcaaactcctgagctcaagcgatccacccacctcaggctctcaaagtgttgggattataggtgtgagccaatatgtccagcctaattttattttattttttaccatcttaaaactattgtgcatttaatgaagcattattatgccactaactttaacctatccggccttactcaaatggtgtaagcaaaagatggaagaagtatactatttggtatgtagtggaatgtcatcactagtaatcactttgccagtaaactgcaaatgaagaatattgttcccgttagttaaatttttaatcttttttcttaatttattattactatctgtgagtatatagtatgtgtatatatgtcttatagagaatattttgattcaggcatacaatatgtagtaattacattagggtaaataaggtatctgtcacctctagcatttatcctttctaatccaaacagtgtaattatacacttttagttacttttaaatgtccaattaaattgtaattgactacagggtgatttttatggtcataataaaaattatacagaaatataaatagaatatgggctggacgcagtggctcatgcctgtaatcccagcactttggtaggcgacgtcg

SEQ ID NO: 203270 - DNA, 2840 bp, Homo sapiens
  Payload ID: 20085
  Gene Name: zinc finger protein 627
  Uniprot ID: Q7L945
  ENST ID: ENST00000361113
  CDS Start-End: 209-1594
aactgtccattcagatgggcccgggagaggagggcagggcctgcgcctccctacggagcctttgtttctggcgaccgtccccacccgggctcgcgtctccgtttctccgagaggcccaaggtgtctccgccgcagcctctgtcgcgccgtgacctgtacaggtcgcgggagtcgtagggaggacgccgggacacctggaagccgagaaatggattcagtggcctttgaggatgtggctgtgaacttcaccctggaggagtgggctttgctggatccttcccagaagaatctctacagggatgtgatgcgggaaaccttcaggaacctggcttctgtaggaaaacaatgggaagaccagaacattgaagacccattcaaaattcccaggagaaatataagtcatattccagagagactctgtgaaagtaaagaaggtggtcaaggtgaagaaaccttcagccagattccagatggtattctgaacaagaaaactcctggagtaaaaccgtgtgaaagcagtgtgtgtggagaagttggcatgggtccttcatcacttaataggcacatcagagatcacactggacgtgaaccaaatgaatatcaggaatatggaaagaagtcatatacacgtaaccagtgtggacgagccttgagttatcatcgctcttttccagtacgtgaaaggactcatcctggaggaaagccctatgattgtaaggaatgtggagaaacctttatttctcttgtaagcattcgaagacacatgttaacgcataggggaggtgtaccttacaaatgtaaggtgtgtgggaaagcctttgattatcccagtttatttcgtatacatgaaagaagtcacactggagagaaaccttatgaatgcaagcaatgtgggaaagccttcagttgttccagttacattagaatacatgaaaggactcacactggagataaaccctatgaatgcaagcagtgtgggaaagctttcagttgttccaagtacattcgaatccatgaacgaactcacacaggagagaaaccctacgaatgtaaacagtgcggtaaagcctttaggtgcgccagttctgttcgaagtcacgagaggactcacaccggagagaaactttttgaatgtaaggaatgcgggaaggctttgacttgtcttgcaagtgttagaagacacatgataaagcacactggcaatggaccttataaatgtaaggtgtgtgggaaagcctttgatttccccagttcatttcgaatccatgaaaggacccacactggagagaaaccctatgattgtaagcaatgtgggaaagccttcagttgttccagttcgtttcgaaaacatgaaagaattcacactggagagaaaccctataaatgtacaaaatgtgggaaagccttcagtcgttccagttacttccgaatccatgaaagaactcacactggagagaaaccctatgaatgtaagcaatgtgggaaagccttcagtcgatccacttactttcgagtacatgaaaaaattcatactggagagaaaccctatgagaaccctaaccctaacgcttcagttgtcccagttctttcatgagcatgaaaggagtcacatagagaaaccccatgaaagtaagaaatttgggaaagccttcagtcctttctgtttctttcaactacgtgaaaggattcacagtggagaaagaccctgtaagataattggctttaaattacgagagacttgtgataggacagtaaaacctagagttggagttggatctctggattgtgttatgtcagtgttggtaggttaggaactagatttcccagaatccattccatttgtgattccatgatacaattcaccagtaacctatcttacatgagattcggaagtaagttaagaaggcattagtcatggtttggaagcaccatacagggagacagctgtgtgaatacaggctgtatggacacttgcttccatcccattttcctgcttctttgggttgccaatcaagagtatcctcaaaacgacttgactttaattttctcggaggtgataggcttccacacaggtctccagaagccctgcattgaatatccatccacactttggttttccttcagacattattatgtctgtactaggcaactaattcagactgtcctggttgggaatattctgtgatgctctgactcccctagtctgtagacggaattggcatacggtctaatttgtgtagtaagcacctttgttcatactagtagtgactgtattcttgattcagcctgatagctaccatgctgctgtcaaaaccaaccagaggggagcttgttcttctgctgtagtgtgcagtgactggcctcacccaggactttgatgtgagaatgagcactttcctctatcaggaaatttcaagtgtttcctgttattcgtagctcaatgtaatgcctcagttcattttcagttgtttgattatatgtgactaatatgtattttttattcaaacaagacttctgtacatgtttcttcaaaacagtttattaactgtcttcagtcttggattacatcaagtttataattttggcaaattgttaagacactgtgaagtcagcgttaaccatgtgcatacaacttaaggaattttttcctcctcatgtaaattttacttttcatgcttatatagtttcaacttttatcttcatagtaatttctcatctactcataataccaaaagttaagtcatgctgttttgtgtgctctcttgctaaagaccgcagagaccatacctgttgtcaaagagggtgtaataaactgtaataataatcatgaccacaaacca

SEQ ID NO: 203271 - DNA, 541 bp, Homo sapiens
  Payload ID: 20085
  Gene Name: zinc finger protein 627
  ENST ID: ENST00000585493
  CDS Start-End: 491-541
agtttccaggagcggcaagtgaggaatatgaaataaccttatggctgaatcagggtgaaggggaagcttgtaagcatggaagacgctctactcaaactaaaaagttcaagttctgatccagcagatgaagagggaggcctgagaggctgctgttctaactcgctcccagagacggggccttactctgctgcctaggctggagtacagtggcacaatcatagctgattgcagcctcaaactcctgggctcaagcgaaactcccacgtcagcctcctgagtacctgggactacaggtactgaggatggaggacaaggggtcagtggagacccagctttgagcagagccctgcctaaggtccagggctcgatctggccctaaccacagagtcaccttgaggattcagtggcctttgaggatgtggctgtgaacttcaccctggaggagtgggctttgctggatccttcccagaagaatctctacagggatgtgatgcgggaaaccttcaggaacctggcttctgtaggaaaacaatgggaagac

SEQ ID NO: 203272 - DNA, 2755 bp, Homo sapiens
  Payload ID: 20085
  Gene Name: zinc finger protein 627
  ENST ID: ENST00000588174
  CDS Start-End: 146-349
gtttctggcgaccgtccccacccgggctcgcgtctccgtttctccgagaggcccaaggtgtctccgccgcagcctctgtcgcgccgtgacctgtacaggtcgcgggagtcgtagggaggacgccgggacacctggaagccgagaaatggattcagtggcctttgaggatgtggctgtgaacttcaccctggaggagtgggctttgctggatccttcccagaagaatctctacagggatgtgatgcgggaaaccttcaggaacctggcttctgtaggaaaacaatgggaagaccagaacattgaagacccattcaaaattcccaggagaaatataagagagactctgtgaaagtaaagaaggtggtcaaggtgaagaaaccttcagccagattccagatggtattctgaacaagaaaactcctggagtaaaaccgtgtgaaagcagtgtgtgtggagaagttggcatgggtccttcatcacttaataggcacatcagagatcacactggacgtgaaccaaatgaatatcaggaatatggaaagaagtcatatacacgtaaccagtgtggacgagccttgagttatcatcgctcttttccagtacgtgaaaggactcatcctggaggaaagccctatgattgtaaggaatgtggagaaacctttatttctcttgtaagcattcgaagacacatgttaacgcataggggaggtgtaccttacaaatgtaaggtgtgtgggaaagcctttgattatcccagtttatttcgtatacatgaaagaagtcacactggagagaaaccttatgaatgcaagcaatgtgggaaagccttcagttgttccagttacattagaatacatgaaaggactcacactggagataaaccctatgaatgcaagcagtgtgggaaagctttcagttgttccaagtacattcgaatccatgaacgaactcacacaggagagaaaccctacgaatgtaaacagtgcggtaaagcctttaggtgcgccagttctgttcgaagtcacgagaggactcacaccggagagaaactttttgaatgtaaggaatgcgggaaggctttgacttgtcttgcaagtgttagaagacacatgataaagcacactggcaatggaccttataaatgtaaggtgtgtgggaaagcctttgatttccccagttcatttcgaatccatgaaaggacccacactggagagaaaccctatgattgtaagcaatgtgggaaagccttcagttgttccagttcgtttcgaaaacatgaaagaattcacactggagagaaaccctataaatgtacaaaatgtgggaaagccttcagtcgttccagttacttccgaatccatgaaagaactcacactggagagaaaccctatgaatgtaagcaatgtgggaaagccttcagtcgatccacttactttcgagtacatgaaaaaattcatactggagagaaaccctatgagaaccctaaccctaacgcttcagttgtcccagttctttcatgagcatgaaaggagtcacatagagaaaccccatgaaagtaagaaatttgggaaagccttcagtcctttctgtttctttcaactacgtgaaaggattcacagtggagaaagaccctgtaagataattggctttaaattacgagagacttgtgataggacagtaaaacctagagttggagttggatctctggattgtgttatgtcagtgttggtaggttaggaactagatttcccagaatccattccatttgtgattccatgatacaattcaccagtaacctatcttacatgagattcggaagtaagttaagaaggcattagtcatggtttggaagcaccatacagggagacagctgtgtgaatacaggctgtatggacacttgcttccatcccattttcctgcttctttgggttgccaatcaagagtatcctcaaaacgacttgactttaattttctcggaggtgataggcttccacacaggtctccagaagccctgcattgaatatccatccacactttggttttccttcagacattattatgtctgtactaggcaactaattcagactgtcctggttgggaatattctgtgatgctctgactcccctagtctgtagacggaattggcatacggtctaatttgtgtagtaagcacctttgttcatactagtagtgactgtattcttgattcagcctgatagctaccatgctgctgtcaaaaccaaccagaggggagcttgttcttctgctgtagtgtgcagtgactggcctcacccaggactttgatgtgagaatgagcactttcctctatcaggaaatttcaagtgtttcctgttattcgtagctcaatgtaatgcctcagttcattttcagttgtttgattatatgtgactaatatgtattttttattcaaacaagacttctgtacatgtttcttcaaaacagtttattaactgtcttcagtcttggattacatcaagtttataattttggcaaattgttaagacactgtgaagtcagcgttaaccatgtgcatacaacttaaggaattttttcctcctcatgtaaattttacttttcatgcttatatagtttcaacttttatcttcatagtaatttctcatctactcataataccaaaagttaagtcatgctgttttgtgtgctctcttgctaaagaccgcagagaccatacctgttgtcaaagagggtgtaataaactgtaataataatcatg

SEQ ID NO: 203273 - DNA, 591 bp, Homo sapiens
  Payload ID: 20085
  Gene Name: zinc finger protein 627
  ENST ID: ENST00000587939
  CDS Start-End: 418-591
gcgcctccctacggagcctttgtttctggcgaccgtccccacccgggctcgcgtctccgtttctccgagaggcccaaggtgtctccgccgcagcctctgtcgcgccgtgacctgtacaggtcgcgggagtcgtagggaggacgccgggacacctggaagccgagaaatggacaccaagaacttgaaaagataattcaccaagtggaagaacgacttgcaaatcctgtgtctggtggggcatcttatccagaagcagcctgagtctcagtcccctccatcacactccatcagggtgggggctgaattggcagccaggactcccaggattcagtggcctttgaggatgtggctgtgaacttcaccctggaggagtgggctttgctggatccttcccagaagaatctctacagggatgtgatgcgggaaaccttcaggaacctggcttctgtaggaaaacaatgggaagaccagaacattgaagacccattcaaaattcccaggagaaatataagtcatattccagagagactctgtgaaagtaaagaaggtggtcaaggtgaagaaaccttcagccagattccagatggtatt

SEQ ID NO: 203274 - DNA, 3177 bp, Homo sapiens
  Payload ID: 20086
  Gene Name: zinc finger protein 628
  ENST ID: ENST00000391718
  CDS Start-End: 1-3177
ccaggtgtgatggtcggctcccacgcggacatggcgccggcctctactgcggagggggccggggagaagccaggccctgcggcccctgccccggcggcccagtacgaatgtggggagtgtggcaagtcattccggtggtcgtcccggctcctgcaccaccagcgcacgcacacaggcgagcggccctacaagtgcccagactgccccaaggctttcaaaggctcctcggccctgctctaccaccagcgaggccacacgggcgagcggccctaccagtgccccgactgtcccaaggccttcaagcgctcctctctgctgcagatccaccgtagcgtgcacaccggcctgcgggccttcatctgcggccagtgcggcctggccttcaagtggtcgtcccactaccagtaccacttaaggcagcacacaggcgagcgcccctacccgtgcccggactgccccaaggccttcaagaactcgtccagcctgcggcgccaccgccacgtgcacaccggcgagcggccctacacctgtggagtctgcgggaagagcttcacgcagagcaccaacctgcggcagcaccagcgcgtgcacacgggcgagcggcccttccgctgcccgctctgccccaagaccttcacccactcctccaacctgctgctgcaccagcgcacgcacggcgccgcccccgccccgggtaccgcctccgcggccccgcccccccagtcccgggagcccggcaaggtcttcgtgtgcgacgcctacctgcagcggcacctccagccccacagcccgcccgcgcctcccgccccgccgcccccgcccccgcccgtggtgcctgagctctttttggcggcggcggagaccacggtggagctggtgtaccgctgcgatggctgcgagcagggattcagcagcgaggagctgctcctggagcaccagccgtgccccgggcccgatgcggcgccccagccccaggaggcacccgccgaggcgcccaaggccgaccagccaccgtcccctctgccgcagccccctcctcccgccgccgcccccgcgcctggctttgcctgtctgccctgcggcaagtccttccggacggtggctgggctctcccgccaccagcacagccacggggctgccggcgggcaagcgttccgctgcggcagctgcgacggctccttcccgcagctggccagcctcctggcgcatcagcagtgccacgtggaagaggccgcggccgggcgcccgcccccgcaggctgaggctgcggaggtgacctgcccccaggaaccgctggcgcctgccgcccccgtcccgccgccacccccgtccgcccccgcttctgcggagcggccctacaaatgtgccgagtgcggcaagtccttcaagggctcctccgggctgcgctaccacctgcgggaccacacgggcgagcggccctaccagtgtggcgagtgcggcaaggccttcaagcgctcctccctgctggccatccaccagcgggtgcacacgggcctgcgggccttcacctgtggccagtgcggcctcaccttcaagtggtcgtcccactaccagtaccacctgcggctgcactctggcgagcggccctacgcctgcggggagtgtggcaaggccttccgcaacacgtcgtgcctgcgtcgccaccgccacgtgcacactggcgagaggccccacgcctgcggtgtctgcggcaagagcttcgcgcagacctccaacctgcggcagcaccagcgcgtgcacacgggcgagcggcccttccgctgcccgctctgccccaagaccttcacccactcctccaacctgctgctgcaccagcgcacgcactcggcggagcgccccttcacctgccccatctgcggtcgcggcttcgttatggccgcctatctgcagcggcacctgaggacgcacgccccggccaacacgcctcccagcaccacagcccctgccgccggcccccagccccctgctccactggctgctgcgcgggccccgccagccacccaagatgtccacgtcctgccccacctccaggccacgctctccctcgaggtggcggggggcacggcccaggccccgagcttggggccagcagcgcccaactctcagacgttcctcctggtgcaaactgcccagggcctccagctgatccccagcagcgtgcagccccctacacctccgccccctcccgcacctcccaagctcatcctgctgccctcctccagtgctggggctgggggcggccgtgcaaggcagggcccgcgggcagtggggaaagcgggccagggggcgggagtggtctggctgccaggccctgggggtctaggggtgcagggagcggccagcgctggggccagcgggacagggcagagcctcatcgttctgcagaatgtggggggtggggaggcagggccacaggaaatgagtggggtgcagctccagcccctccgaccagccccagaagtaaccacggtccagctccagccagcgcaggaggtgaccacagtccagctccagccagcacaggaagtaaccacggtccagctccagccagcacaggaggtgaccacggtccagctccagcccgtggccggccagctctccaattccagtgggggagctgtggctactgaggcacccaacctgctggttgttcagagcggggcagctgaggagttgctcactggcccgggccccggggaggcgggggatggcgaggccagcactggtgtggtccaggatgtcctctttgagacactccagacggacgagggcttgcagagcgtgctggtgctgagcggggccgatggcgaacagactcgactctgcgtacaggaggtagaaacacttcctcctgggctgacggagccgcctgccaccggcccacccggacagaaactcctcatcatccgcagcgccccagccactgagctgctggacagcagcaacactggaggaggcaccgccacgctgcagctcctggccccaccgccgtcaggcccagcctcgggccccgcggggctccccggggctccagcctcccagatggtgcaagtggtccccgcaggagctgggcctggtgttatgacccctcagggcctgccctccatccagattgtccagactctacccgcagtccagctggtgcacacgttttga

SEQ ID NO: 203275 - DNA, 472 bp, Homo sapiens
  Payload ID: 20086
  Gene Name: zinc finger protein 628
  ENST ID: ENST00000591164
  CDS Start-End: 168-472
ggttgggtgcctcgcgccgggggccgttgggagggagtgcgcccctgccccccctccccggtccccacagctgcaccgccgctgccggggccccaccttcccgtcgacccccgcgggaaggtcctggggctgccaccctcgttcccccgattggggccgcaggtgtgatggtcggctcccacgcggacatggcgccggcctctactgcggagggggccggggagaagccaggccctgcggcccctgccccggcggcccagtacgaatgtggggagtgtggcaagtcattccggtggtcgtcccggctcctgcaccaccagcgcacgcacacaggcgagcggccctacaagtgcccagactgccccaaggctttcaaaggctcctcggccctgctctaccaccagcgaggccacacgggcgagcggccctaccagtgccccgactgtcccaaggccttcaagcgctcctctct

SEQ ID NO: 203276 - DNA, 3847 bp, Homo sapiens
  Payload ID: 20086
  Gene Name: zinc finger protein 628
  Uniprot ID: Q5EBL2
  ENST ID: ENST00000598519
  CDS Start-End: 554-3733
ggtgcatggaaggatttttttgcagatgagagggaatcgggattaataaggggaacttgcgaccccgcgtctcgagctggccgtccctggccttgggctcaccggggcctcggcccccaagacctgacaactggagtccgcgaccacaactgggagaactacaactcccaggatgccgcgcaccgcctgcgcccgagctcgacgaggcctcgcacagccaatgggagggtccgggggcgggaactcggagtacgtgcgttgtgacgcaccgacggcgacgtcggggtttgtgtgcgcgagaggccgccgataaaggttgggtgcctcgcgccgggggccgttgggagggagtgcgcccctgccccccctccccggtccccacagctgcaccgccgctgccggggccccaccttcccgtcgacccccgcgggaaggtcctggggctgccaccctcgttcccccgattggggccgcagaggcatgatcaaggacagggttgcctgccaagaacaggaggggagaggaggggctggaggtttcaggagaaagaagcatgtcaggtgtgatggtcggctcccacgcggacatggcgccggcctctactgcggagggggccggggagaagccaggccctgcggcccctgccccggcggcccagtacgaatgtggggagtgtggcaagtcattccggtggtcgtcccggctcctgcaccaccagcgcacgcacacaggcgagcggccctacaagtgcccagactgccccaaggctttcaaaggctcctcggccctgctctaccaccagcgaggccacacgggcgagcggccctaccagtgccccgactgtcccaaggccttcaagcgctcctctctgctgcagatccaccgtagcgtgcacaccggcctgcgggccttcatctgcggccagtgcggcctggccttcaagtggtcgtcccactaccagtaccacttaaggcagcacacaggcgagcgcccctacccgtgcccggactgccccaaggccttcaagaactcgtccagcctgcggcgccaccgccacgtgcacaccggcgagcggccctacacctgtggagtctgcgggaagagcttcacgcagagcaccaacctgcggcagcaccagcgcgtgcacacgggcgagcggcccttccgctgcccgctctgccccaagaccttcacccactcctccaacctgctgctgcaccagcgcacgcacggcgccgcccccgccccgggtaccgcctccgcggccccgcccccccagtcccgggagcccggcaaggtcttcgtgtgcgacgcctacctgcagcggcacctccagccccacagcccgcccgcgcctcccgccccgccgcccccgcccccgcccgtggtgcctgagctctttttggcggcggcggagaccacggtggagctggtgtaccgctgcgatggctgcgagcagggattcagcagcgaggagctgctcctggagcaccagccgtgccccgggcccgatgcggcgccccagccccaggaggcacccgccgaggcgcccaaggccgaccagccaccgtcccctctgccgcagccccctcctcccgccgccgcccccgcgcctggctttgcctgtctgccctgcggcaagtccttccggacggtggctgggctctcccgccaccagcacagccacggggctgccggcgggcaagcgttccgctgcggcagctgcgacggctccttcccgcagctggccagcctcctggcgcatcagcagtgccacgtggaagaggccgcggccgggcgcccgcccccgcaggctgaggctgcggaggtgacctgcccccaggaaccgctggcgcctgccgcccccgtcccgccgccacccccgtccgcccccgcttctgcggagcggccctacaaatgtgccgagtgcggcaagtccttcaagggctcctccgggctgcgctaccacctgcgggaccacacgggcgagcggccctaccagtgtggcgagtgcggcaaggccttcaagcgctcctccctgctggccatccaccagcgggtgcacacgggcctgcgggccttcacctgtggccagtgcggcctcaccttcaagtggtcgtcccactaccagtaccacctgcggctgcactctggcgagcggccctacgcctgcggggagtgtggcaaggccttccgcaacacgtcgtgcctgcgtcgccaccgccacgtgcacactggcgagaggccccacgcctgcggtgtctgcggcaagagcttcgcgcagacctccaacctgcggcagcaccagcgcgtgcacacgggcgagcggcccttccgctgcccgctctgccccaagaccttcacccactcctccaacctgctgctgcaccagcgcacgcactcggcggagcgccccttcacctgccccatctgcggtcgcggcttcgttatggccgcctatctgcagcggcacctgaggacgcacgccccggccaacacgcctcccagcaccacagcccctgccgccggcccccagccccctgctccactggctgctgcgcgggccccgccagccacccaagatgtccacgtcctgccccacctccaggccacgctctccctcgaggtggcggggggcacggcccaggccccgagcttggggccagcagcgcccaactctcagacgttcctcctggtgcaaactgcccagggcctccagctgatccccagcagcgtgcagccccctacacctccgccccctcccgcacctcccaagctcatcctgctgccctcctccagtgctggggctgggggcggccgtgcaaggcagggcccgcgggcagtggggaaagcgggccagggggcgggagtggtctggctgccaggccctgggggtctaggggtgcagggagcggccagcgctggggccagcgggacagggcagagcctcatcgttctgcagaatgtggggggtggggaggcagggccacaggaaatgagtggggtgcagctccagcccctccgaccagccccagaagtaaccacggtccagctccagccagcgcaggaggtgaccacagtccagctccagccagcacaggaagtaaccacggtccagctccagccagcacaggaggtgaccacggtccagctccagcccgtggccggccagctctccaattccagtgggggagctgtggctactgaggcacccaacctgctggttgttcagagcggggcagctgaggagttgctcactggcccgggccccggggaggcgggggatggcgaggccagcactggtgtggtccaggatgtcctctttgagacactccagacggacgagggcttgcagagcgtgctggtgctgagcggggccgatggcgaacagactcgactctgcgtacaggaggtagaaacacttcctcctgggctgacggagccgcctgccaccggcccacccggacagaaactcctcatcatccgcagcgccccagccactgagctgctggacagcagcaacactggaggaggcaccgccacgctgcagctcctggccccaccgccgtcaggcccagcctcgggccccgcggggctccccggggctccagcctcccagatggtgcaagtggtccccgcaggagctgggcctggtgttatgacccctcagggcctgccctccatccagattgtccagactctacccgcagtccagctggtgcacacgttttgaggagaggcagtgattcccctcccgccccgcacagagaccccgactcactgccagccggggcggggcagggtgccgcaggctgggcttgctaataaagacccgagtctccccgcc

SEQ ID NO: 203277 - DNA, 6087 bp, Homo sapiens
  Payload ID: 20087
  Gene Name: zinc finger protein 629
  Uniprot ID: Q9UEG4
  ENST ID: ENST00000262525
  CDS Start-End: 209-2818
tcctgctccgtcccagtcaccctgaactggtccccgggtcctcagcctggaatcaccccttgagaaggaccccagagtcctcggcgcccagtccgtcccccgaggcagggcactgaaggggttaagtcccctggggctggattccgccttccggcttttcccagaccccagagccggtccctggaacactgcagtcctgagctctgggatggagcccgagactgcgctgtggggcccggatctgcagggtccggaacagagccccaacgatgctcacagaggtgccgagagtgaaaacgaagaggagagccctcggcaggaaagttctggggaggagatcatcatgggagacccggctcagagtccagaatccaaggactcaacagagatgtccctggagagatcctcccaggacccctctgtcccccagaaccccccaaccccactgggtcactccaatcccttggaccaccagatccccctggaccccccagccccggaggtagtccctaccccatctgactggaccaaggcctgcgaggccagctggcagtggggcgctctcaccacatggaacagccccccagtcgtccccgccaacgagcccagcctgcgggagctggtgcagggccgcccggcgggggcggagaagccctacatctgcaacgagtgcggcaagagcttcagccagtggtccaagctgctgcggcaccagcgcatccacacgggagagcggcccaacacctgctccgagtgcggcaagagcttcacgcagagctcgcacctggtgcagcaccagcgcacgcacaccggcgagaagccctacaagtgccccgactgcggcaagtgcttcagctggagctccaacctggtgcagcaccagcgcacgcacacgggagagaagccctacaagtgcacggagtgcgagaaagccttcacccagagcaccaacctcatcaagcaccagcgatcccacaccggcgagaagccctacaagtgcggcgagtgccgccgggctttctaccgcagctcggacctcatccagcaccaggccacccacacaggcgagaaaccctacaagtgccccgagtgcgggaagcgcttcggccagaaccacaacctcctcaagcaccagaagatccacgcgggcgagaagccataccgctgcaccgagtgcgggaagagcttcatccagagctcggagctgacccagcaccagcgcacgcacacaggcgagaagccctacgagtgcctagagtgcggcaagagcttcggccacagctccaccctcatcaagcaccagcggactcacctgcgcgaggacccgttcaagtgcccagtgtgcggcaagaccttcaccctgagcgccacgttgctgcggcaccagcgcacgcacacgggcgagcggccctacaagtgcccagagtgcggcaagagcttcagcgtcagctccaacctcatcaaccaccagcgcatccaccgcggcgagcggccctacatctgcgccgactgcggcaagagcttcatcatgagctccacccttatccgccaccagcgcatccacaccggtgagaagccctacaagtgttccgactgcggcaagagcttcatccgcagctcccaccttatccagcaccgccgcacgcacaccggcgagaagccctacaagtgccccgagtgcggcaagagcttcagccagagctccaaccttattacccacgtccgcacgcacatggacgagaacctgttcgtgtgctccgactgcgggaaggccttcctggaagcccacgagctggagcagcaccgggtgatccatgagagggggaagaccccagcgcgtagggcccagggcgacagcctgctggggctcggggacccctccctgctgaccccgccgccgggagccaagccgcacaagtgtctcgtgtgcggaaagggcttcaacgacgagggcatcttcatgcaacatcagaggatccacatcggagaaaacccctacaaaaatgcagacggcctcatcgcacacgcagcccccaaacctcctcagttacgatccccaaggctccctttcagagggaattcctaccccggggctgcggagggcagagcggaggcccccggacagccccttaagccgccggagggtcaggagggcttcagccagaggcgggggctgctgtcctccaagacctacatctgctcccactgcggagagagcttcctggatcgctctgtgctcctccagcatcagctcacccacggcaacgaaaagccctttctctttcctgattatagaattggcctaggggaaggcgcagggcccagccccttcttaagtgggaagccctttaaatgccctgaatgcaaacaaagctttggcctcagctctgagctgctgctgcaccagaaagtccatgcaggcgggaagagctcccagaagagtccagagctggggaagagctcttccgtcctcctggagcatctcaggagccccctgggggccagaccctaccgctgctcagattgcagggcctccttcctcgaccgcgtggccctcacccggcaccaagaaacccacacccaggaaaaaccccccaatcccgaggacccccctccagaggcagtcaccctgtccacagatcaggaaggtgagggcgagacccctacccccacagagagcagcagccatggggaagggcaaaaccccaaaaccctagtggaagaaaagccctatctgtgccccgagtgtggagccggcttcacagaagtcgcagccctcctgctccataggagctgccacccaggtgtctccctgtgaaatgggtctggagaccaggggcctcgctctctccagagaggaacactggattttttcccccaaaaaaattacatggggaagggaggataaccctatcagatggtagtggagtggaggagaaagaaccctgggaaaaaatagtgcttttacatcagtgatgagaaaccctataaaattgttggtgggaagcacttataaggcagtagagaaaaactgttgggttagaaaccctataaatatgtaggaaaaaaaaaagccctttaagtctgtagcagaaaaaccctataaaccatagtggataaaagccctattaattgtaggaagaggtcccaatatgtctctgaacaaccctataaaattgtatcaaaatccttaggaaaatcctatagggtcggggaagtaccgcaatggcactgacccgggagtaacgaccctcagatgatgcagaaaacacctctccctcactgttccacaatgttctctcccagcagccctggacagttctcatggaggaagatgctcagctgggggagtggtgtgggaactgggtggaactgaaaaggaagaaaataggagaaaaataagtgaccaggagctctggagcccccagaggagataagacagagactaggaagaaaaggtcccactcactgcactggggtccttggggtttgaggacaatgttagatgcattgtgtgttttagggaaagaggcctatggaatcccttatcaaaaccccaaaatggggaagaaaaaacaaattggcaagcctttttaaaggctgaagtttggggtgcagaaacatggtcagtataagaatactgagaaaccaccacaaaaattagggggaagcagggggcagtttctgttagattgctttgaggggagcaaaccaaggtggggaaactgctcacatggaacccagctaactccaggccccttcttgcttccggaagcttgcgaaactgcaagtagcaggcaggtcccagctctcagagtgcaagggttctccccacaccaggcaggaccaccctttctccctgcccagccagggacttctactctgcaaggcctccagggatggcggttgcctcccaccacattctcaggtctcaccttcaggaggtttttcctgaaatctaactgccgccagtggcagctcatttcctcaaattctgtcctcagtggagagggagaaccgctgctagtcgacctccaaagaataaagcccttcagagacttagggcctgcgtgtgggcctccccagccttctccaagtcatcagggccacagaatttcttagaaagctttgattagccagcaacttgattttaaacttcagctattcatctttgttggtagcaaggctgccccgcaggataaggcagccctcctccctggtggggatccagacaccccacagactgagccacaggtccctgaagagtccgcagaggccgtatcaccctcttcaccctggtacctggagccctccagggttgtgagatccagcccaatctcagccttgagatggatgggatggattccactcacttggctcccctctcctccttagccagaaaccttcagaaggaaacagaaggatgagaaagcctcccttgccaggcccatctcacctcccacaccacacagttacacattcataaacagccaagcctgctcacaggcctgggcatatgtggctggggagagactgttgccctatgagatggtggaagacagaaaactcttgaatgaaacatctgtaacaagactcccactccctaatcctggagaccccttcaaaaggagaggactctgctcagcgctgggtcagaaaggaagtgcttgccaaccccagtaatgcgctgtcctggagtaagaggactgagatgccagctgtggggcccgtcaggagtcacgtctcaagagaggggtgacccagatttttgcaaagctgtggaagagacctctaattccatgacctaaagtttcacacaacctttatgcaaatccttcgccatttgtctatcctggccccagcaggatgaccctcacatttaaaaggatcaaaatctcaaacattgtgggaggaaaacgccaggcctgctggggagagggagaaggcaggcctcaggattgtgcggagaaccatgttgccatctgcataacgccccagcctatccaagtgccaggaagggaagcactactgaggggggtgctgcctgtgggtctcttcctaacagaacgccaacgaagggggtgccctgtaagaatgagaagtctgccaagtctaaggagatgtccccctccccaagatggtagcagaaactgaagttgtaaagacaaacctctcgcaaagccagaagcagatgctctcaaaaacaggcctaaggaatctgttcccagaagaggcctggggagcagcttttggggctcagaggccagtctggggggaggcaggcagtgtgactgaaggccggcgcaggcctgtttcggactagggtgtagcatatttagtaggatgctcacatgttgtagggatgggtgagggctaaggggcttggctcttgtacgggatggatgatgtgagcgcacagttcgtagggtcaggcgtcttgcggtaggaaaggggcagggttcgatacctctggggtgtggcgtgttctctcttgcccacctccccaagctcctttaaccaggagcttccctcccagagtgagctacgtcttgggaggattgaagcagggaggtggcagtggctagagttgctcagatcggctcagatgaaggcccaggggtcaaagcatttgctcaccacaactgagtctggaaggcactgtgcagccaaaccctcttgtccaatcacatgcaggccccaggcccctcagaaacgccctggtggagggaggagcccaacagatagggtcagggagtcagtggggaaagcagaggggagagcttagagtgaaacttgaaactgctatggacatggaggtcagatgggaacttggaactgggcatgaatcctgaatggtggggaaacttgaagccatcacagccaagaggtggggttccatgacctgccctgaggtcagcagctcccagactcctttgccctcactagggaagccccagtcaccggacttgtccccatggagtgaagagaggccccatttttgagtgttgtgtgtccaaaacagtgttgtgtcactggtggtcatgttgcttagttgaagagaataaagggaataagatttcctgggtg

SEQ ID NO: 203278 - DNA, 2791 bp, Homo sapiens
  Payload ID: 20088
  Gene Name: zinc finger protein 630
  ENST ID: ENST00000276054
  CDS Start-End: 936-2537
ctggtggccgggaacgcccactcacccggacaagtcgcggcccttccaagcctcacactgctttcgtaggatcaattccgaatacccaaactcggagatatcacgaggactcccccgggcccccaaacgcacctctcctctggctggaatgggagcctccagaagcagtgcgagaccacggccagcgacagaggtcctggcgctggcggaatgacgccatttttgttactggtagagctcggcttcgtggctgtttcggagccaccgaaagataagctccctcgtcaccctgacatctctccgggaagactggaagggaaatggcctttcgggggatgttgaacgcatttgggcaggcggggagccaagcccggcttgagagcagagccggggacgaagttccggaaatggaattaccgagtcagatgagaaacacaagtcatcaatgaattaacaagcaacacattgtcacatccagctgttgaagagtggttaactcagcttgatctccgaagactcttctgcaccccaccccgcccccaactgctttccaaagagaaacagaaaatgattgagtcccaggaaccagtgacatttgaggatgtggctgtggacttcacgcaggaagagtggcagcagttgaatcctgctcagaagaccctgcatagggatgtgatgctggagacctataatcacctggtctccgtggggtgttcaggtataaaaccagatgtaatctttaagttggaacatggaaaggacccatggatcatagagagtgagttgtcaaggtggatctacccagagtgaaaggccttgaatcttcccagcagatcatttctggagaacttttatttcaaagggagatactagaaagagccccaaaggataattcattgtactctgttttaaaaatctggcatattgataatcagatggatagatatcaaggaaatcaagacagagttttgaggcaggtcacagtcatcagtcgtgaaacattgactgatgagatgggttccaagtacagtgcatttgggaaaatgttcaatcggtgcacagaccttgctcctttaagtcaaaaattccataagtttgattcatgtgaaaatagcttgaagtctaattcagacttactaaattataacaggagctatgcaagaaagaaccccactaagagatttagatgtgggagaccacctaagtataatgcttcctgttctgtgcctgagaaggaaggcttcattcatactggaatggagccctatggagatagtcaatgtgaaaaagttctcagtcataagcaagcccatgttcagtataagaaatttcaagccagagagaaacccaatgtttgtagtatgtgtgggaaagcctttatcaagaagtcacagctcattatacatcaaagaattcatactggagagaaaccatatgtatgtggagattgtaggaaagccttcagtgagaaatcacacctcattgtgcatcagaggattcatactggggagaaaccctatgaatgtactaagtatggaagagcattctcccggaagtcacctttcactgttcatcagagagtccatactggagagaaaccctatgagtgttttgagtgtccaaaagctttctcccagaagtcacatctaattatacatcagagagttcataccagagagaagccctttgaatgcagtgaatgcaggaaagccttctgtgagatgtctcacctttttatacaccagataactcatactgggaagaagccctatgaatgtactgaatgtgggaagaccttccctcggaaaacacagctcattatacatcagagaacgcatactggagagaagccctataagtgtggtgaatgtgggaaaactttctgccaacagtcccacctcataggacatcaaagaattcatacaggagaaaaaccttatgtgtgtactgactgtgggaaggccttttcccagaagtcacacctcactggccatcaaagacttcatactggagagaaaccttatatgtgtactgaatgtggaaaatccttctctcagaaatcacctcttatcatacaccagagaattcatacaggggagaaaccttatcagtgtggtgaatgtggcaaaaccttctcccagaaatcactcctcattattcatctgagagttcacacaggggagaaaccttatgagtgtactgagtgtgggagggccttttccctgaagtcacatctcattctacatcagagaggtcatactggagagaaaccctatgaatgtagtgaatgtggaaaggccttctgtggaaagtctccactcattatacatcagaaaactcatcctagggagaaaacccctgaatgtgctgagtctggaatgacttttttctggaaatcacagatgattacatatcagagaagacacactggggagaaaccctccagatgcagtgactgtgggaaggcattctgccagcatgtatactttactgggcatcagaatccatataggaaagacaccttgtatatatgctgattgtgggaaggcctattcccagaagtcagtcctcattgtctatgggaaaactcacattgaatagaaatagtgacaacttctcaactgtagaatagactaatatgttcctcagtatacatgattacccttccacagaatgatctgcttaggccctcagaatattttcaacatcacaaatatggaatcaatttgctcaccctcaaactgtctcagccctcttcacagaataaatgtatctggaagaattagcacta

SEQ ID NO: 203279 - DNA, 2455 bp, Homo sapiens
  Payload ID: 20088
  Gene Name: zinc finger protein 630
  Uniprot ID: Q2M218
  ENST ID: ENST00000409324
  CDS Start-End: 228-2201
gagtttgtggggtgatgggggatctgtgcggtgtttgatgatgtctgtaagggacgaagttccggaaatggaattaccgagtcagatgagaaacacaagtcatcaatgaattaacaagcaacacattgtcacatccagctgttgaagagtggttaactcagcttgatctccgaagactcttctgcaccccaccccgcccccaactgctttccaaagagaaacagaaaatgattgagtcccaggaaccagtgacatttgaggatgtggctgtggacttcacgcaggaagagtggcagcagttgaatcctgctcagaagaccctgcatagggatgtgatgctggagacctataatcacctggtctccgtggggtgttcaggtataaaaccagatgtaatctttaagttggaacatggaaaggacccatggatcatagagagtgagttgtcaaggtggatctacccagacagagtgaaaggccttgaatcttcccagcagatcatttctggagaacttttatttcaaagggagatactagaaagagccccaaaggataattcattgtactctgttttaaaaatctggcatattgataatcagatggatagatatcaaggaaatcaagacagagttttgaggcaggtcacagtcatcagtcgtgaaacattgactgatgagatgggttccaagtacagtgcatttgggaaaatgttcaatcggtgcacagaccttgctcctttaagtcaaaaattccataagtttgattcatgtgaaaatagcttgaagtctaattcagacttactaaattataacaggagctatgcaagaaagaaccccactaagagatttagatgtgggagaccacctaagtataatgcttcctgttctgtgcctgagaaggaaggcttcattcatactggaatggagccctatggagatagtcaatgtgaaaaagttctcagtcataagcaagcccatgttcagtataagaaatttcaagccagagagaaacccaatgtttgtagtatgtgtgggaaagcctttatcaagaagtcacagctcattatacatcaaagaattcatactggagagaaaccatatgtatgtggagattgtaggaaagccttcagtgagaaatcacacctcattgtgcatcagaggattcatactggggagaaaccctatgaatgtactaagtatggaagagcattctcccggaagtcacctttcactgttcatcagagagtccatactggagagaaaccctatgagtgttttgagtgtccaaaagctttctcccagaagtcacatctaattatacatcagagagttcataccagagagaagccctttgaatgcagtgaatgcaggaaagccttctgtgagatgtctcacctttttatacaccagataactcatactgggaagaagccctatgaatgtactgaatgtgggaagaccttccctcggaaaacacagctcattatacatcagagaacgcatactggagagaagccctataagtgtggtgaatgtgggaaaactttctgccaacagtcccacctcataggacatcaaagaattcatacaggagaaaaaccttatgtgtgtactgactgtgggaaggccttttcccagaagtcacacctcactggccatcaaagacttcatactggagagaaaccttatatgtgtactgaatgtggaaaatccttctctcagaaatcacctcttatcatacaccagagaattcatacaggggagaaaccttatcagtgtggtgaatgtggcaaaaccttctcccagaaatcactcctcattattcatctgagagttcacacaggggagaaaccttatgagtgtactgagtgtgggagggccttttccctgaagtcacatctcattctacatcagagaggtcatactggagagaaaccctatgaatgtagtgaatgtggaaaggccttctgtggaaagtctccactcattatacatcagaaaactcatcctagggagaaaacccctgaatgtgctgagtctggaatgacttttttctggaaatcacagatgattacatatcagagaagacacactggggagaaaccctccagatgcagtgactgtgggaaggcattctgccagcatgtatactttactgggcatcagaatccatataggaaagacaccttgtatatatgctgattgtgggaaggcctattcccagaagtcagtcctcattgtctatgggaaaactcacattgaatagaaatagtgacaacttctcaactgtagaatagactaatatgttcctcagtatacatgattacccttccacagaatgatctgcttaggccctcagaatattttcaacatcacaaatatggaatcaatttgctcaccctcaaactgtctcagccctcttcacagaataaatgtatctggaagaattagcacta

SEQ ID NO: 203280 - DNA, 2829 bp, Homo sapiens
  Payload ID: 20088
  Gene Name: zinc finger protein 630
  Uniprot ID: Q2M218
  ENST ID: ENST00000442455
  CDS Start-End: 568-2541
ctggtggccgggaacgcccactcacccggacaagtcgcggcccttccaagcctcacactgctttcgtaggatcaattccgaatacccaaactcggagatatcacgaggactcccccgggcccccaaacgcacctctcctctggctggaatgggagcctccagaagcagtgcgagaccacggccagcgacagaggtcctggcgctggcggaatgacgccatttttgttactggtagagctcggcttcgtggctgtttcggagccaccgaaagataagctccctcgtcaccctgacatctctccgggaagactggaagggaaatggcctttcgggggatgttgaacgcatttgggcaggcggggagccaagcccggcttgagagcagagccggggacgaagttccggaaatggaattaccgagtcagatgagaaacacaagtcatcaatgaattaacaagcaacacattgtcacatccagctgttgaagagtggttaactcagcttgatctccgaagactcttctgcaccccaccccgcccccaactgctttccaaagagaaacagaaaatgattgagtcccaggaaccagtgacatttgaggatgtggctgtggacttcacgcaggaagagtggcagcagttgaatcctgctcagaagaccctgcatagggatgtgatgctggagacctataatcacctggtctccgtggggtgttcaggtataaaaccagatgtaatctttaagttggaacatggaaaggacccatggatcatagagagtgagttgtcaaggtggatctacccagacagagtgaaaggccttgaatcttcccagcagatcatttctggagaacttttatttcaaagggagatactagaaagagccccaaaggataattcattgtactctgttttaaaaatctggcatattgataatcagatggatagatatcaaggaaatcaagacagagttttgaggcaggtcacagtcatcagtcgtgaaacattgactgatgagatgggttccaagtacagtgcatttgggaaaatgttcaatcggtgcacagaccttgctcctttaagtcaaaaattccataagtttgattcatgtgaaaatagcttgaagtctaattcagacttactaaattataacaggagctatgcaagaaagaaccccactaagagatttagatgtgggagaccacctaagtataatgcttcctgttctgtgcctgagaaggaaggcttcattcatactggaatggagccctatggagatagtcaatgtgaaaaagttctcagtcataagcaagcccatgttcagtataagaaatttcaagccagagagaaacccaatgtttgtagtatgtgtgggaaagcctttatcaagaagtcacagctcattatacatcaaagaattcatactggagagaaaccatatgtatgtggagattgtaggaaagccttcagtgagaaatcacacctcattgtgcatcagaggattcatactggggagaaaccctatgaatgtactaagtatggaagagcattctcccggaagtcacctttcactgttcatcagagagtccatactggagagaaaccctatgagtgttttgagtgtccaaaagctttctcccagaagtcacatctaattatacatcagagagttcataccagagagaagccctttgaatgcagtgaatgcaggaaagccttctgtgagatgtctcacctttttatacaccagataactcatactgggaagaagccctatgaatgtactgaatgtgggaagaccttccctcggaaaacacagctcattatacatcagagaacgcatactggagagaagccctataagtgtggtgaatgtgggaaaactttctgccaacagtcccacctcataggacatcaaagaattcatacaggagaaaaaccttatgtgtgtactgactgtgggaaggccttttcccagaagtcacacctcactggccatcaaagacttcatactggagagaaaccttatatgtgtactgaatgtggaaaatccttctctcagaaatcacctcttatcatacaccagagaattcatacaggggagaaaccttatcagtgtggtgaatgtggcaaaaccttctcccagaaatcactcctcattattcatctgagagttcacacaggggagaaaccttatgagtgtactgagtgtgggagggccttttccctgaagtcacatctcattctacatcagagaggtcatactggagagaaaccctatgaatgtagtgaatgtggaaaggccttctgtggaaagtctccactcattatacatcagaaaactcatcctagggagaaaacccctgaatgtgctgagtctggaatgacttttttctggaaatcacagatgattacatatcagagaagacacactggggagaaaccctccagatgcagtgactgtgggaaggcattctgccagcatgtatactttactgggcatcagaatccatataggaaagacaccttgtatatatgctgattgtgggaaggcctattcccagaagtcagtcctcattgtctatgggaaaactcacattgaatagaaatagtgacaacttctcaactgtagaatagactaatatgttcctcagtatacatgattacccttccacagaatgatctgcttaggccctcagaatattttcaacatcacaaatatggaatcaatttgctcaccctcaaactgtctcagccctcttcacagaataaatgtatctggaagaattagcactactttggtgttgtttggtcattaaatgctttatag

SEQ ID NO: 203281 - DNA, 1245 bp, Homo sapiens
  Payload ID: 20088
  Gene Name: zinc finger protein 630
  ENST ID: ENST00000428463
  CDS Start-End: 253-519
aacagtatgtgggttatgcaaatgggagtttgtggggtgatgggggatctgtgcggtgtttgatgatgtctgtaagggacgaagttccggaaatggaattaccgagtcagatgagaaacacaagtcatcaatgaattaacaagcaacacattgtcacatccagctgttgaagagtggttaactcagcttgatctccgaagactcttctgcaccccaccccgcccccaactgctttccaaagagaaacagaaaatgattgagtcccaggaaccagtgacatttgaggatgtggctgtggacttcacgcaggaagagtggcagcagttgaatcctgctcagaagaccctgcatagggatgtgatgctggagacctataatcacctggtctccgtggggtgttcaggtataaaaccagatgtaatctttaagttggaacatggaaaggacccatggatcatagagagtgagttgtcaaggtggatctacccaggtatatttggattatgtatcttaatctgagaactactttagacattgtggtccaatctgagagtattctgtttttcagtagatggagtgctggctgttcctcggaacctgtgtcttcacccaggtattcatgctggcttcctggaccctttgtgtctttttctgcctggaaaagtaggaatccatggtgcatacagaagatacaaagaattgtttgagtctggagtgcagtggcacaatctcagctcactgcagcctttacctcccaggtcaagtgatcctcccacctcagcctcccaagttgctgggactacaggcacgtgccaccacgtccagagagaggatctcactcttgcccaggctggagtgcagtgatgtgattacagctcattgcagcctcgaactcctggactcaagcaatcctcctgcctcagcctcctgagtagcacagtgacctgcccctaaaggttcatgcgcatccctcagacccctctttagacgcgccccgcttctccctctgccctctccccttgcccaagccccgaggtgggggcctggtgtgaatgctccggccgaagtgaacctgcacccccgcacccgaaggcctctttccggcttctgggcaaggcggccccggtgagctcggccgtcacacatctctgctttttcccaagaagagcaggaaatggccaaaccccaggggctagtgacatttgaagatgtagctgtggatttcacccaggaggagtggcagta

SEQ ID NO: 203282 - DNA, 988 bp, Homo sapiens
  Payload ID: 20088
  Gene Name: zinc finger protein 630
  ENST ID: ENST00000428686
  CDS Start-End: 345-988
cccggacaagtcgcggcccttccaagcctcacactgctttcgtaggatcaattccgaatacccaaactcggagatatcacgaggactcccccgggcccccaaacgcacctctcctctggctggaatgggagcctccagaagcagtgcgagaccacggccagcgacagaggacgaagttccggaaatggaattaccgagtcagatgagaaacacaagtcatcaatgaattaacaagcaacacattgtcacatccagctgttgaagagtggttaactcagcttgatctccgaagactcttctgcaccccaccccgcccccaactgctttccaaagagaaacagaaaatgattgagtcccaggaaccagtgacatttgaggatgtggctgtggacttcacgcaggaagagtggcagcagttgaatcctgctcagaagaccctgcatagggatgtgatgctggagacctataatcacctggtctccgtggggtgttcaggtataaaaccagatgtaatctttaagttggaacatggaaaggacccatggatcatagagagtgagttgtcaaggtggatctacccagacagagtgaaaggccttgaatcttcccagcagatcatttctggagaacttttatttcaaagggagatactagaaagagccccaaaggataattcattgtactctgttttaaaaatctggcatattgataatcagatggatagatatcaaggaaatcaagacagagttttgaggcaggtcacagtcatcagtcgtgaaacattgactgatgagatgggttccaagtacagtgcatttgggaaaatgttcaatcggtgcacagaccttgctcctttaagtcaaaaattccataagtttgattcatgtgaaaatagcttgaagtctaattcagacttactaaattataacaggagctatgcaagaaagaaccccactaagagatttagatgtgggagaccacctaagta

SEQ ID NO: 203283 - DNA, 541 bp, Homo sapiens
  Payload ID: 20088
  Gene Name: zinc finger protein 630
  ENST ID: ENST00000421903
  CDS Start-End: 420-541
acgaagttccggaaatggaattaccgagtcagatgagaaacacaagtcatcaatgaattaacaagcaacacattgtcacatccagctgttgaagagtggttaactcagcttgatctccgaagactcttctgcaccccaccccgcccccaactgctttccaaagagaaacagaaaatgattgagtcccagggtgttcaggtataaaaccagatgtaatctttaagttggaacatggaaaggacccatggatcatagagagtgagttgtcaaggtggatctacccagacagagtgaaaggccttgaatcttcccagcagatcatttctggagaacttttatttcaaagggagatactagaaagagccccaaaggataattcattgtactctgttttaaaaatctggcatattgataatcagatggatagatatcaaggaaatcaagacagagttttgaggcaggtcacagtcatcagtcgtgaaacattgactgatgagatgggttccaagtacagtgcatttgggaaaatgttcaatcggtg

SEQ ID NO: 203284 - DNA, 2220 bp, Homo sapiens
  Payload ID: 20088
  Gene Name: zinc finger protein 630
  ENST ID: ENST00000616492
  CDS Start-End: 1-1932
atggtggaaggggaagaagagtggcagcagttgaatcctgctcagaagaccctgcatagggatgtgatgctggagacctataatcacctggtctccgtggggtgttcaggtataaaaccagatgtaatctttaagttggaacatggaaaggacccatggatcatagagagtgagttgtcaaggtggatctacccagacagagtgaaaggccttgaatcttcccagcagatcatttctggagaacttttatttcaaagggagatactagaaagagccccaaaggataattcattgtactctgttttaaaaatctggcatattgataatcagatggatagatatcaaggaaatcaagacagagttttgaggcaggtcacagtcatcagtcgtgaaacattgactgatgagatgggttccaagtacagtgcatttgggaaaatgttcaatcggtgcacagaccttgctcctttaagtcaaaaattccataagtttgattcatgtgaaaatagcttgaagtctaattcagacttactaaattataacaggagctatgcaagaaagaaccccactaagagatttagatgtgggagaccacctaagtataatgcttcctgttctgtgcctgagaaggaaggcttcattcatactggaatggagccctatggagatagtcaatgtgaaaaagttctcagtcataagcaagcccatgttcagtataagaaatttcaagccagagagaaacccaatgtttgtagtatgtgtgggaaagcctttatcaagaagtcacagctcattatacatcaaagaattcatactggagagaaaccatatgtatgtggagattgtaggaaagccttcagtgagaaatcacacctcattgtgcatcagaggattcatactggggagaaaccctatgaatgtactaagtatggaagagcattctcccggaagtcacctttcactgttcatcagagagtccatactggagagaaaccctatgagtgttttgagtgtccaaaagctttctcccagaagtcacatctaattatacatcagagagttcataccagagagaagccctttgaatgcagtgaatgcaggaaagccttctgtgagatgtctcacctttttatacaccagataactcatactgggaagaagccctatgaatgtactgaatgtgggaagaccttccctcggaaaacacagctcattatacatcagagaacgcatactggagagaagccctataagtgtggtgaatgtgggaaaactttctgccaacagtcccacctcataggacatcaaagaattcatacaggagaaaaaccttatgtgtgtactgactgtgggaaggccttttcccagaagtcacacctcactggccatcaaagacttcatactggagagaaaccttatatgtgtactgaatgtggaaaatccttctctcagaaatcacctcttatcatacaccagagaattcatacaggggagaaaccttatcagtgtggtgaatgtggcaaaaccttctcccagaaatcactcctcattattcatctgagagttcacacaggggagaaaccttatgagtgtactgagtgtgggagggccttttccctgaagtcacatctcattctacatcagagaggtcatactggagagaaaccctatgaatgtagtgaatgtggaaaggccttctgtggaaagtctccactcattatacatcagaaaactcatcctagggagaaaacccctgaatgtgctgagtctggaatgacttttttctggaaatcacagatgattacatatcagagaagacacactggggagaaaccctccagatgcagtgactgtgggaaggcattctgccagcatgtatactttactgggcatcagaatccatataggaaagacaccttgtatatatgctgattgtgggaaggcctattcccagaagtcagtcctcattgtctatgggaaaactcacattgaatagaaatagtgacaacttctcaactgtagaatagactaatatgttcctcagtatacatgattacccttccacagaatgatctgcttaggccctcagaatattttcaacatcacaaatatggaatcaatttgctcaccctcaaactgtctcagccctcttcacagaataaatgtatctggaagaattagcactactttggtgttgtttggtcattaaatgctttatag

SEQ ID NO: 203285 - DNA, 946 bp, Homo sapiens
  Payload ID: 20088
  Gene Name: zinc finger protein 630
  ENST ID: ENST00000627643
  CDS Start-End: 345-946
cccggacaagtcgcggcccttccaagcctcacactgctttcgtaggatcaattccgaatacccaaactcggagatatcacgaggactcccccgggcccccaaacgcacctctcctctggctggaatgggagcctccagaagcagtgcgagaccacggccagcgacagaggacgaagttccggaaatggaattaccgagtcagatgagaaacacaagtcatcaatgaattaacaagcaacacattgtcacatccagctgttgaagagtggttaactcagcttgatctccgaagactcttctgcaccccaccccgcccccaactgctttccaaagagaaacagaaaatgattgagtcccaggaagagtggcagcagttgaatcctgctcagaagaccctgcatagggatgtgatgctggagacctataatcacctggtctccgtggggtgttcaggtataaaaccagatgtaatctttaagttggaacatggaaaggacccatggatcatagagagtgagttgtcaaggtggatctacccagacagagtgaaaggccttgaatcttcccagcagatcatttctggagaacttttatttcaaagggagatactagaaagagccccaaaggataattcattgtactctgttttaaaaatctggcatattgataatcagatggatagatatcaaggaaatcaagacagagttttgaggcaggtcacagtcatcagtcgtgaaacattgactgatgagatgggttccaagtacagtgcatttgggaaaatgttcaatcggtgcacagaccttgctcctttaagtcaaaaattccataagtttgattcatgtgaaaatagcttgaagtctaattcagacttactaaattataacaggagctatgcaagaaagaaccccactaagagatttagatgtgggagaccacctaagta

SEQ ID NO: 203286 - DNA, 6505 bp, Homo sapiens
  Payload ID: 20089
  Gene Name: zinc finger protein 638
  Uniprot ID: Q14966
  ENST ID: ENST00000264447
  CDS Start-End: 315-6251
gcatgcgtgcagctctttggaggcggtagcgttttcggcgtcgagactggaggctgagtgctaaactgtgtggggcgcggatgggatccagctgttagtcgggtaggcatagctttgtgttattcttggaaaatttcgcaccacttgtgaattccttgaacctgggcattgcaaacccacttctgttgggcccatctcctttgcactttgctcagattaagactcagttggcgcttcagcagctgaatgccgttgcctcacatggttcaacaccaccttatactttattaaatcaggctttcttgaaaatagccatgtcgagacccaggtttaatcctcgaggagactttccacttcaaaggccacgagcacctaacccttctgggatgaggcctccaggaccatttatgaggcctggatctatgggtctcccaagattttacccagcagggagagcacgtggaattccacacagatttgctggccatgaatcttatcagaacatggggccacagagaatgaatgttcaggtaactcaacacagaactgatccaagattgaccaaagaaaaactggattttcatgaagcacaacagaagaaggggaagcctcatggtagccggtgggatgatgagcctcatatatctgcatcagtggcagtgaaacagagttctgtaacacaggttacagagcagagtcccaaagtacagagccgctatacaaaagagagtgcctcaagtatcttagcaagttttggattatctaatgaagacctagaagaacttagtcgctatcctgatgaacaactaactcctgaaaatatgccattaattttgagggatataagaatgcgaaaaatggggcgccgattacctaatttaccttctcagagcagaaataaagaaacacttggtagtgaagcagtttcaagtaatgtgatcgattatgggcatgcaagcaaatatggctacacagaagatccacttgaagtacgtatttatgatcctgaaattccaactgatgaggtcgagaatgaatttcagtcacagcagaacatttctgcatctgttcccaatccaaatgtgatatgtaattctatgtttcctgttgaagacgtatttcgccaaatggacttccccggtgagtcctccaataatcggtcctttttctcagttgagagtggaaccaagatgtcaggcttacacatttcaggaggacagtcagtccttgaacccataaaatccgtcaaccaatccattaaccaaacagttagccagacaatgagtcaatctctgattcctccatctatgaaccagcaacctttttcgtcggaattaatttcatctgtaagccagcaagagcggatcccacatgaacctgtgattaattcatctaacgtacatgttggatcaagaggaagtaaaaagaattaccagtcacaggctgacattcccattcggtctccctttggtattgtgaaagcatcctggctaccaaagttttcacatgctgatgcccagaagatgaagagacttccaactccttctatgatgaatgattattatgcagcatctccaagaatatttccacatttgtgttctctgtgtaacgtagaatgtagtcatttgaaggattggattcagcatcaaaatacatctactcatattgagagctgtcgacagttacgtcaacagtatcctgattggaatcctgagatcctcccatcgagaagaaatgagggcaatagaaaagaaaatgaaactccacgaagacgttctcattcccccagtcctaggcgttctagaagatcaagctcaagtcacagattccgtcggtctcgaagcccaatgcattacatgtataggccgagaagtcgaagtccaagaatttgccatcgtttcatttctagatacagatccagatccagatcccgttcaccatatcgaattagaaatccatttagaggtagtccaaaatgctttcgatcagttagccctgagaggatgtcaaggagatcagtgagatcatcagatagaaaaaaagcattagaagatgtagtacaacgatctgggcatgggacagaatttaataaacagaagcatcttgaagctgctgataagggacattcaccagcacaaaagcctaaaactagcagtggaacaaaaccatcagttaaacctacaagcgctacaaagagtgattcaaatctaggaggacattctattcgttgtaaatcaaagaatcttgaagatgacactttgtcagaatgtaaacaggtgtctgataaagctgtttctctccagcgaaagcttcggaaagaacagtcattgcattatggttcggttcttcttataactgaattaccagaggatggttgtactgaagaagatgtgagaaaattatttcaaccatttgggaaagtgaatgatgtcctaattgttccatatagaaaagaggcttacctagaaatggaatttaaagaggcaattactgcaattatgaagtacattgaaacaacacctcttacgataaaaggaaaaagtgtgaaaatatgtgttccaggaaagaaaaaagcacagaacaaagaggtgaagaaaaagactttagagtcaaagaaagtatctgcatctaccttaaaaagagatgcagatgcttcaaaagctgttgaaattgttacttcaacttctgctgccaaaactggacaagccaaggcatctgtagccaaagtaaacaaatctacagggaaatcagcaagttctgtaaaatctgtggtaacggtagctgttaaaggtaataaagcttcaatcaaaacagcaaaatctggtggaaagaagtctctagaagccaaaaagactgggaatgtcaaaaacaaagactctaacaaacctgtgactataccagaaaactctgaaataaagaccagtattgaagtcaaagccactgaaaactgtgctaaagaagctatttctgatgctgctttggaggccacagagaatgaaccacttaacaaggaaacagaagaaatgtgtgtgatgcttgtctctaatttgcctaataaaggatattctgtagaagaagtttatgacttagcaaaaccatttggtggtttaaaggatatcttgattttatcatctcataaaaaggcatatatagaaataaatagaaaagctgctgagtctatggtaaaattttatacctgcttcccagtattgatggatggaaatcaactctcaataagtatggctcctgaaaacatgaatataaaagatgaggaagctatatttataaccttggtaaaagaaaatgacccagaggcaaacatagatacaatttatgatcgatttgtacatcttgataatttaccggaagatggacttcagtgtgtactttgtgttggacttcagtttggaaaagtggatcaccatgtattcataagtaatagaaacaaggcaattcttcagttagatagtcctgaatctgctcagtcaatgtatagctttctgaaacaaaatccacaaaatattggtgaccatatgttgacctgctcattatctccaaagatagacttaccagaggtgcaaattgagcatgacccagaattagaaaaagaaagccctggcttgaaaaacagtccaattgatgaaagtgaggtgcaaacagcaactgatagtccctctgttaaacctaatgagcttgaagaagaaagtactcccagcattcaaacagaaactttggtacagcaggaagagccttgtgaggaagaagctgaaaaagcaacatgtgattctgactttgctgttgaaactttggagcttgaaactcaaggagaggaggtcaaagaagaaattcctcttgtagcatccgcttcagtcagtattgaacaattcactgaaaatgccgaggagtgtgctttaaatcagcagatgtttaacagtgacttggagaagaaaggggcagaaattattaaccctaaaacagcattgttaccatctgacagtgtgtttgcagaagaaaggaacctcaaaggaattctagaagaatctccatctgaagcagaagatttcatttctggaattacacagactatggtagaagctgtagctgaagtagaaaaaaatgaaactgtttcggaaatattgccatcaacttgtattgtgacgttagtaccaggaattcccactggggatgagaagacagtggacaaaaagaatatttctgaaaaaaaaggtaacatggatgaaaaggaggagaaggaatttaatactaaggaaaccagaatggatcttcaaataggaacagagaaggctgaaaagaatgaaggtaggatggatgcagaaaaggtggaaaagatggcagcaatgaaagaaaagcctgcagaaaacactttattcaaggcatacccaaataaaggagtgggtcaggctaataagcctgatgaaactagtaaaactagtattctggctgtatcagatgtatctagcagtaaaccaagcatcaaggctgttatagtctcttctcctaaggcaaaagctacagtttcaaaaactgaaaatcagaaaagttttccaaaatctgtgcccagagatcaaataaatgctgaaaagaaactttcagccaaggaatttggtctgcttaaacccacaagtgccaggtcaggcttggcagaaagcagcagtaaattcaaacctactcagagcagtcttaccagaggaggcagtggaaggatctcagccctgcaaggcaagctttctaaactggattacagagatataacaaaacaatctcaggaaacagaggctagaccttccatcatgaaacgggatgacagcaacaataagactttggctgagcaaaacactaagaatcctaaaagcactactggtagaagttccaaatctaaagaggagccattatttccatttaatttggatgaatttgttactgtggatgaggttatagaagaagtgaatccttctcaggccaagcagaatccactaaagggaaaaaggaaagaaactctcaaaaatgttcctttctctgaacttaacttaaagaagaaaaaggggaaaacttccactcctcgtggtgttgagggagaactatcttttgtgacattggatgagattggggaagaggaagatgcagctgcacatctagcacaagctctagtcactgtggatgaagtaattgatgaagaagaactaaatatggaagaaatggtaaaaaattcaaattcactttttacattagatgaattaattgaccaagatgattgcatttcccacagtgaacctaaagatgttactgttctgtcagtggctgaagaacaagatctcctcaaacaggaacgcttggtaactgtggatgaaattggagaagtggaagagctacctttgaatgagtcagcagacataacttttgccactttaaatactaaaggaaatgaaggagatactgtaagggattccattggcttcatttcttctcaggtgcccgaagacccttctactttagttactgtagatgaaatacaagatgacagcagtgatttgcatttagtgactttggatgaagtaactgaagaggatgaagactctctggcggattttaacaaccttaaagaagagcttaattttgttactgttgatgaagttggagaggaggaagatggagataatgatttaaaagttgagttagcacaaagcaaaaatgaccatcccacagataaaaaagggaatagaaagaagagagctgtggacacaaaaaagacaaaacttgaatccttgtcccaagtgggtccagtaaatgagaatgttatggaagaagatctaaaaaccatgattgaaagacacttaacagctaaaactccaaccaagagagttagaattgggaaaactctgccatcagaaaaagctgttgtgacagaaccagcaaaaggtgaagaggccttccagatgagtgaagttgatgaggaatctggattaaaggattcagaaccagagcgaaaacgcaagaagactgaagactcttcttcaggcaaatcagtggcgtctgatgtccctgaggaattagactttcttgtacctaaggctggattcttctgtccaatttgttccctcttctactcaggtgaaaaagcaatgacaaatcactgcaagagtacacgtcataagcaaaatactgagaaattcatggccaagcaaagaaaggaaaaggagcagaatgaggctgaagaaagaagctctaggtgattgggggaaaggaaagaattcactagaaatttgtttagggtccagttgatttgtgtatttttgttatcatttaatttgtaattttcgtttcagaagcaaatattcgtgttgtacaaatttctgattgccctaaatgtagagagactgatggggaaagtatgatgggtttgatttttatatcaaatcatcaggcatggagaaatatcttttagaagtgttaaaataaatgttcctactgtatatttaaaatacca

SEQ ID NO: 203287 - DNA, 6821 bp, Homo sapiens
  Payload ID: 20089
  Gene Name: zinc finger protein 638
  Uniprot ID: Q14966
  ENST ID: ENST00000409544
  CDS Start-End: 631-6567
gcatgcgtgcagctctttggaggcggtagcgttttcggcgtcgagactggaggctgagtgctaaactgtgtggggcgcggatgggatccagctgttagtcggtattacagcgtgaaataaattcccagtatttttcaagattatgtaaaaggagttgtaattactgctcagcacctaggacagcacccagtgcaacacaatgtacatgaactctggcttgaggtttggggcttgtgttctgcattcaggaaagaaaagaagagaaagtttttgggaaatttaaatcttcgtaagcccttactctaaaagtatatgaaatgcagaatggtttcatggctttatttcaaaatgttttacactggctgtagaacccacttcatgaagtagtttgagttaaaatgatctaatatttgtgttttaactttcagctttgtgttattcttggaaaatttcgcaccacttgtgaattccttgaacctgggcattgcaaacccacttctgttgggcccatctcctttgcactttgctcagattaagactcagttggcgcttcagcagctgaatgccgttgcctcacatggttcaacaccaccttatactttattaaatcaggctttcttgaaaatagccatgtcgagacccaggtttaatcctcgaggagactttccacttcaaaggccacgagcacctaacccttctgggatgaggcctccaggaccatttatgaggcctggatctatgggtctcccaagattttacccagcagggagagcacgtggaattccacacagatttgctggccatgaatcttatcagaacatggggccacagagaatgaatgttcaggtaactcaacacagaactgatccaagattgaccaaagaaaaactggattttcatgaagcacaacagaagaaggggaagcctcatggtagccggtgggatgatgagcctcatatatctgcatcagtggcagtgaaacagagttctgtaacacaggttacagagcagagtcccaaagtacagagccgctatacaaaagagagtgcctcaagtatcttagcaagttttggattatctaatgaagacctagaagaacttagtcgctatcctgatgaacaactaactcctgaaaatatgccattaattttgagggatataagaatgcgaaaaatggggcgccgattacctaatttaccttctcagagcagaaataaagaaacacttggtagtgaagcagtttcaagtaatgtgatcgattatgggcatgcaagcaaatatggctacacagaagatccacttgaagtacgtatttatgatcctgaaattccaactgatgaggtcgagaatgaatttcagtcacagcagaacatttctgcatctgttcccaatccaaatgtgatatgtaattctatgtttcctgttgaagacgtatttcgccaaatggacttccccggtgagtcctccaataatcggtcctttttctcagttgagagtggaaccaagatgtcaggcttacacatttcaggaggacagtcagtccttgaacccataaaatccgtcaaccaatccattaaccaaacagttagccagacaatgagtcaatctctgattcctccatctatgaaccagcaacctttttcgtcggaattaatttcatctgtaagccagcaagagcggatcccacatgaacctgtgattaattcatctaacgtacatgttggatcaagaggaagtaaaaagaattaccagtcacaggctgacattcccattcggtctccctttggtattgtgaaagcatcctggctaccaaagttttcacatgctgatgcccagaagatgaagagacttccaactccttctatgatgaatgattattatgcagcatctccaagaatatttccacatttgtgttctctgtgtaacgtagaatgtagtcatttgaaggattggattcagcatcaaaatacatctactcatattgagagctgtcgacagttacgtcaacagtatcctgattggaatcctgagatcctcccatcgagaagaaatgagggcaatagaaaagaaaatgaaactccacgaagacgttctcattcccccagtcctaggcgttctagaagatcaagctcaagtcacagattccgtcggtctcgaagcccaatgcattacatgtataggccgagaagtcgaagtccaagaatttgccatcgtttcatttctagatacagatccagatccagatcccgttcaccatatcgaattagaaatccatttagaggtagtccaaaatgctttcgatcagttagccctgagaggatgtcaaggagatcagtgagatcatcagatagaaaaaaagcattagaagatgtagtacaacgatctgggcatgggacagaatttaataaacagaagcatcttgaagctgctgataagggacattcaccagcacaaaagcctaaaactagcagtggaacaaaaccatcagttaaacctacaagcgctacaaagagtgattcaaatctaggaggacattctattcgttgtaaatcaaagaatcttgaagatgacactttgtcagaatgtaaacaggtgtctgataaagctgtttctctccagcgaaagcttcggaaagaacagtcattgcattatggttcggttcttcttataactgaattaccagaggatggttgtactgaagaagatgtgagaaaattatttcaaccatttgggaaagtgaatgatgtcctaattgttccatatagaaaagaggcttacctagaaatggaatttaaagaggcaattactgcaattatgaagtacattgaaacaacacctcttacgataaaaggaaaaagtgtgaaaatatgtgttccaggaaagaaaaaagcacagaacaaagaggtgaagaaaaagactttagagtcaaagaaagtatctgcatctaccttaaaaagagatgcagatgcttcaaaagctgttgaaattgttacttcaacttctgctgccaaaactggacaagccaaggcatctgtagccaaagtaaacaaatctacagggaaatcagcaagttctgtaaaatctgtggtaacggtagctgttaaaggtaataaagcttcaatcaaaacagcaaaatctggtggaaagaagtctctagaagccaaaaagactgggaatgtcaaaaacaaagactctaacaaacctgtgactataccagaaaactctgaaataaagaccagtattgaagtcaaagccactgaaaactgtgctaaagaagctatttctgatgctgctttggaggccacagagaatgaaccacttaacaaggaaacagaagaaatgtgtgtgatgcttgtctctaatttgcctaataaaggatattctgtagaagaagtttatgacttagcaaaaccatttggtggtttaaaggatatcttgattttatcatctcataaaaaggcatatatagaaataaatagaaaagctgctgagtctatggtaaaattttatacctgcttcccagtattgatggatggaaatcaactctcaataagtatggctcctgaaaacatgaatataaaagatgaggaagctatatttataaccttggtaaaagaaaatgacccagaggcaaacatagatacaatttatgatcgatttgtacatcttgataatttaccggaagatggacttcagtgtgtactttgtgttggacttcagtttggaaaagtggatcaccatgtattcataagtaatagaaacaaggcaattcttcagttagatagtcctgaatctgctcagtcaatgtatagctttctgaaacaaaatccacaaaatattggtgaccatatgttgacctgctcattatctccaaagatagacttaccagaggtgcaaattgagcatgacccagaattagaaaaagaaagccctggcttgaaaaacagtccaattgatgaaagtgaggtgcaaacagcaactgatagtccctctgttaaacctaatgagcttgaagaagaaagtactcccagcattcaaacagaaactttggtacagcaggaagagccttgtgaggaagaagctgaaaaagcaacatgtgattctgactttgctgttgaaactttggagcttgaaactcaaggagaggaggtcaaagaagaaattcctcttgtagcatccgcttcagtcagtattgaacaattcactgaaaatgccgaggagtgtgctttaaatcagcagatgtttaacagtgacttggagaagaaaggggcagaaattattaaccctaaaacagcattgttaccatctgacagtgtgtttgcagaagaaaggaacctcaaaggaattctagaagaatctccatctgaagcagaagatttcatttctggaattacacagactatggtagaagctgtagctgaagtagaaaaaaatgaaactgtttcggaaatattgccatcaacttgtattgtgacgttagtaccaggaattcccactggggatgagaagacagtggacaaaaagaatatttctgaaaaaaaaggtaacatggatgaaaaggaggagaaggaatttaatactaaggaaaccagaatggatcttcaaataggaacagagaaggctgaaaagaatgaaggtaggatggatgcagaaaaggtggaaaagatggcagcaatgaaagaaaagcctgcagaaaacactttattcaaggcatacccaaataaaggagtgggtcaggctaataagcctgatgaaactagtaaaactagtattctggctgtatcagatgtatctagcagtaaaccaagcatcaaggctgttatagtctcttctcctaaggcaaaagctacagtttcaaaaactgaaaatcagaaaagttttccaaaatctgtgcccagagatcaaataaatgctgaaaagaaactttcagccaaggaatttggtctgcttaaacccacaagtgccaggtcaggcttggcagaaagcagcagtaaattcaaacctactcagagcagtcttaccagaggaggcagtggaaggatctcagccctgcaaggcaagctttctaaactggattacagagatataacaaaacaatctcaggaaacagaggctagaccttccatcatgaaacgggatgacagcaacaataagactttggctgagcaaaacactaagaatcctaaaagcactactggtagaagttccaaatctaaagaggagccattatttccatttaatttggatgaatttgttactgtggatgaggttatagaagaagtgaatccttctcaggccaagcagaatccactaaagggaaaaaggaaagaaactctcaaaaatgttcctttctctgaacttaacttaaagaagaaaaaggggaaaacttccactcctcgtggtgttgagggagaactatcttttgtgacattggatgagattggggaagaggaagatgcagctgcacatctagcacaagctctagtcactgtggatgaagtaattgatgaagaagaactaaatatggaagaaatggtaaaaaattcaaattcactttttacattagatgaattaattgaccaagatgattgcatttcccacagtgaacctaaagatgttactgttctgtcagtggctgaagaacaagatctcctcaaacaggaacgcttggtaactgtggatgaaattggagaagtggaagagctacctttgaatgagtcagcagacataacttttgccactttaaatactaaaggaaatgaaggagatactgtaagggattccattggcttcatttcttctcaggtgcccgaagacccttctactttagttactgtagatgaaatacaagatgacagcagtgatttgcatttagtgactttggatgaagtaactgaagaggatgaagactctctggcggattttaacaaccttaaagaagagcttaattttgttactgttgatgaagttggagaggaggaagatggagataatgatttaaaagttgagttagcacaaagcaaaaatgaccatcccacagataaaaaagggaatagaaagaagagagctgtggacacaaaaaagacaaaacttgaatccttgtcccaagtgggtccagtaaatgagaatgttatggaagaagatctaaaaaccatgattgaaagacacttaacagctaaaactccaaccaagagagttagaattgggaaaactctgccatcagaaaaagctgttgtgacagaaccagcaaaaggtgaagaggccttccagatgagtgaagttgatgaggaatctggattaaaggattcagaaccagagcgaaaacgcaagaagactgaagactcttcttcaggcaaatcagtggcgtctgatgtccctgaggaattagactttcttgtacctaaggctggattcttctgtccaatttgttccctcttctactcaggtgaaaaagcaatgacaaatcactgcaagagtacacgtcataagcaaaatactgagaaattcatggccaagcaaagaaaggaaaaggagcagaatgaggctgaagaaagaagctctaggtgattgggggaaaggaaagaattcactagaaatttgtttagggtccagttgatttgtgtatttttgttatcatttaatttgtaattttcgtttcagaagcaaatattcgtgttgtacaaatttctgattgccctaaatgtagagagactgatggggaaagtatgatgggtttgatttttatatcaaatcatcaggcatggagaaatatcttttagaagtgttaaaataaatgttcctactgtatatttaaaatacca

SEQ ID NO: 203288 - DNA, 931 bp, Homo sapiens
  Payload ID: 20089
  Gene Name: zinc finger protein 638
  ENST ID: ENST00000437658
  CDS Start-End: 341-931
gggagcctacgagggctcgcaggagctgggaggcgcgcatgcgtgcagctctttggaggcggtagcgttttcggcgtcgagactggaggctgagtgctaaactgtgtggggcgcggatgggatccagctgttagtcggctttgtgttattcttggaaaatttcgcaccacttgtgaattccttgaacctgggcattgcaaacccacttctgttgggcccatctcctttgcactttgctcagattaagactcagttggcgcttcagcagctgaatgccgttgcctcacatggttcaacaccaccttatactttattaaatcaggctttcttgaaaatagccatgtcgagacccaggtttaatcctcgaggagactttccacttcaaaggccacgagcacctaacccttctgggatgaggcctccaggaccatttatgaggcctggatctatgggtctcccaagattttacccagcagggagagcacgtggaattccacacagatttgctggccatgaatcttatcagaacatggggccacagagaatgaatgttcaggtaactcaacacagaactgatccaagattgaccaaagaaaaactggattttcatgaagcacaacagaagaaggggaagcctcatggtagccggtgggatgatgagcctcatatatctgcatcagtggcagtgaaacagagttctgtaacacaggttacagagcagagtcccaaagtacagagccgctatacaaaagagagtgcctcaagtatcttagcaagttttggattatctaatgaagacctagaagaacttagtcgctatcctgatgaacaactaactcctgaaaatatgccattaattttgagggatataagaatgcgaaaaatggggcgccgattacctaatttaccttctcagagcagaaataaagaa

SEQ ID NO: 203289 - DNA, 760 bp, Homo sapiens
  Payload ID: 20089
  Gene Name: zinc finger protein 638
  ENST ID: ENST00000417778
  CDS Start-End: 673-760
ggaggcggtagcgttttcggcgtcgagactggaggctgagtgctaaactgtgtggggcgcggatgggatccagctgttagtcgggtaggcataggcgaagtttggggccaggaccagaaattgtagtagtttaaaggagtcccgatgaaaaacttgtcaccaggatccagcgatttatgttcaagtactttttccaacgagctctggaattttgcacaaaaaattttctgctttttcccctcatttgttgtaaaggattattttttcagggatgttgtgcttgctggttcagatttacaattaaaaattgataacctggagaaaaggattgaccaaaaaaaggttatttatttcataagatgactatccataaatcttccgatgaacgaacctctttatgaccagagctcctggggttaaaggagaaaggttttataatggctgtcttaatttgtttggtggttttccagctttgtgttattcttggaaaatttcgcaccacttgtgaattccttgaacctgggcattgcaaacccacttctgttgggcccatctcctttgcactttgctcagattaagactcagttggcgcttcagcagctgaatgccgttgcctcacatggttcaacaccaccttatactttattaaatcaggctttcttgaaaatagccatgtcgagacccaggtttaatcctcgaggagactttccacttcaaaggccacgagcacctaacccttctgggatgaggcctccaggac

SEQ ID NO: 203290 - DNA, 595 bp, Homo sapiens
  Payload ID: 20089
  Gene Name: zinc finger protein 638
  ENST ID: ENST00000454278
  CDS Start-End: 409-595
atgcgtgcagctctttggaggcggtagcgttttcggcgtcgagactggaggctgagtgctaaactgtgtggggcgcggatgggatccagctgttagtcgggtaggcatagtgttttgaaatttgtgatggaaaattaaaatggaaggaaaataagtatatagaagatgagaagagaataatggaaaggaaaaagagtgaggaaaagctttgtgttattcttggaaaatttcgcaccacttgtgaattccttgaacctgggcattgcaaacccacttctgttgggcccatctcctttgcactttgctcagattaagactcagttggcgcttcagcagctgaatgccgttgcctcacatggttcaacaccaccttatactttattaaatcaggctttcttgaaaatagccatgtcgagacccaggtttaatcctcgaggagactttccacttcaaaggccacgagcacctaacccttctgggatgaggcctccaggaccatttatgaggcctggatctatgggtctcccaagattttacccagcagggagagcacgtggaattccacacagatttgctggccatgaatcttatcaga

SEQ ID NO: 203291 - DNA, 585 bp, Homo sapiens
  Payload ID: 20089
  Gene Name: zinc finger protein 638
  ENST ID: ENST00000455226
  CDS Start-End: 399-585
atgcgtgcagctctttggaggcggtagcgttttcggcgtcgagactggaggctgagtgctaaactgtgtggggcgcggatgggatccagctgttagtcggtgttttgaaatttgtgatggaaaattaaaatggaaggaaaataagtatatagaagatgagaagagaataatggaaaggaaaaagagtgaggaaaagctttgtgttattcttggaaaatttcgcaccacttgtgaattccttgaacctgggcattgcaaacccacttctgttgggcccatctcctttgcactttgctcagattaagactcagttggcgcttcagcagctgaatgccgttgcctcacatggttcaacaccaccttatactttattaaatcaggctttcttgaaaatagccatgtcgagacccaggtttaatcctcgaggagactttccacttcaaaggccacgagcacctaacccttctgggatgaggcctccaggaccatttatgaggcctggatctatgggtctcccaagattttacccagcagggagagcacgtggaattccacacagatttgctggccatgaatcttatcaga

SEQ ID NO: 203292 - DNA, 731 bp, Homo sapiens
  Payload ID: 20089
  Gene Name: zinc finger protein 638
  ENST ID: ENST00000454122
  CDS Start-End: 623-731
ggaggcggtagcgttttcggcgtcgagactggaggctgagtgctaaactgtgtggggcgcggatgggatccagctgttagtcgggtaggcatagtattacagcgtgaaataaattcccagtatttttcaagattatgtaaaaggagttgtaattactgctcagcacctaggacagcacccagtgcaacacaatgtacatgaactctggcttgaggtttggggcttgtgttctgcattcaggaaagaaaagaagagaaagtttttgggaaatttaaatcttcgtaagcccttactctaaaagtatatgaaatgcagaatggtttcatggctttatttcaaaatgttttacactggctgtagaacccacttcatgaagtagtttgagttaaaatgatctaatatttgtgttttaactttcagctttgtgttattcttggaaaatttcgcaccacttgtgaattccttgaacctgggcattgcaaacccacttctgttgggcccatctcctttgcactttgctcagattaagactcagttggcgcttcagcagctgaatgccgttgcctcacatggttcaacaccaccttatactttattaaatcaggctttcttgaaaatagccatgtcgagacccaggtttaatcctcgaggagactttccacttcaaaggccacgagcacctaacccttctgggatgaggcctccaggaccatttatgaggcctggatcta

SEQ ID NO: 203293 - DNA, 560 bp, Homo sapiens
  Payload ID: 20089
  Gene Name: zinc finger protein 638
  ENST ID: ENST00000466975
  CDS Start-End: 47-560
gtgcaaggcgtgtgaggcgcgtagagagccgcgcgcgccgtctgcgatgccccgggacggcgttcctgccgggaataccaccccggcggcagcccaggctgccgcgcagagcccggattccgcgactgccggggcaccgcaggttttggactcgctgaagcggtatcctgattggaatcctgagatcctcccatcgagaagaaatgagggcaatagaaaagaaaatgaaactccacgaagacgttctcattcccccagtcctaggcgttctagaagatcaagctcaagtcacagattccgtcggtctcgaagcccaatgcattacatgtataggccgagaagtcgaagtccaagaatttgccatcgtttcatttctagatacagatccagatccagatcccgttcaccatatcgaattagaaatccatttagaggtagtccaaaatgctttcgatcagttagccctgagaggatgtcaaggagatcagtgagatcatcagatagaaaaaaagcattagaagatgtagtacaacgatctgggcatgggacagaatttaata

SEQ ID NO: 203294 - DNA, 590 bp, Homo sapiens
  Payload ID: 20089
  Gene Name: zinc finger protein 638
  ENST ID: ENST00000475743
  CDS Start-End: 321-590
gcgcatgcgtgcagctctttggaggcggtagcgttttcggcgtcgagactggaggctgagtgctaaactgtgtggggcgcggatgggatccagctgttagtcgggattggattcagcatcaaaatacatctactcatattgagagctgtcgacagttacgtcaacagtatcctgattggaatcctgagatcctcccatcgagaagaaatgagggcaatagaaaagaaaatgaaactccacgaagacgttctcattcccccagtcctaggcgttctagaagatcaagctcaagtcacagattccgtcggtctcgaagcccaatgcattacatgtataggccgagaagtcgaagtccaagaatttgccatcgtttcatttctagatacagatccagatccagatcccgttcaccatatcgaattagaaatccatttagaggtagtccaaaatgctttcgatcagttagccctgagaggatgtcaaggagatcagtgagatcatcagatagaaaaaaagcattagaagatgtagtacaacgatctgggcatgggacagaatttaataaacagaagcatcttgaagctgctgat

SEQ ID NO: 203295 - DNA, 846 bp, Homo sapiens
  Payload ID: 20089
  Gene Name: zinc finger protein 638
  ENST ID: ENST00000461991
  CDS Start-End: 1-476
aaaaagggaatagaaagaagagagctgtggacacaaaaaagacaaaacttgaatccttgtcccaagtgggtccagtaaatgagaatgttatggaagaagatctaaaaaccatgattgaaagacacttaacagctaaaactccaaccaagagagttagaattgggaaaactctgccatcagaaaaagctgttgtgacagaaccagcaaaaggtgaagaggccttccagatgagtgaagttgatgaggaatctggattaaaggattcagaaccagagcgaaaacgcaagaagactgaagactcttcttcaggcaaatcagtggcgtctgatgtccctgaggaattagactttcttgtacctaaggctggattcttctgtccaatttgttccctcttctactcaggtgaaaaagcaatgacaaatcactgcaagagtacacgtcataagcaaaatactgagcaacatttgccagagtagattctgcagatcactagtctcatatgacactccattattaaaaaattcatggccaagcaaagaaaggaaaaggagcagaatgaggctgaagaaagaagctctaggtgattgggggaaaggaaagaattcactagaaatttgtttagggtccagttgatttgtgtatttttgttatcatttaatttgtaattttcgtttcagaagcaaatattcgtgttgtacaaatttctgattgccctaaatgtagagagactgatggggaaagtatgatgggtttgatttttatatcaaatcatcaggcatggagaaatatcttttagaagtgttaaaataaatgttcctactgtatatttaaaataccatctgtgtt

SEQ ID NO: 203296 - DNA, 626 bp, Homo sapiens
  Payload ID: 20089
  Gene Name: zinc finger protein 638
  ENST ID: ENST00000464375
  CDS Start-End: 333-626
gcgcgcatgcgtgcagctctttggaggcggtagcgttttcggcgtcgagactggaggctgagtgctaaactgtgtggggcgcggatgggatccagctgttagtcgggtaggcataggattggattcagcatcaaaatacatctactcatattgagagctgtcgacagttacgtcaacagtatcctgattggaatcctgagatcctcccatcgagaagaaatgagggcaatagaaaagaaaatgaaactccacgaagacgttctcattcccccagtcctaggcgttctagaagatcaagctcaagtcacagattccgtcggtctcgaagcccaatgcattacatgtataggccgagaagtcgaagtccaagaatttgccatcgtttcatttctagatacagatccagatccagatcccgttcaccatatcgaattagaaatccatttagaggtagtccaaaatgctttcgatcagttagccctgagaggatgtcaaggagatcagtgagatcatcagatagaaaaaaagcattagaagatgtagtacaacgatctgggcatgggacagaatttaataaacagaagcatcttgaagctgctgataagggacattcaccagcacaaaag

SEQ ID NO: 203297 - DNA, 746 bp, Homo sapiens
  Payload ID: 20089
  Gene Name: zinc finger protein 638
  ENST ID: ENST00000466330
  CDS Start-End: 195-746
cgggacggcgttcctgccgggaataccaccccggcggcagcccaggctgccgcgcagagcccggattccgcgactgccggggcaccgcaggttttggactcgctgaagcggattggattcagcatcaaaatacatctactcatattgagagctgtcgacagttacgtcaacatttgtcctctcataattaaaagatgctccagacaatatatctattctcaaagtatcctgattggaatcctgagatcctcccatcgagaagaaatgagggcaatagaaaagaaaatgaaactccacgaagacgttctcattcccccagtcctaggcgttctagaagatcaagctcaagtcacagattccgtcggtctcgaagcccaatgcattacatgtataggccgagaagtcgaagtccaagaatttgccatcgtttcatttctagatacagatccagatccagatcccgttcaccatatcgaattagaaatccatttagaggtagtccaaaatgctttcgatcagttagccctgagaggatgtcaaggagatcagtgagatcatcagatagaaaaaaagcattagaagatgtagtacaacgatctgggcatgggacagaatttaataaacagaagcatcttgaagctgctgataagggacattcaccagcacaaaagcctaaaactagcagtggaacaaaaccatcagttaaacctacaagcgctacaaagagtgattcaaatctaggagga

SEQ ID NO: 203298 - DNA, 3518 bp, Homo sapiens
  Payload ID: 20089
  Gene Name: zinc finger protein 638
  ENST ID: ENST00000410075
  CDS Start-End: 365-3121
gtgcaaggcgtgtgaggcgcgtagagagccgcgcgcgccgtctgcgatgccccgggacggcgttcctgccgggaataccaccccggcggcagcccaggctgccgcgcagagcccggattccgcgactgccggggcaccgcaggttttggactcgctgaagcgctttgtgttattcttggaaaatttcgcaccacttgtgaattccttgaacctgggcattgcaaacccacttctgttgggcccatctcctttgcactttgctcagattaagactcagttggcgcttcagcagctgaatgccgttgcctcacatggttcaacaccaccttatactttattaaatcaggctttcttgaaaatagccatgtcgagacccaggtttaatcctcgaggagactttccacttcaaaggccacgagcacctaacccttctgggatgaggcctccaggaccatttatgaggcctggatctatgggtctcccaagattttacccagcagggagagcacgtggaattccacacagatttgctggccatgaatcttatcagaacatggggccacagagaatgaatgttcaggtaactcaacacagaactgatccaagattgaccaaagaaaaactggattttcatgaagcacaacagaagaaggggaagcctcatggtagccggtgggatgatgagcctcatatatctgcatcagtggcagtgaaacagagttctgtaacacaggttacagagcagagtcccaaagtacagagccgctatacaaaagagagtgcctcaagtatcttagcaagttttggattatctaatgaagacctagaagaacttagtcgctatcctgatgaacaactaactcctgaaaatatgccattaattttgagggatataagaatgcgaaaaatggggcgccgattacctaatttaccttctcagagcagaaataaagaaacacttggtagtgaagcagtttcaagtaatgtgatcgattatgggcatgcaagcaaatatggctacacagaagatccacttgaagtacgtatttatgatcctgaaattccaactgatgaggtcgagaatgaatttcagtcacagcagaacatttctgcatctgttcccaatccaaatgtgatatgtaattctatgtttcctgttgaagacgtatttcgccaaatggacttccccggtgagtcctccaataatcggtcctttttctcagttgagagtggaaccaagatgtcaggcttacacatttcaggaggacagtcagtccttgaacccataaaatccgtcaaccaatccattaaccaaacagttagccagacaatgagtcaatctctgattcctccatctatgaaccagcaacctttttcgtcggaattaatttcatctgtaagccagcaagagcggatcccacatgaacctgtgattaattcatctaacgtacatgttggatcaagaggaagtaaaaagaattaccagtcacaggctgacattcccattcggtctccctttggtattgtgaaagcatcctggctaccaaagttttcacatgctgatgcccagaagatgaagagacttccaactccttctatgatgaatgattattatgcagcatctccaagaatatttccacatttgtgttctctgtgtaacgtagaatgtagtcatttgaaggattggattcagcatcaaaatacatctactcatattgagagctgtcgacagttacgtcaacagtatcctgattggaatcctgagatcctcccatcgagaagaaatgagggcaatagaaaagaaaatgaaactccacgaagacgttctcattcccccagtcctaggcgttctagaagatcaagctcaagtcacagattccgtcggtctcgaagcccaatgcattacatgtataggccgagaagtcgaagtccaagaatttgccatcgtttcatttctagatacagatccagatccagatcccgttcaccatatcgaattagaaatccatttagaggtagtccaaaatgctttcgatcagttagccctgagaggatgtcaaggagatcagtgagatcatcagatagaaaaaaagcattagaagatgtagtacaacgatctgggcatgggacagaatttaataaacagaagcatcttgaagctgctgataagggacattcaccagcacaaaagcctaaaactagcagtggaacaaaaccatcagttaaacctacaagcgctacaaagagtgattcaaatctaggaggacattctattcgttgtaaatcaaagaatcttgaagatgacactttgtcagaatgtaaacaggtgtctgataaagctgtttctctccagcgaaagcttcggaaagaacagtcattgcattatggttcggttcttcttataactgaattaccagaggatggttgtactgaagaagatgtgagaaaattatttcaaccatttgggaaagtgaatgatgtcctaattgttccatatagaaaagaggcttacctagaaatggaatttaaagaggcaattactgcaattatgaagtacattgaaacaacacctcttacgataaaaggaaaaagtgtgaaaatatgtgttccaggaaagaaaaaagcacagaacaaagaggtgaagaaaaagactttagagtcaaagaaagtatctgcatctaccttaaaaagagatgcagatgcttcaaaagctgttgaaattgttacttcaacttctgctgagtcggtggatcagactcagcagctggtgcccctcgtgaggaacactgcaagggatcacgacggaacccccgaaaatgaaggcgaagagactgtgcagtcagccctctttggattccagtacgatgcatcagaccataccatggcgtggctaggacccaacacagtaccagaagtgaaggaaatgatcctgcaggacccgcagctccagacaacacagcttcctcagacgacacaagccccggacattacctgggggatgctgaagaagacaacttacaaggctgagcaaatcctgctccagacacagaaaccattcactccagataatttgttccttgctctgctctctggtgatgcaaagccggaatacgagcagtaatcgctacgcctgacaaacctgctgctgtgcacatctgtactcttcaatcaacaaaacctgatgcaaaaaacaaaagggggagatgtaggagatcagtcagggtggtgggaaaagttataaggagagacgcaaaccttcttggaagtccaggaggttttgcaaagcttcgggagagaataaaggctgaaggcagctaaattctcttaccctgacgctaagggcaagaagtaggtaacaaaggagtgtaaaggaatttatctagacgagttttatttacttttgcagacctttgatcatcctattgcgcgcaggactgctcccaaggcggtgggggtgacaattacctacagattgtgttggctccaggcctttgtcattaaatctgtactgaataaat

SEQ ID NO: 203299 - DNA, 871 bp, Homo sapiens
  Payload ID: 20089
  Gene Name: zinc finger protein 638
  ENST ID: ENST00000494621
  CDS Start-End: 411-871
ggagtcctgcgccttgaggctcaagcggcggcgtgcaaggcgtgtgaggcgcgtagagagccgcgcgcgccgtctgcgatgccccgggacggcgttcctgccgggaataccaccccggcggcagcccaggctgccgcgcagagcccggattccgcgactgccggggcaccgcaggttttggactcgctgaagcggattggattcagcatcaaaatacatctactcatattgagagctgtcgacagttacgtcaacagtatcctgattggaatcctgagatcctcccatcgagaagaaatgagggcaatagaaaagaaaatgaaactccacgaagacgttctcattcccccagtcctaggcgttctagaagatcaagctcaagtcacagattccgtcggtctcgaagcccaatgcattacatgtataggccgagaagtcgaagtccaagaatttgccatcgtttcatttctagatacagatccagatccagatcccgttcaccatatcgaattagaaatccatttagaggtagtccaaaatgctttcgatcagttagccctgagaggatgtcaaggagatcagtgagatcatcagatagaaaaaaagcattagaagatgtagtacaacgatctgggcatgggacagaatttaataaacagaagcatcttgaagctgctgataagggacattcaccagcacaaaagcctaaaactagcagtggaacaaaaccatcagttaaacctacaagcgctacaaagagtgattcaaatctaggaggacattctattcgttgtaaatcaaagaatcttgaagatgacactttgtcagaatgtaaacaggtgtctgataaagctgtttctctccagcgaaa

SEQ ID NO: 203300 - DNA, 1107 bp, Homo sapiens
  Payload ID: 20089
  Gene Name: zinc finger protein 638
  ENST ID: ENST00000493576
  CDS Start-End: 1-856
acctaaagatgttactgttctgtcagtggctgaagaacaagatctcctcaaacaggaacgcttggtaactgtggatgaaattggagaagtggaagagctacctttgaatgagtcagcagacataacttttgccactttaaatactaaaggaaatgaaggagatactgtaagggattccattggcttcatttcttctcaggtgcccgaagacccttctactttagttactgtagatgaaatacaagatgacagcagtgatttgcatttagtgactttggatgaagtaactgaagaggatgaagactctctggcggattttaacaaccttaaagaagagcttaattttgttactgttgatgaagttggagaggaggaagatggagataatgatttaaaagttgagttagcacaaagcaaaaatgaccatcccacagataaaaaagggaatagaaagaagagagctgtggacacaaaaaagacaaaacttgaatccttgtcccaagtgggtccagtaaatgagaatgttatggaagaagatctaaaaaccatgattgaaagacacttaacagttgatgaggaatctggattaaaggattcagaaccagagcgaaaacgcaagaagactgaagactcttcttcaggcaaatcagtggcgtctgatgtccctgaggaattagactttcttgtacctaaggctggattcttctgtccaatttgttccctcttctactcaggtgaaaaagcaatgacaaatcactgcaagagtacacgtcataagcaaaatactgagaaattcatggccaagcaaagaaaggaaaaggagcagaatgaggctgaagaaagaagctctaggtgattgggggaaaggaaagaattcactagaaatttgtttagggtccagttgatttgtgtatttttgttatcatttaatttgtaattttcgtttcagaagcaaatattcgtgttgtacaaatttctgattgccctaaatgtagagagactgatggggaaagtatgatgggtttgatttttatatcaaatcatcaggcatggagaaatatcttttagaagtgttaaaataaatgttcctactgtatatttaaaata

SEQ ID NO: 203301 - DNA, 6064 bp, Homo sapiens
  Payload ID: 20090
  Gene Name: zinc finger protein 639
  Uniprot ID: Q9UID6
  ENST ID: ENST00000326361
  CDS Start-End: 446-1903
caacgagttgtagccgcggagagcaggcgtcgatgctggcgcccaaagcctccagcctgagagtcgcctcactcgtgtgacgacagagtttcactcctgttacccaggctggaggacaatgatgtgatctcgggtcaccacaacctccgcctcccggattcaagcgattctcatgcctcagcctcccgagtagctcagattacaggcatgtgccaccacgcccggctaattttgtattttcagtcgagacggggtttccccatgttggtcaggctagtcttgaattcccgacctcaggtgatctgttcgcctcggcctcccaaagtgctgggattacaggcgtgaaccactgcacccggcgaggcattttttactgtctacagaaacttattgtaattcatttttcctcactccagtagtaagaattataccaaattgaaaagatatgaatgagtatcctaaaaaaagaaaaaggaagactctacacccttctcgttattcagattcctctggaataagcagaattgcagatggattcaatggaattttctctgatcattgttacagtgtctgttctatgagacagccagatttaaaatattttgacaacaaagatgatgattctgataccgagacgtcaaatgacttgccaaaatttgcagatggaatcaaggccagaaacagaaatcagaactacctggttcccagtcctgtacttagaattctagaccacactgccttttctacagaaaaatctgctgatattgtaatttgtgatgaagagtgtgactcacctgaatcagtcaaccagcaaacccaagaggagagtcctatagaagttcacactgctgaagatgttccaattgctgtagaagtgcatgcgatttctgaggattatgatatagagacagaaaacaattcctctgagagtctccaagaccaaactgatgaagaaccgccagctaaactttgtaaaattcttgacaagagccaagctttgaatgtgactgcccagcagaaatggcctttactgagagctaatagcagtggcctctataaatgtgaactttgtgagtttaacagcaaatatttttctgacttaaagcagcatatgatcctgaagcataaacgtactgattcaaatgtgtgtcgagtatgcaaggaaagtttctctaccaatatgcttctgatagaacatgccaaactgcatgaagaggatccctacatttgtaaatactgtgattataagacagtaatttttgagaacctcagccagcacattgcagacacccattttagtgatcacctctattggtgtgaacagtgtgatgtacagttctcctcaagcagtgaactctacctacatttccaggagcacagctgtgatgaacagtacttgtgtcagttctgtgaacatgaaactaatgatccagaagacttgcatagccatgtggtaaatgagcatgcatgtaaattaatagagttaagtgataagtataacaatggtgaacatggacagtatagcctcttaagcaaaattacctttgacaaatgtaaaaacttctttgtatgtcaagtatgtggttttcggagtagacttcacacaaatgttaacaggcatgttgctattgaacatacaaaaatttttcctcatgtttgtgatgactgtgggaaaggcttttcaagtatgctagaatattgcaagcatttaaattcacatttatctgaagggatttatttatgtcaatattgtgaatattcaacaggacaaattgaagatcttaaaattcatctagatttcaagcattcagctgacttgcctcataaatgtagtgactgcttgatgaggtttggaaatgaaagggaattaataagtcaccttccagtccatgagacaacttgattattctctttaacttacagaatgttagtttaaaataataaattcatcctttttttggagatgattaaatggatgattgtaaacacaacttatgaaatctgcctttaacaagtaacttttttaaattataaaattttattggcattgctccattttctgtatataaatatatctttaatgtggtattttcaattgcgtgatagtttgtagtttcaaccactcttggtgactgtcatcctgtttcttccatattctctgatttcatgaattgaaaagaaacaaatgtattgaagaagtgagctacagttttccttccttaaccatgggtgctagtaactttttaaaactcaagacaagattagttttttatgtgtgaagtcattaaattattacacgaccagaactaaaatgcaatatacagttaagtccacggatactcccattaatgagaaataacactaggaagccactattacaggaagaaaagatttggttttcatggcagtctgtttttttaaaaaaaaatttttgagccactatctattgttgaatattttaagatgggatgagggaggaactaataagggcttacacaataaaaaataactatatcataactcattcataacttgatgtttcattttctgttgaggaaccataaattcattcacagacttaatatttttttcttagagatggtctcgttctgttgtccaggatggagtgcagtggttgatcatagctcccgggctgtagtctcccaggctcgagcaatcctcccacttcaccctcctgcatagctaggactacaggcatgtggcaccatgcccgctaagtttttaaatttcttgtagagatgagatctcgctatgttgcccaggccagtctcaaactcctggactcaagcaatcctcccaccttggccttccaaatcactgggattataggcatgagccattatgcctgactcttgcccaaatttctgatgtcaaattgttcattgacagaaaacccactgaagtatttaaagttaggaagatctgggagataggggttgctggcatgaaaatgtataacttacaacatttattaataaaatgataaattagcatcaatattagttcgtatggctgccataacaaattactacaaactgagttgcctacctagcagaaatttatggtctcacagttgtgaaggccagacattcaaaatggagttattggcagttggttccttctgagggttgtgggggaaggatctgtttcaggtctgtccttggcttgtagatggatagcctcatgttcacatggtgttctccctgtgtgcaagtctgtcccccaaatttcctctttttttttttttttttgcttttttaattttttgagacagaatttcactcttgtcgcccaggctggagtacagtggcgcgatctcagctcattgcaacctccgcctcccaggttcaagtgattctgctgcctcagcttcccaagtagctggggttaacaggcgtcagccaccatgccaggctaattttgtatttttagtagaaacggggtttcaccacgttggccaggctggtctcaaattcctgacctcaggtgatccacctgcctcagtctcccaaagtgctgggattacaggcatgaggcaccgccccaggccaaatttcttgtttttataaagactccagtcatattgattggattagggcccctcccaatgtcctccttttaacttaaagacctgatctccaaataaggtcatattctaaggtgctgaggtttaggacttcaacatatgaatttgggagggaacacaattgagtagcagagtctgaaacagcactataaagaagatagaattatatgtatcattgccctcaaatttaacaagcactgctaacattattttttaggtttattgatataagtggaagatcaatttatgaccaatgattttcccacttcaagaatttagtctgtttggacaatggtggctgcaagtattcttagaaggtattatttttatccccactattttgttgtatgtgcatacctgtgttcctagcaactcacattccatctaattataacattcctgttacggctgataacaaatgtttctcagaagacttaaaattgtaacagtttaaattgtaagataaccttagaaagcatctggtctaaaccctccagttttctaagttccttgcagaaatagaaatgtagatagctatgaggccaagtacatataaccagttatgtctcatgggagtgggatccaggttatctggtttactgtctagtgatgtttccattacatcatgttacataaacctaacctttctccctgggatgttttttgtgactacttcacctaacaattaacctagttgttgataattttgtttttatgctttttatacatctagctccaggaattggatttttggaaaaacaccttaagtaatgccttggtttgtttgttttcttttaatctatttgctgctttacatttggatcaagtgttagtaattgaaaagattgcaggctgggcgtggtggcccacgcctctaatcccagcactttgtgggtggctgagatgggcagatcacgaggtcaggagatccagaccatcctggctaacagtgaaaccccgtctctactaaaaatacaaaaaaaaattagctgggcgtggtggtgggcacctgtagtcccagctactcgggaggctgaggcaggagaatggcgtgaacccgggaggtggagcttgcagtgagccgagatcgcgccaccacattccagcctgggtgacagagtgagactgtctcaaaaaaaaaaaagaaaagaagaaaagattgcaatgcagctactcaagagacatatatccaagtttcagaaccatataattttgtacttttttttttttcagacagtcttgctctgttgcccaggctggagtgtagtggcgtgatcttggctcaaggcaacctccacctctcaggtgtaagcaattctcctgccttagcctcccaagtagctgggattataggcgtgtgccaccacacccggctaatttttgtgtttttaatagagacggggtttcaccatgttgaccaggctggtcttgaactcctgacctcttgtgatctgcccacctcgacctcccaaagtgctaggattacaggcgtgagccactgcacccggcataattttggactttttgatgaatctgcagcttcaggacctatcccaatgacagtttgtcccacaaaaccttttcgccttggcccagttttcaaatcaatgattgaccataaattgcttgaagtagttggtctttatttatttattttttgagatggagccttgctctgtcgcccagactggaatgcagtggcgtgatcttggctcgctgcaacctctgcctcccgggtttaagcaattctcctgcctcagcctcccgagtagctgggatacaggtgcccaccaccacacccagctaatttttctatttttagtagagatggggtttcaccatcttggccaggctggtcttgaactcctgaccttgtgatccacccacttcggcctcccaaagtgctgggattacaggcctgagccaccacgcccggccagtctttatttttaacttaaagaacttcagaaaaacaaacctacctaaaaaaattaacactcctggttttgttttgttttttgttttgttttacttcagagacagacattttcactgtatacttgtgacttgcaccacaattcaagtctgagattacctaactgatgatgtttattaacacttcagtagaattcttcgcagcagtgaacagtagtgacaggtcattatgtttttcttgctgttttaaatcttcatcttacaatgagttattttgaaattccaaaacatttccctgtattccagaaattgaaaatggttgttcactaaaaagcctcttcttttcctgcttataaatttgccaattttgccattttaaatcacctttcttacgtttctctgaattgtatattatttgtcaatttcacagtttctataatctattgtttgctgaattgttacagtcttttgtttttaatagactagcactattcctaattattaaatctgatttacaaagca

SEQ ID NO: 203302 - DNA, 564 bp, Homo sapiens
  Payload ID: 20090
  Gene Name: zinc finger protein 639
  ENST ID: ENST00000494234
  CDS Start-End: 175-564
aaataggaaaatgatttttttcttgaaaattatttatattctgatctgtgtgatgagtacttttttctggaagccaggaggccgatacatatttgtgacaatatttttttaaaggaaatgtctccgcctttagcttgaaaactacctaaaaatacttccaatgattgaaaagatatgaatgagtatcctaaaaaaagaaaaaggaagactctacacccttctcgttattcagattcctctggaataagcagaattgcagatggattcaatggaattttctctgatcattgttacagtgtctgttctatgagacagccagatttaaaatattttgacaacaaagatgatgattctgataccgagacgtcaaatgacttgccaaaatttgcagatggaatcaaggccagaaacagaaatcagaactacctggttcccagtcctgtacttagaattctagaccacactgccttttctacagaaaaatctgctgatattgtaatttgtgatgaagagtgtgactcacctgaatcagtcaaccagcaaacccaagaggagagtcctata

SEQ ID NO: 203303 - DNA, 2033 bp, Homo sapiens
  Payload ID: 20090
  Gene Name: zinc finger protein 639
  Uniprot ID: Q9UID6
  ENST ID: ENST00000496856
  CDS Start-End: 384-1841
acctcacctcgtcacctccccgccctctcggcgggcccctgaggtgcgcggcgcaggcgcggagcgtggcggccagggcagtgcggccgcggagcctaggccaggggcctggcgctcagggcgtggggcgcgcggggagggagaggggtcggcccagcacagcgtccgggagcgctagggccggagcagcgctgcccgccgccgtgcgtccgcgggaaggaccgcgcggcccctccgcctgcgctctcggccgccgccgcctctgcgtgggccggccgggagggcctcgggggactgactggcattttttactgtctacagaaacttattgtaattcatttttcctcactccagtagtaagaattataccaaattgaaaagatatgaatgagtatcctaaaaaaagaaaaaggaagactctacacccttctcgttattcagattcctctggaataagcagaattgcagatggattcaatggaattttctctgatcattgttacagtgtctgttctatgagacagccagatttaaaatattttgacaacaaagatgatgattctgataccgagacgtcaaatgacttgccaaaatttgcagatggaatcaaggccagaaacagaaatcagaactacctggttcccagtcctgtacttagaattctagaccacactgccttttctacagaaaaatctgctgatattgtaatttgtgatgaagagtgtgactcacctgaatcagtcaaccagcaaacccaagaggagagtcctatagaagttcacactgctgaagatgttccaattgctgtagaagtgcatgcgatttctgaggattatgatatagagacagaaaacaattcctctgagagtctccaagaccaaactgatgaagaaccgccagctaaactttgtaaaattcttgacaagagccaagctttgaatgtgactgcccagcagaaatggcctttactgagagctaatagcagtggcctctataaatgtgaactttgtgagtttaacagcaaatatttttctgacttaaagcagcatatgatcctgaagcataaacgtactgattcaaatgtgtgtcgagtatgcaaggaaagtttctctaccaatatgcttctgatagaacatgccaaactgcatgaagaggatccctacatttgtaaatactgtgattataagacagtaatttttgagaacctcagccagcacattgcagacacccattttagtgatcacctctattggtgtgaacagtgtgatgtacagttctcctcaagcagtgaactctacctacatttccaggagcacagctgtgatgaacagtacttgtgtcagttctgtgaacatgaaactaatgatccagaagacttgcatagccatgtggtaaatgagcatgcatgtaaattaatagagttaagtgataagtataacaatggtgaacatggacagtatagcctcttaagcaaaattacctttgacaaatgtaaaaacttctttgtatgtcaagtatgtggttttcggagtagacttcacacaaatgttaacaggcatgttgctattgaacatacaaaaatttttcctcatgtttgtgatgactgtgggaaaggcttttcaagtatgctagaatattgcaagcatttaaattcacatttatctgaagggatttatttatgtcaatattgtgaatattcaacaggacaaattgaagatcttaaaattcatctagatttcaagcattcagctgacttgcctcataaatgtagtgactgcttgatgaggtttggaaatgaaagggaattaataagtcaccttccagtccatgagacaacttgattattctctttaacttacagaatgttagtttaaaataataaattcatcctttttttggagatgattaaatggatgattgtaaacacaacttatgaaatctgcctttaacaagtaacttttttaaattataaaattttattggcattgctccattttctgtatataaatatatctttaatgtggtattttcaa

SEQ ID NO: 203304 - DNA, 584 bp, Homo sapiens
  Payload ID: 20090
  Gene Name: zinc finger protein 639
  ENST ID: ENST00000481587
  CDS Start-End: 173-584
gccgcctctgcgtgggccggccgggagggcctcgggggactgactgtgaattgagatggttactcaaggaatgattgtttacattgttaggcattttttactgtctacagaaacttattgtaattcatttttcctcactccagtagtaagaattataccaaattgaaaagatatgaatgagtatcctaaaaaaagaaaaaggaagactctacacccttctcgttattcagattcctctggaataagcagaattgcagatggattcaatggaattttctctgatcattgttacagtgtctgttctatgagacagccagatttaaaatattttgacaacaaagatgatgattctgataccgagacgtcaaatgacttgccaaaatttgcagatggaatcaaggccagaaacagaaatcagaactacctggttcccagtcctgtacttagaattctagaccacactgccttttctacagaaaaatctgctgatattgtaatttgtgatgaagagtgtgactcacctgaatcagtcaaccagcaaacccaagaggagagtcctatagaagttcacactgctgaagatg

SEQ ID NO: 203305 - DNA, 1730 bp, Homo sapiens
  Payload ID: 20090
  Gene Name: zinc finger protein 639
  Uniprot ID: Q9UID6
  ENST ID: ENST00000484866
  CDS Start-End: 83-1540
gcattttttactgtctacagaaacttattgtaattcatttttcctcactccagtagtaagaattataccaaattgaaaagatatgaatgagtatcctaaaaaaagaaaaaggaagactctacacccttctcgttattcagattcctctggaataagcagaattgcagatggattcaatggaattttctctgatcattgttacagtgtctgttctatgagacagccagatttaaaatattttgacaacaaagatgatgattctgataccgagacgtcaaatgacttgccaaaatttgcagatggaatcaaggccagaaacagaaatcagaactacctggttcccagtcctgtacttagaattctagaccacactgccttttctacagaaaaatctgctgatattgtaatttgtgatgaagagtgtgactcacctgaatcagtcaaccagcaaacccaagaggagagtcctatagaagttcacactgctgaagatgttccaattgctgtagaagtgcatgcgatttctgaggattatgatatagagacagaaaacaattcctctgagagtctccaagaccaaactgatgaagaaccgccagctaaactttgtaaaattcttgacaagagccaagctttgaatgtgactgcccagcagaaatggcctttactgagagctaatagcagtggcctctataaatgtgaactttgtgagtttaacagcaaatatttttctgacttaaagcagcatatgatcctgaagcataaacgtactgattcaaatgtgtgtcgagtatgcaaggaaagtttctctaccaatatgcttctgatagaacatgccaaactgcatgaagaggatccctacatttgtaaatactgtgattataagacagtaatttttgagaacctcagccagcacattgcagacacccattttagtgatcacctctattggtgtgaacagtgtgatgtacagttctcctcaagcagtgaactctacctacatttccaggagcacagctgtgatgaacagtacttgtgtcagttctgtgaacatgaaactaatgatccagaagacttgcatagccatgtggtaaatgagcatgcatgtaaattaatagagttaagtgataagtataacaatggtgaacatggacagtatagcctcttaagcaaaattacctttgacaaatgtaaaaacttctttgtatgtcaagtatgtggttttcggagtagacttcacacaaatgttaacaggcatgttgctattgaacatacaaaaatttttcctcatgtttgtgatgactgtgggaaaggcttttcaagtatgctagaatattgcaagcatttaaattcacatttatctgaagggatttatttatgtcaatattgtgaatattcaacaggacaaattgaagatcttaaaattcatctagatttcaagcattcagctgacttgcctcataaatgtagtgactgcttgatgaggtttggaaatgaaagggaattaataagtcaccttccagtccatgagacaacttgattattctctttaacttacagaatgttagtttaaaataataaattcatcctttttttggagatgattaaatggatgattgtaaacacaacttatgaaatctgcctttaacaagtaacttttttaaattataaaattttattggcattgctccattttctgtatataaatatatctttaatgtggtattttc

SEQ ID NO: 203306 - DNA, 1228 bp, Homo sapiens
  Payload ID: 20090
  Gene Name: zinc finger protein 639
  ENST ID: ENST00000491818
  CDS Start-End: 580-1228
gccgcggagcctaggccaggggcctggcgctcagggcgtggggcgcgcggggagggagaggggtcggcccagcacagcgtccgggagcgctagggccggagcagcgctgcccgccgccgtgcgtccgcgggaaggaccgcgcggcccctccgcctgcgctctcggccgccgccgcctctgcgtgggccggccgggagggcctcgggggactgactgacagagtttcactcctgttacccaggctggaggacaatgatgtgatctcgggtcaccacaacctccgcctcccggattcaagcgattctcatgcctcagcctcccgagtagctcagattacaggcatgtgccaccacgcccggctaattttgtattttcagtcgagacggggtttccccatgttggtcaggctagtcttgaattcccgacctcaggtgatctgttcgcctcggcctcccaaagtgctgggattacaggcgtgaaccactgcacccggcgaggcattttttactgtctacagaaacttattgtaattcatttttcctcactccagtagtaagaattataccaaattgaaaagatatgaatgagtatcctaaaaaaagaaaaaggaagactctacacccttctcgttattcagattcctctggaataagcagaattgcagatggattcaatggaattttctctgatcattgttacagtgtctgttctatgagacagccagatttaaaatattttgacaacaaagatgatgattctgataccgagacgtcaaatgacttgccaaaatttgcagatggaatcaaggccagaaacagaaatcagaactacctggttcccagtcctgtacttagaattctagaccacactgccttttctacagaaaaatctgctgatattgtaatttgtgatgaagagtgtgactcacctgaatcagtcaaccagcaaacccaagaggagagtcctatagaagttcacactgctgaagatgttccaattgctgtagaagtgcatgcgatttctgaggattatgatatagagacagaaaacaattcctctgagagtctccaagaccaaactgatgaagaaccgccagctaaactttgtaaaattcttgacaagagccaagctttgaatgtgactgcccagcagaaatggcctttactgagagctaatagcagtggcctctataaatgtgaactttgtgagtttaacagcaaatattttt

SEQ ID NO: 203307 - DNA, 1117 bp, Homo sapiens
  Payload ID: 20090
  Gene Name: zinc finger protein 639
  ENST ID: ENST00000466264
  CDS Start-End: 253-1117
ctcagattacaggcatgtgccaccacgcccggctaattttgtattttcagtcgagacggggtttccccatgttggtcaggctagtcttgaattcccgacctcaggtgatctgttcgcctcggcctcccaaagtgctgggattacaggcgtgaaccactgcacccggcgaggcattttttactgtctacagaaacttattgtaattcatttttcctcactccagtagtaagaattataccaaattgaaaagatatgaatgagtatcctaaaaaaagaaaaaggaagactctacacccttctcgttattcagattcctctggaataagcagaattgcagatggattcaatggaattttctctgatcattgttacagtgtctgttctatgagacagccagatttaaaatattttgacaacaaagatgatgattctgataccgagacgtcaaatgacttgccaaaatttgcagatggaatcaaggccagaaacagaaatcagaactacctggttcccagtcctgtacttagaattctagaccacactgccttttctacagaaaaatctgctgatattgtaatttgtgatgaagagtgtgactcacctgaatcagtcaaccagcaaacccaagaggagagtcctatagaagttcacactgctgaagatgttccaattgctgtagaagtgcatgcgatttctgaggattatgatatagagacagaaaacaattcctctgagagtctccaagaccaaactgatgaagaaccgccagctaaactttgtaaaattcttgacaagagccaagctttgaatgtgactgcccagcagaaatggcctttactgagagctaatagcagtggcctctataaatgtgaactttgtgagtttaacagcaaatatttttctgacttaaagcagcatatgatcctgaagcataaacgtactgattcaaatgtgtgtcgagtatgcaaggaaagtttctctaccaatatgcttctgatagaacatgccaaactgcatgaagaggatccctacatttgtaaatactgtgattataagacagtaatttttgagaacctcagccagcacattgcagacacccattttagtgatcacctct

SEQ ID NO: 203308 - DNA, 1458 bp, Homo sapiens
  Payload ID: 20090
  Gene Name: zinc finger protein 639
  Uniprot ID: Q9UID6
  ENST ID: ENST00000621687
  CDS Start-End: 1-1458
atgaatgagtatcctaaaaaaagaaaaaggaagactctacacccttctcgttattcagattcctctggaataagcagaattgcagatggattcaatggaattttctctgatcattgttacagtgtctgttctatgagacagccagatttaaaatattttgacaacaaagatgatgattctgataccgagacgtcaaatgacttgccaaaatttgcagatggaatcaaggccagaaacagaaatcagaactacctggttcccagtcctgtacttagaattctagaccacactgccttttctacagaaaaatctgctgatattgtaatttgtgatgaagagtgtgactcacctgaatcagtcaaccagcaaacccaagaggagagtcctatagaagttcacactgctgaagatgttccaattgctgtagaagtgcatgcgatttctgaggattatgatatagagacagaaaacaattcctctgagagtctccaagaccaaactgatgaagaaccgccagctaaactttgtaaaattcttgacaagagccaagctttgaatgtgactgcccagcagaaatggcctttactgagagctaatagcagtggcctctataaatgtgaactttgtgagtttaacagcaaatatttttctgacttaaagcagcatatgatcctgaagcataaacgtactgattcaaatgtgtgtcgagtatgcaaggaaagtttctctaccaatatgcttctgatagaacatgccaaactgcatgaagaggatccctacatttgtaaatactgtgattataagacagtaatttttgagaacctcagccagcacattgcagacacccattttagtgatcacctctattggtgtgaacagtgtgatgtacagttctcctcaagcagtgaactctacctacatttccaggagcacagctgtgatgaacagtacttgtgtcagttctgtgaacatgaaactaatgatccagaagacttgcatagccatgtggtaaatgagcatgcatgtaaattaatagagttaagtgataagtataacaatggtgaacatggacagtatagcctcttaagcaaaattacctttgacaaatgtaaaaacttctttgtatgtcaagtatgtggttttcggagtagacttcacacaaatgttaacaggcatgttgctattgaacatacaaaaatttttcctcatgtttgtgatgactgtgggaaaggcttttcaagtatgctagaatattgcaagcatttaaattcacatttatctgaagggatttatttatgtcaatattgtgaatattcaacaggacaaattgaagatcttaaaattcatctagatttcaagcattcagctgacttgcctcataaatgtagtgactgcttgatgaggtttggaaatgaaagggaattaataagtcaccttccagtccatgagacaacttga

SEQ ID NO: 203309 - DNA, 4544 bp, Homo sapiens
  Payload ID: 20091
  Gene Name: zinc finger protein 641
  Uniprot ID: Q96N77
  ENST ID: ENST00000301042
  CDS Start-End: 263-1579
gctggctccgccggccgccggctcccagacgcaagcggagggcggaggggaggggcaggcggcgcccgggagggaggcaccgggccgcgggccaagcctaccgggggtcccttgctacccatatgtgtgaagaaaagggggaaatgaaagccctagaacccacactgcagtgggcatgggatcatcctggaaccaggagaaacgaggttagggctaccaccttaaccgcccaggtgctggctctgcgtgaatatcttaggaaatgcaagctgaggacaggtcacaatttgggtctgcagcagaaatgctttcagaacagacagcagcgctggggacaggatgggaatcaatgaatgtacagctggatggagcagagccccaggtggaaaggggaagccaggaagagcggccatggagaacagtaccaggacctctggagcacctgtgctgtgaccttgaagaggagccacagtcccttcaggagaaggctcagtctgctccctgggttcctgcaattccccaggaggggaacactggagactgggagatggcagctgcacttcttgcggctggatcacagggcctggtaaccatcaaggatgtgtcactgtgcttctctcaggaggagtggcggagcctggacccctctcagacagacttttatggagaatatgtcatgcaggaaaactgtgggatagtagtctctctgagatttccaattcccaaactggacatgctttctcaactagaaggaggagaagaacaatgggtccctgacccccaggacttagaggagagggacattctgagggtcacatatacaggagatggaagtgaacatgagggggatacccctgaactagaagcagaacctcccagaatgttatccagcgtgtctgaagatactgttctctggaacccggagcatgatgagagctgggattccatgcccagcagctccagaggaatgctcctggggcccccttttcttcaggaagatagtttctcaaacctgctgtgtagcacagagatggattccctgttaagaccccacacatgcccccagtgtgggaaacagtttgtatggggttcccaccttgccaggcatcaacaaacacacactggggagagaccctacagctgcctcaagtgtgagaagacctttgggcgaagacatcacctcatcaggcaccagaaaacccacctacatgacaagaccagcaggtgctctgagtgtggtaagaatttccgatgcaactcccatctggccagccaccagagagtgcatgcagaaggcaaatcctgcaaaggccaagaggttggagagagccctggcacaaggaaacggcagcgtgccccaccagtgccaaagtgtcacgtgtgcactgaatgtgggaagagctttggccgaaggcaccaccttgtgagacactggctgacccacactggggagaagcccttccagtgccctcgctgtgagaagagctttggccgaaaacatcacctggacaggcacctgctcacccaccagggacaaagtccccggaacagctgggacagaggaacatctgtcttttgaaatctgtttccactacagctatggtcaagtctatcagccggtgctaccaggagtcactgccagggctgccgttctcctgaaccccagtggccagaatcataagccctgaccccatccctagaaagatgaggtcccagcaatggccagagcatttctcaccagttctgtgagatagcacataaaaatagagttctttgggcaaaacttttgggaagcaatgcatcctacatgggctgatattcagcctgagctgttctcaagaggagagtggtactggcagtttatggctgaaatccattctgattggttggagtctatgctataccagttgttaaacattttgagtatcactcttgcatactgttactattatattttctctatatatagacagaaaggccattttagaatattaaaggctctgaaaatttctgcagtagacccaactgaaggttctattaaggcagtgtttcctaaatgtatttgacctcagtatcctttctatttacatcccacagaactggtgactatgaaacactctggtgaacactgggttagagagtaacaaggaaacaagagatagtgatcaggcatccagagcccccttttttatccatatgaaagccaggggggccagaccttgttcatgtgtgggtctgtcttccttatgccaatcagcagtatatacatcacctctcaccctcacctgctgaaaaaataacctttttacccattattcctactcccttcatcctgcacatacatatatccagctgagagatcacactacaaggctaagagatgatctaatacccccaaatagccctggcccacacagaaaaacagaaaaacaaaaaaaactttatccccttgaacagtcccctctctcctcttgactgtctttatgtgtctgtgtatttgtgtgcagggtctttgaagacagcatgctatgtgcaaactgtacaagctaggttttctaggggctgtgttctggggatgagggtagtggggattatatggggttttttctttgtttcaagacaggaagcagtctggttaagggagaactagtggaaagggttaaatgacaggttaagttgagtacaaagctttcccagtactgctgagattaagacaattgtggatgtgtatgtctaggtttgaatctctgggctgcagattgcttttgccctggcagagaaagaggagtctttggggaggtgagctgtttcttgttgatttcaggcaagaggcacatagaaactttgtattgagtggggattttgttttaagtgctggaaaattagggcaggaattacgtgtttgcaagttgttgccatcactggtttgaatttgactgcctcatcaaggggcaagagttattcttgaagatctcattctcccagaaacagaactttagggaaaatggctgtggcttagcttttcagctgctgcagggtaataagctttctggttggttttccttccaattctggaaaggtgtccacactaagacccttaactctagggcttgcataagtattctagcatcgttagctaatgagttggtcattgtttctctttatcaataattgtgttaataccaatcttataatttaaaaattatcttgtatgtaagagcagttcggggttagggaggaagaggagcaaagtgggatattttctctttaatgcttagatactgtttcttccctaagatgtgtttctcaaccacaattggtggaatgaaccagagaggcaagaggaagtgaattgcaccaatttagtttagcgactgtgccttttgcaggaaaaactgggtgaatcacagctcctcagagtcctggactcaactagaattgaagatagacttattttgctgactgggcttcttagagtttatgtgacttgaacagcttggcccctgcctcccttctgctactgtgagcagccttccttcttccttcattcttcctggaatgcagttctcttgcttatgatcctatgaataaggcaaaatggctggtctttgtaaggcaggtcttgccctagcttctcagaaacaggagcattttaggatcagtattaggagatgccccagggagtaagaaagtattgggttcagtgataaatctggactctgacatttcttttactctccctctttaatactaaaagctctgcataagcaatggttcagaacctgtcttgggtacagacctgttgaatctgacagaaaccagaaacgcacttttgagaaaaagacatttgtaattcactcagttttccatacacatttagcaggttcaaagcccatctgtggaatccctaaactgccttcaaagaaagggagttccccgatctaaaatggtcattatatatttgtgtcaagaattagaaggcaagggtcactaaatattttaaggattaaggtaccagaggcatcagtggtataaggatggagtctggtctttaattacgacaagggtattgcttacattctactctctggttttcaaaaagatctgacatgctgacaaatccagctcctcacaaatcttgtttgaaggacttgtgggaagtgatattccttactattagatcacgccccttataactacatgttaacatccagccttttatctgtttgagtaattgtagggatagaaagtgaagcccccagagttaggtgcaagtatagcacccagctgaaaggcatcatggagtctaagggccttctacagaaggggcaatcctttgggttatttctggtgtaccactgtcttctctacctcggtccaacaccacctctcttggacaaaaaataaaacaagcaacagccatcagatgagtgaatagatttgaatgatttttcccacagggaatcagcctcaaatgttcatgtttcaccccgtcccctttaaataaaaagaatctctgtgttctctttgggcaaaatgtaaaa

SEQ ID NO: 203310 - DNA, 1856 bp, Homo sapiens
  Payload ID: 20091
  Gene Name: zinc finger protein 641
  Uniprot ID: Q96N77
  ENST ID: ENST00000448928
  CDS Start-End: 57-1304
gtgggaggcccagtagccagagcggaaaatggtcacaatttgggtctgcagcagaaatgctttcagaacagacagcagcgctggggacaggatgggaatcaatgaatgtacagctggatggagcagagccccaggtggaaaggggaagccaggaagagcggccatggagaacagtaccaggacctctggagcacctgtgctgtgaccttgaagaggagccacagtcccttcaggagaaggctcagtctgctccctgggttcctgcaattccccaggaggggaacactggagactgggagatggcagctgcacttcttgcggctggatcacaggtgagctctgcttcccttggcgtctcctgtggtcccatcactgctgcctttgtattgctttcgcatcagcccattgatgagttggctcacatgatcatcaatggatttccaattcccaaactggacatgctttctcaactagaaggaggagaagaacaatgggtccctgacccccaggacttagaggagagggacattctgagggtcacatatacaggagatggaagtgaacatgagggggatacccctgaactagaagcagaacctcccagaatgttatccagcgtgtctgaagatactgttctctggaacccggagcatgatgagagctgggattccatgcccagcagctccagaggaatgctcctggggcccccttttcttcaggaagatagtttctcaaacctgctgtgtagcacagagatggattccctgttaagaccccacacatgcccccagtgtgggaaacagtttgtatggggttcccaccttgccaggcatcaacaaacacacactggggagagaccctacagctgcctcaagtgtgagaagacctttgggcgaagacatcacctcatcaggcaccagaaaacccacctacatgacaagaccagcaggtgctctgagtgtggtaagaatttccgatgcaactcccatctggccagccaccagagagtgcatgcagaaggcaaatcctgcaaaggccaagaggttggagagagccctggcacaaggaaacggcagcgtgccccaccagtgccaaagtgtcacgtgtgcactgaatgtgggaagagctttggccgaaggcaccaccttgtgagacactggctgacccacactggggagaagcccttccagtgccctcgctgtgagaagagctttggccgaaaacatcacctggacaggcacctgctcacccaccagggacaaagtccccggaacagctgggacagaggaacatctgtcttttgaaatctgtttccactacagctatggtcaagtctatcagccggtgctaccaggagtcactgccagggctgccgttctcctgaaccccagtggccagaatcataagccctgaccccatccctagaaagatgaggtcccagcaatggccagagcatttctcaccagttctgtgagatagcacataaaaatagagttctttgggcaaaacttttgggaagcaatgcatcctacatgggctgatattcagcctgagctgttctcaagaggagagtggtactggcagtttatggctgaaatccattctgattggttggagtctatgctataccagttgttaaacattttgagtatcactcttgcatactgttactattatattttctctatatatagacagaaaggccattttagaatattaaaggctctgaaaatttctgcagtagacccaactgaaggttctattaaggcagtgtttcctaaatgtatttgacctcagtatcctttctatttacatcccacagaactggtgactatgaaacactctggtgaacactg

SEQ ID NO: 203311 - DNA, 7819 bp, Homo sapiens
  Payload ID: 20091
  Gene Name: zinc finger protein 641
  Uniprot ID: Q96N77
  ENST ID: ENST00000544117
  CDS Start-End: 710-2026
gccggagggagctgcggctggagggagggacgcctggcttcccggggcggctggtgggggctcggtcacccataggggctgggaggaggatcggcgcgtcttccgggttgctgcctttcccgggggtctgccccgctgacattctgtgcccgcctctcgccctgtctccccgtgcccatcgcaactgtcaggccctgcgggctcccgccgctgtcactcgcgcacaggttaccccgtggctccctttctcttcacttgctcatgccccagctcatgggaaacctgttttctgacctcacttcccctgctccagttctgccttgctcggattctctgaaatctgaccctttccaggggcactgtgacaagaagaagggaagaagcaaccttacccctgagcaggctcccgtcccgcccatgccctacccgtggcaggggccagggttctctgatggacggagccaactcgtccgtgtgcccttgggctactcatttttataacatggccccttttctgttcatcagcactggctgcagaaacttccttttgcaggtcccttgctacccatatgtgtgaagaaaagggggaaatgaaagccctagaacccacactgcagtgggcatgggatcatcctggaaccaggagaaacgaggttagggctaccaccttaaccgcccaggtgctggctctgcgtgaatatcttaggaaatgcaagctgaggacaggtcacaatttgggtctgcagcagaaatgctttcagaacagacagcagcgctggggacaggatgggaatcaatgaatgtacagctggatggagcagagccccaggtggaaaggggaagccaggaagagcggccatggagaacagtaccaggacctctggagcacctgtgctgtgaccttgaagaggagccacagtcccttcaggagaaggctcagtctgctccctgggttcctgcaattccccaggaggggaacactggagactgggagatggcagctgcacttcttgcggctggatcacagggcctggtaaccatcaaggatgtgtcactgtgcttctctcaggaggagtggcggagcctggacccctctcagacagacttttatggagaatatgtcatgcaggaaaactgtgggatagtagtctctctgagatttccaattcccaaactggacatgctttctcaactagaaggaggagaagaacaatgggtccctgacccccaggacttagaggagagggacattctgagggtcacatatacaggagatggaagtgaacatgagggggatacccctgaactagaagcagaacctcccagaatgttatccagcgtgtctgaagatactgttctctggaacccggagcatgatgagagctgggattccatgcccagcagctccagaggaatgctcctggggcccccttttcttcaggaagatagtttctcaaacctgctgtgtagcacagagatggattccctgttaagaccccacacatgcccccagtgtgggaaacagtttgtatggggttcccaccttgccaggcatcaacaaacacacactggggagagaccctacagctgcctcaagtgtgagaagacctttgggcgaagacatcacctcatcaggcaccagaaaacccacctacatgacaagaccagcaggtgctctgagtgtggtaagaatttccgatgcaactcccatctggccagccaccagagagtgcatgcagaaggcaaatcctgcaaaggccaagaggttggagagagccctggcacaaggaaacggcagcgtgccccaccagtgccaaagtgtcacgtgtgcactgaatgtgggaagagctttggccgaaggcaccaccttgtgagacactggctgacccacactggggagaagcccttccagtgccctcgctgtgagaagagctttggccgaaaacatcacctggacaggcacctgctcacccaccagggacaaagtccccggaacagctgggacagaggaacatctgtcttttgaaatctgtttccactacagctatggtcaagtctatcagccggtgctaccaggagtcactgccagggctgccgttctcctgaaccccagtggccagaatcataagccctgaccccatccctagaaagatgaggtcccagcaatggccagagcatttctcaccagttctgtgagatagcacataaaaatagagttctttgggcaaaacttttgggaagcaatgcatcctacatgggctgatattcagcctgagctgttctcaagaggagagtggtactggcagtttatggctgaaatccattctgattggttggagtctatgctataccagttgttaaacattttgagtatcactcttgcatactgttactattatattttctctatatatagacagaaaggccattttagaatattaaaggctctgaaaatttctgcagtagacccaactgaaggttctattaaggcagtgtttcctaaatgtatttgacctcagtatcctttctatttacatcccacagaactggtgactatgaaacactctggtgaacactgggttagagagtaacaaggaaacaagagatagtgatcaggcatccagagcccccttttttatccatatgaaagccaggggggccagaccttgttcatgtgtgggtctgtcttccttatgccaatcagcagtatatacatcacctctcaccctcacctgctgaaaaaataacctttttacccattattcctactcccttcatcctgcacatacatatatccagctgagagatcacactacaaggctaagagatgatctaatacccccaaatagccctggcccacacagaaaaacagaaaaacaaaaaaaactttatccccttgaacagtcccctctctcctcttgactgtctttatgtgtctgtgtatttgtgtgcagggtctttgaagacagcatgctatgtgcaaactgtacaagctaggttttctaggggctgtgttctggggatgagggtagtggggattatatggggttttttctttgtttcaagacaggaagcagtctggttaagggagaactagtggaaagggttaaatgacaggttaagttgagtacaaagctttcccagtactgctgagattaagacaattgtggatgtgtatgtctaggtttgaatctctgggctgcagattgcttttgccctggcagagaaagaggagtctttggggaggtgagctgtttcttgttgatttcaggcaagaggcacatagaaactttgtattgagtggggattttgttttaagtgctggaaaattagggcaggaattacgtgtttgcaagttgttgccatcactggtttgaatttgactgcctcatcaaggggcaagagttattcttgaagatctcattctcccagaaacagaactttagggaaaatggctgtggcttagcttttcagctgctgcagggtaataagctttctggttggttttccttccaattctggaaaggtgtccacactaagacccttaactctagggcttgcataagtattctagcatcgttagctaatgagttggtcattgtttctctttatcaataattgtgttaataccaatcttataatttaaaaattatcttgtatgtaagagcagttcggggttagggaggaagaggagcaaagtgggatattttctctttaatgcttagatactgtttcttccctaagatgtgtttctcaaccacaattggtggaatgaaccagagaggcaagaggaagtgaattgcaccaatttagtttagcgactgtgccttttgcaggaaaaactgggtgaatcacagctcctcagagtcctggactcaactagaattgaagatagacttattttgctgactgggcttcttagagtttatgtgacttgaacagcttggcccctgcctcccttctgctactgtgagcagccttccttcttccttcattcttcctggaatgcagttctcttgcttatgatcctatgaataaggcaaaatggctggtctttgtaaggcaggtcttgccctagcttctcagaaacaggagcattttaggatcagtattaggagatgccccagggagtaagaaagtattgggttcagtgataaatctggactctgacatttcttttactctccctctttaatactaaaagctctgcataagcaatggttcagaacctgtcttgggtacagacctgttgaatctgacagaaaccagaaacgcacttttgagaaaaagacatttgtaattcactcagttttccatacacatttagcaggttcaaagcccatctgtggaatccctaaactgccttcaaagaaagggagttccccgatctaaaatggtcattatatatttgtgtcaagaattagaaggcaagggtcactaaatattttaaggattaaggtaccagaggcatcagtggtataaggatggagtctggtctttaattacgacaagggtattgcttacattctactctctggttttcaaaaagatctgacatgctgacaaatccagctcctcacaaatcttgtttgaaggacttgtgggaagtgatattccttactattagatcacgccccttataactacatgttaacatccagccttttatctgtttgagtaattgtagggatagaaagtgaagcccccagagttaggtgcaagtatagcacccagctgaaaggcatcatggagtctaagggccttctacagaaggggcaatcctttgggttatttctggtgtaccactgtcttctctacctcggtccaacaccacctctcttggacaaaaaataaaacaagcaacagccatcagatgagtgaatagatttgaatgatttttcccacagggaatcagcctcaaatgttcatgtttcaccccgtcccctttaaataaaaagaatctctgtgttctctttgggcaaaatgtaaaacagggatatcatcttcaggaacctgtcacatttttccatctggtacctccaccctattctgagtatcctcccctttccaccccaacatagtatctttcaaagaatcccttgcataggagactgtaaccgaaagtgttagcttttcaccaggctatttacactttacgccttagttctaattgtggaaggaaaaacttttcccttgtcaaagtaatgttatggcttcagagaaccaaagaggtgataatttgggacaaaattcctccctttccaacattcctgcaatcaaatcactgtttcctatttccatcaagggcaggtcctgactcagacctacaaaggccagaaggccagttctttccatctctgaattaggatgcatgcactgaatgggagtgggtggggctgggcaatatcagaaaagtgaaatccattcctttagatccttagagagcctgagctagcaaaattttcctcttttcccttgtgagccataccaaactgtggctctcaaaatttggtctttgggccagcagcataaatatcacctggaaacttgtttgaaatgcaaattcttagcccccgccccaggagaactactgaatcagaaactcgggaaggagctcaacgttcagtcttttaactaaatgccctcctggatgtgtgatacaagctaaagtttgagaaccactggctaggggattcatatttcaagcagtggtacctcacccttttcggatggatcttcacactcctgttgtcaggtttattctctgtagcctcactaggctagacctcagttccattccccttagttgcaaggtcttcttccactcttaactcagtaaaagaactggggctagtcaccaatatcagaaactatggtggggcaactaccaagctcctgtgattcattggggctggggcttccaatatgggcactgaggatacttgggtccagaaatctgaaaggacagaaaggaataaacaactcaaaggtggaaaatccaatgtaaaactgaaaaactgacatccgaggaaatgattctcctttgccttgtccttttcactggctcttctaataagaggcaggtggagtgggcatctagcacaaaggtagagtaaggcctaccatgccaagcccttaagaacccaagttttccaacataaaaattggattagagaccaacgaggggccatggaagggatttctaaccatgatttggcataccctatgggcaagggcagcaggaacatcagagtccccagggcataagagagaactaggtttttctagtaagatttgacacaagcaagatttaaatccagactctgcttactaggtagaggttgtaaccaatgaagccatggtgcccaaaatgcattctgctgcttagaagattctgacagattcaggctgtggggaggaatctgccttgcagtctctgaccctgctacctcctccagttcctctcccaggcgcacctatgaggacagactgaactgacagttataaatctgcccacaggtcttctccaaggtcaaaagattagaccccaaggctgagactttcttcaactccaggcctcatgctgtctccctctttcctgccaccacctcctttttcccaacaggcagcattcttcctctacaatttgttcatactctttttcagatttttttgtttgtttgagttttgctttgttctgactgagcaataacatgcccttccaagggcatttgttctctccaacccccattccttcttccattctagtttatctcttcaagcttctggccaattctattccatcatgagtccacttactacctattcctctgcctactgtccagtttcttttctatcagctttaagcctactaagcaggggtcaattcatacttaccactctcatcctccaaattcttggcttggctatagcagttcatcagccacctcaccactctgcccctttctcatacacactcccacaggacaccaccactactccaccccctgcctagtactgccaaatctggcccctctactccattccctagaggttcttcttccaatcaggtaacttccaaagttgttttccacttttcaccatttttaatttacttccttccagtctcctgtgactcctgagaatcaaactctctctttttttttttttgagatggagtcttgctctgtcacccaggctggagtgcagtgacgcgatctcggctcactgcaagctccgcctcccaggtttacgccattttcttgcctcagcctcccgagtagctgggactacaagcgcccaccaccacgcctatttttttttttttttttgtattttttttagtagagacggggtttcacggtgttagccaggatggtctcaatctcttgacctcgtgatccacccaccttggcctcccaaagtgctgggattacaggcctgagccaccgcgcccagcccaaactctcaattctacaagcaattttttgtgtccttattatgtgccaggcactggcaatttcaggcctgggagatcaaatgtgacccttgctcctgctctcagtgtgttcttcagccaagccctcccccaccaccactttcctgccttgtctcttgccaccaggcacctgggcatcctcttccaggaaactttggggatgaatgcccacttgccatgcagcccaactgctccgtgcctatcagatttctagctattatctgaattggttccttctgatgaactgtgaacttccttgggttacccaacaggggacttatggtccctgtcagttgaataaaagatgtattggctgtgtca

SEQ ID NO: 203312 - DNA, 556 bp, Homo sapiens
  Payload ID: 20091
  Gene Name: zinc finger protein 641
  ENST ID: ENST00000550342
  CDS Start-End: 326-556
ggggcactgtgacaagaagaagggaagaagcaaccttacccctgagcaggctcccgtcccgcccatgccctacccgtggcaggggccagggttctctgatggacggagccaactcgtccgtgtgcccttgggctactcatttttataacatggccccttttctgttcatcagcactggctgcagaaacttccttttgcaggtcccttgctacccatatgtgtgaagaaaagggggaaatgaaagccctagaacccacactgcagtgggcatgggatcatcctggaaccaggagaaacgaggtcacaatttgggtctgcagcagaaatgctttcagaacagacagcagcgctggggacaggatgggaatcaatgaatgtacagctggatggagcagagccccaggtggaaaggggaagccaggaagagcggccatggagaacagtaccaggacctctggagcacctgtgctgtgaccttgaagaggagccacagtcccttcaggagaaggctcagtctgctccctgggttcctgcaattccccaggaggggaacact

SEQ ID NO: 203313 - DNA, 555 bp, Homo sapiens
  Payload ID: 20091
  Gene Name: zinc finger protein 641
  ENST ID: ENST00000550181
  CDS Start-End: 233-555
aagtgactcctcctcagtgctctctcaagccctttatcctatcgtgaaaactagagggtacgctccttgaggaattccagactgttgtctggagaaatcgctctcggcctcggtctggcctgtaacgggcggttacgcaattccaggtaattgacgaaccctgaggacagaactccgtgggaggcccagtagccagagcggaaaatggtcacaatttgggtctgcagcagaaatgctttcagaacagacagcagcgctggggacaggatgggaatcaatgaatgtacagctggatggagcagagccccaggtggaaaggggaagccaggaagagcggccatggagaacagtaccaggacctctggagcacctgtgctgtgaccttgaagaggagccacagtcccttcaggagaaggctcagtctgctccctgggttcctgcaattccccaggaggggaacactggagactgggagatggcagctgcacttcttgcggctggatcacagggcctggtaaccatcaaggatgtgtcactgtgcttctctcaggagga

SEQ ID NO: 203314 - DNA, 315 bp, Homo sapiens
  Payload ID: 20091
  Gene Name: zinc finger protein 641
  ENST ID: ENST00000546874
  CDS Start-End: 1-154
ctgtgggatagtagtctctctgagatttccaattcccaaactggacatgctttctcaactagaaggaggagaagaacaatgggtccctgacccccaggacttagaggagagggacattctgagggtcacatatacaggtaagaacctagaataggctttcagccacttccttcacagttcgggacatcatcattccatgttcgtttaatccctcctctgcctcagagagttccagagacaaaaggtttagagatttttttcttcaaaagcaagggagtgtaatagaatgatgtagcaggcactttgtggatttga

SEQ ID NO: 203315 - DNA, 290 bp, Homo sapiens
  Payload ID: 20091
  Gene Name: zinc finger protein 641
  ENST ID: ENST00000549125
  CDS Start-End: 45-290
cgggccaagcctaccgggggtcacaatttgggtctgcagcagaaatgctttcagaacagacagcagcgctggggacaggatgggaatcaatgaatgtacagctggatggagcagagccccaggtggaaaggggaagccaggaagagcggccatggagaacagtaccaggacctctggagcacctgtgctgtgaccttgaagaggagccacagtcccttcaggagaagggatttccaattcccaaactggacatgctttctcaactagaaggaggagaagaacaatgggtc

SEQ ID NO: 203316 - DNA, 575 bp, Homo sapiens
  Payload ID: 20091
  Gene Name: zinc finger protein 641
  ENST ID: ENST00000548932
  CDS Start-End: 166-575
ctaccgggggtcccttgctacccatatgtgtgaagaaaagggggaaatgaaagccctagaacccacactgcagtgggcatgggatcatcctggaaccaggagaaacgaggttagggctaccaccttaaccgcccaggtgctggctctgcgtgaatatcttaggaaatgcaagctgaggacaggtcacaatttgggtctgcagcagaaatgctttcagaacagacagcagcgctggggacaggatgggaatcaatgaatgtacagctggatggagcagagccccaggtggaaaggggaagccaggaagagcggccatggagaacagtaccaggacctctggagcacctgtgctgtgaccttgaagaggagccacagtcccttcaggagaaggctcagtctgctccctgggttcctgcaattccccaggaggggaacactggagactgggagatggcagctgcacttcttgcggctggatcacagggcctggtaaccatcaaggatgtgtcactgtgcttctctcaggaggagtggcggagcctggacccctctcagacagacttttatggagaata

SEQ ID NO: 203317 - DNA, 1823 bp, Homo sapiens
  Payload ID: 20091
  Gene Name: zinc finger protein 641
  Uniprot ID: Q96N77
  ENST ID: ENST00000547026
  CDS Start-End: 132-1406
gctggctccgccggccgccggctcccagacgcaagcggagggcggaggggaggggcaggcggcgcccgggagggaggcaccgggccgcgggccaagcctaccgggggtcacaatttgggtctgcagcagaaatgctttcagaacagacagcagcgctggggacaggatgggaatcaatgaatgtacagctggatggagcagagccccaggtggaaaggggaagccaggaagagcggccatggagaacagtaccaggacctctggagcacctgtgctgtgaccttgaagaggagccacagtcccttcaggagaaggctcagtctgctccctgggttcctgcaattccccaggaggggaacactggagactgggagatggcagctgcacttcttgcggctggatcacagggcctggtaaccatcaaggatgtgtcactgtgcttctctcaggaggagtggcggagcctggacccctctcagacagacttttatggagaatatgtcatgcaggaaaactgtgggatagtagtctctctgagatttccaattcccaaactggacatgctttctcaactagaaggaggagaagaacaatgggtccctgacccccaggacttagaggagagggacattctgagggtcacatatacaggagatggaagtgaacatgagggggatacccctgaactagaagcagaacctcccagaatgttatccagcgtgtctgaagatactgttctctggaacccggagcatgatgagagctgggattccatgcccagcagctccagaggaatgctcctggggcccccttttcttcaggaagatagtttctcaaacctgctgtgtagcacagagatggattccctgttaagaccccacacatgcccccagtgtgggaaacagtttgtatggggttcccaccttgccaggcatcaacaaacacacactggggagagaccctacagctgcctcaagtgtgagaagacctttgggcgaagacatcacctcatcaggcaccagaaaacccacctacatgacaagaccagcaggtgctctgagtgtggtaagaatttccgatgcaactcccatctggccagccaccagagagtgcatgcagaaggcaaatcctgcaaaggccaagaggttggagagagccctggcacaaggaaacggcagcgtgccccaccagtgccaaagtgtcacgtgtgcactgaatgtgggaagagctttggccgaaggcaccaccttgtgagacactggctgacccacactggggagaagcccttccagtgccctcgctgtgagaagagctttggccgaaaacatcacctggacaggcacctgctcacccaccagggacaaagtccccggaacagctgggacagaggaacatctgtcttttgaaatctgtttccactacagctatggtcaagtctatcagccggtgctaccaggagtcactgccagggctgccgttctcctgaaccccagtggccagaatcataagccctgaccccatccctagaaagatgaggtcccagcaatggccagagcatttctcaccagttctgtgagatagcacataaaaatagagttctttgggcaaaacttttgggaagcaatgcatcctacatgggctgatattcagcctgagctgttctcaagaggagagtggtactggcagtttatggctgaaatccattctgattggttggagtctatgctataccagttgttaaacattttgagtatcactcttgcatactgttactattatattttctctatatatagacagaaaggccattttagaatattaaa

SEQ ID NO: 203318 - DNA, 5763 bp, Homo sapiens
  Payload ID: 20092
  Gene Name: zinc finger protein 644
  Uniprot ID: Q9H582
  ENST ID: ENST00000337393
  CDS Start-End: 284-4267
gtttccgctgccctcgtttgtctaattggcccagacgctccaccagcgcgaagcttcccgggagctcctcgctggccacccccgcggcccgcagcccggcagaggcgggaaagcagcgcgcctgcgccgtgggaaccggggctggaggcgaaaagcggggagcggaggggggccgctggagccgagtagcgtacagagcggcgtgtgacgcggggacgccgcgtgctcccaacgtcgccccggtttgacgcacacggcaccaaactgtttgatttaattttggatgagatcgttcttgcagcaagatgttaataagacaaaatctagactaaatgtgttaaatgggcttgccaacaatatggatgatttgaagataaacaccgatattactggtgctaaagaagaactcctagatgacaacaattttatctcagacaaagagagcggagttcataagccaaaagattgtcaaacatcatttcagaaaaataatacgttgactctgcctgaagaactgtcaaaggacaaatctgaaaacgccttaagtggaggccagtctagtctatttatacatgctggtgctcctactgtttctagtgaaaactttatcttgcctaaaggagctgctgttaatggaccagtttcacactcctccttaactaagacttccaatatgaataaaggcagtgtttcattaaccactggacagcctgtggatcagccaacaacagaatcttgttcaactttgaaggtagcagctgatcttcagctgtctacaccacagaaagcaagtcaacaccaagttttatttttgttatcagatgtagcacatgctaagaatcccacccattccaataaaaaactacctacctctgcttcagttggttgtgacattcagaattcagtagggagtaatataaagtcagatggcactttaataaatcaagtagaggtgggtgaggatggtgaagatttattggtgaaagatgattgtgtcaatacagtaacgggaatttcctcaggtacagatggatttaggtcagaaaatgatacaaactgggatccccaaaaagagttcattcaatttcttatgactaatgaggaaacagtagataaagctccacctcattctaaaataggtctagaaaaaaaaagaaagcgaaaaatggatgtaagcaagataactcgttataccgaggattgctttagtgattctaattgtgtacccaataaatcaaaaatgcaagaagtagactttctagaacaaaatgaagagctacaagcagtagactcacagaaatatgcattatcaaaagtgaagcctgaatcaactgatgaagacttagaatctgtggatgccttccaacatctaatttataacccagataagtgtggagaagagagttcacctgttcatactagcacttttctttcaaataccttaaaaaagaaatgtgaagagagtgattctgagtcacctgctactttcagtaccgaagagccatcattctacccctgtacaaagtgcaatgtgaattttagggagaagaagcacctccacaggcatatgatgtatcatttagatgggaatagtcactttcgccatcttaatgtcccaaggccatatgcttgtagagaatgtggacggacatttcgagatcgcaattcacttctaaaacatatgattattcaccaggagagaagacagaagttgatggaggaaattcgtgaattgaaagaacttcaggatgaaggaagaagtgcacgattacagtgtcctcagtgtgtgtttggtaccaattgccctaaaacatttgtgcaacatgctaaaacccatgaaaaagataaaaggtactactgctgtgaagagtgtaacttcatggcagtgacagaaaatgaattggaatgccatcgaggcattgcacatggggcagtggtaaaatgccctatggtcacttctgatattgcccagagaaaaacacaaaaaaagactttcatgaaagactctgtagtaggatcatccaaaaaatcagctacctacatatgtaagatgtgtccttttactacttcagccaaaagtgttttaaaaaagcacacggagtacttgcattcatcatcatgtgttgattcatttggtagtcctcttggacttgataaaagaaaaaatgacatccttgaagaacctgtagatagtgatagcactaaaacattaactaaacaacagtcaaccacatttccaaagaactctgctttaaaacaagatgtgaagcgaacatttggatcaacctcacaatcaagtagtttttcaaaaattcataagcggccacacagaatacagaaagctcggaaaagcattgcccaatcaggtgtaaacatgtgcaatcaaaacagctctcctcataagaatgttacaattaaaagcagcgttgaccaaaaacctaagtatttccatcaagcagcaaaagaaaagtctaatgccaaggcaaatagccactatttgtatagacacaaatatgaaaactataggatgatcaaaaaatcaggtgaatcatatcctgtgcatttcaaaaaagaagaagctagttcattaaattctttacacctgttttcatcatcaagtaattctcacaacaattttatttcagaccctcataagcctgacgccaaaaggcctgaaagcttcaaagatcacagacgtgtagctgtaaagagagtaattaaggaatctaagaaggaaagttctgttggaggggaagacttggatagctatccagattttttgcataaaatgactgttgtcgttttgcaaaaacttaattctgctgaaaagaaagatagttatgaaacagaagatgaaagttcctgggataatgttgagttaggagactacactacacaggccatagaagatgaaacctatagtgatattaatcaagagcatgtaaatttattccctttatttaagagcaaagtggaaggtcaggagcctggagaaaatgctactcttagttatgaccaaaacgatggcttttattttgaatactatgaagatactggaagtaacaactttttgcatgagatacatgatcctcagcatttagaaactgcagatgcttcattgtcaaagcatagttctgtttttcattggactgatttgtctcttgagaagaaatcgtgtccttactgcccagcaacatttgaaacaggtgttgggttatcaaatcatgtcagggggcatcttcacagagcaggattaagctatgaagcccgtcatgttgtatcaccagaacaaatagccacaagtgacaaaatgcagcatttcaaaagaactggcacaggaacacctgttaaacgagttagaaaagctatagagaagtctgaaaccacttctgaacacacttgtcagctctgtggtggttggtttgatactaaaattggattatcaaatcatgttagaggccacttgaaaagacttggaaagacgaaatgggatgctcacaaatctccaatctgtgttctgaatgagatgatgcaaaatgaagaaaaatatgaaaaaatcttaaaggcattgaacagtcgtcgtattattcccagaccatttgtagctcaaaaacttgcatcaagtgatgactttatatctcaaaatgttatacctcttgaagcataccgtaatggcctaaagactgaagctctgtcagtgtctgcatcagaagaagaagggctgaatttcttaaatgaatatgatgaaacaaaaccagaactgcccagtgggaaaaagaatcagtctcttacactcatagaacttcttaaaaataaaaggatgggagaagaaaggaattctgctatttctcctcaaaagatccataatcagacagcaagaaagagattcgttcagaaatgcgttcttccattaaatgaggatagtccgttgatgtatcagccacaaaaaatggacttgactatgcactcagccttagattgtaagcaaaagaaatcaaggtcaagatctggaagcaagaagaaaatgctaacattacctcatggtgctgacgaggtttacattctccgatgcaggttttgtggcctagtctttcgaggacccttgtctgttcaggaagactggattaagcacttacaacgacatattgtaaacgctaatcttccacggactggagctggcatggtggaagtcacgtcactacttaaaaagcctgcctccattacagaaacttcattttctctactaatggccgaagcagcttcatagaaccaggaaaccttttaaatagccagtttgaattggatgtaaatttgaaattctttttttttaagccacattaaattatctgtttataaatactaaagcaggaaaatggggggaaagtgaattacagtgacatcagagcaaattgaatacttaaaacagtaagtagtctatatattttatatagggtggaagatgtgtttttaaggtttatgaagttttgttggttaactgtgttcactcagtaaaagagcagtacatgtaagcagccattaataaactgttgcacatggatacttatagacagacttattggacaattatgttttttgcagtgttaccagaatcaaggctctgtttattccccacaagacttgcatagaaaaataagatattatattttgtttgtatgtatttagtgttttgtataataccaagaaccgctgactaaatttactcaaattagggcattaaatatcatgtacttcatagtttgagactgttcactcaaatagggcagagtactattctatctagatgtgtaagtgttttttttaaaatcacatggaacggttttttttatactaaaaagtggagggagatttgtttaaacaagtatttctaaaagaaatatgtacatagttctggaaattatttgtggtaaggaaatattctttactccagttgcatttctcagacaataaagtggtgcatccatgctacctcctactttgtcaacaaagatgctatttaccctttacatttttgtatcataatagattttaaaaatctaatgttctttattgcaagacattcttttgttaacaggtttgtttctttttaatgttttacctaaaatttgacatgcttacaggacaggtttgcctcttactttatttaacattgtagaaatgtaattaataaacaatgctcactacacagtttagaatagacgttctcatttatattatcttccaaatttgatcagttagcaaaacttaatacaccaattaaaatatttctacatatgagaatgtttacaatttaaattttagaacttgttttggatgtgattatatgtacgaaaatcgtgtaacactatgctcatgctaagaaccgacataacagaattactgaaataaatgtgctgtgaggaatggaaaatatggtgcaggtgtcttggtcatgataaattgtgattctttttaaaaattttttccaaaaacaattaggtattttaatctgaaatcagattcctttacaaacaacaagtttttgtatgcaagcaccattttatttcatgtagtatggctaatactatagttgaaccaaggatatgcattgattctttgcttcgtatgtaaataaagttaaaaacagttaaaataaggagtattttggtagagtatatacatacctcactgccagtgaaattgctttcctatggtatatctccttaccagaaaaatctctaaataaaaaaaggtttaaagaaaatt

SEQ ID NO: 203319 - DNA, 2036 bp, Homo sapiens
  Payload ID: 20092
  Gene Name: zinc finger protein 644
  Uniprot ID: Q9H582
  ENST ID: ENST00000347275
  CDS Start-End: 225-542
cggggcgggccgagagcagtcaccaacccctctcgttgaggctgctcggttgtggccagaaacgctggctctggcattaactgtctacacccctccccttacttgggacaggaccgcatagccctcccctccccccgtcctgcaagatcttatgcggctaggtgcctgggaagtaacagcaagaggtttgatttaattttggatgagatcgttcttgcagcaagatgttaataagacaaaatctagccttagattgtaagcaaaagaaatcaaggtcaagatctggaagcaagaagaaaatgctaacattacctcatggtgctgacgaggtttacattctccgatgcaggttttgtggcctagtctttcgaggacccttgtctgttcaggaagactggattaagcacttacaacgacatattgtaaacgctaatcttccacggactggagctggcatggtggaagtcacgtcactacttaaaaagcctgcctccattacagaaacttcattttctctactaatggccgaagcagcttcatagaaccaggaaaccttttaaatagccagtttgaattggatgtaaatttgaaattctttttttttaagccacattaaattatctgtttataaatactaaagcaggaaaatggggggaaagtgaattacagtgacatcagagcaaattgaatacttaaaacagtaagtagtctatatattttatatagggtggaagatgtgtttttaaggtttatgaagttttgttggttaactgtgttcactcagtaaaagagcagtacatgtaagcagccattaataaactgttgcacatggatacttatagacagacttattggacaattatgttttttgcagtgttaccagaatcaaggctctgtttattccccacaagacttgcatagaaaaataagatattatattttgtttgtatgtatttagtgttttgtataataccaagaaccgctgactaaatttactcaaattagggcattaaatatcatgtacttcatagtttgagactgttcactcaaatagggcagagtactattctatctagatgtgtaagtgttttttttaaaatcacatggaacggttttttttatactaaaaagtggagggagatttgtttaaacaagtatttctaaaagaaatatgtacatagttctggaaattatttgtggtaaggaaatattctttactccagttgcatttctcagacaataaagtggtgcatccatgctacctcctactttgtcaacaaagatgctatttaccctttacatttttgtatcataatagattttaaaaatctaatgttctttattgcaagacattcttttgttaacaggtttgtttctttttaatgttttacctaaaatttgacatgcttacaggacaggtttgcctcttactttatttaacattgtagaaatgtaattaataaacaatgctcactacacagtttagaatagacgttctcatttatattatcttccaaatttgatcagttagcaaaacttaatacaccaattaaaatatttctacatatgagaatgtttacaatttaaattttagaacttgttttggatgtgattatatgtacgaaaatcgtgtaacactatgctcatgctaagaaccgacataacagaattactgaaataaatgtgctgtgaggaatggaaaatatggtgcaggtgtcttggtcatgataaattgtgattctttttaaaaattttttccaaaaacaattaggtattttaatctgaaatcagattcctttacaaacaacaagtttttgtatgcaagcaccattttatttcatgtagtatggctaatactatagttgaaccaaggatatgcattgattctttgcttcgtatgtaaataaagttaaaaacagttaaaataaggagtattttggtagagtatatacatacctcactgccagtgaaattgctttcctatggtatatctccttaccagaaaaatctctaaataaaaaaaggtttaaagaaaa

SEQ ID NO: 203320 - DNA, 1253 bp, Homo sapiens
  Payload ID: 20092
  Gene Name: zinc finger protein 644
  Uniprot ID: Q9H582
  ENST ID: ENST00000361321
  CDS Start-End: 323-640
gagaacagtggtgcactgtttccgctgccctcgtttgtctaattggcccagacgctccaccagcgcgaagcttcccgggagctcctcgctggccacccccgcggcccgcagcccggcagaggcgggaaagcagcgcgcctgcgccgtgggaaccggggctggaggcgaaaagcggggagcggaggggggccgctggagccgagtagcgtacagagcggcgtgtgacgcggggacgccgcgtgctcccaacgtcgccccggtttgacgcacacggcaccaaactgtttgatttaattttggatgagatcgttcttgcagcaagatgttaataagacaaaatctagccttagattgtaagcaaaagaaatcaaggtcaagatctggaagcaagaagaaaatgctaacattacctcatggtgctgacgaggtttacattctccgatgcaggttttgtggcctagtctttcgaggacccttgtctgttcaggaagactggattaagcacttacaacgacatattgtaaacgctaatcttccacggactggagctggcatggtggaagtcacgtcactacttaaaaagcctgcctccattacagaaacttcattttctctactaatggccgaagcagcttcatagaaccaggaaaccttttaaatagccagtttgaattggatgtaaatttgaaattctttttttttaagccacattaaattatctgtttataaatactaaagcaggaaaatggggggaaagtgaattacagtgacatcagagcaaattgaatacttaaaacagtaagtagtctatatattttatatagggtggaagatgtgtttttaaggtttatgaagttttgttggttaactgtgttcactcagtaaaagagcagtacatgtaagcagccattaataaactgttgcacatggatacttatagacagacttattggacaattatgttttttgcagtgttaccagaatcaaggctctgtttattccccacaagacttgcatagaaaaataagatattatattttgtttgtatgtatttagtgttttgtataataccaagaaccgctgactaaatttactcaaattagggcattaaatatcatgtacttcatagtttgagactgttcactcaaatagggcagagtactattctatctagatgtgtaagtgttttttttaaaatcacatggaacggttttttttatactaaaaagtggagggagatttgtttaaacaag

SEQ ID NO: 203321 - DNA, 5702 bp, Homo sapiens
  Payload ID: 20092
  Gene Name: zinc finger protein 644
  Uniprot ID: Q9H582
  ENST ID: ENST00000370440
  CDS Start-End: 219-4202
gcaatgcactgagtaacggggcgggccgagagcagtcaccaacccctctcgttgaggctgctcggttgtggccagaaacgctggctctggcattaactgtctacacccctccccttacttgggacaggaccgcatagccctcccctccccccgtcctgcaagatcttatgcggctaggtgcctgggaagtaacagcaagaggtttgatttaattttggatgagatcgttcttgcagcaagatgttaataagacaaaatctagactaaatgtgttaaatgggcttgccaacaatatggatgatttgaagataaacaccgatattactggtgctaaagaagaactcctagatgacaacaattttatctcagacaaagagagcggagttcataagccaaaagattgtcaaacatcatttcagaaaaataatacgttgactctgcctgaagaactgtcaaaggacaaatctgaaaacgccttaagtggaggccagtctagtctatttatacatgctggtgctcctactgtttctagtgaaaactttatcttgcctaaaggagctgctgttaatggaccagtttcacactcctccttaactaagacttccaatatgaataaaggcagtgtttcattaaccactggacagcctgtggatcagccaacaacagaatcttgttcaactttgaaggtagcagctgatcttcagctgtctacaccacagaaagcaagtcaacaccaagttttatttttgttatcagatgtagcacatgctaagaatcccacccattccaataaaaaactacctacctctgcttcagttggttgtgacattcagaattcagtagggagtaatataaagtcagatggcactttaataaatcaagtagaggtgggtgaggatggtgaagatttattggtgaaagatgattgtgtcaatacagtaacgggaatttcctcaggtacagatggatttaggtcagaaaatgatacaaactgggatccccaaaaagagttcattcaatttcttatgactaatgaggaaacagtagataaagctccacctcattctaaaataggtctagaaaaaaaaagaaagcgaaaaatggatgtaagcaagataactcgttataccgaggattgctttagtgattctaattgtgtacccaataaatcaaaaatgcaagaagtagactttctagaacaaaatgaagagctacaagcagtagactcacagaaatatgcattatcaaaagtgaagcctgaatcaactgatgaagacttagaatctgtggatgccttccaacatctaatttataacccagataagtgtggagaagagagttcacctgttcatactagcacttttctttcaaataccttaaaaaagaaatgtgaagagagtgattctgagtcacctgctactttcagtaccgaagagccatcattctacccctgtacaaagtgcaatgtgaattttagggagaagaagcacctccacaggcatatgatgtatcatttagatgggaatagtcactttcgccatcttaatgtcccaaggccatatgcttgtagagaatgtggacggacatttcgagatcgcaattcacttctaaaacatatgattattcaccaggagagaagacagaagttgatggaggaaattcgtgaattgaaagaacttcaggatgaaggaagaagtgcacgattacagtgtcctcagtgtgtgtttggtaccaattgccctaaaacatttgtgcaacatgctaaaacccatgaaaaagataaaaggtactactgctgtgaagagtgtaacttcatggcagtgacagaaaatgaattggaatgccatcgaggcattgcacatggggcagtggtaaaatgccctatggtcacttctgatattgcccagagaaaaacacaaaaaaagactttcatgaaagactctgtagtaggatcatccaaaaaatcagctacctacatatgtaagatgtgtccttttactacttcagccaaaagtgttttaaaaaagcacacggagtacttgcattcatcatcatgtgttgattcatttggtagtcctcttggacttgataaaagaaaaaatgacatccttgaagaacctgtagatagtgatagcactaaaacattaactaaacaacagtcaaccacatttccaaagaactctgctttaaaacaagatgtgaagcgaacatttggatcaacctcacaatcaagtagtttttcaaaaattcataagcggccacacagaatacagaaagctcggaaaagcattgcccaatcaggtgtaaacatgtgcaatcaaaacagctctcctcataagaatgttacaattaaaagcagcgttgaccaaaaacctaagtatttccatcaagcagcaaaagaaaagtctaatgccaaggcaaatagccactatttgtatagacacaaatatgaaaactataggatgatcaaaaaatcaggtgaatcatatcctgtgcatttcaaaaaagaagaagctagttcattaaattctttacacctgttttcatcatcaagtaattctcacaacaattttatttcagaccctcataagcctgacgccaaaaggcctgaaagcttcaaagatcacagacgtgtagctgtaaagagagtaattaaggaatctaagaaggaaagttctgttggaggggaagacttggatagctatccagattttttgcataaaatgactgttgtcgttttgcaaaaacttaattctgctgaaaagaaagatagttatgaaacagaagatgaaagttcctgggataatgttgagttaggagactacactacacaggccatagaagatgaaacctatagtgatattaatcaagagcatgtaaatttattccctttatttaagagcaaagtggaaggtcaggagcctggagaaaatgctactcttagttatgaccaaaacgatggcttttattttgaatactatgaagatactggaagtaacaactttttgcatgagatacatgatcctcagcatttagaaactgcagatgcttcattgtcaaagcatagttctgtttttcattggactgatttgtctcttgagaagaaatcgtgtccttactgcccagcaacatttgaaacaggtgttgggttatcaaatcatgtcagggggcatcttcacagagcaggattaagctatgaagcccgtcatgttgtatcaccagaacaaatagccacaagtgacaaaatgcagcatttcaaaagaactggcacaggaacacctgttaaacgagttagaaaagctatagagaagtctgaaaccacttctgaacacacttgtcagctctgtggtggttggtttgatactaaaattggattatcaaatcatgttagaggccacttgaaaagacttggaaagacgaaatgggatgctcacaaatctccaatctgtgttctgaatgagatgatgcaaaatgaagaaaaatatgaaaaaatcttaaaggcattgaacagtcgtcgtattattcccagaccatttgtagctcaaaaacttgcatcaagtgatgactttatatctcaaaatgttatacctcttgaagcataccgtaatggcctaaagactgaagctctgtcagtgtctgcatcagaagaagaagggctgaatttcttaaatgaatatgatgaaacaaaaccagaactgcccagtgggaaaaagaatcagtctcttacactcatagaacttcttaaaaataaaaggatgggagaagaaaggaattctgctatttctcctcaaaagatccataatcagacagcaagaaagagattcgttcagaaatgcgttcttccattaaatgaggatagtccgttgatgtatcagccacaaaaaatggacttgactatgcactcagccttagattgtaagcaaaagaaatcaaggtcaagatctggaagcaagaagaaaatgctaacattacctcatggtgctgacgaggtttacattctccgatgcaggttttgtggcctagtctttcgaggacccttgtctgttcaggaagactggattaagcacttacaacgacatattgtaaacgctaatcttccacggactggagctggcatggtggaagtcacgtcactacttaaaaagcctgcctccattacagaaacttcattttctctactaatggccgaagcagcttcatagaaccaggaaaccttttaaatagccagtttgaattggatgtaaatttgaaattctttttttttaagccacattaaattatctgtttataaatactaaagcaggaaaatggggggaaagtgaattacagtgacatcagagcaaattgaatacttaaaacagtaagtagtctatatattttatatagggtggaagatgtgtttttaaggtttatgaagttttgttggttaactgtgttcactcagtaaaagagcagtacatgtaagcagccattaataaactgttgcacatggatacttatagacagacttattggacaattatgttttttgcagtgttaccagaatcaaggctctgtttattccccacaagacttgcatagaaaaataagatattatattttgtttgtatgtatttagtgttttgtataataccaagaaccgctgactaaatttactcaaattagggcattaaatatcatgtacttcatagtttgagactgttcactcaaatagggcagagtactattctatctagatgtgtaagtgttttttttaaaatcacatggaacggttttttttatactaaaaagtggagggagatttgtttaaacaagtatttctaaaagaaatatgtacatagttctggaaattatttgtggtaaggaaatattctttactccagttgcatttctcagacaataaagtggtgcatccatgctacctcctactttgtcaacaaagatgctatttaccctttacatttttgtatcataatagattttaaaaatctaatgttctttattgcaagacattcttttgttaacaggtttgtttctttttaatgttttacctaaaatttgacatgcttacaggacaggtttgcctcttactttatttaacattgtagaaatgtaattaataaacaatgctcactacacagtttagaatagacgttctcatttatattatcttccaaatttgatcagttagcaaaacttaatacaccaattaaaatatttctacatatgagaatgtttacaatttaaattttagaacttgttttggatgtgattatatgtacgaaaatcgtgtaacactatgctcatgctaagaaccgacataacagaattactgaaataaatgtgctgtgaggaatggaaaatatggtgcaggtgtcttggtcatgataaattgtgattctttttaaaaattttttccaaaaacaattaggtattttaatctgaaatcagattcctttacaaacaacaagtttttgtatgcaagcaccattttatttcatgtagtatggctaatactatagttgaaccaaggatatgcattgattctttgcttcgtatgtaaataaagttaaaaacagttaaaataaggagtattttggtagagtatatacatacctcactgccagtgaaattgctttcctatggtatatctccttaccagaaaaatctctaaataaaaaaaggtttaaagaaaattaaaa

SEQ ID NO: 203322 - DNA, 2056 bp, Homo sapiens
  Payload ID: 20092
  Gene Name: zinc finger protein 644
  ENST ID: ENST00000621077
  CDS Start-End: 52-2004
tgtacaaagtgcaatgtgaattttagggagaagaagcacctccacaggcatatgatgtatcatttagatgggaatagtcactttcgccatcttaatgtcccaaggccatatgcttgtagagaatgtggacggacatttcgagatcgcaattcacttctaaaacatatgattattcaccaggagagaagacagaagttgatggaggaaattcgtgaattgaaagaacttcaggatgaaggaagaagtgcacgattacagtgtcctcagtgtgtgtttggtaccaattgccctaaaacatttgtgcaacatgctaaaacccatgaaaaagataaaaggtactactgctgtgaagagtgtaacttcatggcagtgacagaaaatgaattggaatgccatcgaggcattgcacatggggcagtggtaaaatgccctatggtcacttctgatattgcccagagaaaaacacaaaaaaagactttcatgaaagactctgtagtaggatcatccaaaaaatcagctacctacatatgtaagatgtgtccttttactacttcagccaaaagtgttttaaaaaagcacacggagtacttgcattcatcatcatgtgttgattcatttggtagtcctcttggacttgataaaagaaaaaatgacatccttgaagaacctgtagatagtgatagcactaaaacattaactaaacaacagtcaaccacatttccaaagaactctgctttaaaacaagatgtgaagcgaacatttggatcaacctcacaatcaagtagtttttcaaaaattcataagcggccacacagaatacagaaagctcggaaaagcattgcccaatcaggtgtaaacatgtgcaatcaaaacagctctcctcataagaatgttacaattaaaagcagcgttgaccaaaaacctaagtatttccatcaagcagcaaaagaaaagtctaatgccaaggcaaatagccactatttgtatagacacaaatatgaaaactataggatgatcaaaaaatcaggtgaatcatatcctgtgcatttcaaaaaagaagaagctagttcattaaattctttacacctgttttcatcatcaagtaattctcacaacaattttatttcagaccctcataagcctgacgccaaaaggcctgaaagcttcaaagatcacagacgtgtagctgtaaagagagtaattaaggaatctaagaaggaaagttctgttggaggggaagacttggatagctatccagattttttgcataaaatgactgttgtcgttttgcaaaaacttaattctgctgaaaagaaagatagttatgaaacagaagatgaaagttcctgggataatgttgagttaggagactacactacacaggccatagaagatgaaacctatagtgatattaatcaagagcatgtaaatttattccctttatttaagagcaaagtggaaggtcaggagcctggagaaaatgctactcttagttatgaccaaaacgatggcttttattttgaatactatgaagatactggaagtaacaactttttgcatgagatacatgatcctcagcatttagaaactgcagatgcttcattgtcaaagcatagttctgtttttcattggactgatttgtctcttgagaagaaatcgtgtccttactgcccagcaacatttgaaacaggtgttgggttatcaaatcatgtcagggggcatcttcacagagcaggattaagctatgaagcccgtcatgttgtatcaccagaacaaatagccacaagtgacaaaatgcagcatttcaaaagaactggcacaggaacacctgttaaacgagttagaaaagctatagagaagtctgaaaccacttctgaacacacttgtcagctctgtggtggttggtttgatactaaaattggattatcaaatcatgttagaggccacttgaaaagacttggaaagacgaaatgggatgctcacaaatctccaatctgtgtttgaatgagatgatgcaaaatgaagaaaaatatgaaaaaatcttaaaggcattgaa

SEQ ID NO: 203323 - DNA, 1519 bp, Homo sapiens
  Payload ID: 20093
  Gene Name: zinc finger protein 645
  Uniprot ID: Q8N7E2
  ENST ID: ENST00000323684
  CDS Start-End: 50-1327
tttttgaggaagtagacaaacctaaatatgtgtctgaactccaaggaatatgaacaagatgcctgctggtgaacaagaatgtgaatataacaaagaagggaagtactactctaaaggagttaaactggtgagaaaaaagaaaaaaattcctggttaccgttggggggacattaagataaacatcataggtgaaaaggatgatttaccaattcatttctgtgacaaatgtgatttgcctattaaaatctatgggcgaataattccgtgcaagcatgctttttgctatcactgtgctaatttatatgacaaagtcggatataaagtatgtccgcgctgtcgttatcctgtgctgagaattgaggcgcataaacgaggttctgtcttcatgtgtagtattgttcagcagtgcaagagaacatacttgtctcagaaaagcttacaggctcatatcaaacgccgccataagagagctcgaaaacaagttaccagcgcttcgcttgaaaaagttcgtcctcatattgctccgccacaaactgaaatctctgacatccctaaaagactgcaagacagggaccatctaagctatattccaccagaacagcacaccatggtgtcactaccgtctgtgcaacatatgctacaagagcaacataatcagccacataaggatatccaggctcctcccccagaactatctctaagtctgccttttcccatccagtgggaaaccgttagtatttttacgagaaaacatggcaatttaacagttgatcatattcagaataactcagattctggtgctaagaagccaacacctcccgactattatcctgagtgtcaaagtcaaccagcggtatcgtcccctcatcatattatacctcagaaacagcattatgcgccacctccatctccatcatcaccagtaaaccatcaaatgccatatcctcctcaggatgtagttactcctaactcggttcgtagccaagtgccagctctaaccacgacctacgatccatcatctggatatattattgtaaaggtgccacctgatatgaattctcctccactacgtgctccccagtctcaaaatggtaatccatctgcaagtgaatttgcttctcaccattataaccttaacattttacctcagttcaccgaaaatcaagaaaccttgagccctcagtttacacaaacagatgcaatggatcatagaaggtggcctgcatggaaacgactgtcaccttgtccaccaacgcggagtccacctccttcaaccctacatggtcgatcacatcattcacaccagagaagacatagacggtattaaggatgataacagtatttggaactgaagacctgatgggaaaaaaaccttcaagttctatactgtactgtggataagcggctcagttcagcagagctggagttgaacaactttgttcctctggtgtggtaaattgacctaaaggtgacctctgacgatttcctgaaataaatatgcaatgttacattttcaaaa

SEQ ID NO: 203324 - DNA, 6892 bp, Homo sapiens
  Payload ID: 20094
  Gene Name: zinc finger protein 646
  Uniprot ID: O15015
  ENST ID: ENST00000300850
  CDS Start-End: 290-5788
agtaacaataggaagtgtccgtagagctgggagtagactcctggctcatgccagctgcgccctcttttctctacctccttcctcttccccccttctcctttccctctttcccttccctcccacctcccgggaaccctggctgagtgtgcgtgtgtgggagcgcgagagccccccgacagccaccccttggggcgcgcggctgcagttagggccttggcccctccaccagaggaaggtgctgccacgtgtctgctccttctgaacctccaggtttctgctacgttgccccatggaggacacacccccctcactcagctgctccgactgtcagcgccactttcccagcctcccagagctctctcggcaccgagaactgctccatccatctcccaaccaggacagtgaggaggctgacagcatccctcggccctaccgttgtcagcagtgtgggcggggctaccgtcaccccgggagcctggttaaccatcgtcggacccacgagactggccttttcccctgtaccacctgtggcaaggacttctccaatcccatggctctcaagagccatatgaggacacatgctcctgagggccgccgcaggcacaggcccccacgccccaaggaagccactccacacctccagggtgagacggtgtccactgactcctggggccaaaggcttggctctagtgaaggctgggaaaaccagacaaaacatacagaagagacacctgactgtgaatctgtacctgaccccagggcagcttcgggtacgtgggaagatctgcccaccagacaaagagaaggcttggcaagccacccaggtcctgaggatggtgcagacggctggggaccctccactaactctgccagagcccctcctctccccatcccagccagcagccttcttagcaacttggaacagtatctggctgaatcagtagtgaacttcacagggggccaggagcccacccagtcccctcctgctgaggaggagcggcggtacaaatgtagtcagtgtggcaagacctacaagcacgccgggagcctcaccaaccaccgccagagccacacgctgggcatctacccctgtgccatctgtttcaaggagttctctaacctcatggctctgaagaaccactctcgactgcatgcccagtatcggccttaccactgtccccactgcccccgtgtcttccggctcccccgggagctgctggaacaccagcagtcccatgagggtgaaaggcaggagccacgctgggaggagaaagggatgcccaccaccaatgggcacacagatgagagcagccaggaccagctccccagtgcacagatgctgaatggctctgcggagctcagcacctctggggagctggaggacagtggcctggaggaataccggcctttccgctgtggggactgtggccgtacttaccgccatgctgggagcctcatcaaccatcgaaagagccaccagacaggtgtctacccctgctcactctgttctaagcagctgttcaatgcggctgccctcaaaaaccatgtgcgggctcatcacaggcccaggcaaggagttggggaaaatgggcagccatcagtcccaccagctcccctgctgctggctgagaccacccacaaagaggaagaggaccccaccaccaccctggaccatcggccctataagtgcagtgagtgtggtcgtgcttaccgccaccgggggagcctggtgaaccatcgccacagccatcggactggagagtaccagtgctcactctgtccccgcaagtaccccaatctcatggccctgcgcaaccacgtgcgggtacattgcaaggctgctcgccgaagtgcagacatcggggctgagggtgcccccagccacctcaaggtagaactcccgcctgacccagtggaggcagaggcagccccgcacacagatcaggaccatgtgtgcaaacatgaagaagaggccacggacatcaccccagcagcagacaagacagcagcacatatctgtagcatctgtgggctgctctttgaagacgctgagagccttgaacgtcatggcctgactcatggggcaggggaaaaggaaaatagcagaacagagaccacaatgtcacctcctagggcctttgcctgccgagactgtggaaagagctatcgccactcaggcagccttatcaaccacaggcagacccaccagacaggagacttcagttgtggggcctgtgccaagcacttccacaccatggctgccatgaagaaccacttgcgccggcacagtcggcggcggagcaggcggcatcggaagcgggctggcggtgccagcggtgggagagaagccaaactcctggcagcggagagctggacccgggagctagaagacaatgaaggcctggagtctccccaagacccttcaggggaaagtcctcatggggctgaaggcaacctggaaagtgatggggactgtttgcaggctgaatctgaaggggacaaatgtgggcttgagagggatgagacccatttccagggtgataaagagagcggaggcactggggaaggactggaaaggaaggatgccagtttacttgacaacttggacatcccaggtgaggaaggtggtggcactcacttctgcgatagcctcactggggtggatgaagaccagaagccagccactggccaacccaactcctcttcccactctgccaatgctgtcactggctggcaggctggggccgctcacacatgctctgactgtgggcattctttcccccatgccactggcctgctgagccacaggccctgccacccaccaggcatctatcagtgctccctctgcccgaaggagtttgactctctgcctgccctccgcagccacttccagaaccataggcctggggaggcgacctcagcacagcctttcctctgctgcctctgtggcatgatcttccctgggcgggctggctacaggcttcaccggcgccaggcccacagctcctctggcatgactgagggctcagaggaggagggggaagaggaaggagtggcagaggcagcccctgcacgcagtccaccactgcagctctcggaagcagagctgctgaatcagctgcagcgggaggtggaagcgctggacagtgcagggtatgggcacatctgtggctgctgtggtcagacctacgatgacctggggagcctggagcgtcaccaccaaagtcagagttctgggactactgcagacaaggctcccagccccttgggagtggcaggtgatgccatggagatggtcgtggacagtgtcttggaggacatagtgaattctgtctctggagagggtggagatgccaagtctcaagagggagcaggcacccccttgggagacagcctctgcatccagggtggggaaagtttgttggaggctcagccccgccccttccgctgcaaccagtgtggcaagacctatcgccatgggggcagcctggtgaaccaccgcaagatccaccagactggagactttctctgccctgtctgctcccgctgctaccccaacctggctgcctaccgtaatcatctgcggaaccaccctcgctgcaaaggctctgagccccaggttgggcccatcccagaggcagcaggtagcagtgagctgcaggttgggcccatcccagaaggaggcagcaacaagccccagcacatggcagaggaggggccggggcaagcagaagtcgagaagctccaggaagaacttaaagtggagcccctggaggaagtggccagggtgaaagaagaggtgtgggaggagaccactgtgaagggggaggagatagagcccaggctggagactgccgagaagggctgccagactgaagccagctctgagcggcccttcagctgcgaggtgtgtggccgatcctacaagcacgccggcagcctcatcaaccaccggcagagccaccagaccggccactttggctgtcaggcctgctccaagggcttctcaaacctcatgtccctcaagaaccaccggcgcatccatgcagatccccgacgtttccgctgcagcgagtgtgggaaggccttccgcctgcggaaacagctggccagccaccagcgggtccacatggaacggcgtgggggtgggggcacccgaaaggcgactcgggaagatcggcccttccgctgtgggcagtgcgggcggacctatcgccacgccggcagcctcctgaaccaccggcgcagccacgagacgggccagtacagctgccccacctgccccaagacctactccaaccgcatggccctgaaggaccaccagaggctgcactcagagaatcggcggcgacgggctggacggtccaggcgcacagctgtgcgttgcgccctctgtggccgcagcttccctggccggggatctttggagcggcacctgcgggagcatgaggagacagaaagggagccagccaatggccagggaggcctggatggcacagcggccagtgaggcgaacctgactggcagccagggactagagacccaattgggtggtgctgagccagtaccccacttggaggatggagtcccaaggccaggggagcgcagtcagagccccatcagggcagcaagctcagaagccccagagccactgtcctggggtgcagggaaggcaggtgggtggccggtaggtgggggactggggaatcatagtggaggctgggttcctcagttcctaactaggtcagaggagccagaggacagtgtccacaggagtccttgccacgctggtgactgccagctcaatggacctactctgagtcacatggatagctgggacaacagagacaacagctctcagctgcagccagggagccactcctcttgcagccagtgtggcaagacttactgccagtcaggcagcctcttgaaccacaacaccaacaagacagaccgacactattgcctgctctgctccaaggagttcttaaatcctgtggccacaaagagccacagccacaaccacatagacgcccagacctttgcctgtcctgactgtggcaaagcctttgagtcccaccaggaactggccagccacctgcaggctcatgcccggggccacagccaggtgccagcccagatggaggaggccagagatcccaaagccgggactggggaggaccaggtggttctccctggtcaagggaaagcccaggaggccccatcagaaacccccagaggcccaggagagagtgtggagagagccaggggaggacaagcggtgacgtccatggcggctgaggacaaggagcggcccttccgctgcacccagtgcgggcgctcctaccgccatgctggcagcctgctgaaccaccagaaggcccacaccacagggttgtacccgtgctccctctgtcccaaacttctccctaacctgctgtctcttaagaaccacagcaggacccacacggaccccaagcgccactgctgcagcatctgtggcaaggcctttcggacagctgcccggctggagggccacgggcgggtccatgcaccccgggaggggcctttcacctgcccccattgtccccgccacttccgccgccgaatcagcttcgtgcagcaccagcagcagcaccaggaggagtggacggtggccggctccggagccccagtggcaccagtgacgggcagaggggacttgccattgccccctccacccacccccacgaccccactcctggatccttcaccccagtggcctgcagacctcagcttctccctctgaacttcaagtctccaaagatcagaatctgggggagggagcgcgtgcagggaggggcttgatctccacattttctcaggagtagttcgggcatccccatatcttctcctctccccttgtgaagaggacccagatctggcttctttcccaaggagggggtggggtgttcctcgcgtccctgtccttgaaggacctccttcccccagcctcatcaccgtgctcttctcagcgccaccctcagcagccagattgcaacaccagggagaggcggatgcagagccccaccggtgggaaagttgcctgtggaagggagccttttgctacaatttgtaacttattttctaaagtctattttgtaacaatttatttaagtttaaaaaaaggaaaactgctgccccccaaaaaaagaaattttcaaaacaacgtggctggcgtgattgtatctgaaagggtaaaggaggaggaaagctgagacgcctgcttggtagcagagttgggtgtgggagtgtccacagacacccctgtcctgcagggtggggagtgggcacctgtggccccaggcaggttccttcccacagctgctgggcttctgggcctgccctggtgcctggaatcacacatgacagggtggggaggacaggggcagtaatgccatttgcctgcctgcattctcttgtcctgagaatggccaggtcccctgtcagcagctggttggttggcctgtggggaaggaaggagggtggagttgtcctcatcctcacggctttggtccctccctccctccccattcctcgaaggaacagggtctgtcttggccgccatgacagatgagaatactgaggctcaaagcggttgagcagcctgctccaagtcacacgatgacaaagaaccagaatctgaatcaaatgggtctgcctgttgctccaccctacccaaggcagctggagtgggttagaacggcacgttctcactggagagagaagggtcctggagaggcagggtttggcaggaggccccggggccacatacttatgttggccaggcagcttccaggctcagcctcgggctctggttcctcggcgaagtagacctgccagtccaaactgc

SEQ ID NO: 203325 - DNA, 8118 bp, Homo sapiens
  Payload ID: 20094
  Gene Name: zinc finger protein 646
  Uniprot ID: O15015
  ENST ID: ENST00000394979
  CDS Start-End: 424-5913
gagcagattcctactgttcttaaaggacagtaatgccttttgagtctggtctgaagaacataacaggtctgtgatcagaagtaggttgcatctctctcaactttaatttccttagctatacctgtagggatgacttaagcctaggggagctcctatatttgggaagcttgtgcacagggaagccttaaatgatggtgcctgcagattggatctagtagaaattaggtccttgggcatggatgcttggggaacctctcagtgacctcaggtgaacttgttgctcgtagagccaagaggcgaagttaattcaggccttccttttgaccactgccccctcttcctaggccttggcccctccaccagaggaaggtgctgccacgtgtctgctccttctgaacctccaggtttctgctacgttgccccatggaggacacacccccctcactcagctgctccgactgtcagcgccactttcccagcctcccagagctctctcggcaccgagaactgctccatccatctcccaaccaggacagtgaggaggctgacagcatccctcggccctaccgttgtcagcagtgtgggcggggctaccgtcaccccgggagcctggttaaccatcgtcggacccacgagactggccttttcccctgtaccacctgtggcaaggacttctccaatcccatggctctcaagagccatatgaggacacatgctcctgagggccgccgcaggcacaggcccccacgccccaaggaagccactccacacctccagggtgagacggtgtccactgactcctggggccaaaggcttggctctagtgaaggctgggaaaaccagacaaaacatacagaagagacacctgactgtgaatctgtacctgaccccagggcagcttcgggtacgtgggaagatctgcccaccagacaaagagaaggcttggcaagccacccaggtcctgaggatggtgcagacggctggggaccctccactaactctgccagagcccctcctctccccatcccagccagcagccttcttagcaacttggaacagtatctggctgaatcagtagtgaacttcacagggggccaggagcccacccagtcccctcctgctgaggaggagcggcggtacaaatgtagtcagtgtggcaagacctacaagcacgccgggagcctcaccaaccaccgccagagccacacgctgggcatctacccctgtgccatctgtttcaaggagttctctaacctcatggctctgaagaaccactctcgactgcatgcccagtatcggccttaccactgtccccactgcccccgtgtcttccggctcccccgggagctgctggaacaccagcagtcccatgagggtgaaaggcaggagccacgctgggaggagaaagggatgcccaccaccaatgggcacacagatgagagcagccaggaccagctccccagtgcacagatgctgaatggctctgcggagctcagcacctctggggagctggaggacagtggcctggaggaataccggcctttccgctgtggggactgtggccgtacttaccgccatgctgggagcctcatcaaccatcgaaagagccaccagacaggtgtctacccctgctcactctgttctaagcagctgttcaatgcggctgccctcaaaaaccatgtgcgggctcatcacaggcccaggcaaggagttggggaaaatgggcagccatcagtcccaccagctcccctgctgctggctgagaccacccacaaagaggaagaggaccccaccaccaccctggaccatcggccctataagtgcagtgagtgtggtcgtgcttaccgccaccgggggagcctggtgaaccatcgccacagccatcggactggagagtaccagtgctcactctgtccccgcaagtaccccaatctcatggccctgcgcaaccacgtgcgggtacattgcaaggctgctcgccgaagtgcagacatcggggctgagggtgcccccagccacctcaaggtagaactcccgcctgacccagtggaggcagaggcagccccgcacacagatcaggaccatgtgtgcaaacatgaagaagaggccacggacatcaccccagcagcagacaagacagcagcacatatctgtagcatctgtgggctgctctttgaagacgctgagagccttgaacgtcatggcctgactcatggggcaggggaaaaggaaaatagcagaacagagaccacaatgtcacctcctagggcctttgcctgccgagactgtggaaagagctatcgccactcaggcagccttatcaaccacaggcagacccaccagacaggagacttcagttgtggggcctgtgccaagcacttccacaccatggctgccatgaagaaccacttgcgccggcacagtcggcggcggagcaggcggcatcggaagcgggctggcggtgccagcggtgggagagaagccaaactcctggcagcggagagctggacccgggagctagaagacaatgaaggcctggagtctccccaagacccttcaggggaaagtcctcatggggctgaaggcaacctggaaagtgatggggactgtttgcaggctgaatctgaaggggacaaatgtgggcttgagagggatgagacccatttccagggtgataaagagagcggaggcactggggaaggactggaaaggaaggatgccagtttacttgacaacttggacatcccaggtgaggaaggtggtggcactcacttctgcgatagcctcactggggtggatgaagaccagaagccagccactggccaacccaactcctcttcccactctgccaatgctgtcactggctggcaggctggggccgctcacacatgctctgactgtgggcattctttcccccatgccactggcctgctgagccacaggccctgccacccaccaggcatctatcagtgctccctctgcccgaaggagtttgactctctgcctgccctccgcagccacttccagaaccataggcctggggaggcgacctcagcacagcctttcctctgctgcctctgtggcatgatcttccctgggcgggctggctacaggcttcaccggcgccaggcccacagctcctctggcatgactgagggctcagaggaggagggggaagaggaaggagtggcagaggcagcccctgcacgcagtccaccactgcagctctcggaagcagagctgctgaatcagctgcagcgggaggtggaagcgctggacagtgcagggtatgggcacatctgtggctgctgtggtcagacctacgatgacctggggagcctggagcgtcaccaccaaagtcagagttctgggactactgcagacaaggctcccagccccttgggagtggcaggtgatgccatggagatggtcgtggacagtgtcttggaggacatagtgaattctgtctctggagagggtggagatgccaagtctcaagagggagcaggcacccccttgggagacagcctctgcatccagggtggggaaagtttgttggaggctcagccccgccccttccgctgcaaccagtgtggcaagacctatcgccatgggggcagcctggtgaaccaccgcaagatccaccagactggagactttctctgccctgtctgctcccgctgctaccccaacctggctgcctaccgtaatcatctgcggaaccaccctcgctgcaaaggctctgagccccaggttgggcccatcccagaggcagcaggtagcagtgagctgcaggttgggcccatcccagaaggaggcagcaacaagccccagcacatggcagaggaggggccggggcaagcagaagtcgagaagctccaggaagaacttaaagtggagcccctggaggaagtggccagggtgaaagaagaggtgtgggaggagaccactgtgaagggggaggagatagagcccaggctggagactgccgagaagggctgccagactgaagccagctctgagcggcccttcagctgcgaggtgtgtggccgatcctacaagcacgccggcagcctcatcaaccaccggcagagccaccagaccggccactttggctgtcaggcctgctccaagggcttctcaaacctcatgtccctcaagaaccaccggcgcatccatgcagatccccgacgtttccgctgcagcgagtgtgggaaggccttccgcctgcggaaacagctggccagccaccagcgggtccacatggaacggcgtgggggtgggggcacccgaaaggcgactcgggaagatcggcccttccgctgtgggcagtgcgggcggacctatcgccacgccggcagcctcctgaaccaccggcgcagccacgagacgggccagtacagctgccccacctgccccaagacctactccaaccgcatggccctgaaggaccaccagaggctgcactcagagaatcggcggcgacgggctggacggtccaggcgcacagctgtgcgttgcgccctctgtggccgcagcttccctggccggggatctttggagcggcacctgcgggagcatgaggagacagaaagggagccagccaatggccagggaggcctggatggcacagcggccagtgaggcgaacctgactggcagccagggactagagacccaattgggtggtgctgagccagtaccccacttggaggatggagtcccaaggccaggggagcgcagtcagagccccatcagggcagcaagctcagaagccccagagccactgtcctggggtgcagggaaggcaggtgggtggccggtaggtgggggactggggaatcatagtggaggctgggttcctcagttcctaactaggtcagaggagccagaggacagtgtccacaggagtccttgccacgctggtgactgccagctcaatggacctactctgagtcacatggatagctgggacaacagagacaacagctctcagctgcagccagggagccactcctcttgcagccagtgtggcaagacttactgccagtcaggcagcctcttgaaccacaacaccaacaagacagaccgacactattgcctgctctgctccaaggagttcttaaatcctgtggccacaaagagccacagccacaaccacatagacgcccagacctttgcctgtcctgactgtggcaaagcctttgagtcccaccaggaactggccagccacctgcaggctcatgcccggggccacagccaggtgccagcccagatggaggaggccagagatcccaaagccgggactggggaggaccaggtggttctccctggtcaagggaaagcccaggaggccccatcagaaacccccagaggcccaggagagagtgtggagagagccaggggaggacaagcggtgacgtccatggcggctgaggacaaggagcggcccttccgctgcacccagtgcgggcgctcctaccgccatgctggcagcctgctgaaccaccagaaggcccacaccacagggttgtacccgtgctccctctgtcccaaacttctccctaacctgctgtctcttaagaaccacagcaggacccacacggaccccaagcgccactgctgcagcatctgtggcaaggcctttcggacagctgcccggctggagggccacgggcgggtccatgcaccccgggaggggcctttcacctgcccccattgtccccgccacttccgccgccgaatcagcttcgtgcagcaccagcagcagcaccaggaggagtggacggtggccggctccggtagggggcatgaagggtcccaggaggaggtgggcacacagtggagggggaagtccagccccaaagtcggtgggggagcaaggagtgagaggagagagccccggggattctaagaggtgggtgggggcttggctatggggtgagagaagtagcttgaggatgtgctgagctgagcacccgcaagtcaggtataacaaatagcagggtgggttgggcagcacgtgggggcgtggtcaggccgaggctgctacctgggctcctccattacactgtagccagaatggaatggtctttctgttcaggggaaggtcactgggtaccccctggctgctgtgtctggaaaccctcctgagtcagccagtaaagtaatgacttccagagaaaaagaggaagccattggtttggtctaggttccattctttcctggagcaggccgggtgccagggaacaagggatggggcatgggctccacggcttccctgctgacttggccacggaaactggttcactggttggcaccctactccctgtccctctttccctgcgccttgtctctgctgctcctctccttggaaactagacctctggtccttccctgtcagtgttgctcccatctcttctctaacctttattcagccccttttccctctgctgccaacggcctttttaggatccaaccaaaccaccctttctacctgcgcaccctgccaccctctgcacacctttaactggaggactgagtcacagataattgtttccttgaagtccaggcccagctgcagcaacaacagtcattagcccgtgtcacatccctgatcagagggcatctccgtggggaatcgcctccacccagcactgctggaagccgcagctgccagggagtggggcggccggttccctcagcaggacctgggctggcctctccacctcccctagtagaggcggacccattccatctagtggccaccgagggtgggtggccctgagatggtgggcccttgacaggccttgtcagagcagagggcaggtgggagtcacctgaaagctgaaggaatggctttaaggatagaagatttctcatgacctcaagggatatgagggaggagccagtttgccagggctgggaaaataattaggaggcctagaatccctgttctcatctgggcctccggggccaggggcaggggaatggcctgcagggctgggagggggtacacgctgtgcggggtctgcccctcagttggtgacctcctctctctctccccccaggagccccagtggcaccagtgacgggcagaggggacttgccattgccccctccacccacccccacgaccccactcctggatccttcaccccagtggcctgcagacctcagcttctccctctgaacttcaagtctccaaagatcagaatctgggggagggagcgcgtgcagggaggggcttgatctccacattttctcaggagtagttcgggcatccccatatcttctcctctccccttgtgaagaggacccagatctggcttctttcccaaggagggggtggggtgttcctcgcgtccctgtccttgaaggacctccttcccccagcctcatcaccgtgctcttctcagcgccaccctcagcagccagattgcaacaccagggagaggcggatgcagagccccaccggtgggaaagttgcctgtggaagggagccttttgctacaatttgtaacttattttctaaagtctattttgtaacaatttatttaagtttaaaaaaaggaaaactgctgccccccaaaaaaagaaattttcaaaacaacgtggctggcgtgattgtatctgaaagggtaaaggaggaggaaagctgagacgcctgcttggtagcagagttgggtgtgggagtgtccacagacacccctgtcctgcagggtggggagtgggcacctgtggccccaggcaggttccttcccacagctgctgggcttctgggcctgccctggtgcctggaatcacacatgacagggtggggaggacaggggcagtaatgccatttgcctgcctgcattctcttgtcctgagaatggccaggtcccctgtcagcagctggttggttggcctgtggggaaggaaggagggtggagttgtcctcatcctcacggctttggtccctccctccctccccattcctcgaaggaacagggtctgtcttggccgccatgacagatgagaatactgaggctcaaagcggttgagcagcctgctccaagtcacacgatgacaaagaaccagaatctgaatcaaatgggtctgcctgttgctccaccct

SEQ ID NO: 203326 - DNA, 1077 bp, Homo sapiens
  Payload ID: 20094
  Gene Name: zinc finger protein 646
  ENST ID: ENST00000428260
  CDS Start-End: 358-1077
tagagctgggagtagactcctggctcatgccagctgcgccctcttttctctacctccttcctcttccccccttctcctttccctctttcccttccctcccacctcccgggaaccctggctgagtgtgcgtgtgtgggagcgcgagagccccccgacagccaccccttggggcgcgcggctgcagttagggtaagggtcccagtgcgcaggcgcgctcttgttcgcggtccccaactgacgcgcccgcggcgggaaggagagggggccgccggtgcgaggccttggcccctccaccagaggaaggtgctgccacgtgtctgctccttctgaacctccaggtttctgctacgttgccccatggaggacacacccccctcactcagctgctccgactgtcagcgccactttcccagcctcccagagctctctcggcaccgagaactgctccatccatctcccaaccaggacagtgaggaggctgacagcatccctcggccctaccgttgtcagcagtgtgggcggggctaccgtcaccccgggagcctggttaaccatcgtcggacccacgagactggccttttcccctgtaccacctgtggcaaggacttctccaatcccatggctctcaagagccatatgaggacacatgctcctgagggccgccgcaggcacaggcccccacgccccaaggaagccactccacacctccagggtgagacggtgtccactgactcctggggccaaaggcttggctctagtgaaggctgggaaaaccagacaaaacatacagaagagacacctgactgtgaatctgtacctgaccccagggcagcttcgggtacgtgggaagatctgcccaccagacaaagagaaggcttggcaagccacccaggtcctgaggatggtgcagacggctggggaccctccactaactctgccagagcccctcctctccccatcccagccagcagccttcttagcaacttggaacagtatctggctgaatcagtagtgaacttcacagggggccaggagcccacccagtcccctcctgctgaggaggagcggcggtacaaa

SEQ ID NO: 203327 - DNA, 582 bp, Homo sapiens
  Payload ID: 20094
  Gene Name: zinc finger protein 646
  ENST ID: ENST00000564189
  CDS Start-End: 419-582
gtaacaataggaagtgtccgtagagctgggagtagactcctggctcatgccagctgcgccctcttttctctacctccttcctcttccccccttctcctttccctctttcccttccctcccacctcccgggaaccctggctgagtgtgcgtgtgtgggagcgcgagagccccccgacagccaccccttggggcgcgcggctgcagttagggtaagggtcccagtgcgcaggcgcgctcttgttcgcggtccccaactgacgcgcccgcggcgggaaggagagggggccgccggtgcgaggtaggcgtcctgagaggaaattggcagacgagatgagtgaggccttggcccctccaccagaggaaggtgctgccacgtgtctgctccttctgaacctccaggtttctgctacgttgccccatggaggacacacccccctcactcagctgctccgactgtcagcgccactttcccagcctcccagagctctctcggcaccgagaactgctccatccatctcccaaccaggacagtgaggaggctgacagcatccctcggccctaccgttgtcagcagtgtgggcg

SEQ ID NO: 203328 - DNA, 3649 bp, Homo sapiens
  Payload ID: 20095
  Gene Name: zinc finger protein 648
  Uniprot ID: Q5T619
  ENST ID: ENST00000339948
  CDS Start-End: 209-1915
ctctgcagccgctggactggacacaaagcgtgagagacagagacaccatctctgctgatttgtacctaactggttcctgttgctgagagcccacgtgtcacagaagccagggcagaggccccacactgctgtctgcatttcccaggtatcctgagccaagcaggatactcctcctcagaggagtaggcaatagaagcgcctgaacatcatggcacaagtggactcccaggacaggtggggagaggcgtctcctctcagcagcttgactgaggaagctcatgacacccagatgctgagcatgaacttagagagtgacgatgaagatggtggggaggccgaaaaagagggcaccgctgacccggtggcctgtccaaggggcagctccccagtaacacacgaaaatcctgacttgccatggccccatccactgggcaaagaggaagagaaattctctgactcctccagtgctgggggcatggggcagaaaccagtggaaatgtctgggaaagccagttggagcagagatgtgacaaagatcaacgagacccagggttccccgggagcaagcagagctctgggttcccttcccagtggtctcgcacacaaattgttaggtcagatgcaacctcttggggaccgactacctgcgggtgatgatggatactcgggggcaaaccaggacgcagtcttggatgtcccacccagcttccccagcaatggaaagtatctctgtgcgcacaaaagtgtagacacgtccgcagggaactcttctctgttgtgtttccccaggccggggagcaactgggaccttcccacgcaagagacacatacaccagcccaggcgtcggccaccccagccagcctggctgccgcggtcctggcaaaagcgcggaacagcaggaaagtacagaaccaggcgggccggcgcgagggcggagaggctgaggcgcgtccctacaggtgcctgcggggcgggcgggcctttcagaagcccagcaagccgctgagccccgcggagacgcgcggcggcgccgccaagcgctacgcgtgcgagctatgcgggaaggcctactcccaccgcggcacactccagcagcacaggcgcctgcacacgggcgagcggccctaccagtgctccttctgcgacaaggcctacacctggtcctccgaccaccggaagcacatccgcacccacacaggcgagaaaccctacccgtgtccagactgcgggaaggccttcgtgcgctcttcggacctgcgcaaacaccagcgcaacatgcacagcaacaataagcccttcccgtgctccgagtgcggcctgaccttcaacaagccgctgtcgctgctgcgccaccagcgcacgcacctgggcgccaagcccttccgctgccccgcctgcgaccgggagttcgctgtggccagccgcatggtggagcaccagcgcgtgcactcgggcgagcggcccttcccctgccccacctgcggcaagtgcttcaccaagtcctccaatctgtccgagcaccagacgctgcacaccggccagaggcctttcaagtgcgctgactgcggcgtggccttcgcgcagccctcgcgcctcgtgcgccaccagcgcatccacactggcgagaggccctttccttgcacgcagtgtggccaggcctttgcccgctcttcgaccctgaagcggcaccaacagatccactccggggagaagggattcctctgtgccgagtgcggcagggccttccgcattgcctctgagttggcccagcacatacgaatgcacaacggagagaggccctaccagtgtgaggactgcggccaggccttcaccaggtccaatcacctccaacgacaccgagccaagcacggcacctgcaagaaggagcccatcccttcctcctctgacgagtgaagatagcatcgtcgacctcactacttggaaccttcccaggtgggcccactcacatggtattgccagcctcactggtcagcctcgcctcccagcaggtcgcgggtcatcagtggtccatttgattatttatttgatcccttgaacagaaagtcaccaccgagagagcacccaggtgggtggtttcacatcagtggttctgagtgtccgaggtcataagcaattggaaaagggaaagacaaagtagtgggagctgatcaaacgttgagttccttgggttggggaacctgaatcaatcagaaactgcttctagaattacatgctgggcactgggccgggctccagggataaggtggggaaaaagactaacctgtcctaccctcaaagccatatgcaaatactgaaaagaaggcctgaggggctggtcctctttagagaaagatgctttttggtttttatataaataaaggaatccccagaagtggtccctatgatgaactcccccaaagcaacgccgtttttggaggaactcaaacccagtccaacatcccatcatttcacttgactgcagaaatggctttacccttaggatatatctttatgagtcttggctttgaagtggagaagggctttatcttagagaaggtggtttatgtcatattccagttattctagaagttcaggacagccttagcatctgaaaaagaagcccattcctctttatagtggaatttagtaagtagatctaacccgagtctcacccacagaattcatataaattcatatatgccttctctctggctgcctcttttcctgtttgcactctgagggcttaagtcatatgtgatatttacaaagcaattggcccatttacagagagacatatataatttctccacaaagccttgaccatggttcatgaaaccgtttgggttcatttaaatttgtctgaatcattagtcttgacttgaagtgaacaaaacaccctttgcccaagtgccattggcttgtctgcatttcaaaatcattaaaaccaggtatggaagcctacgtgctcacagttatctaatgaggttatttcaaagtttgcattactaacagccattctgcaaagtgtattgatgtgtatagtgatctgtataaagtcagtagttcttagctgaacctcaactgtgaggaatctatgactccacagatgtccttggtgcacataggcaaacggcacttctcatcttactgaagttaaataagatattccataagaaggtatagtgccctttttgggggagtacctttagtatattcctaaaattgccaccaaagaatgccaaatctgaatttctcttggtttccacctgatttggaactagggtgtgacctctaaatagcattctcatgacacatgggggcgccaaagagaagtaagagagatagctagatagctagatagctagatagtcttgtgtcttgtttgaccaaggtaaccgtaataaaagagtccatccccatcctttactgttgatgtgaccttgggcttcagtttctgcatctgcattggcaaaatagaagtgatagtagtaggtaaaagttagagtgatcctactatatgacggaaactttggctggatgcaagagctttaaattggtagaaaagtcacaagatgagcttgtgactatgaagagagcaaaagctaacttttttttcctagataatcaataaaatatttgaagactgaa

SEQ ID NO: 203329 - DNA, 3197 bp, Homo sapiens
  Payload ID: 20096
  Gene Name: zinc finger protein 649
  Uniprot ID: Q9BS31
  ENST ID: ENST00000354957
  CDS Start-End: 286-1803
gactcgcgccctcgtccgccgccataggccagtgccggggtttaagggccaggaaaggaagcattcagggaatttaggtgtagccagaagaaaatcaggtcctggctccccagaagcaagagagttcaaatgaaggaaggaggaggttcctggatgtggatgtcatcatttctgggaacactcttaaatggagactcagatttcttagccaaaatttagggaggatccagaagaaaccaaagacgaagcatcccagttcttgggtatttcctgaaacagaagaaaatgacaaaggcccaggaatcactgaccctggaggatgtggctgtggacttcacctgggaggagtggcagttcctgagccctgctcagaaggacctgtaccgggatgtgatgttggagaactacagcaaccttgtgtcagtggggtatcaagccggcaaacctgatgccctcaccaagttggaacaaggagaaccactatggacactagaagatgaaatccacagtccagcccacccagaaattgagaaagctgatgatcatctgcagcagcccttgcaaaaccaaaaaatactgaagaggacgggacaacgctatgaacacggaagaactttgaaatcatatttaggtttaaccaaccagagcagaagatacaacagaaaggagcctgctgagtttaatggagatggagcttttctccatgataatcatgaacaaatgcctacggaaattgaattccctgaaagtagaaaacccatcagcaccaagtcacaattccttaaacatcagcaaacacacaacatagagaaagcccatgaatgcactgactgtgggaaagctttcctcaagaagtctcagctcactgagcataagagaattcatacaggaaagaaaccccacgtgtgtagcttgtgtgggaaagccttctacaagaagtacaggctcactgaacacgagagagctcacagaggagagaaaccccacgggtgtagcttgtgtgggaaagccttctacaagaggtacaggctcactgaacacgagagagctcacaaaggagagaaaccatacgggtgcagtgaatgtgggaaagccttccccaggaaatctgagcttactgaacatcaaaggattcacacgggaattaagccccatcaatgcagcgaatgtgggagagctttctccagaaaatcactactcgttgtacatcagcgaactcatacaggagagaagcctcatacatgcagtgaatgtggaaaaggcttcattcagaagggcaatctcaacatacatcaacgaactcacactggagagaaaccttatggatgcattgactgtggcaaggccttcagccagaagtcttgccttgtagcacatcagagatatcatacaggaaagactccctttgtatgtcctgaatgtgggcaaccctgttcacagaagtcaggactcattagacatcagaaaattcactcaggagagaaaccctataaatgcagtgactgtgggaaagccttccttacaaagacaatgctcattgtacatcacagaactcacacgggagagagaccctatggctgtgatgagtgtgagaaagcttacttctatatgtcttgccttgttaaacataagagaatacactcaagggagaaacggggggattcagtgaaggtggaaaatccttccacagcaagtcacagcttaagtcctagtgaacatgtgcaggggaaaagccctgttaatatggtaactgtggcaatggtggcagggcagtgtgagtttgcccacatcctgcattcatgataaacagtttgctgtttgatcatatagcctccagcggaatgctgagtttgtcatgtcccatgggcctttggctccctgcactaatatgtatagtagggtttacaagatatgaaatatattttacttttttatatcttataaacctcactacccctcccacaatattgtttttcatttactatcttgatcatagagtttggctggggaggggggcagttttagaggcttccacttggtgttcctcagaatgatatctcttactccgggggccaaggtaggggttagcttttgttctctttgtagtttagattgtatctcttgccttgttcaagttcacaaatctttttgtgtatacacatatgtacatgaaaatgatgttcatgctttttattattttacccttcattatttcattttttatagttctcatagctatgtctttcagttcactaatcttttttccacagtgtttaatctgtcattaatcccatccaaagtatgttttctctcagaaattgtaatttttaacctctaataatttgacatgggtttttccctgttatatctttcatatctttatttatcatggttttacttttaacctatttatgctttcatatttaaagtgggtgtttagtgggcaacatacagttgggccttccttttttatccagttaacaatctctgtctttttactggggtatttagatcatttacgttcaatgtattgatgtttttaggtttaaattactaacttactatttgttgtttattctatgtcttctttgttctccttttcttctttttctgctttcccttagagtagctgagtgtgtttatattacatattgtctcctttgttggcttattaactgtaaatccttgtcatttgattccttgagattttatagcatacatcattgtgagggattgcatatttatgtcctctccaaatttacatgttgaagtcctaatccctaagggatggcattaggaagtgtgacctttggaaggtaattacatcttgaaagtggaaccctcatgatgagattatgtgtcttatgagacaacacagaagagagtttgttttctctttctctgctctttgccatgtgaagacagaatgagatgaccatgcataaaccaggaaatggactctcactggacactagacctgccaacaccttgattgtgttttagagtccagttctagagactcctcagcctctggaacgtgagaaatgaatgtttgttaaggcagtcagtcagtctatggtgtattttttctagtagcctgaactgactgaaagaaaatcatgaacttatcattctaacttcaaggacattatatcacttactgtataataaaataatcttacagtagtatatctcta

SEQ ID NO: 203330 - DNA, 2283 bp, Homo sapiens
  Payload ID: 20096
  Gene Name: zinc finger protein 649
  ENST ID: ENST00000600738
  CDS Start-End: 286-1719
gactcgcgccctcgtccgccgccataggccagtgccggggtttaagggccaggaaaggaagcattcagggaatttaggtgtagccagaagaaaatcaggtcctggctccccagaagcaagagagttcaaatgaaggaaggaggaggttcctggatgtggatgtcatcatttctgggaacactcttaaatggagactcagatttcttagccaaaatttagggaggatccagaagaaaccaaagacgaagcatcccagttcttgggtatttcctgaaacagaagaaaatgacaaaggcccaggaatcactgaccctggaggatgtggctgtggacttcacctgggaggagtggcagttcctgagccctgctcagaaggacctgtaccgggatgtgatgttggagaactacagcaaccttgtgtcagtggggtatcaagccggcaaacctgatgccctcaccaagttggaacaaggagaaccactatggacactagaagatgaaatccacagtccagcccacccagaaattgagaaagctgatgatcatctgcagcagcccttgcaaaaccaaaaaatactgaagaggacgggacaacgctatgaacacggaagaactttgaaatcatatttaggtttaaccaaccagagcagaagatacaacagaaaggagcctgctgagtttaatggagatggagcttttctccatgataatcatgaacaaatgcctacggaaattgaattccctgaaagtagaaaacccatcagcaccaagtcacaattccttaaacatcagcaaacacacaacatagagaaagcccatgaatgcactgactgtgggaaagctttcctcaagaagtctcagctcactgagcataagagaattcatacaggaaagaaaccccacgtgtgtagcttgtgtgggaaagccttctacaagaagtacaggctcactgaacacgagagagctcacaaaggagagaaaccatacgggtgcagtgaatgtgggaaagccttccccaggaaatctgagcttactgaacatcaaaggattcacacgggaattaagccccatcaatgcagcgaatgtgggagagctttctccagaaaatcactactcgttgtacatcagcgaactcatacaggagagaagcctcatacatgcagtgaatgtggaaaaggcttcattcagaagggcaatctcaacatacatcaacgaactcacactggagagaaaccttatggatgcattgactgtggcaaggccttcagccagaagtcttgccttgtagcacatcagagatatcatacaggaaagactccctttgtatgtcctgaatgtgggcaaccctgttcacagaagtcaggactcattagacatcagaaaattcactcaggagagaaaccctataaatgcagtgactgtgggaaagccttccttacaaagacaatgctcattgtacatcacagaactcacacgggagagagaccctatggctgtgatgagtgtgagaaagcttacttctatatgtcttgccttgttaaacataagagaatacactcaagggagaaacggggggattcagtgaaggtggaaaatccttccacagcaagtcacagcttaagtcctagtgaacatgtgcaggggaaaagccctgttaatatggtaactgtggcaatggtggcagggcagtgtgagtttgcccacatcctgcattcatgataaacagtttgctgtttgatcatatagcctccagcggaatgctgagtttgtcatgtcccatgggcctttggctccctgcactaatatgtatagtagggtttacaagatatgaaatatattttacttttttatatcttataaacctcactacccctcccacaatattgtttttcatttactatcttgatcatagagtttggctggggaggggggcagttttagaggcttccacttggtgttcctcagaatgatatctcttactccgggggccaaggtaggggttagcttttgttctctttgtagtttagattgtatctcttgccttgttcaagttcacaaatctttttgtgtatacacatatgtacatgaaaatgatgttcatgctttttattattttacccttcattatttcattttttatagttctcatagctatgtctttcagttcactaatcttttttccacagtgtttaatctgtcattaatcccatccaaagtatgttttctctcagaaattgtaatttttaacctctaataatttgacatgggtttttccctgttata

SEQ ID NO: 203331 - DNA, 564 bp, Homo sapiens
  Payload ID: 20096
  Gene Name: zinc finger protein 649
  ENST ID: ENST00000596690
  CDS Start-End: 442-564
atgtcccatcgtcctagcgcggcagaattgactcgcgccctcgtccgccgccataggccagtgccggggtttaagggccaggaaaggaagcattcagggaatttaggtgtagccagaagaaaatcaggtcctggctccccagaagcaagagagttcaaatgaaggaaggaggaggttcctggatgtggatgtcatcatttctgggaacactcttaaatggagactcagatttcttagccaaaatttagggaggatccagaagaaaccaaagacgaagcatcccagttcttgggtatttcctgaaacagaagaaaatgacaaaggcccagttcacatgtgaccagtgttggaatataatgtgcgactctgccagaccctgttggctacattaagtgtcagcttgtgtccaaaatctttggccaccatcacacccagagaatcatggaatcactgaccctggaggatgtggctgtggacttcacctgggaggagtggcagttcctgagccctgctcagaaggacctgtaccgggatgtgatgttggagaactacagcaaccttgtg

SEQ ID NO: 203332 - DNA, 546 bp, Homo sapiens
  Payload ID: 20096
  Gene Name: zinc finger protein 649
  ENST ID: ENST00000595418
  CDS Start-End: 405-546
agaattgactcgcgccctcgtccgccgccataggccagtgccggggtttaagggccaggaaaggaagcattcagggaatttaggtgtagccagaagaaaatcaggagtttccttgagcaatgaacgattcgcgaattgggcagcccccagaatcacagcagattaacagagactccaggggtgcctcgtggtcagaacaaatttatagacaaaaaaggtcctggctccccagaagcaagagagttcaaatgaaggaaggaggaggttcctggatgtggatgtcatcatttctgggaacactcttaaatggagactcagatttcttagccaaaatttagggaggatccagaagaaaccaaagacgaagcatcccagttcttgggtatttcctgaaacagaagaaaatgacaaaggcccaggaatcactgaccctggaggatgtggctgtggacttcacctgggaggagtggcagttcctgagccctgctcagaaggacctgtaccgggatgtgatgttggagaactacagcaaccttgtgtcagtgg

SEQ ID NO: 203333 - DNA, 730 bp, Homo sapiens
  Payload ID: 20096
  Gene Name: zinc finger protein 649
  ENST ID: ENST00000599530
  CDS Start-End: 601-730
gcagaattgactcgcgccctcgtccgccgccataggccagtgccggggtttaagggccaggaaaggaagcattcagggaatttaggtgtagccagaagaaaatcaggtcctggctccccagaagcaagagagttcaaatgaaggaaggaggaggttcctggatgtggatgtcatcatttctgggaacactcttaaatggagactcagatttcttagccaaaatttagggaggatccagaagaaaccaaagacgaagcatcccagttcttgggtatttcctgaaacagaagaaaatgacaaaggcccaggtaacttttggtttgttttattcttaactcgattccctgatggatttgtggaagtctgaagaaatcagttcatttacattaaaagtataaattggaaaaaatgagctctggggagaaacagacttagactgtacctttaatccaggacaaagtgggatcacaaatactttgttcacatagttcacatgtgaccagtgttggaatataatgtgcgactctgccagaccctgttggctacattaagtgtcagcttgtgtccaaaatctttggccaccatcacacccagagaatcatggaatcactgaccctggaggatgtggctgtggacttcacctgggaggagtggcagttcctgagccctgctcagaaggacctgtaccgggatgtgatgttggagaactacagcaaccttgtgtcagtgg

SEQ ID NO: 203334 - DNA, 5988 bp, Homo sapiens
  Payload ID: 20097
  Gene Name: zinc finger protein 652
  Uniprot ID: Q9Y2D9
  ENST ID: ENST00000362063
  CDS Start-End: 320-2140
gcggggagccggcggttatctgggcggcggagcgctcacaatgtggcaggagacagaaaagataagatgctcccaagtcccttgcagctctcttcagaagaaaaatcactagtgctctgctcttgccataataccaaacctttttgactcatgctttggtgctgcaacactggaagaattgcacacagtttccaggaatatctttttttcatttgagtgattctttgtggatgagaaaagatttgagtcttaataattaccttgttttaaagctatttctttatagtctgaactgtttaataaattgggccacttaccaatgagccacacagccagttcttgtcaggagctggttgaaaactgtgctgtgcatgtagcaggaatggcacaagaagatagccgtcgtggtcaagtgccatcttccttttatcatggtgccaaccaagaacttgacctgtccaccaaagtgtacaaaagggaatcaggaagtccttattctgtgttagtggacaccaagatgagcaaaccgcatctccatgaaacagaagaacagccatatttcagggagacaagagcagtgtctgacgtgcatgctgttaaggaagaccgggagaattctgatgacacagaggaggaagaggaagaagtctcttacaaaagggagcagatcatagtggaggtaaaccttaataatcaaacattaaatgtatctaaaggggaaaagggtgtctcttctcagtccaaagagactcctgttcttaagacaagcagtgaggaggaagaggaagagagtgaggaagaggccacagatgacagcaatgactatggagagaatgaaaagcagaagaaaaaggagaagatagtagagaaagtcagcgttacacaaaggagaaccaggagagctgcctctgttgccgcagctaccacttcccctactcccagaactacaagaggtcgtaggaagagtgtagagccacctaagcgtaagaagcgggccacaaaggagcccaaagcaccagtccagaaagctaagtgtgaagagaaagagactctgacctgtgagaagtgccccagggtatttaacactcgctggtacctggagaagcacatgaacgttactcataggcgcatgcagatttgtgataaatgtggcaagaagtttgtcctggaaagtgagctgtcccttcaccagcaaacagactgtgaaaaaaacattcagtgtgtttcctgtaacaaatcgttcaagaaactctggtcccttcatgaacatatcaagatcgtccatggatatgcagaaaagaaattttcctgtgaaatttgtgagaagaaattctataccatggctcatgtgcggaaacacatggttgcacacacaaaagacatgccatttacatgcgaaacctgtggaaaatcattcaaacgcagtatgtcactcaaggtgcactccttgcagcattctggagagaagccctttagatgcgagaactgtgacgaaaggtttcagtacaagtaccagctacgctcccacatgagcattcatattgggcacaaacagttcatgtgccagtggtgtggcaaggatttcaacatgaagcagtacttcgacgaacacatgaaaacacacactggagagaaaccctttatctgtgaaatctgtggcaaaagcttcaccagccgccccaacatgaagagacaccgcagaactcacacaggcgagaagccctatccatgtgatgtgtgtggccagcggttccgcttctcgaacatgcttaaggcccacaaggagaagtgctttcgggtgaccagccccgtgaatgtgccacctgctgtccagatcccacttacaacttccccagccaccccagttccttctgtggtgaacacagccacaaccccaacccctccaatcaatatgaatcctgtaagcactcttccccctcggcccatcccccaccccttctcacacctgcacatccacccacaccctcaccacccacaccaccttcccatccctccagtccctcacctcccgccacctccagctctctttaagagtgagcctttaaatcatagaggccagagtgaggacaactttctgcggcacctggcagagaagaacagttcagcacagcatcattaacatccgtctccttagtgtgttctccaggagacacgtccccatgtgtgagcgtgcacagagggagtcggtgagcatttccttagttctcagactctcctccgcctctaccaagagcttcgccagtgtcactgaatcaacagatccaagggaatgaacaagaagactaccttgagctcacagagggactgtcatctaaaccaggggaaccactgaactaaagcccaatttgcttgcattttctgatgacttttataagtttcaaatactcagacttgtggaattttataatttcatatcagctgatgaggtatgcttgcttttatatcccagacttctcctcaaagaggggataggcctggtttcctttgtactaatcgggaaggctgtgagattaatccagagcattaattgtatcactgtgtatggtaaggaattcttttcagcttttggtgccagctacagagttgagctggccatgtttcacagtatatcaagcattatagagaaagacagaaattttcttctttgtgtagctctcctaacgcactctttattttactacagaaattattttagagtttttgtatagacttctttggtagtctgtttctaaaatgaaatgtatttcaataagcagtgtaattttttcagtgtagctgaacctatgttgtaaaatagaaaaaaatttttataatcatcaaaatgtgattcttaaagatgcatataacttctataattcaaagctattcttacatccgtacaactcaaaaggtgcttcagagactagatgtatctgagagggtctccagaccaggttactgcaaaaatgaggttttgctttcaggatttggcgtaaatacttggtagttttgacatctctgcttaacactcaagagaggctccctaatgtgctcctgtcctccatgttctgcttggcttcgttagtgcattacatgaaatgatttgcaggggatggggccttttccagggaagtcacctaaagcttgcatgttttgaaaatttgaataaggctgtttgctgacaggaggaggaagtagtggagatcatttcatctcagtcacgtctgtttctcacttcccttaggaattgtgttgatgtttaacttttatgggatgacaaattgaaatcgctcattttgaggttgctttatttttctagaattgttataagaagctaaaatagtaaacttaaaatcacaaacatgacattgctgatagtggctgagaaattcagatgagaagacaaattggttatgaattttgaaatatctattatatgtaaaatgtggatatgttcacaaccttgagctattttaacacagtttaaatatagtgagggaaaactcctaagttttactgccctgtcctctgcaaattatgtaataccagcattcttaggcgataaagagagcagcacctctagtacctttaggcagattactttttcaagtttggggaacttcaaaagaccataatcaaccaggagcttattataggaaaggctgaacagaagggctagtgtattgattacacttaacagatcatatttatccagactcagtatagcttaaaattttgtatttctttatctgagagaactgagttcccaggctaaatcacttacctcccaccccctctccaattttttttttaagagacaaggtcttgctatgttgcccaggctagagtgcagtggctattcacaggtgcagttatagcacactacagcctccaactcttgggttcaagcaaccctgcctcagctaaccaagtagctgggactacaggtgcatgctaccatgcccagtccattttttaatcttgaaatttcttcatttttctttcttcggtttcttaaaatctttgcctgaatcagaacgctggcttttatttatttttttatttttaatattaaatgtgcagatatgcttcgagcacttttctaactaatgagctctgtggtaagaaaaaatgaactctttcaattgagattaagtccatatttttcaaacatcacgttctctattggctttttggtttagtgtttctaaattttctccttctgattttgcctgtcttatataatgagcataggaaaattttggaatgaggcagaaaagtatatcaagacatacttcctggttttggatgtaagttttaaagaatggtatttttaatatttgtacacattctttgagcacccaggtacccaagccaataaggaaagttaattccttgcatatgactgttatatctttagtggttgtctccctctccctccacagtctccttggcattccatgacaagtttgtcaacctacacttttatatagacatatcattatttcatggtcaagcctgtagtattaaaatgatttttttaaaagatgtaaactgtgcttagttaattggttatattttgttctgttttttttttttttttttttttttttttgaggcagagtcttgttctgttgcctgggctggagtgcagtggcgtgatcttggctcactgcaacccccgccccccgggttcaagtgattctcctgcctcagcctcccgagtagctggaattacaggcatgcgccagcacgcccggctaagttttgtatttttggcagagatggggtttcaccatattggccaggctggtctcaaactcctgaccttgtgatccgcccacctcagcctccgaaagtgctgggattacaggcgtgagccaccacgtccaactgccttattttgttctgaataaatttacagtattgggcagcaattctggattctagacttgagaccacagaatcaaccatttcatgaggttgtactgtaattatacactggaatattcaggtagtcatctttgatttttcattcaagtaaatatagccataagaaaatatctgctatacaggaaaaccagtattaagcaaataccaccatccttaacagaaacaaaaatatatatatatattatttttaaaaattagcattgtcatacagtacaattcttagtgaagtgtattgtggaacaatttagaaacttcctttttttcccctagattaaggatactttccttgacttgagacttgtggtcttcaggaaaactactcagaatataatgactcctcatcagtatcatattgtatataaataatgaaatgcattaagaatattcacaacattgaacccaggaggcggagcttgcagtgagccgagattgcgccactgcgctccagcctgggcaacagagcgagactccatctcaaaaaaaaaaaaaaaaagaatattcacaacattaatgcttctgaatagaagaactgcaggattaagccttaaacatatatgtgcaacacgtttaacatgcttaagactcaaactcagggttgaaaatttggttggggtcctctttgtaagataaaagttgcattatgtggtatgttctcttccatatatgctacagcaccccatgaattcttcaaaactttttacctacttgttatctgtttatgaaaaaaagaattatggagaagtttgagttctcagcccttatctgtacatgtctgttaaagacaacaaaggctgcatttaagcattatatagataacaaattgaggctgtctctcgttacttagttttactgtcttcaaaggcttgtatcattgctagggttaagacttatttgaggatgagttggcattgtattttttgtgtgtgtgggttggtttgtatttgtttcgtttttatttttctattttctctcatagatttatcagtaaaatataaactcttccttagccttaataaaggctgctgctttctcaaa

SEQ ID NO: 203335 - DNA, 4701 bp, Homo sapiens
  Payload ID: 20097
  Gene Name: zinc finger protein 652
  Uniprot ID: Q9Y2D9
  ENST ID: ENST00000430262
  CDS Start-End: 467-2287
ggagcggcggccacgtagcgctgcggcggcagcggcagcggccgaggccgggtctgaggagcggccctgaggacagacgttgggcagggggggaggggctggcccagccggcggttgtgactcgagcgccgcggctgcaggcccccgccgcagggatggaccgccgaggcggcggccggggcggcggaggcggaggcggccggcccggataagatgctcccaagtcccttgcagctctcttcagaagaaaaatcactagtgctctgctcttgccataataccaaacctttttgactcatgctttggtgctgcaacactggaagaattgcacacagtttccaggaatatctttttttcatttgagtgattctttgtggatgagaaaagatttgagtcttaataattaccttgttttaaagctatttctttatagtctgaactgtttaataaattgggccacttaccaatgagccacacagccagttcttgtcaggagctggttgaaaactgtgctgtgcatgtagcaggaatggcacaagaagatagccgtcgtggtcaagtgccatcttccttttatcatggtgccaaccaagaacttgacctgtccaccaaagtgtacaaaagggaatcaggaagtccttattctgtgttagtggacaccaagatgagcaaaccgcatctccatgaaacagaagaacagccatatttcagggagacaagagcagtgtctgacgtgcatgctgttaaggaagaccgggagaattctgatgacacagaggaggaagaggaagaagtctcttacaaaagggagcagatcatagtggaggtaaaccttaataatcaaacattaaatgtatctaaaggggaaaagggtgtctcttctcagtccaaagagactcctgttcttaagacaagcagtgaggaggaagaggaagagagtgaggaagaggccacagatgacagcaatgactatggagagaatgaaaagcagaagaaaaaggagaagatagtagagaaagtcagcgttacacaaaggagaaccaggagagctgcctctgttgccgcagctaccacttcccctactcccagaactacaagaggtcgtaggaagagtgtagagccacctaagcgtaagaagcgggccacaaaggagcccaaagcaccagtccagaaagctaagtgtgaagagaaagagactctgacctgtgagaagtgccccagggtatttaacactcgctggtacctggagaagcacatgaacgttactcataggcgcatgcagatttgtgataaatgtggcaagaagtttgtcctggaaagtgagctgtcccttcaccagcaaacagactgtgaaaaaaacattcagtgtgtttcctgtaacaaatcgttcaagaaactctggtcccttcatgaacatatcaagatcgtccatggatatgcagaaaagaaattttcctgtgaaatttgtgagaagaaattctataccatggctcatgtgcggaaacacatggttgcacacacaaaagacatgccatttacatgcgaaacctgtggaaaatcattcaaacgcagtatgtcactcaaggtgcactccttgcagcattctggagagaagccctttagatgcgagaactgtgacgaaaggtttcagtacaagtaccagctacgctcccacatgagcattcatattgggcacaaacagttcatgtgccagtggtgtggcaaggatttcaacatgaagcagtacttcgacgaacacatgaaaacacacactggagagaaaccctttatctgtgaaatctgtggcaaaagcttcaccagccgccccaacatgaagagacaccgcagaactcacacaggcgagaagccctatccatgtgatgtgtgtggccagcggttccgcttctcgaacatgcttaaggcccacaaggagaagtgctttcgggtgaccagccccgtgaatgtgccacctgctgtccagatcccacttacaacttccccagccaccccagttccttctgtggtgaacacagccacaaccccaacccctccaatcaatatgaatcctgtaagcactcttccccctcggcccatcccccaccccttctcacacctgcacatccacccacaccctcaccacccacaccaccttcccatccctccagtccctcacctcccgccacctccagctctctttaagagtgagcctttaaatcatagaggccagagtgaggacaactttctgcggcacctggcagagaagaacagttcagcacagcatcattaacatccgtctccttagtgtgttctccaggagacacgtccccatgtgtgagcgtgcacagagggagtcggtgagcatttccttagttctcagactctcctccgcctctaccaagagcttcgccagtgtcactgaatcaacagatccaagggaatgaacaagaagactaccttgagctcacagagggactgtcatctaaaccaggggaaccactgaactaaagcccaatttgcttgcattttctgatgacttttataagtttcaaatactcagacttgtggaattttataatttcatatcagctgatgaggtatgcttgcttttatatcccagacttctcctcaaagaggggataggcctggtttcctttgtactaatcgggaaggctgtgagattaatccagagcattaattgtatcactgtgtatggtaaggaattcttttcagcttttggtgccagctacagagttgagctggccatgtttcacagtatatcaagcattatagagaaagacagaaattttcttctttgtgtagctctcctaacgcactctttattttactacagaaattattttagagtttttgtatagacttctttggtagtctgtttctaaaatgaaatgtatttcaataagcagtgtaattttttcagtgtagctgaacctatgttgtaaaatagaaaaaaatttttataatcatcaaaatgtgattcttaaagatgcatataacttctataattcaaagctattcttacatccgtacaactcaaaaggtgcttcagagactagatgtatctgagagggtctccagaccaggttactgcaaaaatgaggttttgctttcaggatttggcgtaaatacttggtagttttgacatctctgcttaacactcaagagaggctccctaatgtgctcctgtcctccatgttctgcttggcttcgttagtgcattacatgaaatgatttgcaggggatggggccttttccagggaagtcacctaaagcttgcatgttttgaaaatttgaataaggctgtttgctgacaggaggaggaagtagtggagatcatttcatctcagtcacgtctgtttctcacttcccttaggaattgtgttgatgtttaacttttatgggatgacaaattgaaatcgctcattttgaggttgctttatttttctagaattgttataagaagctaaaatagtaaacttaaaatcacaaacatgacattgctgatagtggctgagaaattcagatgagaagacaaattggttatgaattttgaaatatctattatatgtaaaatgtggatatgttcacaaccttgagctattttaacacagtttaaatatagtgagggaaaactcctaagttttactgccctgtcctctgcaaattatgtaataccagcattcttaggcgataaagagagcagcacctctagtacctttaggcagattactttttcaagtttggggaacttcaaaagaccataatcaaccaggagcttattataggaaaggctgaacagaagggctagtgtattgattacacttaacagatcatatttatccagactcagtatagcttaaaattttgtatttctttatctgagagaactgagttcccaggctaaatcacttacctcccaccccctctccaattttttttttaagagacaaggtcttgctatgttgcccaggctagagtgcagtggctattcacaggtgcagttatagcacactacagcctccaactcttgggttcaagcaaccctgcctcagctaaccaagtagctgggactacaggtgcatgctaccatgcccagtccattttttaatcttgaaatttcttcatttttctttcttcggtttcttaaaatctttgcctgaatcagaacgctggcttttatttatttttttatttttaatattaaatgtgcagatatgcttcgagcacttttctaactaatgagctctgtggtaagaaaaaatgaactctttcaattgagattaagtccatatttttcaaacatcacgttctctattggctttttggtttagtgtttctaaattttctccttctgattttgcctgtcttatataatgagcataggaaaattttggaatgaggcagaaaagtatatcaagacatacttcctggttttggatgtaagttttaaagaatggtatttttaatatttgtacacattctttgagcacccaggtacccaagccaataaggaaagttaattccttgcatatgactgttatatctttagtggttgtctccctctccctccacagtctccttggcattccatgacaagtttgtcaacctacacttttatatagacatatcattatttcatggtcaagcctgtagtattaaaatgatttttttaaaagatgtaaa

SEQ ID NO: 203336 - DNA, 4543 bp, Homo sapiens
  Payload ID: 20097
  Gene Name: zinc finger protein 652
  ENST ID: ENST00000508237
  CDS Start-End: 468-1748
gagcgccgcggctgcaggcccccgccgcagggatggaccgccgaggcggcggccggggcggcggaggcggaggcggccggcccggtggtctggagccgaaccggcaatatctctgaggtgtgactgttctctcagcttcatcaaatataaagtggaaagagttttgttcatgaagccactgaatgaaccattgcttgccttaaaggaagataagatgctcccaagtcccttgcagctctcttcagaagaaaaatcactagtgctctgctcttgccataataccaaacctttttgactcatgctttggtgctgcaacactggaagaattgcacacagtttccaggaatatctttttttcatttgagtgattctttgtggatgagaaaagatttgagtcttaataattaccttgttttaaagctatttctttatagtctgaactgtttaataaattgggccacttaccaatgagccacacagccagttcttgtcaggagctggttgaaaactgtgctgtgcatgtagcaggaatggcacaagaagatagccgtcgtggtcaagtgccatcttccttttatcatggtgccaaccaagaacttgacctgtccaccaaagtgtacaaaagggaatcaggaagtccttattctgtgttagtggacaccaagatgagcaaaccgcatctccatgaaacagaagaacagccatatttcagggagacaagagcagtgtctgacgtgcatgctgttaaggaagaccgggagaattctgatgacacagaggaggaagaggaagaagtctcttacaaaagggagcagatcatagtggagtgtgtttcctgtaacaaatcgttcaagaaactctggtcccttcatgaacatatcaagatcgtccatggatatgcagaaaagaaattttcctgtgaaatttgtgagaagaaattctataccatggctcatgtgcggaaacacatggttgcacacacaaaagacatgccatttacatgcgaaacctgtggaaaatcattcaaacgcagtatgtcactcaaggtgcactccttgcagcattctggagagaagccctttagatgcgagaactgtgacgaaaggtttcagtacaagtaccagctacgctcccacatgagcattcatattgggcacaaacagttcatgtgccagtggtgtggcaaggatttcaacatgaagcagtacttcgacgaacacatgaaaacacacactggagagaaaccctttatctgtgaaatctgtggcaaaagcttcaccagccgccccaacatgaagagacaccgcagaactcacacaggcgagaagccctatccatgtgatgtgtgtggccagcggttccgcttctcgaacatgcttaaggcccacaaggagaagtgctttcgggtgaccagccccgtgaatgtgccacctgctgtccagatcccacttacaacttccccagccaccccagttccttctgtggtgaacacagccacaaccccaacccctccaatcaatatgaatcctgtaagcactcttccccctcggcccatcccccaccccttctcacacctgcacatccacccacaccctcaccacccacaccaccttcccatccctccagtccctcacctcccgccacctccagctctctttaagagtgagcctttaaatcatagaggccagagtgaggacaactttctgcggcacctggcagagaagaacagttcagcacagcatcattaacatccgtctccttagtgtgttctccaggagacacgtccccatgtgtgagcgtgcacagagggagtcggtgagcatttccttagttctcagactctcctccgcctctaccaagagcttcgccagtgtcactgaatcaacagatccaagggaatgaacaagaagactaccttgagctcacagagggactgtcatctaaaccaggggaaccactgaactaaagcccaatttgcttgcattttctgatgacttttataagtttcaaatactcagacttgtggaattttataatttcatatcagctgatgagggtcccaggccataaaacaacggagagctgtacttgcttgtcacttggaggaaccacatccttgagacagcctgctgtcttgtatgtcttcagtaggaaacttctgacacacacattcaagggagttcctgcccctgagaagtgttcccatagctttccagtcgcaggttactttcacactacgtcagcttctctggtgagatcagggatgttacatattacttgaaaatgatttcataggaagtgaggatggggcaagaaaggaggtagaagctgaattttgcttaacttcagaaggaaatctgatacttgccttggctagttctgatcaactaaagagcctgtgtctgtactggatgtgccaaagagtcaagttgtttctggaatatccagctcctctgaatgaacacagcttcctccctacctgtcttttatgggtgaaaagggaccgtctgatgagcatgatagacatcctgtacaggactcaagactgtttcattgcatttgaaagttggtgggaagtattttattctgctagagctcctaaccctcctagaaatatcttttcatgctctattaattcaattcattagtttaaaaagaaacagtgtgacataattttggtgtttacttcttaagttgtctccccaagggcatatatgtagcctctgaaaatgggatgatttcttctcaatcttccataaatttgaatatgcattttattcatttcttgacatgggctgtgtgactgttttccatcagcagttctggctttgtccacaagggagcaataaagtacgttagctttattctcaaccttctaaagaaagatcccacttttaaatctcttctggaatagcctcttagctcaaagcttattcatgtattttgattatttaagaaattttcccttattacaaagtccagtcgtcgttcatccctcatgatgccaagcaatgattgatgtgtgggtgtggagtccttgtgggtcaggcatcttaattaattagactttttacatattgatgatccccagattgaaagccaggaccttcccataggggcgcctttgtgtgctaaaggcagagcaggcaggcttctccactcctatctcctccgcaggccaccaccatcacatctataggaggaacaagagcactgggggaactctggagtatgagtaaggaaatgcttctcaccttctctgctccaaagagatatctgttacatcagggaacaagtcctctaggtcaggcacttcctcctgaccagtgcaacgggcactccaggttagaaactgtgtgtgctccctctctgtcagttacttgtctaagggctcctatccgtggtcatcagctctctggccatgagttctgtttgtgcttattgcagcagcatcttcacaacaaacaggtcagtaatcaacctgggaagggaaaagacgacagtaaatattaccccctgtagagccgggaggcatttacacctggaatggccttcttaactgatttctgcctggccacctcacccccagccaagtctgaacctgagcaataccaggcacagagaggtgtctacttgtaactccaacacttgacaaaaaacaaaactgaagctgtgattggtttaggcagcaagtggccaggtgcaacttgtttgtttttatttttgttttccccaacagtactgagatcacttgcacttttcctcatttcttaagaaaatccagtttgcttgccatgacttgtttagcgttaggtttacaaagcttgttgttgaatgttgaatatttgtccaaaggagtttgacaaaatagaagctgcttggtccctgttctgcctgctaggtcataaggatgaaggccatgtggctggggtacttatgtcaagtccagaatggggcagtgtccctctcctacctctctgcggagacgcaattgaaggtcaagtagactcagtgtagggcaggcagctgtcatgctgcaaagaagtttagaggagtctttgggttggggaggtgacaggtaggtaggacaggatctcttaagatgggaaagatactggggagaggagggctgcttggccccagggaactgcagtgaggtggaactgagctccgctcctgaatctccaaaggagcccatgctgcccggcttccctgagtcattttttccagcatcctgtcagatccctcaatgtactgatttcccccttgtgttaactataccgatattatttttttagcaattgaaatgcacttttttatttcaactcaatcatgattttaagtataaaaaatttatagattgttaaaactacttttttgtgtatttttaaccactcaatgtagcattgtatattttattcttgtgagactctggtacaggtgtgccgcctaatgatttttctgagatgctgggcctttggatgtgtacggtaaccaacttaatgctaatgttcaaagtaaaaaaaaaaaaaaaaagcagcca

SEQ ID NO: 203337 - DNA, 2240 bp, Homo sapiens
  Payload ID: 20098
  Gene Name: zinc finger protein 653
  Uniprot ID: Q96CK0
  ENST ID: ENST00000293771
  CDS Start-End: 138-1985
agtttccattcttggtctccttttggcgccctggggcagcgagagaccgtgagaaatttctcggcggcgccgaagatgcgcgccacttccggtctggctcctaacaacgggggaggctggtaaccagggtgggggggatggcggagcgggcgctagagcccgaggcggaggcggaggctgaggcgggcgcgggcggggaggcagcagccgaggagggcgcagcgggccgaaaggcgcggggccggccgcgactcacggagtcggaccgggcccggcgacggctcgagtcccggaagaagtacgacgtgcggcgcgtgtacctgggcgaggcgcacgggccctgggtggacctgcggcgccgcagcggctggagcgacgccaagctcgccgcctacctcatctctctggagcgcggccagcggagcggccgccacgggaagccttgggagcaggtccccaaaaagccaaagcggaagaaaaggcggcgacgcaacgtgaactgcctgaagaacgtggtgatctggtacgaggaccacaagcaccgctgcccgtacgagccgcacctggcggagctagaccccacttttggcctgtacaccacggccgtgtggcagtgcgaagctggccaccgctacttccaggacctgcattcgcccctgaagcccctcagcgactcagaccctgacagtgacaaagtgggcaatgggctggtggctggcagctctgactcatccagctctggctctgcctctgactctgaggagtctcctgagggccagccggtcaaggctgcggcagcggcagcggcagcgacgcccaccagcccggtgggcagcagcgggctcatcactcaggagggcgtgcacattccctttgacgtccaccacgtggaaagcctggccgagcagggtaccccgctgtgctccaacccagcaggcaatgggcctgaagccctggagacagtggtgtgcgtgccggtgcctgtgcaagtgggtgcgggccccagcgccctctttgagaacgtgccccaggaggccctgggtgaggtggtggccagctgccccatgccaggcatggtgcccggctcacaggtgatcatcattgcgggccctggttacgacgctctcacggccgagggcattcacctcaacatggcagcaggcagcggtgtccccggcagtggactgggcgaggaggtgccctgtgccatgatggagggtgtggcagcctacacccagacagagcccgagggtagccagcctagcaccatggacgccaccgcagtagcaggcatcgagaccaagaaagagaaggaggacctgtgcttgctaaagaaggaggagaaggaggagccagtagccccggagctggcaacaacggtgcctgagagcgcagagcctgaggcagaggcggacggggaggagctggacggcagcgacatgtcagccatcatctatgaaatccccaaggagcctgagaagaggcggcggagcaagcggtcgcgggtgatggatgctgacggcctgctcgagatgttccactgcccatacgagggctgcagccaagtctacgtggccctcagcagcttccagaaccacgtcaatcttgtgcatcggaaaggaaagaccaaagtgtgccctcatcctggctgtggcaagaagttctatttatccaaccacctgcggcggcacatgatcatccattcaggtgtccgtgaattcacctgcgagacctgcggcaagtccttcaagaggaagaaccacctggaggtacatcggcgcacccacaccggcgagacccccctgcagtgcgagatctgtggctaccagtgccggcagcgcgcgtcgctcaactggcacatgaagaagcacactgcggaggtgcagtacaacttcacgtgcgatcgctgcgggaagcgcttcgagaagctggacagcgtcaagttccacacgctcaaaagccacccggatcacaagcccacctgacccacctgaccactgaccgcccctatttattcgtccgctcggacaccacgcccgggcttgccggggcctggacagctgcgagggccgcccggaccgcgggccggaaggaggcgcccccgccccgccccagagctgggccccctgggcaggttccccaccccgccccaccgcatccttctcggagctggtgcctggggctgcattgctggaactgtgtcaagagagcagagtgagattaaagagcgagaaaggaga

SEQ ID NO: 203338 - DNA, 674 bp, Homo sapiens
  Payload ID: 20098
  Gene Name: zinc finger protein 653
  ENST ID: ENST00000590296
  CDS Start-End: 1-652
cgagatgttccactgcccatacgagggctgcagccaagtctacgtggccctcagcagcttccagaaccacgtcaatcttgtgcatcggaaaggaaagaccaaagtgtgccctcatcctggctgtggcaagaagttctatttatccaaccacctgcggcggcacatgatcatccattcaggtgtccgtgaattcacctgcgagacctgcggcaagtccttcaagaggaagaaccacctggaggtgcgagatctgtggctaccagtgccggcagcgcgcgtcgctcaactggcacatgaagaagcacactgcggaggtgcagtacaacttcacgtgcgatcgctgcgggaagcgcttcgagaagctggacagcgtcaagttccacacgctcaaaagccacccggatcacaagcccacctgacccacctgaccactgaccgcccctatttattcgtccgctcggacaccacgcccgggcttgccggggcctggacagctgcgagggccgcccggaccgcgggccggaaggaggcgcccccgccccgccccagagctgggccccctgggcaggttccccaccccgccccaccgcatccttctcggagctggtgcctggggctgcattgctggaactgtgtcaagagagcagagtgagattaaagagcgagaaaggaga

SEQ ID NO: 203339 - DNA, 636 bp, Homo sapiens
  Payload ID: 20098
  Gene Name: zinc finger protein 653
  ENST ID: ENST00000588541
  CDS Start-End: 1-104
gcggccgccacggacggagactgaggctcagaggggacaagacctgcttgaggtcacacaggcagttgagagcagagctgagtcttgaacttgggtctggctgatacccaagactgtccccactgcaatgtgacactcccagcctccagcggaagccttgggagcaggtccccaaaaagccaaagcggaagaaaaggcggcgacgcaacgtgaactgcctgaagaacgtggtgatctggtacgaggaccacaagcaccgctgcccgtacgagccgcacctggcggagctagaccccacttttggcctgtacaccacggccgtgtggcagtgcgaagctggccaccgctacttccaggacctgcattcgcccctgaagcccctcagcgactcagaccctgacagtgacaaaggtaggtctgcagggcgagggcacatagggggccgcccatttctgggggcttcttacgagccctaggctagcatcacaaacagaatagcagccacagtggctctggctctggctctggcactggggcagagcagggacacgatgggccaggctgagtccttcgtggccttgccctctttgcgtccttacagagcttgagtggggaggcagtccctctttatggagc

SEQ ID NO: 203340 - DNA, 581 bp, Homo sapiens
  Payload ID: 20098
  Gene Name: zinc finger protein 653
  ENST ID: ENST00000589051
  CDS Start-End: 1-218
agatgttccactgcccatacgagggctgcagccaagtctacgtggccctcagcagcttccaggtgtccgtgaattcacctgcgagacctgcggcaagtccttcaagaggaagaaccacctggaggtacatcggcgcacccacaccggcgagacccccctgcagtgcgagatctgtggctaccagtgccggcagcgcgcgtcgctcaactggcacatgaagaagcacactgcggaggtgcagtacaacttcacgtgcgatcgctgcgggaagcgcttcgagaagctggacagcgtcaagttccacacgctcaaaagccacccggatcacaagcccacctgacccacctgaccactgaccgcccctatttattcgtccgctcggacaccacgcccgggcttgccggggcctggacagctgcgagggccgcccggaccgcgggccggaaggaggcgcccccgccccgccccagagctgggccccctgggcaggttccccaccccgccccaccgcatccttctcggagctggtgcctggggctgcattgctggaactgtgtcaagagagcagagtgagattaaag

SEQ ID NO: 203341 - DNA, 534 bp, Homo sapiens
  Payload ID: 20098
  Gene Name: zinc finger protein 653
  ENST ID: ENST00000592756
  CDS Start-End: 1-508
gaaagagaaggaggacctgtgcttgctaaagaaggaggagaaggaggagccagtagccccggagctggcaacaacggtgcctgagagcgcagagcctgaggcagaggcggacggggaggagctggacggcagcgacatgtcagccatcatctatgaaatccccaaggagcctgagaagaggcggcggagcaagcggtcgcgggtgatggatgctgacggcctgctcgagatgttccactgcccatacgagggctgcagccaagtctacgtggccctcagcagcttccagaaccacgtcaatcttgtgcatcggaaaggaaagaccaaagtgtgccctcatcctggctgtggcaagaagttctatttatccaaccacctgcggcggcacatgatcatccattcaggtgtccgtgaattcacctgcgagacctgcggcaagtccttcaagaggaagaaccacctggaggtacatcggcgcacccacaccggcgagacccccctgcagtgagtgacaggccgccccgtgccgctaga

SEQ ID NO: 203342 - DNA, 4966 bp, Homo sapiens
  Payload ID: 20099
  Gene Name: zinc finger protein 654
  Uniprot ID: Q8IZM8
  ENST ID: ENST00000309495
  CDS Start-End: 208-1953
ctggaaaataatgcaggtaatctaaaaaggacggaggaacagcaaggtttggatgaagggtttgactctcttacagatcagagcactggagagactgatcctgatgatgtatctggagtgcagcctaaaggtcatattaatacgaagaaaaatcttacagctctcagtacttccaaagtagatcacaatgtcccaaggcatcgttgtatgttatgtaacaaggaatttttaggtggtcacattgtaaggcatgcccaggctcatcagaaaaaaggcagttttgcatgtgtaatatgtggtaggaaatttagaaacagaggacttatgcagaagcatttgaagaatcatgttaagaagatacagaggcagcaaattgctgcagctcaacaggatgatcaggaagtcactgctttggaagaaataaattgttctagttcttccatttcatttgaaaatgggaattctgatagtaaggatttggaagtggagacacttactgcttctagtgaaggaaacaaagaagtcatccctgagcatgtggctgaattcattgaaattcccataagtgtaccagaagatgttattgaaaatgttattgaaaatggcagtcctaataattctttaaataatgttttcaagcctttaactgaatgtggggatgattatgaggaggaagaggatgaagaaggtgattatgaagaagatgattatgacctgaatcaagaaacttcagtaattcataaaatcaatggaactgtgtgccatccaaaagacatatatgccacagatcaagaaggaaactttaagtgtcctgctcttggttgtgtccggatatttaaaagaattgggtttctaaataaacatgcaatgaccgtacatccaaccgatttaaatgtgcgacaaacagtaatgaagtggagcaaaggaaaatgcaaattttgtcaaaggcaatttgaagattctcaacattttatagaccaccttaatagacatagctatccaaatgtgtatttttgtttgcattttaattgcaacgagtcgtttaagctgccgttccagcttgcccagcacacaaaaagtcacaggatatttcaggctcagtgtagttttccagaatgccatgagctttttgaagatcttcctctgctgtatgaacatgaagctcaacactatttaagtaaaacaccagagtcatctgcacaaccaagtgaaacaattctttgggatgttcagacagactcaaatcctaatcaggaaaaagactcatctagtaatgagaaacaaactattagtctgccagtttctactagcaaatcaaggaaagagtctacagaaccaaagacatgtatagaaagtatggaaaagaaaacagacagtttagttcagaatggaaacgaacgttctgatgacactgtttcaaatataagcttgatagaccaaaagatgcctgacatagagccaaattctgaaaataattgtagtagtagtgatatagtcaatggacacagtgaaatagagcaaacacctttagtttcatcagatcctgctttgaaaattgatacaaacagaatcaggacagaaaatggttccattttgcccagtgttgtaccacaagaacacaacaccttgccagtatctcaggcaccttccaaaccaaatctgacaagtgaacatacttcatatggcttaattttaacaaaaccatacgtcagaccattgcctcccagttaccttgatgaacggtatcttagtatgccaaaacgcagaaaatttctgactgatagagtagatgcctgttctgatcaagataacgtgtataaaaaatcagtgaaaagattaagatgtggcaaatgcctgaccacctactgtaatgcagaagcacttgaggctcatcttgcacaaaagaaatgtcagacactctttggatttgattcagatgatgaaagtgcctgatgaaaacggttcagaaagatctgtcaatcaagcagtagtgtgaaaaaagcactataagaaaatgcatcatcagtttgctatttccctgatggccttaattttagagtggtcttggattactaaagataaagacaaagcacattttctagaatgaactcacagagatgtgctggcttagactccaaaaggattataaaactcccaaagtaccagttttccagaaaaccacattttacagtttatgatgattaatagcagcagcatgttcagtttcgcttatatgagaaacatgtttaggcaactagtcagaaaaccagctatggccttacagaaagggaaaaattaacccattattaaaaagtgtgtgtggggaggggggctggtttacaatattaaaccatttaaagtattttattctacaaatggggtttgttttcttgtcatgcataatcagattatgtcccctcccttctggttaaacatggtttaaggaaccgctgctgtttggtttgtgattgatttagaaacttatacattaacttaccacagtgctatcaattaaagattgtaacaggtttccagatgattaattaggtcaaagttcaatgaatggcacgccagcattgaaaattaaaaaacaaaacaaaaaaaaccacagtgctttgctaataagctcttgatagaacctcccactaaccacttttgtggtacaaattagttaacatttaaagggcagcagtgtcaataaaatagaaaaaaaccgatcagtactctggggagagatgaaaggaatctaagactttacaggctttgtagttgaaggaaaacactgaattgcaaattattcaatgtgaataatggtaaaagcacactgggatacttctgtttgtgtatatgttgggacattgcttgatgattcatagtaaggtcctttagacattaatgtgagttatctaagtacagtcctattaaaataactggctcaaaaaatcagctaagaatcaggttgagaaatcattcattttattctattaggagaggtaattccaaaataagccatactattcctgtttttttaattcattagtgatgactctggtctgaacagtaatttttatatgtaaaaggaagtatttacacaaaacatttgcacaagaacacagtaagagatacattcaagcattgttttccttagtgatgttattttcctaagaagattttaacttaataaagtgttaaaacaataaatatttttaaaaataccctctcagatgttttccatttgtccattattgaaaggaagatgcttaaagacttccttttactaatagtgtgtaaatctaaaacagggattaaaataacaaaaaggcagtgtttcaaaacagatctcctaatgtcccaatgtcaaatattccagttattctaaataataaaatctttgttcaaggcagataatctcatcagaccctattagagcttcttgaatgaggctattacggaagtggggaatttcttccaggtagcatccatattttattaaattaggatttccagatcatgatagatcagatgatttttttttaatttcccggttttattggtttatcatcagcattcactactatgcaatgatggtcataagtccattccaaatttaaatttgtttctgttatgtagcctatattaggctgtggaatttacatttaggtaactaaacacagctcataattaaaatcttttctttaaggtcagctaaaaaaaatgtttcctgtatttcttgatactaaaaatgtaatgatttttattttagttcattctaaaagtatgtcttgtaataaaaagtctgtttggaaactggttcatttggacagtgaagtcttttgaaatatttctgctttgtacattttccagaagtttaatattttatcacattttccacaagttgtaacaattgatataaatccatgcccacaaagtattccattttcattacttttactgttcatgccaagatgtttcaaatatattccatttgtaatctgtctttaacttgaggtttatttctacttttgtgttgctaaaattatttctgcaagactgagatcaaactggtttatatataactaaatcaaggaatgttttataaaattctatttgaccacactgtcttaacctcggtttatatacttctcaaatagctattgaaagaatgtgttcattttattacatctgtcttttaaaacataaacctacatcattttgcttttatagggtgcataaacttccaacagttctaatttgagcgcttcagaagaaaaggaagcttgcttcttattcctcagattcttctttttttctgttttgaggatgtattcatcctacatggaccaagtttcaaatctttgtttttaaataaaaatttccttcaaaaaattaaatgttaaatttctgctgtgtgtcagtaaggtgaagaaaatagcaaatctgaatttttgctgctcagatattatggaggaggtaaaaaggggaatctccgtggacaaggacactggtactttgggctttagccatattcatttttttgaaaccaccaattatataatacttaaataatttatatcattgaacttgtgattcttttcaaatcacactgaaggttcagccgtactcctttcatgtttggtttaatactgttgtatggatgaaaaacctaaaagggatgatagtgtttattttttaatttatttggtactgtaaaacaccttttcagaatgagtaaatgctgcatatgcattttggagttgttaatatgtgaaagatattacagattcagcaagaaaggaaatttgtgcttccttgttgaatgttaaattattttactttgcattttataagagtacaaattaaaactgagccattgaactgcaataaatcaacaatagtgtctcatttcaagaaattttttgtactgtacatagatttgttcaataaaacgtccttgttggtaatcaag

SEQ ID NO: 203343 - DNA, 2535 bp, Homo sapiens
  Payload ID: 20100
  Gene Name: zinc finger protein 655
  Uniprot ID: Q8N720
  ENST ID: ENST00000252713
  CDS Start-End: 238-1713
cctcatccggggctctcacccacatccgggaccctcatgcctgggcggaggagggggggccctcattcgggaccctgcactccgtcgccggaagtgccaccgagaagcgccggcctcggggctgtctacagcggcccgggagaggctgtggtggccccgagcgcgagtgtgtaggtgacaggacagcggccaggcccgcccctcccctcgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactggggatggagagaccagagaagagaacaagctgttgattcctaagcagaaaatttcggaagaagtgcattcatacaaagtgagagtaggaagactcaaacacgatattacccaagttcctgagactagagaagtgtataagtctgaggacagattagaaagacttcaggaaattctaaggaaatttctgtacctggagagagagtttaggcaaataacaatcagcaaggaaaccttcaccagtgagaagaacaatgaatgtcatgaacccgaaaaaagcttcagtctggactctactattgatgcagatcagagagttcttagaatacagaataccgatgacaatgataagtatgacatgagcttcaaccagaattcagcctctggtaaacatgaacacttaaatctaacagaggattttcagagtagtgaatgtaaggaaagcttaatggatctctcccaccttaataaatgggagagcatccctaacactgagaaatcctataaatgtgatgtatgtgggaaaattttccatcagagctcagcccttactagacatcagagaatccatactagagagaagccctacaaatgtaaagaatgtgaaaagtctttcagtcagagctcaagtcttagtcgacataaaagaatacacactagagaaaaaccttacaaatgtgaagcatctgataaatcctgtgaagcgtctgataaatcctgtagtccaagctcaggcataattcagcataagaaaattcacaccagagccaaatcttacaaatgtagcagttgtgaaagagtcttcagtcgtagtgtccaccttactcaacatcagaaaattcacaaagagatgccctgtaagtgtactgtatgtggcagtgacttctgccatacttcatacctacttgaacatcagagggtccatcatgaagagaaagcctatgagtatgatgaatatgggttggcctatattaaacaacaaggaattcatttcagagaaaagccctatacgtgtagtgaatgtggaaaagacttcagattgaattcacatcttattcagcatcaaagaattcacacaggagagaaagcacatgaatgtaatgaatgtggaaaagctttcagtcaaacctcatgccttattcagcatcacaaaatgcataggaaagagaaatcgtatgaatgtaatgagtatgagggcagtttcagtcatagctcagatcttatcctgcaacaagaagtcctcaccagacagaaagcctttgattgtgatgtatgggaaaagaactccagtcagagagcacatctagttcaacatcagagcattcataccaaagagaactcatgaatgtaatgaagatgggaagatatttatcaaattcaggcttcattcagcatctgagagttcacaccagggagaaatcatgtatgtactgcatgtggtaaagccttcagtcatagctcagccattgctcagcatcagataattcacaccagagagaaaccctctgaatgtgacgaatgaagaaaaggtattagtgttaaactcttaatcgactcctgcaaatctataccagtgagaaatcttacaaatgtattgaatgtggcaaatttttcatgctattagtattttcataccttagtcacatttggagaattcacatgggaataaaattccattgctgcaatgaatgtgaaaaagccatcagtcaaagaaactaccttgtttagtatcaaattcacgccatgcaaaaagattataaatgtaataagcatgtatgtgtgtgaggagattcagtcataacccaacgctcattcaacatcaaagaatttatacctaagagaacttatttgggtgtagtaaatggcagatctttcaataggagtttaactagtctttgtcatatcagaatatccatagtagacaagaatttgatgtaacgcaaatggaaaaactcgacaccacatttcaggctttacccaacatcgaaataatggagagaaaattgttgattatttgtttatgaaattgttaatacatagtcccaatctttttcattgcacaaaaatctagggttgacttggtaaatgcagtgacattttctcatggagttcctttatttaatatgtattctaagtaggtacgtttatttttacttttttattataa

SEQ ID NO: 203344 - DNA, 1601 bp, Homo sapiens
  Payload ID: 20100
  Gene Name: zinc finger protein 655
  Uniprot ID: Q8N720
  ENST ID: ENST00000320583
  CDS Start-End: 410-955
aacggctagagacgcccagtgagttagcatggagggcagtgggaccggaaaaagacgtggaaaagctgcgaaaacgagccttcgaatcatggacgcgcgggcccagctcctcctccgagttcctcatccggggccgtcactcacatccggggccctcactcacatccgggaccctcatccggggctctcacccacatccgggaccctcatgcctgggcggaggagggggggccctcattcgggaccctgcactccgtcgccggaagtgccaccgagaagcgccggcctcggggctgtctacagcggcccgggagaggctgtggtggccccgagcgcgagtgtgtaggtgacaggacagcggccaggcccgcccctcccctcgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactggggctccacctgttcctcaggtgcctgctcttccccgtgagggaagcccaggagaccaggcagctgcgctcttgacagccaggtaccaggagtttgtgacattcgaggatgtggctgtgcaccttactcgagaggaatggggatacctggaccctgttcagagggacctctacagagaagtgatgttagagaattatgggaacgtggtctcactgggcatacttctccgccttcccaccacccggattcatagtgtgaattcctgcccggccctgagtcatacccaggcaagtgctttctctggagaaacacttgccgtccttacagcaggaatctccaagagatggcccaagtatcggcttcccatcgatattgctcgtccctgctcggaaactccttttccacgattgtgagatattaaaattgactgatggaatagaagctccccaggatgccaccactgtgtaaaatcgcagctcctcaaattacctctgtttaatttcaaatgttagggtccaaggaagccctctgttgcaaccagatatgttttgaacccagttcattcagaaaccatggttggtggtcatcatctacttgtattgtgaaaaaccagaaattccaaattcagctcttcagttatggtcttttcatattattttagaatgtgaaacttatgctgtgtgcccctccttttatgtggcgaacacaacctgccccgtatggtgcctaactctcctgtgaaccctgggcttccctcatgtttaacattctggtttcctccttccttgaagtccctgtggccctcttcaaggtcctaccttcctaccctttattctttgtggttctgtacagattgatgcaattatattgcctttcctgattaagtgttccttactctgtccttgatggaggggagaagggagggcaaagaagttaaatttatttcagggcatcaaattgaatatctacttaataactttgtaaactgtaaagtgacatacatataattgtaaagtactgttaattttatctaataattacagagtttccaacagttaa

SEQ ID NO: 203345 - DNA, 1370 bp, Homo sapiens
  Payload ID: 20100
  Gene Name: zinc finger protein 655
  Uniprot ID: Q8N720
  ENST ID: ENST00000357864
  CDS Start-End: 394-726
cagtgagttagcatggagggcagtgggaccggaaaaagacgtggaaaagctgcgaaaacgagccttcgaatcatggacgcgcgggcccagctcctcctccgagttcctcatccggggccgtcactcacatccggggccctcactcacatccgggaccctcatccggggctctcacccacatccgggaccctcatgcctgggcggaggagggggggccctcattcgggaccctgcactccgtcgccggaagtgccaccgagaagcgccggcctcggggctgtctacagcggcccgggagaggctgtggtggccccgagcgcgagtgtgtaggtgacaggacagcggccaggcccgcccctcccctcgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactgggggcatacttctccgccttcccaccacccggattcatagtgtgaattcctgcccggccctgagtcatacccaggcaagtgctttctctggagaaacacttgccgtccttacagcaggaatctccaagagatggcccaagtatcggcttcccatcgatattgctcgtccctgctcggaaactccttttccacgattgtgagatattaaaattgactgatggaatagaagctccccaggatgccaccactgtgtaaaatcgcagctcctcaaattacctctgtttaatttcaaatgttagggtccaaggaagccctctgttgcaaccagatatgttttgaacccagttcattcagaaaccatggttggtggtcatcatctacttgtattgtgaaaaaccagaaattccaaattcagctcttcagttatggtcttttcatattattttagaatgtgaaacttatgctgtgtgcccctccttttatgtggcgaacacaacctgccccgtatggtgcctaactctcctgtgaaccctgggcttccctcatgtttaacattctggtttcctccttccttgaagtccctgtggccctcttcaaggtcctaccttcctaccctttattctttgtggttctgtacagattgatgcaattatattgcctttcctgattaagtgttccttactctgtccttgatggaggggagaagggagggcaaagaagttaaatttatttcagggcatcaaattgaatatctacttaataactttgtaaactgtaaagtgacatacatataattgtaaagtactgttaattttatctaataattacagagtttccaacagtt

SEQ ID NO: 203346 - DNA, 4528 bp, Homo sapiens
  Payload ID: 20100
  Gene Name: zinc finger protein 655
  Uniprot ID: Q8N720
  ENST ID: ENST00000394163
  CDS Start-End: 184-1659
cggcgtccggccgcggccgacggtagttcgcttccccgagagtgcgcggaggcccgggtgcgaggagggcctgtttctcttcagccctggttcattcacctcgcggaccgagggccccgccgtcaggagccggcgaccgtgccctggtgcgagctgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactggggatggagagaccagagaagagaacaagctgttgattcctaagcagaaaatttcggaagaagtgcattcatacaaagtgagagtaggaagactcaaacacgatattacccaagttcctgagactagagaagtgtataagtctgaggacagattagaaagacttcaggaaattctaaggaaatttctgtacctggagagagagtttaggcaaataacaatcagcaaggaaaccttcaccagtgagaagaacaatgaatgtcatgaacccgaaaaaagcttcagtctggactctactattgatgcagatcagagagttcttagaatacagaataccgatgacaatgataagtatgacatgagcttcaaccagaattcagcctctggtaaacatgaacacttaaatctaacagaggattttcagagtagtgaatgtaaggaaagcttaatggatctctcccaccttaataaatgggagagcatccctaacactgagaaatcctataaatgtgatgtatgtgggaaaattttccatcagagctcagcccttactagacatcagagaatccatactagagagaagccctacaaatgtaaagaatgtgaaaagtctttcagtcagagctcaagtcttagtcgacataaaagaatacacactagagaaaaaccttacaaatgtgaagcatctgataaatcctgtgaagcgtctgataaatcctgtagtccaagctcaggcataattcagcataagaaaattcacaccagagccaaatcttacaaatgtagcagttgtgaaagagtcttcagtcgtagtgtccaccttactcaacatcagaaaattcacaaagagatgccctgtaagtgtactgtatgtggcagtgacttctgccatacttcatacctacttgaacatcagagggtccatcatgaagagaaagcctatgagtatgatgaatatgggttggcctatattaaacaacaaggaattcatttcagagaaaagccctatacgtgtagtgaatgtggaaaagacttcagattgaattcacatcttattcagcatcaaagaattcacacaggagagaaagcacatgaatgtaatgaatgtggaaaagctttcagtcaaacctcatgccttattcagcatcacaaaatgcataggaaagagaaatcgtatgaatgtaatgagtatgagggcagtttcagtcatagctcagatcttatcctgcaacaagaagtcctcaccagacagaaagcctttgattgtgatgtatgggaaaagaactccagtcagagagcacatctagttcaacatcagagcattcataccaaagagaactcatgaatgtaatgaagatgggaagatatttatcaaattcaggcttcattcagcatctgagagttcacaccagggagaaatcatgtatgtactgcatgtggtaaagccttcagtcatagctcagccattgctcagcatcagataattcacaccagagagaaaccctctgaatgtgacgaatgaagaaaaggtattagtgttaaactcttaatcgactcctgcaaatctataccagtgagaaatcttacaaatgtattgaatgtggcaaatttttcatgctattagtattttcataccttagtcacatttggagaattcacatgggaataaaattccattgctgcaatgaatgtgaaaaagccatcagtcaaagaaactaccttgtttagtatcaaattcacgccatgcaaaaagattataaatgtaataagcatgtatgtgtgtgaggagattcagtcataacccaacgctcattcaacatcaaagaatttatacctaagagaacttatttgggtgtagtaaatggcagatctttcaataggagtttaactagtctttgtcatatcagaatatccatagtagacaagaatttgatgtaacgcaaatggaaaaactcgacaccacatttcaggctttacccaacatcgaaataatggagagaaaattgttgattatttgtttatgaaattgttaatacatagtcccaatctttttcattgcacaaaaatctagggttgacttggtaaatgcagtgacattttctcatggagttcctttatttaatatgtattctaagtaggtacgtttatttttacttttttattataattttgatattaaaaagaacagagatggggtcttgctttgttgcccaggctggtcttgaactcctggcctcaagcgatcctcccacctgtcctcccaaagtgctggggttacaggcgtgtgtcactgtgctgggcctattttatttatagaactcatttaagctgtttttattttaatatgccctataaacatttttatattttttgaaattggttcttagtgttcacaacttccataagatactgctaatgcaccagtattaaaacacatcgacgtaagtagctcatttagctttttctgctgttcttggcccaagttctttccaaaaccaactcttaggcctgctctttactagggatcttatgtcgtattgctttacagccacaacacttggattcctgttgattaacttctccattctcttaagcacctttagaagatttagaagtttcctagttttaagtgtttcaccagcaagtattccatacctacttgatgttgctggtctggtgtcttatttcctaaagtgaagcatctttttttaaaaaagaatttgattgacaatatatccagtccaatataagtatgaaggattctctctcctgagattgtagcaggcagccaaacattttcaaatgatgcccaaggttttagctgtcttgtgtgcatccacagtctgcgaagaagacatgataaggacatcagggagccaacaagactcctaatagcctcactacattcatccagtgcctattctgcatgcctaagcttagagttcttttatatacctctacggccagcaaaatgctcaggtctgctcttggtagggtaaacataaagaagatacacaggccgggcatggtggctcacacctgtaatcccagcactttgggaggctgaggcggatggatcacgaggtcaggcagtcgagaccatcctggccaacatggtgaaaccccgtctctactaaaaatacaaaagttagccgggtgtggtggcacgcgcctgtaatcccagctactcaggaggctgaggcaggagaactgcttgaacctgggaggcggaggttgcagtgagccgagattgcaccactgcactccagcctgggcgacagagcaggactctctctcaaaaaaacacaaaaaaacaaaaacaaaaaaccatacacacacacacacacacacaaatcagcatcataagggaatgtagccttccaacagagatgatgctgttcgtatgttaatctcagagacagtatttcaagagagtggcaggtctgttcctggtaaaattttaaccattaggattgcagataaatgtttgaattctgctcctctctcatcaatccaggacagtatttgaagtgtgagggctttgtgtatagttgtttatccattaccacatttttgtattttaatagtctacaggctatataaaagaacatggctttttgactgataaaagtgattacagatgttggctcaagttcagggccaccatcatatacctaacaagagttcatgattctttaggtaatgtcaaaacattttgtatttttccatcttaagctttataacattttgtgagtaagacaaatgttatttaaaattcttgttgtcagtccagcaattgaggctttcatagttcagtgttataatattcagtagggaccctcaacaaatatataaaaatatgttgctcactctataatcctcctatggctaacctctaggatagttctgccactatattttacttctttgccatcagcaagagtaggatttcatcaaggcaaggtaggaatctaaatgaaattgatatataaatgaattgatctaaatgtaaaagcaaatgaaaaatgcatgtgttttttcctgtcaaacatgtatacccttatgtatagagaccagtagtcacgtatggtgactgaaacaggattatgtaatccctaaaaagcagaatatgtaaaaatcacatgtatgcgtttggtttaggaatgtgcttttgtacttccacttgaataaaggtgtgtttggtattctgagaa

SEQ ID NO: 203347 - DNA, 793 bp, Homo sapiens
  Payload ID: 20100
  Gene Name: zinc finger protein 655
  ENST ID: ENST00000422164
  CDS Start-End: 247-793
gaagccgttttggggtcgcagcggggtggcagcttgttttgccttcacgggagtagaaggaggcggcgtccggccgcggccgacggtagttcgcttccccgagagtgcgcggaggcccgggtgcgaggagggcctgtttctcttcagccctggttcattcacctcgcggaccgagggccccgccgtcaggagccggcgaccgtgccctggtgcgagctgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactgggggatttccaatttccaagcctgatgggatctcccagctggaacaggatctacaggtctttgatctggaaactaagactagagaagtcttaagagatgactgctcagatggagagaccagagaagagaacaagctgttgattcctaagcagaaaatttcggaagaagtgcattcatacaaagtgagagtaggaagactcaaacacgatattacccaagttcctgagactagagaagtgtataagtctgaggacagattagaaagacttcaggaaattctaaggaaatttctgtacctggagagagagtttaggcaaataacaatcagcaaggaaaccttcaccagtgagaagaacaatgaatgtcatgaacccgaaaaaagcttcagtctggactctactattgatgcagatc

SEQ ID NO: 203348 - DNA, 782 bp, Homo sapiens
  Payload ID: 20100
  Gene Name: zinc finger protein 655
  ENST ID: ENST00000422422
  CDS Start-End: 90-242
tggtggccccgagcgcgagtgtgtaggtgacaggacagcggccaggcccgcccctcccctcgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactggggtgggaagctgggattagccaagctgtagtgctgctgggaagcatcagtggggtttgtcggcagctcccttggtgcatacttctccgccttcccaccacccggattcatagtgtgaattcctgcccggccctgagtcatacccaggcaagtgctttctctggagaaacacttgccgtccttacagcaggaatctccaagagatggcccaagtatcggcttcccatcgatattgctcgtccctgctcggaaactccttttccacgattgtgagatattaaaattgactgatggaatagaagctccccaggatgccaccactgtgtaaaatcgcagctcctcaaattacctctgtttaatttcaaatgttagggtccaaggaagccctctgttgcaaccagatatgttttgaacccagttcattcagaaaccatggttggtggtcatcatctacttgtattgtgaaaaaccagaaattccaaattcagctcttcagttatggtcttttcatattattttagaatgtgaaacttatgctgtgtgcccctccttttatgtgg

SEQ ID NO: 203349 - DNA, 567 bp, Homo sapiens
  Payload ID: 20100
  Gene Name: zinc finger protein 655
  ENST ID: ENST00000427931
  CDS Start-End: 231-567
gttttggggtcgcagcggggtggcagcttgttttgccttcacgggagtagaaggaggcggcgtccggccgcggccgacggtagttcgcttccccgagagtgcgcggaggcccgggtgcgaggagggcctgtttctcttcagccctggttcattcacctcgcggaccgagggccccgccgtcaggagccggcgaccgtgccctgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactgggggatttccaatttccaagcctgatgggatctcccagctggaacaggatctacaggtctttgatctggaaactaagactagagaagtcttaagagatgactgctcagatggagagaccagagaagagaacaagctgttgattcctaagcagaaaatttcggaagaagtgcattcatacaaagtgagagtaggaagactcaaac

SEQ ID NO: 203350 - DNA, 4624 bp, Homo sapiens
  Payload ID: 20100
  Gene Name: zinc finger protein 655
  ENST ID: ENST00000425063
  CDS Start-End: 103-414
ccgggagaggctgtggtggccccgagcgcgagtgtgtaggtgacaggacagcggccaggcccgcccctcccctcgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactggggctccacctgttcctcaggtgcctgctcttccccgtgagggaagcccaggagaccaggcagctgcgctcttgacagccaggtaccaggatttccaatttccaagcctgatgggatctcccagctggaacaggatctacaggtctttgatctggaaactaagactagagaagtcttaagagatgactgctcagatggagagaccagagaagagaacaagctgttgattcctaagcagaaaatttcggaagaagtgcattcatacaaagtgagagtaggaagactcaaacacgatattacccaagttcctgagactagagaagtgtataagtctgaggacagattagaaagacttcaggaaattctaaggaaatttctgtacctggagagagagtttaggcaaataacaatcagcaaggaaaccttcaccagtgagaagaacaatgaatgtcatgaacccgaaaaaagcttcagtctggactctactattgatgcagatcagagagttcttagaatacagaataccgatgacaatgataagtatgacatgagcttcaaccagaattcagcctctggtaaacatgaacacttaaatctaacagaggattttcagagtagtgaatgtaaggaaagcttaatggatctctcccaccttaataaatgggagagcatccctaacactgagaaatcctataaatgtgatgtatgtgggaaaattttccatcagagctcagcccttactagacatcagagaatccatactagagagaagccctacaaatgtaaagaatgtgaaaagtctttcagtcagagctcaagtcttagtcgacataaaagaatacacactagagaaaaaccttacaaatgtgaagcatctgataaatcctgtgaagcgtctgataaatcctgtagtccaagctcaggcataattcagcataagaaaattcacaccagagccaaatcttacaaatgtagcagttgtgaaagagtcttcagtcgtagtgtccaccttactcaacatcagaaaattcacaaagagatgccctgtaagtgtactgtatgtggcagtgacttctgccatacttcatacctacttgaacatcagagggtccatcatgaagagaaagcctatgagtatgatgaatatgggttggcctatattaaacaacaaggaattcatttcagagaaaagccctatacgtgtagtgaatgtggaaaagacttcagattgaattcacatcttattcagcatcaaagaattcacacaggagagaaagcacatgaatgtaatgaatgtggaaaagctttcagtcaaacctcatgccttattcagcatcacaaaatgcataggaaagagaaatcgtatgaatgtaatgagtatgagggcagtttcagtcatagctcagatcttatcctgcaacaagaagtcctcaccagacagaaagcctttgattgtgatgtatgggaaaagaactccagtcagagagcacatctagttcaacatcagagcattcataccaaagagaactcatgaatgtaatgaagatgggaagatatttatcaaattcaggcttcattcagcatctgagagttcacaccagggagaaatcatgtatgtactgcatgtggtaaagccttcagtcatagctcagccattgctcagcatcagataattcacaccagagagaaaccctctgaatgtgacgaatgaagaaaaggtattagtgttaaactcttaatcgactcctgcaaatctataccagtgagaaatcttacaaatgtattgaatgtggcaaatttttcatgctattagtattttcataccttagtcacatttggagaattcacatgggaataaaattccattgctgcaatgaatgtgaaaaagccatcagtcaaagaaactaccttgtttagtatcaaattcacgccatgcaaaaagattataaatgtaataagcatgtatgtgtgtgaggagattcagtcataacccaacgctcattcaacatcaaagaatttatacctaagagaacttatttgggtgtagtaaatggcagatctttcaataggagtttaactagtctttgtcatatcagaatatccatagtagacaagaatttgatgtaacgcaaatggaaaaactcgacaccacatttcaggctttacccaacatcgaaataatggagagaaaattgttgattatttgtttatgaaattgttaatacatagtcccaatctttttcattgcacaaaaatctagggttgacttggtaaatgcagtgacattttctcatggagttcctttatttaatatgtattctaagtaggtacgtttatttttacttttttattataattttgatattaaaaagaacagagatggggtcttgctttgttgcccaggctggtcttgaactcctggcctcaagcgatcctcccacctgtcctcccaaagtgctggggttacaggcgtgtgtcactgtgctgggcctattttatttatagaactcatttaagctgtttttattttaatatgccctataaacatttttatattttttgaaattggttcttagtgttcacaacttccataagatactgctaatgcaccagtattaaaacacatcgacgtaagtagctcatttagctttttctgctgttcttggcccaagttctttccaaaaccaactcttaggcctgctctttactagggatcttatgtcgtattgctttacagccacaacacttggattcctgttgattaacttctccattctcttaagcacctttagaagatttagaagtttcctagttttaagtgtttcaccagcaagtattccatacctacttgatgttgctggtctggtgtcttatttcctaaagtgaagcatctttttttaaaaaagaatttgattgacaatatatccagtccaatataagtatgaaggattctctctcctgagattgtagcaggcagccaaacattttcaaatgatgcccaaggttttagctgtcttgtgtgcatccacagtctgcgaagaagacatgataaggacatcagggagccaacaagactcctaatagcctcactacattcatccagtgcctattctgcatgcctaagcttagagttcttttatatacctctacggccagcaaaatgctcaggtctgctcttggtagggtaaacataaagaagatacacaggccgggcatggtggctcacacctgtaatcccagcactttgggaggctgaggcggatggatcacgaggtcaggcagtcgagaccatcctggccaacatggtgaaaccccgtctctactaaaaatacaaaagttagccgggtgtggtggcacgcgcctgtaatcccagctactcaggaggctgaggcaggagaactgcttgaacctgggaggcggaggttgcagtgagccgagattgcaccactgcactccagcctgggcgacagagcaggactctctctcaaaaaaacacaaaaaaacaaaaacaaaaaaccatacacacacacacacacacacaaatcagcatcataagggaatgtagccttccaacagagatgatgctgttcgtatgttaatctcagagacagtatttcaagagagtggcaggtctgttcctggtaaaattttaaccattaggattgcagataaatgtttgaattctgctcctctctcatcaatccaggacagtatttgaagtgtgagggctttgtgtatagttgtttatccattaccacatttttgtattttaatagtctacaggctatataaaagaacatggctttttgactgataaaagtgattacagatgttggctcaagttcagggccaccatcatatacctaacaagagttcatgattctttaggtaatgtcaaaacattttgtatttttccatcttaagctttataacattttgtgagtaagacaaatgttatttaaaattcttgttgtcagtccagcaattgaggctttcatagttcagtgttataatattcagtagggaccctcaacaaatatataaaaatatgttgctcactctataatcctcctatggctaacctctaggatagttctgccactatattttacttctttgccatcagcaagagtaggatttcatcaaggcaaggtaggaatctaaatgaaattgatatataaatgaattgatctaaatgtaaaagcaaatgaaaaatgcatgtgttttttcctgtcaaacatgtatacccttatgtatagagaccagtagtcacgtatggtgactgaaacaggattatgtaatccctaaaaagcagaatatgtaaaaatcacatgtatgcgtttggtttaggaatgtgcttttgtacttccacttgaataaaggtgtgtt

SEQ ID NO: 203351 - DNA, 573 bp, Homo sapiens
  Payload ID: 20100
  Gene Name: zinc finger protein 655
  ENST ID: ENST00000422647
  CDS Start-End: 245-573
gttttggggtcgcagcggggtggcagcttgttttgccttcacgggagtagaaggaggcggcgtccggccgcggccgacggtagttcgcttccccgagagtgcgcggaggcccgggtgcgaggagggcctgtttctcttcagccctggttcattcacctcgcggaccgagggccccgccgtcaggagccggcgaccgtgccctggtgcgagctggtcttgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactgggggatttccaatttccaagcctgatgggatctcccagctggaacaggatctacaggtctttgatctggaaactaagactagagaagtcttaagagatgactgctcagatggagagaccagagaagagaacaagctgttgattcctaagcagaaaatttcggaagaagtgcattcatacaaagtgagagtaggaag

SEQ ID NO: 203352 - DNA, 4666 bp, Homo sapiens
  Payload ID: 20100
  Gene Name: zinc finger protein 655
  Uniprot ID: Q8N720
  ENST ID: ENST00000424881
  CDS Start-End: 221-1801
tggcagcttgttttgccttcacgggagtagaaggaggcggcgtccggccgcggccgacggtagttcgcttccccgagagtgcgcggaggcccgggtgcgaggagggcctgtttctcttcagccctggttcattcacctcgcggaccgagggccccgccgtcaggagccggcgaccgtgccctggtgcgagctgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactgggggatttccaatttccaagcctgatgggatctcccagctggaacaggatctacaggtctttgatctggaaactaagactagagaagtcttaagagatgactgctcagatggagagaccagagaagagaacaagctgttgattcctaagcagaaaatttcggaagaagtgcattcatacaaagtgagagtaggaagactcaaacacgatattacccaagttcctgagactagagaagtgtataagtctgaggacagattagaaagacttcaggaaattctaaggaaatttctgtacctggagagagagtttaggcaaataacaatcagcaaggaaaccttcaccagtgagaagaacaatgaatgtcatgaacccgaaaaaagcttcagtctggactctactattgatgcagatcagagagttcttagaatacagaataccgatgacaatgataagtatgacatgagcttcaaccagaattcagcctctggtaaacatgaacacttaaatctaacagaggattttcagagtagtgaatgtaaggaaagcttaatggatctctcccaccttaataaatgggagagcatccctaacactgagaaatcctataaatgtgatgtatgtgggaaaattttccatcagagctcagcccttactagacatcagagaatccatactagagagaagccctacaaatgtaaagaatgtgaaaagtctttcagtcagagctcaagtcttagtcgacataaaagaatacacactagagaaaaaccttacaaatgtgaagcatctgataaatcctgtgaagcgtctgataaatcctgtagtccaagctcaggcataattcagcataagaaaattcacaccagagccaaatcttacaaatgtagcagttgtgaaagagtcttcagtcgtagtgtccaccttactcaacatcagaaaattcacaaagagatgccctgtaagtgtactgtatgtggcagtgacttctgccatacttcatacctacttgaacatcagagggtccatcatgaagagaaagcctatgagtatgatgaatatgggttggcctatattaaacaacaaggaattcatttcagagaaaagccctatacgtgtagtgaatgtggaaaagacttcagattgaattcacatcttattcagcatcaaagaattcacacaggagagaaagcacatgaatgtaatgaatgtggaaaagctttcagtcaaacctcatgccttattcagcatcacaaaatgcataggaaagagaaatcgtatgaatgtaatgagtatgagggcagtttcagtcatagctcagatcttatcctgcaacaagaagtcctcaccagacagaaagcctttgattgtgatgtatgggaaaagaactccagtcagagagcacatctagttcaacatcagagcattcataccaaagagaactcatgaatgtaatgaagatgggaagatatttatcaaattcaggcttcattcagcatctgagagttcacaccagggagaaatcatgtatgtactgcatgtggtaaagccttcagtcatagctcagccattgctcagcatcagataattcacaccagagagaaaccctctgaatgtgacgaatgaagaaaaggtattagtgttaaactcttaatcgactcctgcaaatctataccagtgagaaatcttacaaatgtattgaatgtggcaaatttttcatgctattagtattttcataccttagtcacatttggagaattcacatgggaataaaattccattgctgcaatgaatgtgaaaaagccatcagtcaaagaaactaccttgtttagtatcaaattcacgccatgcaaaaagattataaatgtaataagcatgtatgtgtgtgaggagattcagtcataacccaacgctcattcaacatcaaagaatttatacctaagagaacttatttgggtgtagtaaatggcagatctttcaataggagtttaactagtctttgtcatatcagaatatccatagtagacaagaatttgatgtaacgcaaatggaaaaactcgacaccacatttcaggctttacccaacatcgaaataatggagagaaaattgttgattatttgtttatgaaattgttaatacatagtcccaatctttttcattgcacaaaaatctagggttgacttggtaaatgcagtgacattttctcatggagttcctttatttaatatgtattctaagtaggtacgtttatttttacttttttattataattttgatattaaaaagaacagagatggggtcttgctttgttgcccaggctggtcttgaactcctggcctcaagcgatcctcccacctgtcctcccaaagtgctggggttacaggcgtgtgtcactgtgctgggcctattttatttatagaactcatttaagctgtttttattttaatatgccctataaacatttttatattttttgaaattggttcttagtgttcacaacttccataagatactgctaatgcaccagtattaaaacacatcgacgtaagtagctcatttagctttttctgctgttcttggcccaagttctttccaaaaccaactcttaggcctgctctttactagggatcttatgtcgtattgctttacagccacaacacttggattcctgttgattaacttctccattctcttaagcacctttagaagatttagaagtttcctagttttaagtgtttcaccagcaagtattccatacctacttgatgttgctggtctggtgtcttatttcctaaagtgaagcatctttttttaaaaaagaatttgattgacaatatatccagtccaatataagtatgaaggattctctctcctgagattgtagcaggcagccaaacattttcaaatgatgcccaaggttttagctgtcttgtgtgcatccacagtctgcgaagaagacatgataaggacatcagggagccaacaagactcctaatagcctcactacattcatccagtgcctattctgcatgcctaagcttagagttcttttatatacctctacggccagcaaaatgctcaggtctgctcttggtagggtaaacataaagaagatacacaggccgggcatggtggctcacacctgtaatcccagcactttgggaggctgaggcggatggatcacgaggtcaggcagtcgagaccatcctggccaacatggtgaaaccccgtctctactaaaaatacaaaagttagccgggtgtggtggcacgcgcctgtaatcccagctactcaggaggctgaggcaggagaactgcttgaacctgggaggcggaggttgcagtgagccgagattgcaccactgcactccagcctgggcgacagagcaggactctctctcaaaaaaacacaaaaaaacaaaaacaaaaaaccatacacacacacacacacacacaaatcagcatcataagggaatgtagccttccaacagagatgatgctgttcgtatgttaatctcagagacagtatttcaagagagtggcaggtctgttcctggtaaaattttaaccattaggattgcagataaatgtttgaattctgctcctctctcatcaatccaggacagtatttgaagtgtgagggctttgtgtatagttgtttatccattaccacatttttgtattttaatagtctacaggctatataaaagaacatggctttttgactgataaaagtgattacagatgttggctcaagttcagggccaccatcatatacctaacaagagttcatgattctttaggtaatgtcaaaacattttgtatttttccatcttaagctttataacattttgtgagtaagacaaatgttatttaaaattcttgttgtcagtccagcaattgaggctttcatagttcagtgttataatattcagtagggaccctcaacaaatatataaaaatatgttgctcactctataatcctcctatggctaacctctaggatagttctgccactatattttacttctttgccatcagcaagagtaggatttcatcaaggcaaggtaggaatctaaatgaaattgatatataaatgaattgatctaaatgtaaaagcaaatgaaaaatgcatgtgttttttcctgtcaaacatgtatacccttatgtatagagaccagtagtcacgtatggtgactgaaacaggattatgtaatccctaaaaagcagaatatgtaaaaatcacatgtatgcgtttggtttaggaatgtgcttttgtacttccacttgaataaaggtgtgtttggtattctg

SEQ ID NO: 203353 - DNA, 1441 bp, Homo sapiens
  Payload ID: 20100
  Gene Name: zinc finger protein 655
  ENST ID: ENST00000423973
  CDS Start-End: 147-542
aagtgccaccgagaagcgccggcctcggggctgtctacagcggcccgggagaggctgtggtggccccgagcgcgagtgtgtaggtgacaggacagcggccaggcccgcccctcccctcgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactggggctccacctgttcctcaggtgcctgctcttccccgtgagggaagcccaggagaccaggcagctgcgctcttgacagccaggtaccagagcagccaggatgtgttatttcaggagtttgtgacattcgaggatgtggctgtgcaccttactcgagaggaatggggatacctggaccctgttcagagggacctctacagagaagtgatgttagagaattatgggaacgtggtctcactgggtacagtgggaagctgggattagccaagctgtagtgctgctgggaagcatcagtggggtttgtcggcagctcccttggtgcatacttctccgccttcccaccacccggattcatagtgtgaattcctgcccggccctgagtcatacccaggcaagtgctttctctggagaaacacttgccgtccttacagcaggaatctccaagagatggcccaagtatcggcttcccatcgatattgctcgtccctgctcggaaactccttttccacgattgtgagatattaaaattgactgatggaatagaagctccccaggatgccaccactgtgtaaaatcgcagctcctcaaattacctctgtttaatttcaaatgttagggtccaaggaagccctctgttgcaaccagatatgttttgaacccagttcattcagaaaccatggttggtggtcatcatctacttgtattgtgaaaaaccagaaattccaaattcagctcttcagttatggtcttttcatattattttagaatgtgaaacttatgctgtgtgcccctccttttatgtggcgaacacaacctgccccgtatggtgcctaactctcctgtgaaccctgggcttccctcatgtttaacattctggtttcctccttccttgaagtccctgtggccctcttcaaggtcctaccttcctaccctttattctttgtggttctgtacagattgatgcaattatattgcctttcctgattaagtgttccttactctgtccttgatggaggggagaagggagggcaaagaagttaaatttatttcagggcatcaaattgaatatctacttaataactttgtaaactgtaaagtgacatacatataattgtaaagtactgttaattttatctaataattacagagtttccaacagttaa

SEQ ID NO: 203354 - DNA, 1198 bp, Homo sapiens
  Payload ID: 20100
  Gene Name: zinc finger protein 655
  Uniprot ID: Q8N720
  ENST ID: ENST00000440391
  CDS Start-End: 220-552
ggcagcttgttttgccttcacgggagtagaaggaggcggcgtccggccgcggccgacggtagttcgcttccccgagagtgcgcggaggcccgggtgcgaggagggcctgtttctcttcagccctggttcattcacctcgcggaccgagggccccgccgtcaggagccggcgaccgtgccctggtgcgagctgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactgggggcatacttctccgccttcccaccacccggattcatagtgtgaattcctgcccggccctgagtcatacccaggcaagtgctttctctggagaaacacttgccgtccttacagcaggaatctccaagagatggcccaagtatcggcttcccatcgatattgctcgtccctgctcggaaactccttttccacgattgtgagatattaaaattgactgatggaatagaagctccccaggatgccaccactgtgtaaaatcgcagctcctcaaattacctctgtttaatttcaaatgttagggtccaaggaagccctctgttgcaaccagatatgttttgaacccagttcattcagaaaccatggttggtggtcatcatctacttgtattgtgaaaaaccagaaattccaaattcagctcttcagttatggtcttttcatattattttagaatgtgaaacttatgctgtgtgcccctccttttatgtggcgaacacaacctgccccgtatggtgcctaactctcctgtgaaccctgggcttccctcatgtttaacattctggtttcctccttccttgaagtccctgtggccctcttcaaggtcctaccttcctaccctttattctttgtggttctgtacagattgatgcaattatattgcctttcctgattaagtgttccttactctgtccttgatggaggggagaagggagggcaaagaagttaaatttatttcagggcatcaaattgaatatctacttaataactttgtaaactgtaaagtgacatacatataattgtaaagtactgttaattttatctaataattacagagtttccaacagttaa

SEQ ID NO: 203355 - DNA, 545 bp, Homo sapiens
  Payload ID: 20100
  Gene Name: zinc finger protein 655
  ENST ID: ENST00000452314
  CDS Start-End: 249-545
acatccgggaccctcatccggggctctcacccacatccgggaccctcatgcctgggcggaggagggggggccctcattcgggaccctgcactccgtcgccggaagtgccaccgagaagcgccggcctcggggctgtctacagcggcccgggagaggctgtggtggccccgagcgcgagtgtgtaggtgacaggacagcggccaggcccgcccctcccctcgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactgggggcatacttctccgccttcccaccacccggattcatagtgtgaattcctgcccggccctgagtcatacccaggcaagtgctttctctggagaaacacttgccgtccttacagcaggaatctccaagagatggcccaagtatcggcttcccatcgatattgct

SEQ ID NO: 203356 - DNA, 571 bp, Homo sapiens
  Payload ID: 20100
  Gene Name: zinc finger protein 655
  ENST ID: ENST00000454654
  CDS Start-End: 250-561
ctcacccacatccgggaccctcatgcctgggcggaggagggggggccctcattcgggaccctgcactccgtcgccggaagtgccaccgagaagcgccggcctcggggctgtctacagcggcccgggagaggctgtggtggccccgagcgcgagtgtgtaggtgacaggacagcggccaggcccgcccctcccctcgtaatttctcttaatcttaccttgcagtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactggggctccacctgttcctcaggtgcctgctcttccccgtgagggaagcccaggagaccaggcagctgcgctcttgacagccaggtaccaggatttccaatttccaagcctgatgggatctcccagctggaacaggatctacaggtctttgatctggaaactaagactagagaagtcttaagagatgactg

SEQ ID NO: 203357 - DNA, 655 bp, Homo sapiens
  Payload ID: 20100
  Gene Name: zinc finger protein 655
  ENST ID: ENST00000412636
  CDS Start-End: 221-361
acccacatccgggaccctcatgcctgggcggaggagggggggccctcattcgggaccctgcactccgtcgccggaagtgccaccgagaagcgccggcctcggggctgtctacagcggcccgggagaggctgtggtggccccgagcgcgagtgtgtaggtgacaggacagcggccaggcccgcccctcccctcgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactgggggttagctaaccatgcagcaggtgcttgagtttcacctttctccagtccagcagaattacattttgatgacctccattttgatacttgtagaccagatctaatccgaagattaatctttaggatttccaatttccaagcctgatgggatctcccagctggaacaggatctacaggtctttgatctggaaactaagactagagaagtcttaagagatgactgctcagatggagagaccagagaagagaacaagctgttgattcctaagcagaaaatttcggaagaagtgcattcatacaaa

SEQ ID NO: 203358 - DNA, 1496 bp, Homo sapiens
  Payload ID: 20100
  Gene Name: zinc finger protein 655
  ENST ID: ENST00000416144
  CDS Start-End: 245-616
ccgggaccctcatccggggctctcacccacatccgggaccctcatgcctgggcggaggagggggggccctcattcgggaccctgcactccgtcgccggaagtgccaccgagaagcgccggcctcggggctgtctacagcggcccgggagaggctgtggtggccccgagcgcgagtgtgtaggtgacaggacagcggccaggcccgcccctcccctcgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactggggctccacctgttcctcaggtgcctgctcttccccgtgagggaagcccaggagaccaggcagctgcgctcttgacagccaggtaccaggagtttgtgacattcgaggatgtggctgtgcaccttactcgagaggaatggggatacctggaccctgttcagagggacctctacagagaagtgatgttagagaattatgggaacgtggtctcactgggtacagtgggaagctgggattagccaagctgtagtgctgctgggaagcatcagtggggtttgtcggcagctcccttggtgcatacttctccgccttcccaccacccggattcatagtgtgaattcctgcccggccctgagtcatacccaggcaagtgctttctctggagaaacacttgccgtccttacagcaggaatctccaagagatggcccaagtatcggcttcccatcgatattgctcgtccctgctcggaaactccttttccacgattgtgagatattaaaattgactgatggaatagaagctccccaggatgccaccactgtgtaaaatcgcagctcctcaaattacctctgtttaatttcaaatgttagggtccaaggaagccctctgttgcaaccagatatgttttgaacccagttcattcagaaaccatggttggtggtcatcatctacttgtattgtgaaaaaccagaaattccaaattcagctcttcagttatggtcttttcatattattttagaatgtgaaacttatgctgtgtgcccctccttttatgtggcgaacacaacctgccccgtatggtgcctaactctcctgtgaaccctgggcttccctcatgtttaacattctggtttcctccttccttgaagtccctgtggccctcttcaaggtcctaccttcctaccctttattctttgtggttctgtacagattgatgcaattatattgcctttcctgattaagtgttccttactctgtccttgatggaggggagaagggagggcaaagaagttaaatttatttcagggcatcaaattgaatatctacttaataactttgtaaactgtaaagtgacatacatataattgtaaagtactgttaattttatctaataatta

SEQ ID NO: 203359 - DNA, 544 bp, Homo sapiens
  Payload ID: 20100
  Gene Name: zinc finger protein 655
  ENST ID: ENST00000449244
  CDS Start-End: 147-536
aagtgccaccgagaagcgccggcctcggggctgtctacagcggcccgggagaggctgtggtggccccgagcgcgagtgtgtaggtgacaggacagcggccaggcccgcccctcccctcgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactggggctccacctgttcctcaggtgcctgctcttccccgtgagggaagcccaggagaccaggcagctgcgctcttgacagccaggtaccagccaggatgtgttatttcaggagtttgtgacattcgaggatgtggctgtgcaccttactcgagaggaatggggatacctggaccctgttcagagggacctctacagagaagtgatgttagagaattatgggaacgtggtctcactgggatttccaatttccaagcctgatgggatct

SEQ ID NO: 203360 - DNA, 1815 bp, Homo sapiens
  Payload ID: 20100
  Gene Name: zinc finger protein 655
  Uniprot ID: Q8N720
  ENST ID: ENST00000493277
  CDS Start-End: 98-1678
agaggctgtggtggccccgagcgcgagtgtgtaggtgacaggacagcggccaggcccgcccctcccctcgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactgggggatttccaatttccaagcctgatgggatctcccagctggaacaggatctacaggtctttgatctggaaactaagactagagaagtcttaagagatgactgctcagatggagagaccagagaagagaacaagctgttgattcctaagcagaaaatttcggaagaagtgcattcatacaaagtgagagtaggaagactcaaacacgatattacccaagttcctgagactagagaagtgtataagtctgaggacagattagaaagacttcaggaaattctaaggaaatttctgtacctggagagagagtttaggcaaataacaatcagcaaggaaaccttcaccagtgagaagaacaatgaatgtcatgaacccgaaaaaagcttcagtctggactctactattgatgcagatcagagagttcttagaatacagaataccgatgacaatgataagtatgacatgagcttcaaccagaattcagcctctggtaaacatgaacacttaaatctaacagaggattttcagagtagtgaatgtaaggaaagcttaatggatctctcccaccttaataaatgggagagcatccctaacactgagaaatcctataaatgtgatgtatgtgggaaaattttccatcagagctcagcccttactagacatcagagaatccatactagagagaagccctacaaatgtaaagaatgtgaaaagtctttcagtcagagctcaagtcttagtcgacataaaagaatacacactagagaaaaaccttacaaatgtgaagcatctgataaatcctgtgaagcgtctgataaatcctgtagtccaagctcaggcataattcagcataagaaaattcacaccagagccaaatcttacaaatgtagcagttgtgaaagagtcttcagtcgtagtgtccaccttactcaacatcagaaaattcacaaagagatgccctgtaagtgtactgtatgtggcagtgacttctgccatacttcatacctacttgaacatcagagggtccatcatgaagagaaagcctatgagtatgatgaatatgggttggcctatattaaacaacaaggaattcatttcagagaaaagccctatacgtgtagtgaatgtggaaaagacttcagattgaattcacatcttattcagcatcaaagaattcacacaggagagaaagcacatgaatgtaatgaatgtggaaaagctttcagtcaaacctcatgccttattcagcatcacaaaatgcataggaaagagaaatcgtatgaatgtaatgagtatgagggcagtttcagtcatagctcagatcttatcctgcaacaagaagtcctcaccagacagaaagcctttgattgtgatgtatgggaaaagaactccagtcagagagcacatctagttcaacatcagagcattcataccaaagagaactcatgaatgtaatgaagatgggaagatatttatcaaattcaggcttcattcagcatctgagagttcacaccagggagaaatcatgtatgtactgcatgtggtaaagccttcagtcatagctcagccattgctcagcatcagat

SEQ ID NO: 203361 - DNA, 705 bp, Homo sapiens
  Payload ID: 20100
  Gene Name: zinc finger protein 655
  ENST ID: ENST00000626122
  CDS Start-End: 394-705
cagtgagttagcatggagggcagtgggaccggaaaaagacgtggaaaagctgcgaaaacgagccttcgaatcatggacgcgcgggcccagctcctcctccgagttcctcatccggggccgtcactcacatccggggccctcactcacatccgggaccctcatccggggctctcacccacatccgggaccctcatgcctgggcggaggagggggggccctcattcgggaccctgcactccgtcgccggaagtgccaccgagaagcgccggcctcggggctgtctacagcggcccgggagaggctgtggtggccccgagcgcgagtgtgtaggtgacaggacagcggccaggcccgcccctcccctcgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactggggctccacctgttcctcaggtgcctgctcttccccgtgagggaagcccaggagaccaggcagctgcgctcttgacagccaggtaccaggatttccaatttccaagcctgatgggatctcccagctggaacaggatctacaggtctttgatctggaaactaagactagagaagtcttaa

SEQ ID NO: 203362 - DNA, 2030 bp, Homo sapiens
  Payload ID: 20101
  Gene Name: zinc finger protein 658
  ENST ID: ENST00000619925
  CDS Start-End: 238-2030
ctcgacccaggaagtccagctggcttcacctctcaggcacatgaataggattacatgctccttgattacagtggggttatgtcgcagtaaaaccattatcaagtcgaaccatctcatgtcagggaccatctctgtaagaactgagaggcagaccaggtctctcatgaccccactgctctttcctcctccccagctgaacctccacagtcctctacactcttccaggagcagcagaaaatgaacatgtctcaggcatcagtgtcattccaggacgtgactgtggaattcacccgggaggagtggcagcacctgggccctgtcgagaggacgctgtacagagatgtgatgctggagaactacagccacctcatctcagtgggatattgcattactaaacctaaggtgatctccaagttggagaaaggagaagagccatggtctttagaagatgaattcctgaaccagaggtacccagggtattttaaagttgatcacatcaaagggatccgggaaaaacaagaaaaacctctgtggcaagaaatattcatcagtgatgctgacaaaacattgagtaaagaaggacagaaagttttagaaaaaccatttaatctggaaatagctccagagctttcagaaaaaatatcctgtaaatgtgactcacacagaatgaatttgccagttgcttctcaattaattataagtgaaagaaaatattcaagaaagaagactgaatacatgaatgtgtgtgagaaactgcagcttgatattaagcatgagaaagctcatgctgaagagaaatcttatgaacatggtgaaaatgctaaagctttcagttataagaaagatcagcattggaaatttcaaactttggaggaatcttttgaatgtgatggatctggacaaggtttatatgataagacaatttgtattacacctcagagttttctaacaggagaaaagtcctgtaaggatgatgaatttagaaaaaactttgataaaatcactttatttaaccacatgagaactgacacaagggggaaatgctctgatcttaatgaatatgggacatcctgtgacaaaaccaccgctgttgaatacaataaagttcacatggctatgacacactatgagtgtaatgaaagggggattaatttcagtaggaagtcacccctcactcaatctcagagaactattacaggatggagtgcttttgaaagcaataaatgtgaagaaaattttagccagagctcagcccatatagtacatcagaaaacacaagctggagataaatttggtgaacataatgaatgtacagatgccctctaccagaaattagactttacagcacatcagagaattcacacagaagataaattctacctttctgatgaacatgggaaatgcagaaaatccttttaccggaaagcacacctcattcagcatcagaggccccactcaggagagaaaacttaccaatatgaggaatgtgcaaaatccttttgttcaagttcacatcctattcagcatcctggaacttatgtgggattcaaactttatgaatgtaatgaatgtgggaaagctttctgtcagaattcaaacctcagtaaacatctgagaattcacacaaaagagaaaccttgtgataacaatggctgtgggagatcttacaagtcacccctcataggacaccagaaaacagatgcagagatggaactctgtggtggcagtgaatatgggaagacatcacatctcaaaggacatcagagaattctcatgggggagaaaccctatgaatgtattgaatgtgggaaaactttctccaagacatcacatctcagagcacatcagagaattcacacaggtgaaaaaccctatgaatgtgttgaatgtgagaaaactttctctcacaagacacacctcagtgtacatcagagagttcacacaggggagaaaccctatgaatgtaatgactgtgggaaatcttttacctataactcagccctgagagcacatcaaagaattcacacagg

SEQ ID NO: 203363 - DNA, 2262 bp, Homo sapiens
  Payload ID: 20101
  Gene Name: zinc finger protein 658
  Uniprot ID: Q5TYW1
  ENST ID: ENST00000622180
  CDS Start-End: 238-2091
ctcgacccaggaagtccagctggcttcacctctcaggcacatgaataggattacatgctccttgattacagtggggttatgtcgcagtaaaaccattatcaagtcgaaccatctcatgtcagggaccatctctgtaagaactgagaggcagaccaggtctctcatgaccccactgctctttcctcctccccagctgaacctccacagtcctctacactcttccaggagcagcagaaaatgaacatgtctcaggcatcagtgtcattccaggacgtgactgtggaattcacccgggaggagtggcagcacctgggccctgtcgagaggacgctgtacagagatgtgatgctggagaactacagccacctcatctcagtgggatattgcattactaaacctaaggtgatctccaagttggagaaaggagaagagccatggtctttagaagatgaattcctgaaccagaggtacccagggtattttaaagttgatcacatcaaagggatccgggaaaaacaagaaaaacctctgtggcaagaaatattcatcagtgatgctgacaaaacattgagtaaagaaggacagaaagttttagaaaaaccatttaatctggaaatagctccagagctttcagaaaaaatatcctgtaaatgtgactcacacagaatgaatttgccagttgcttctcaattaattataagtgaaagaaaatattcaagaaagaagactgaatacatgaatgtgtgtgagaaactgcagcttgatattaagcatgagaaagctcatgctgaagagaaatcttatgaacatggtgaaaatgctaaagctttcagttataagaaagatcagcattggaaatttcaaactttggaggaatcttttgaatgtgatggatctggacaaggtttatatgataagacaatttgtattacacctcagagttttctaacaggagaaaagtcctgtaaggatgatgaatttagaaaaaactttgataaaatcactttatttaaccacatgagaactgacacaagggggaaatgctctgatcttaatgaatatgggacatcctgtgacaaaaccaccgctgttgaatacaataaagttcacatggctatgacacactatgagtgtaatgaaagggggattaatttcagtaggaagtcacccctcactcaatctcagagaactattacaggatggagtgcttttgaaagcaataaatgtgaagaaaattttagccagagctcagcccatatagtacatcagaaaacacaagctggagataaatttggtgaacataatgaatgtacagatgccctctaccagaaattagactttacagcacatcagagaattcacacagaagataaattctacctttctgatgaacatgggaaatgcagaaaatccttttaccggaaagcacacctcattcagcatcagaggccccactcaggagagaaaacttaccaatatgaggaatgtgcaaaatccttttgttcaagttcacatcctattcagcatcctggaacttatgtgggattcaaactttatgaatgtaatgaatgtgggaaagctttctgtcagaattcaaacctcagtaaacatctgagaattcacacaaaagagaaaccttgtgataacaatggctgtgggagatcttacaagtcacccctcataggacaccagaaaacagatgcagagatggaactctgtggtggcagtgaatatgggaagacatcacatctcaaaggacatcagagaattctcatgggggagaaaccctatgaatgtattgaatgtgggaaaactttctccaagacatcacatctcagagcacatcagagaattcacacaggtgaaaaaccctatgaatgtgttgaatgtgagaaaactttctctcacaagacacacctcagtgtacatcagagagttcacacaggggagaaaccctatgaatgtaatgactgtgggaaatcttttacctataactcagccctgagagcacatcaaagaattcacacagggcttgctgtctgtcatgttggtatcttaatggctaccaagagtctgtttcatcagtcgtaaggtctctgttttaatgttaaatgctggtcagctgtgcctgaatcccaaaggaacggctcaatgaagagggagtcatgaagaatttggaagagcaagtgccccagtcctatgtatttatgtctccccactgatgtacagtgctccatctgccataaatgtctattgactcaa

SEQ ID NO: 203364 - DNA, 584 bp, Homo sapiens
  Payload ID: 20101
  Gene Name: zinc finger protein 658
  ENST ID: ENST00000621015
  CDS Start-End: 294-584
aaacccagccccacctcctgccgtctgccctcccgggcctgaaagggacacggtgtccgagtctttaggtctgcgcgggagccgaggctgcgcacctgggtagagacaggatttcgccatgttgaccaggctggtcttgaactcttggcctccagcagttcacccccctcggcctcccaaactgctgggattacaggcatgatccaccatgcccggctgagtagttctttgacattagctttaatgaagctgaacctccacagtcctctacactcttccaggagcagcagaaaatgaacatgtctcaggcatcagtgtcattccaggacgtgactgtggaattcacccgggaggagtggcagcacctgggccctgtcgagaggacgctgtacagagatgtgatgctggagaactacagccacctcatctcagtgggatattgcattactaaacctaaggtgatctccaagttggagaaaggagaagagccatggtctttagaagatgaattcctgaaccagaggtacccagggtattttaaagttgatcacatcaaagggatccgggaaaaacaagaaaaacct

SEQ ID NO: 203365 - DNA, 4025 bp, Homo sapiens
  Payload ID: 20101
  Gene Name: zinc finger protein 658
  Uniprot ID: Q5TYW1
  ENST ID: ENST00000621410
  CDS Start-End: 153-3332
gcatgtgtaaacccagccccacctcctgccgtctgccctcccgggcctgaaagggacacggtgtccgagtctttaggtctgcgcgggagccgaggctgcgcacctgggctgaacctccacagtcctctacactcttccaggagcagcagaaaatgaacatgtctcaggcatcagtgtcattccaggacgtgactgtggaattcacccgggaggagtggcagcacctgggccctgtcgagaggacgctgtacagagatgtgatgctggagaactacagccacctcatctcagtgggatattgcattactaaacctaaggtgatctccaagttggagaaaggagaagagccatggtctttagaagatgaattcctgaaccagaggtacccagggtattttaaagttgatcacatcaaagggatccgggaaaaacaagaaaaacctctgtggcaagaaatattcatcagtgatgctgacaaaacattgagtaaagaaggacagaaagttttagaaaaaccatttaatctggaaatagctccagagctttcagaaaaaatatcctgtaaatgtgactcacacagaatgaatttgccagttgcttctcaattaattataagtgaaagaaaatattcaagaaagaagactgaatacatgaatgtgtgtgagaaactgcagcttgatattaagcatgagaaagctcatgctgaagagaaatcttatgaacatggtgaaaatgctaaagctttcagttataagaaagatcagcattggaaatttcaaactttggaggaatcttttgaatgtgatggatctggacaaggtttatatgataagacaatttgtattacacctcagagttttctaacaggagaaaagtcctgtaaggatgatgaatttagaaaaaactttgataaaatcactttatttaaccacatgagaactgacacaagggggaaatgctctgatcttaatgaatatgggacatcctgtgacaaaaccaccgctgttgaatacaataaagttcacatggctatgacacactatgagtgtaatgaaagggggattaatttcagtaggaagtcacccctcactcaatctcagagaactattacaggatggagtgcttttgaaagcaataaatgtgaagaaaattttagccagagctcagcccatatagtacatcagaaaacacaagctggagataaatttggtgaacataatgaatgtacagatgccctctaccagaaattagactttacagcacatcagagaattcacacagaagataaattctacctttctgatgaacatgggaaatgcagaaaatccttttaccggaaagcacacctcattcagcatcagaggccccactcaggagagaaaacttaccaatatgaggaatgtgcaaaatccttttgttcaagttcacatcctattcagcatcctggaacttatgtgggattcaaactttatgaatgtaatgaatgtgggaaagctttctgtcagaattcaaacctcagtaaacatctgagaattcacacaaaagagaaaccttgtgataacaatggctgtgggagatcttacaagtcacccctcataggacaccagaaaacagatgcagagatggaactctgtggtggcagtgaatatgggaagacatcacatctcaaaggacatcagagaattctcatgggggagaaaccctatgaatgtattgaatgtgggaaaactttctccaagacatcacatctcagagcacatcagagaattcacacaggtgaaaaaccctatgaatgtgttgaatgtgagaaaactttctctcacaagacacacctcagtgtacatcagagagttcacacaggggagaaaccctatgaatgtaatgactgtgggaaatcttttacctataactcagccctgagagcacatcaaagaattcacacaggtgagaagccctatgaatgcagtgactgtgagaaaacttttgcccataattcagccctcagagcacatcatagaattcacacgggggagaaaccttatgaatgtaatgaatgtggaaggtcttttgcccatatttctgttctcaaggcacatcaaagaattcacacaggggagaaaccctatgaatgtaatgaatgtgggagatctttcacctacaattcagccctgagagcacatcagagaattcacacaggtagaaaaccctatgaatgtagtgactgtgagaaaacttttgcccataattcagccctcaaaatacatcagagaattcacacgggggagaaaccctatgaatgtaatgaatgtgagaaaacatttgcccataattcagcccttagagcacatcagaatatccacacaggggagaaactctatgaatgtagtgaatgtggaaaaacttttttccagaagacacgcctcagtacacatcggagaattcacacaggggagaaaccctatgaatgtagcaagtgtgggaaaactttctcccagaaatcatacctcagtggacatgagagaattcacacaggggaaaaaccgtatgaatgtaacgtatgtgggaaaacttttgtctataaggcagccctcatagtgcatcaaagaattcacacaggggagaaaccctatgaatgtaaccaatgtgggaaaactttctcccaaagaacacacctctgtgcacatcagagaattcatactggggaaaaaccctatgagtgtaatgaatgtgggaaaacgtttgctgataattcagccctcagggcacatcacagaattcacacaggggagaaaccctatgaatgtaatgactgtgggaagactttctccaagacatcacatctcagagcacatcttagaactcgctcaggggagaaaccctatgaatgcagtgaatgtgggaaaaccttctctgagaagtcatatgttagtgcacatcagagagttcatacgggggagaaaccctacgaatgtaatgtatgtgggaagccatttgcccataattcaaccctcagagtacatcaaagaattcacacaggggagaaatcctatgaatgtaatgattgtgggaaaacgttctcccagaaatcacaccttagtgcacaccagagaattcacacaggggagaaaccctatgagtgtaatgaatgcggaaaagcttttgcccaaaattcaactctcagagtacaccagagaattcacacaggggagaaaccctatgaatgtgatgaatgtgggaaaacttttgtccgtaaggcagctcttagggtacatcacaccagaatgcataccagagagaaaaccctagcatgtaatggatttgggaagtcctgagggaatgcataccttaccacataacacgtagtgcagaaactcatgtgacataggctgggaacttgtttcccttatccatttcctttttcattaggctcatagtttgtggaaaaatcccaatatgccgtttattcaggtggggctgaccatgggatgtggtgctaatgataaatattacatttacccttggcccttaaaaaaaaaaaagaaaaaccctcacagtcttcctggttcataagatggatttggaggttatttctgcagcaaacttgggtcctgtgtgttcaaaaccatagagcacaaggtcaaggaagctagagtctgaaaaacgaacaattcacttccaggtcttcatcagggttttgtttttgttgctttaaagcaagagttaagtttatagtctgttaagctcttacaaatttggcttattagttaaatggacgtagtttagcttaaactttatgttagagtgagatgaaaccctatgaatataatcagttttagaaaaactaatcagtttattgtgcatcagagacgtcacatgaagaagaaaacttgtcgacatccaggatgatcaggagccttcattaaaacagaaattttagggaaaaccacaaaaaccttcgtaaagtgaattgcattaaacatcaattataataaaatttcatattttgaataaatgacatttttcct

SEQ ID NO: 203366 - DNA, 4160 bp, Homo sapiens
  Payload ID: 20101
  Gene Name: zinc finger protein 658
  Uniprot ID: Q5TYW1
  ENST ID: ENST00000612867
  CDS Start-End: 301-3480
aacccagccccacctcctgccgtctgccctcccgggcctgaaagggacacggtgtccgagtctttaggtctgcgcgggagccgaggctgcgcacctggggcacatgaataggattacatgctccttgattacagtggggttatgtcgcagtaaaaccattatcaagtcgaaccatctcatgtcagggaccatctctgtaagaactgagaggcagaccaggtctctcatgaccccactgctctttcctcctccccagctgaacctccacagtcctctacactcttccaggagcagcagaaaatgaacatgtctcaggcatcagtgtcattccaggacgtgactgtggaattcacccgggaggagtggcagcacctgggccctgtcgagaggacgctgtacagagatgtgatgctggagaactacagccacctcatctcagtgggatattgcattactaaacctaaggtgatctccaagttggagaaaggagaagagccatggtctttagaagatgaattcctgaaccagaggtacccagggtattttaaagttgatcacatcaaagggatccgggaaaaacaagaaaaacctctgtggcaagaaatattcatcagtgatgctgacaaaacattgagtaaagaaggacagaaagttttagaaaaaccatttaatctggaaatagctccagagctttcagaaaaaatatcctgtaaatgtgactcacacagaatgaatttgccagttgcttctcaattaattataagtgaaagaaaatattcaagaaagaagactgaatacatgaatgtgtgtgagaaactgcagcttgatattaagcatgagaaagctcatgctgaagagaaatcttatgaacatggtgaaaatgctaaagctttcagttataagaaagatcagcattggaaatttcaaactttggaggaatcttttgaatgtgatggatctggacaaggtttatatgataagacaatttgtattacacctcagagttttctaacaggagaaaagtcctgtaaggatgatgaatttagaaaaaactttgataaaatcactttatttaaccacatgagaactgacacaagggggaaatgctctgatcttaatgaatatgggacatcctgtgacaaaaccaccgctgttgaatacaataaagttcacatggctatgacacactatgagtgtaatgaaagggggattaatttcagtaggaagtcacccctcactcaatctcagagaactattacaggatggagtgcttttgaaagcaataaatgtgaagaaaattttagccagagctcagcccatatagtacatcagaaaacacaagctggagataaatttggtgaacataatgaatgtacagatgccctctaccagaaattagactttacagcacatcagagaattcacacagaagataaattctacctttctgatgaacatgggaaatgcagaaaatccttttaccggaaagcacacctcattcagcatcagaggccccactcaggagagaaaacttaccaatatgaggaatgtgcaaaatccttttgttcaagttcacatcctattcagcatcctggaacttatgtgggattcaaactttatgaatgtaatgaatgtgggaaagctttctgtcagaattcaaacctcagtaaacatctgagaattcacacaaaagagaaaccttgtgataacaatggctgtgggagatcttacaagtcacccctcataggacaccagaaaacagatgcagagatggaactctgtggtggcagtgaatatgggaagacatcacatctcaaaggacatcagagaattctcatgggggagaaaccctatgaatgtattgaatgtgggaaaactttctccaagacatcacatctcagagcacatcagagaattcacacaggtgaaaaaccctatgaatgtgttgaatgtgagaaaactttctctcacaagacacacctcagtgtacatcagagagttcacacaggggagaaaccctatgaatgtaatgactgtgggaaatcttttacctataactcagccctgagagcacatcaaagaattcacacaggtgagaagccctatgaatgcagtgactgtgagaaaacttttgcccataattcagccctcagagcacatcatagaattcacacgggggagaaaccttatgaatgtaatgaatgtggaaggtcttttgcccatatttctgttctcaaggcacatcaaagaattcacacaggggagaaaccctatgaatgtaatgaatgtgggagatctttcacctacaattcagccctgagagcacatcagagaattcacacaggtagaaaaccctatgaatgtagtgactgtgagaaaacttttgcccataattcagccctcaaaatacatcagagaattcacacgggggagaaaccctatgaatgtaatgaatgtgagaaaacatttgcccataattcagcccttagagcacatcagaatatccacacaggggagaaactctatgaatgtagtgaatgtggaaaaacttttttccagaagacacgcctcagtacacatcggagaattcacacaggggagaaaccctatgaatgtagcaagtgtgggaaaactttctcccagaaatcatacctcagtggacatgagagaattcacacaggggaaaaaccgtatgaatgtaacgtatgtgggaaaacttttgtctataaggcagccctcatagtgcatcaaagaattcacacaggggagaaaccctatgaatgtaaccaatgtgggaaaactttctcccaaagaacacacctctgtgcacatcagagaattcatactggggaaaaaccctatgagtgtaatgaatgtgggaaaacgtttgctgataattcagccctcagggcacatcacagaattcacacaggggagaaaccctatgaatgtaatgactgtgggaagactttctccaagacatcacatctcagagcacatcttagaactcgctcaggggagaaaccctatgaatgcagtgaatgtgggaaaaccttctctgagaagtcatatgttagtgcacatcagagagttcatacgggggagaaaccctacgaatgtaatgtatgtgggaagccatttgcccataattcaaccctcagagtacatcaaagaattcacacaggggagaaatcctatgaatgtaatgattgtgggaaaacgttctcccagaaatcacaccttagtgcacaccagagaattcacacaggggagaaaccctatgagtgtaatgaatgcggaaaagcttttgcccaaaattcaactctcagagtacaccagagaattcacacaggggagaaaccctatgaatgtgatgaatgtgggaaaacttttgtccgtaaggcagctcttagggtacatcacaccagaatgcataccagagagaaaaccctagcatgtaatggatttgggaagtcctgagggaatgcataccttaccacataacacgtagtgcagaaactcatgtgacataggctgggaacttgtttcccttatccatttcctttttcattaggctcatagtttgtggaaaaatcccaatatgccgtttattcaggtggggctgaccatgggatgtggtgctaatgataaatattacatttacccttggcccttaaaaaaaaaaaagaaaaaccctcacagtcttcctggttcataagatggatttggaggttatttctgcagcaaacttgggtcctgtgtgttcaaaaccatagagcacaaggtcaaggaagctagagtctgaaaaacgaacaattcacttccaggtcttcatcagggttttgtttttgttgctttaaagcaagagttaagtttatagtctgttaagctcttacaaatttggcttattagttaaatggacgtagtttagcttaaactttatgttagagtgagatgaaaccctatgaatataatcagttttagaaaaactaatcagtttattgtgcatcagagacgtcacatgaagaagaaaacttgtcgacatccaggatgatcaggagccttcattaaaacagaaattttagggaaaaccacaaaaaccttcgtaaagtgaattgcattaaacatcaattataataaaatttcatattttgaataaa

SEQ ID NO: 203367 - DNA, 698 bp, Homo sapiens
  Payload ID: 20101
  Gene Name: zinc finger protein 658
  ENST ID: ENST00000619435
  CDS Start-End: 461-698
gggagccgaggctgcgcacctggggtgagagcgtcggtgacagggctccgcgcggcccaggaacctggggacgggcgggcttgtgtgcggaggacagcagcaggcagtctcaggagtccccaggatggccctcccctctcctccccggcccagtgcgcgggcccaggccgagtcctgtccgcaggtgtaggggctgccgggccccgcggggttgcgggccgggaagaggaaatgtgcgtggatgaggttgacggcgaacaggaggagtagagacaggatttcgccatgttgaccaggctggtcttgaactcttggcctccagcagttcacccccctcggcctcccaaactgctgggattacaggcatgatccaccatgcccggctgagtagttctttgacattagctttaatgaagctgaacctccacagtcctctacactcttccaggagcagcagaaaatgaacatgtctcaggcatcagtgtcattccaggacgtgactgtggaattcacccgggaggagtggcagcacctgggccctgtcgagaggacgctgtacagagatgtgatgctggagaactacagccacctcatctcagtgggatattgcattactaaacctaaggtgatctccaagttggagaaaggagaagagccatggtctttagaagatgaattcctgaaccagaggtacccag

SEQ ID NO: 203368 - DNA, 642 bp, Homo sapiens
  Payload ID: 20101
  Gene Name: zinc finger protein 658
  ENST ID: ENST00000616544
  CDS Start-End: 176-642
aaacccagccccacctcctgccgtctgccctcccgggcctgaaagggacacggtgtccgagtctttaggtctgcgcgggagccgaggctgcgcacctggggacgtgactgtggaattcacccgggaggagtggcagcacctgggccctgtcgagaggacgctgtacagagatgtgatgctggagaactacagccacctcatctcagtgggatattgcattactaaacctaaggtgatctccaagttggagaaaggagaagagccatggtctttagaagatgaattcctgaaccagaggtacccagggtattttaaagttgatcacatcaaagggatccgggaaaaacaagaaaaacctctgtggcaagaaatattcatcagtgatgctgacaaaacattgagtaaagaaggacagaaagttttagaaaaaccatttaatctggaaatagctccagagctttcagaaaaaatatcctgtaaatgtgactcacacagaatgaatttgccagttgcttctcaattaattataagtgaaagaaaatattcaagaaagaagactgaatacatgaatgtgtgtgagaaactgcagcttgatattaagcatgagaaagctcatgctgaagagaaatcttatgaacatgg

SEQ ID NO: 203369 - DNA, 1120 bp, Homo sapiens
  Payload ID: 20102
  Gene Name: zinc finger protein 66
  ENST ID: ENST00000360204
  CDS Start-End: 242-415
gtctctccctgcagctggagctccaggtcgtctgttcactgctctctgtcttcttctcctagaggcccagcctctgtggccctgtgtcctgcaggtattgggagatccacagctaagacgccaggaccccctggaagcctagaaatggtgagagtgccggtccagcatcccgagagaggggccattgcaatttagagatgtggccatagaattctctctggaggagtggcattgcctggacatggcacagcggaatttatatagggatgtgatgttagagaactacagaaacctggtctttcttggtattgttgtctcaaagccagacctcatcacccatctggagcaaggaaaaaaaccttcgactatgcagagacatgagatggtagccaacccctcaggtaggtgtgagtgaaaatgaatacaacagacaacacagtaagaagtccaaggtcaaaaagaaagccagtccttaaggtgtgattctggaagctgtgttccaaaggaacttctgggcagctgttttttttgttttttgtttttgtttttgttgttttaaattttgctgtcacaaaggggcatattgtcttatgcttctaaattctctaaaaattctacttttctctcagtgagcttccttcacattcacagtgagagccaaagtcctcttcatgacatataagagacagcacaatccagctgctttttcattgttttggggacacacaaatatcttcctaattttgagaaactgaaactattttttagttttctttttgtatccggtctgaaatttgtgagagtagtagtttctgttgcatttttttttgttcatttttgtgcacagtccattctatttttattactatatagtcttgaaatatagtttgaaattgtaagtacgatattctgttttcttctttttcctcaagattgctttggctattcaaagtttattttagtttcatgtaaattttagaattgtattttccattattgtaaaaaaaaacactgcaattttaataggaagattattgagtctgtaaatcactttggataatatgattctttaataatatttattcttttaattcattgacataaaatattttaaaattaa

SEQ ID NO: 203370 - DNA, 1745 bp, Homo sapiens
  Payload ID: 20102
  Gene Name: zinc finger protein 66
  Uniprot ID: Q6ZN08
  ENST ID: ENST00000344519
  CDS Start-End: 24-1745
caggaccccctggaagcctagaaatggggccattgcaatttagagatgtggccatagaattctctctggaggagtggcattgcctggacatggcacagcggaatttatatagggatgtgatgttagagaactacagaaacctggtctttcttggtattgttgtctcaaagccagacctcatcacccatctggagcaaggaaaaaaaccttcgactatgcagagacatgagatggtagccaacccctcagttttgtgttctcattttaaccaagacctttggccagagcagagcataaaagattctttccaaaaactgatactgagaaggcataaaaaatgtggacatgataatttgcagttaaaaaaaggctgtgaaagtgtggataagtgtaaagtgcacaaaagaggttataatggacttaaccaatgtttgacaactacccaaagcaaaatgtttcaatgtgataaacatgggaaagtctttcatcaattttcaaatacaaacagacataagataagacatactggaaaaaacccttgcaaatttacagaatgtggcaaagcttttaaccggtcctcaacctttactacacataagaaaattcatactggagagaaaccctataaatgtatagaatgtggcaaagccttcaaccggtcctcacaccttactacacataagataattcatactggagagaaacggtacaaatgtgaagactgtggcaaagcctttaaccgctcctctaaccttactacacataagaaaattcatactggagagaaaccctacaaatgtgaagaatgtggcaaggcctttaagcgctcctctatccttactacacataagagaattcatactggagagaaaccctacaaatgtgaagaatgtggcaaagtttttaagtacctttcttccctttctacacataagataattcatactggagagaaaccctacaaatgtgaagaatgtggtaaagccttcaactggtcctcacaccttactacacataagagaattcatactggagagaaaccctacaaatgtgaagaatgtggcaaaggctttaagtactcctctacccttactaaacataaaataatccatactggagagaaaccctacaaatgtgaagaatgtggtgaagcctttaagtactcctgttcccttactgcacataagataattcatactggaaagaaaccttacaaatgtgaagaatgtggcaaagtgtttaagcactcctctcccctttctaaacataagagaattcatactggagagaaaccctacaaatgtgaagaatgtggcaaagccttcagtcggtcctctattcttactacacataagataattcacactggagagaaaccctacgaatgtgaagactgtggcaaagcctttaaccgctcctctaaccttactaaacacaagaaaattcatactggagagaagccttacaaatgtgaagaatgtggcaaggcctttaagtgctcctctattcttactacacataagagaattcatactgcagataaaccctacaaatgtgaagaatgtggcaaagactttaagtactcctctacccttactagacataagaaaattcatactggagggaaaccacacaagtgcaataaatgtggcaaagcctttatttcatcctcaaaccttagtagacatgagataattcatatgggagggaatccctacaaatgtgaaaatgtggcaaagccttag

SEQ ID NO: 203371 - DNA, 757 bp, Homo sapiens
  Payload ID: 20102
  Gene Name: zinc finger protein 66
  ENST ID: ENST00000594534
  CDS Start-End: 139-756
ccctgcagctggagctccaggtcgtctgttcactgctctctgtcttcttctcctagaggcccagcctctgtggccctgtgtcctgcaggtattgggagatccacagctaagacgccaggaccccctggaagcctagaaatggggccattgcaatttagagatgtggccatagaattctctctggaggagtggcattgcctggacatggcacagcggaatttatatagggatgtgatgttagagaactacagaaacctggtctttcttggtattgttgtctcaaagccagacctcatcacccatctggagcaaggaaaaaaaccttcgactatgcagagacatgagatggtagccaacccctcaggtcctgtgttgcatattttgtttttttgttgttgttttctttctttctttctttttctttctttcttttttttttttttgagatggaatcttgctctgttgcccaggctaaagtgcagtggtgcgatctcagctcactgcaagctctgccttctgggttcaagtgattcccctacctcagcctcccaagtagctgggattacaggtgcacgtcacatcgccaaggtaatttttgtgtttttagtagaaatggtatttcaccatgttggccaggctcgtctcaaactcctgacctcaggttatctgcccacctcaacctcccaaagtgctaggattacaggcttgagctactgcacctggcctgtgttacatattttagatatagatttataaa

SEQ ID NO: 203372 - DNA, 1806 bp, Homo sapiens
  Payload ID: 20102
  Gene Name: zinc finger protein 66
  ENST ID: ENST00000452874
  CDS Start-End: 1-1806
atggggccattgcaatttagagatgtggccatagaattctctctggaggagtggcattgcctggacatggcacagcggaatttatatagggatgtgatgttagagaactacagaaacctggtctttcttggtattgttgtctcaaagccagacctcatcacccatctggagcaaggaaaaaaaccttcgactatgcagagacatgagatggtagccaacccctcagttttgtgttctcattttaaccaagacctttggccagagcagagcataaaagattctttccaaaaactgatactgagaagacataaaaaatgtggacatgataatttgcagttaaaaaaaggctgtgaaagtgtggataagtgtaaagtgcacaaaagaggttataatggacttaaccaatgtttgacaactacccaaagcaaaatgtttcaatgtgataaacatgggaaagtctttcatcaattttcaaatacaaacagacataagataagacatactggaaaaaaccctttcaaatttacagaatgtggcaaagcttttaaccggtcctcaacccttactacacataagaaaattcatactggagagaaaccctataaatgtatagaatgtggcaaagccttcaaccggtcctcacaccttactacacataagataattcatactggagagaaacggtacaaatgtgaagactgtggcaaagcctttaaccgctcctctaaccttactacacataagaaaattcatactggagagaaaccctacaaatgtgaagaatgtggcaaggcctttaagcgctcctctatccttactacacataagagaattcatactggagagaaaccctacaaatgtgaagaatgtggcaaagtttttaagtacctttcttccctttctacacataagataattcatactggagagaaaccctacaaatgtgaagaatgtggtaaagccttcaactggtcctcacaccttactacacataagagaattcatactggagagaaaccctacaaatgtgaagaatgtggcaaaggctttaagtactcctctacccttactaaacataaaataatccatactggagagaaaccctacaaatgtgaagaatgtggtgaagcctttaagtactcctgttcccttactgcacataagataattcatactggaaagaaaccttacaaatgtgaagaatgtggcaaagtgtttaagcactcctctcccctttctaaacataagagaattcatgctggagagaaaccctacaaatgtgaagaatgtggcaaagccttcagtcggtcctctattcttactacacataagataattcacactggagagaaaccctacgaatgtgaagactgtggcaaagcctttaaccgctcctctaaccttactaaacacaagaaaattcatactggagagaagccttacaaatgtgaagaatgtggcaaggcctttaagtgctcctctattcttactacacataagagaattcatactgcagataaaccctacaaatgtgaagaatgtggcaaagactttaagtactcctctacccttactagacataagagaattcatactggagagaaaccctacaaatgtgaagaatgtggcaaagcttttaatcatcccgcaacccttttttcacataagaaaattcatactggagggaaaccacacaagtgcaataaatgtggcaaagcctttatttcatcctcaaaccttagtagacatgagataattcatatgggagggaatccctacaaatgtgaaaatgtggcaaagccttag

SEQ ID NO: 203373 - DNA, 1120 bp, Homo sapiens; identical to SEQ ID NO: 203369
  Payload ID: 20102
  Gene Name: zinc finger protein 66
  ENST ID: ENST00000615930
  CDS Start-End: 242-415

SEQ ID NO: 203374 - DNA, 774 bp, Homo sapiens
  Payload ID: 20102
  Gene Name: zinc finger protein 66
  ENST ID: ENST00000623857
  CDS Start-End: 139-462
ccctgcagctggagctccaggtcgtctgttcactgctctctgtcttcttctcctagaggcccagcctctgtggccctgtgtcctgcaggtattgggagatccacagctaagacgccaggaccccctggaagcctagaaatggggccattgcaatttagagatgtggccatagaattctctctggaggagtggcattgcctggacatggcacagcggaatttatatagggatgtgatgttagagaactacagaaacctggtctttcttggtattgttgtctcaaagccagacctcatcacccatctggagcaaggaaaaaaaccttcgactatgcagagacatgagatggtagccaacccctcaggtcctgtgttgcatattttgtttttttgttgttgttttctttctttctttctttctttttctttttctttctttttttttttttttttttttttctgagatggaatcttgctctgttgcccaggctaaagtgcagtggtgcgatctcggctcactgcaagctctgccttctgggttcaagtgattcccctacctcagcctcccaagtagctgggattacaggtgcacgtcacatcgccaaggtaatttttgtgtttttagtagaaatggtatttcaccatgttggccaggctcgtctcaaactcctgacctcaggttatctgcccacctcaacctcccaaagtgctaggattacaggcttgagctactgcacctggcctgtgttacatattttagatatagatttataaa

SEQ ID NO: 203375 - DNA, 5834 bp, Homo sapiens
  Payload ID: 20103
  Gene Name: zinc finger protein 660
  Uniprot ID: Q6AZW8
  ENST ID: ENST00000322734
  CDS Start-End: 334-1329
agttccttctgcgctttgttcaagatgtgggtctggcgctttcgtgactcaagaccctcttaggaacttcttcactgaactcaaggaggagatcaggcaagatctgtgctgtgcagatcctttggattgaggctgctgtgcacaggaatatggatggtgaaactgggactgaggaggagttaattccaaagcatcattcctgaaaaatcagaatcatacatactttcaagagaattccacagagacattgcccaggaagtcaaaatttagaaggctcctctgaagggaaagagaagactagagaggacactggtatgttccaagcaggagaaaatgaggagaaagacaagaaatttcaaacataagacagttaaagacaataaagtactcacagaagggagtgaccaagaatctgaaaaagacaatagtcagtgctgtgaccctgcaacaaatgagagagttcaggctgaaaagagacagtatgtatgtactgagtgtgggaaagcctttagtcagagtgcaaacctcacagtacatgagcgaatccacacgggagagaaaccctataagtgtaaggagtgtggaaaagctttcagtcatagctctaaccttgttgttcatcggagaatccacactggactgaagccctatacatgcagtgaatgtgggaaatctttcagtggaaagtcacatcttattcggcaccagggaatccacagtggggagaaaacttatgaatgtaaagagtgtgggaaagcctttagtcggagttcgggccttatatcacatcacagagttcacaccggagagaagccctattcttgtattgagtgtgggaaagcctttagccgtagttcaaaccttactcaacatcagcgaatgcacagaggaaaaaaagtttacaaatgtaaggagtgtgggaaaacatgtggttctaatacaaagattatggaccatcagagaattcacactggagagaagccttatgaatgtgatgagtgtggaaaaactttcatcttaaggaaaactcttaatgaacaccagagacttcatcgtagagagaaaccttacaaatgtaatgagtgtgggaaggcttttacttctaatcgaaaccttgttgatcatcagagagttcacactggagagaaaccctataaatgtaatgaatgtgggaaaaccttcaggcagacttctcaagttattctacacttgagaacccacactaaggagaaaccctataaatgtagtgagtgtgggaaagcctatcggtatagttcacagcttattcaacaccagaggaaacataatgaggagaaagaaacctcataaataacaaatattgtgggtagtagggctgactgctgcttttctaaaaagtagttctttagtatcaactttaattctacttctaagaatcatactctacttctaagaaaataattagaagtagacaaagattaatgaaagggatgttcatgacagcatcatatacgactgaaagaagaaaactagattttcaacattacagggttgaaatgaatgatgagctatccatatgatggttctgcagccattgcaaacatttttaaagacaatttaatgccatggggaaatgattggataagacggaagataatgacatacaatccaaaatttaaaaaaatatttttgcataggaaaaattgagaaggaagtaaaccaaaatgttaacagtgatcatctctgggcgataggattataggtgatttctattttcttctgtatacttttctatgctttctagattatctacatgagaatatactaattttatatgcaagaaaaaaagcacagtattttttaaatgcaatgaagacgtgcttattttcactcagcagtgttatgaaaggcacgtagtatatagagcccaaagccctgggattgcaccctgacactggcatttagcagcagtggaaccgcgagcaagtcccttccttttagagcgtgtttcctgttaagtaaaatcataaacaccgatcctttgtcctttttagttttaagacaagctgactttagagttgtcaacaaaatatataataacactgttaggttaaaagaacacagcaaaaattcactgaaccctcctttcccacagttctggaaggatctgcagatgatggagaactacctaggcttcatcttttcaacatatgtctacacaaccagaaaaaaatgaaattgaaacaactgtagactcaaaaacttcagatacagtcaccagttaatataaaactagtgggagactctgccttcacatggtatatagagtttaaaggctaaaagtacaaactttggggttggagatatccatgttctaaccccagttctaccatgaactagcttgtcagttttggacaagtcacttaactgctctgagcctcagacctgtgtgtaaaaaaggaacaattacctaccttacaaggttgttgtgaggattaagtgagtaatgcatgaaatatatgataagccagacacgtggtaaatgataaaatcttaagtataggacattgtagcagtgtttctaaacactttagggagagtgattaaagagaatttttgtgtaaggtagtacttaggatattttcagatgtattgaacagaataccaagtactagcagcctagaccttaagaacattgattgattgcttaaggggaatctagaggtaagcagtgctatgtttggtttggcaactcagcacttcatcacacttctctcttaactccataattttcagcatgttgactttcatttttcataacctcatggtggcaagacagtggccacagctgcatcttgccttcacacaactccttcagattgggaactggaaaaggagctgaggctttctcatctggtttcttccttttgtcactgagaaaaatctttccctgaagaagggacggagaggtgttgagcaatcaatacaacagatgttttctatcttcctctgcctttctttatgaccagtcctccttgaaggtcttagcccatcttccaccaatatttaaaacattttaagtgcttagctcaaagtcactctgaaacacttagaatctccctatttttaactcagccattcctctgtgtatacagtgaatccctaagcccactgttatctgtcttatgcacatagtgaattagtgtttggggaatttttgataatatgttatttagttctccctctattatacaagaaaattgagtgtcattgaggttaggtgactggctagtaagttgtcggagccaggatttgagctcagatctgactttgaaattcatgctttcttcattataccaaagtgcctctgcccaccatggtggttctgtatgtgagtggaagaccagttggcgttttcccaggtagctgcctctatgaaaggtgattgtatctaacaattatttgatatttgaccatggttttatagggaagatgttatcagtgttctgtgaatggggtttatggcctatctctgtacctcataatttagttttaaggtatatatatttctttcttgctgttaccggaaagaaagaagtgaagggtgaaggttgtatatttgtgtgaaaaaaaattactgattttgtcctattttgataggatagtggtttgcacataatttgtgatataatagtcctttgcatggtcattccaagcagggtttggaaggcctggaacagatttgtagcattcatggacaagcctggtctatcattcctgagcagaattgttgatgctttatatattgctgagcagatattctctgaccaaaacattttttcaccaccatgtcatagtgcctaaaactctttatttagataggctttcttttttgtcttagaagactatgatcttcaagagtatatctcaaggaaggatatgatgccatctcataaccagagaactgaatataggagagcttcatatttcttgccccaggcaggcgaggattatagtctcttgaggaggccatcacccatcttctaggctaatacctgccttgagctgtaggaataaacacttgacagtgggttcctgcatcctttcagataaacattcagctataatttgaactgatcacccacctttctccgggagtctcccagggttaccaacttttacctcagtcagagtttaggcatgcagctcttaccatcctttcaagccctttcataataccctctggaaaccaggaactgtctcttttaatgtgctttctttttctttcttttcttttcttttcttttttttttttttttgagatggaatctcgcactgtcgcccatgctggagtgcagtggcgtgatctcagctctcagctcaccgcaacctccagctcccaggttcaagcaattctcctgcctcagcctcctgagtagctgagattacaggcacctgccaccacacccagctaatttttgtatttttaatagagatagggtttcaccatgttggccaggctgatctcgaactcctgacctcacaagatccacctgcctcggcctcccaaagtgctgggattataggcatgagccactgcacctggctttatttatatgtgtatttatttatttatttatttatgagatggagtgttgctcttgtcgcccaggctggagtgcaatggcgtgatatcggctcactgcaacctctgcctcctgggttcaagcgattctcctgtctcagcctcccaagtagctgggattacaggtacctgccaccacacctggctaattttttgtatttttagtagagacgaggttttgccatgttggtcaggctggtcttgaatgaatgtgttttcttcacattcttgttccaatggaaaccgggctgttccccaagggcagtgcttattctgcattcctcaattgctggtttatgtgtctctcaactcatgtacctctctgtactgccatttcttctctcttctccatcagaaacttagctctaatcagtcatggttgcatacacacgtagtcctaggtactcaggaggctgaggggggaggatcacttgagcccaggagttcactgttacagtgagctatgatcacaattctgcactgcagcctaggtcacggagcaagaccctgtctcagaaacaaaacagtacaaaacaaaaaacccacaaaaacccaacccagtgcttttgaaatatatatcactaaactactgtgtattgctcattcttgttatttggtttcttgtctactcacatttattcacttacagttttagtaccctgaatattcctgaggaatataaagaggcaataattttagccacagacatcctggttatatagaattgctcctgtgtagaataaaaatatatatgctctttttagttgagaggaaaatacgaaaatctcattttatatagccttgagtagagggcaatacgtaagacaaagaattctgcttagagaggaaagtgtcgccctggacttagaaatcttttttcatagatggtgcgtcctgtgttaggtattacttggaagaaaattgaagtaaaaaacagctttaagtaactgagtaattaggattaattagtagctgttgaatctaaatcccttaagactaaatttcattgcagctctgtaccctcagcaggacttcctttcttgattgttttttccatttaatataaaatttaaaagatgcccatattgtcagttgtttttagtcgccagactgtctttaatagcctctgatgttataaaactggagtcatgaaattgttttgcaggaagtagtgataattccttcaataaacgtctgctattcttataaa

SEQ ID NO: 203376 - DNA, 474 bp, Homo sapiens
  Payload ID: 20103
  Gene Name: zinc finger protein 660
  ENST ID: ENST00000416644
  CDS Start-End: 357-474
ttgcgtacttcttgtcccacagtgctgtctgcagctcatccttgagggagctaatctcctgtttcagtgactcaagaccctcttaggaacttcttcactgaactcaaggaggagatcaggcaagatctgtgctgtgcagatcctttggattgaggctgctgtgcacaggaatatggatggtgaaactgggactgaggaggagttaattccaaagcatcattcctgaaaaatcagaatcatacatactttcaagagaattccacagagacattgcccaggaagtcaaaatttagaaggctcctctgaagggaaagagaagactagagaggacactggtatgttccaagcaggagaaaatgaggagaaagacaagaaatttcaaacataagacagttaaagacaataaagtactcacagaagggagtgaccaagaatctgaaaaagacaatagtcagtgctgtgaccctgcaacaa

SEQ ID NO: 203377 - DNA, 556 bp, Homo sapiens
  Payload ID: 20103
  Gene Name: zinc finger protein 660
  ENST ID: ENST00000441021
  CDS Start-End: 455-556
agttccttctgcgctttgttcaagatgtgggtctggcgctttcgtgactcaagaccctcttaggaacttcttcactgaactcaaggaggagatcaggcaagatctgtgctgtgcagatcctttggattgaggctgctgtgcacaggaatatgggtatttcctcttattccttactccactgcacctaatcaataaccaagaaccatgtaaccattgcttagagggacttgaacaggcagatgatgctggtgaattaaaggaagacagcctccaaatggtgaaactgggactgaggaggagttaattccaaagcatcattcctgaaaaatcagaatcatacatactttcaagagaattccacagagacattgcccaggaagtcaaaatttagaaggctcctctgaagggaaagagaagactagagaggacactggtatgttccaagcaggagaaaatgaggagaaagacaagaaatttcaaacataagacagttaaagacaataaagtactcacagaagggagtgaccaagaatctgaaaaagacaatagtcagtgc

SEQ ID NO: 203378 - DNA, 474 bp, Homo sapiens; identical to SEQ ID NO: 203376
  Payload ID: 20103
  Gene Name: zinc finger protein 660
  ENST ID: ENST00000630337
  CDS Start-End: 357-474

SEQ ID NO: 203379 - DNA, 556 bp, Homo sapiens; identical to SEQ ID NO: 203377
  Payload ID: 20103
  Gene Name: zinc finger protein 660
  ENST ID: ENST00000626409
  CDS Start-End: 455-556

SEQ ID NO: 203380 - DNA, 5834 bp, Homo sapiens; identical to SEQ ID NO: 203375
  Payload ID: 20103
  Gene Name: zinc finger protein 660
  Uniprot ID: Q6AZW8
  ENST ID: ENST00000625494
  CDS Start-End: 334-1329

SEQ ID NO: 203381 - DNA, 3186 bp, Homo sapiens
  Payload ID: 20104
  Gene Name: zinc finger protein 662
  Uniprot ID: Q6ZS27
  ENST ID: ENST00000328199
  CDS Start-End: 187-1545
cgggtgtggagcacggggagtcgggcgtggggcgggcagggagtggagtcggggtcttactccggtggctgcagggcgcagggtagccgtgtcaggcctgcccaggtgcagagcgctcttccgcgaccccaacagcctctggtccggtctggcgcgccctcgctttcccagagggcgacctgggctatggcggccgtggcgctggcgagcgggacacgcctcggccttgtcctcgagctgctcccgggacagcccgcgctgccccgggcgcgccgggagtcagtgaccttcgaggatgtggccgtctacttctctgagaacgaatggatcggcctgggccctgctcagagagccctgtacagggatgtgatgctggagaattatggggctgtggcttccctggcatttccatttcccaaaccggctctgatttcccagctggagcgaggggaaacaccctggtgctcggttcctcggggagctctggatggagaggccccaaggggcatctcctcagagggtgtgttgaagaggaagaaagaagattttattctgaaggaggaaattattgaggaagcacaggacctcatggtcctatcaagtggaccccagtggtgtggatcccaggaattatggtttgggaaaacctgtgaagagaaaagcaggttagggagatggcctggttacctcaatgggggacgtatggaaagttctacaaatgatattatagaagtgattgtcaaggatgagatgatctcagtagaagagagttcagggaatactgatgtcaataacctccttggtatacatcacaaaattctaaatgagcaaatattctatatatgtgaggaatgcggcaagtgttttgatcaaaatgaggactttgatcaacaccagaaaactcataatggagagaaggtctatggatgtaaggaatgtgggaaggctttcagttttcgatcacattgcattgcacatcagagaattcacagtggggtgaaaccctatgaatgtcaagaatgtgctaaggcctttgtttggaagtcaaacctgattcgtcaccagagaatacatactggagagaaaccctttgaatgtaaggaatgtgggaagggctttagtcagaacacaagccttacgcaacatcaacggatccacactggtgagaaaccatacacatgtaaggaatgtgggaaaagctttactcgaaacccagcccttcttcgacatcagagaatgcacactggggagaagccttacgaatgtaaggactgtgggaagggcttcatgtggaactcagatctttctcagcaccagagggtccacactggggacaagcctcatgaatgtactgactgtgggaaaagcttcttttgcaaggcacatcttattcgacatcaaagaatccatactggggaaagaccctataaatgtaatgactgtgggaaggccttcagtcagaattctgtcttaattaagcaccagaggcgccatgctagagacaaaccctataactgtcagatctctcaccttcttgaacattagagagtgcataatggtgatacttgtttataattcttatgctgcaggaaccctagagacaaaatgagatgaccattcacaatttgctgtaacccttaacttaaatagccagtattatcttgcccttttgaacatttaccatgtactctagcaagactggtccctctgttctatgatgttttaacaaggcatcatttagttgggcagctactctgtatcaggtgctaaccactttacatacattaatttgcataacaatcctattaaggtaggtgctcttctccccattttacaaatgagaaatctgagttgaaagaggttataaaactcattcagggttgctcagttagtaagttatagagttgaaattggagccaggcctatctgactgcagagtttactgttctttacttaattgtacatatttatgtctctgcccatttttatttgcttattttcctgtgcttttagtttcccttcatcactcagatctagctccttcaactaagaagatctctcttcctcttctacttgtaatcagtaccacccaagttagtatttaattatgtgccatcttatatttttctaatagtctcatgtcttttaatcttaaccccagctaaatgactctgaggaccaacagtacatttcttttatgtttttcaaatcctgaaacattaatctttgactagatataacatgctcatgataaaaaagaattgaaatagttgaaaagggtgttcagtgaaaagtaaatttccttgtcattcctatctcttgagttctccccagaggcaatcactgctactggttgtgtatctctgtagatactctttgtatacaagtgtttattagtattgcttttcataattctgtctcactgaaaaccttatttgatggaagcaacattgcagttaaattgtgaactctaagaccttttcttcagaagttgctttccttttgaggccaccaaagtaatttagggaaacagcagagggtaatccaggtctttttttttttttttttttttttagacagagtctcactctgttgctctggctggagtgcagtggtgctatctcagctcactgcaagctccacctcctgggttcatgccattcttctgcctcagcctcccaagtagctgggactacaggtgcccgccaccatgcctggctaatattttttatttttagtagagacggggtttcaccatgttagccaggctggtctcgatctcctgaccttgtgatccacctgtctcggcctcccaaagtgctgggattacaggcctcagctaccacgcctggccaatccaggtcttaagagacctcattgcctttgttttatgagatatcattctgggattgggaatatgtaaactcaactggagattttttttcataaaaatttatatagttccagccctctcattgcttcctatcctaaatcctcttccagtctgtccatccctcactaccatgatagtctacattctgataagctgtgaggccactgccaagggagggagaaatggtcactttctggtggtggttaatgctttgttagatagcttcatccagtcaatagttgaaaagttttcacataatccagtattggcatcagagccagaaatgccctccc

SEQ ID NO: 203382 - DNA, 4099 bp, Homo sapiens
  Payload ID: 20104
  Gene Name: zinc finger protein 662
  Uniprot ID: Q6ZS27
  ENST ID: ENST00000440367
  CDS Start-End: 532-1812
tggcagttaaagaaataactccccaggaggtgctagacatcgggcgcatgttagaggcacaaagatgagaatgttaaaagacataaaatacaggtctgctctgggaatgcaaaaactggtaaaaggagagataaaagagcaggtgcagtctagtgaagtacccgctacctcctatcagcaaatatctgtccacctagggtgcagcgagctggagaggaaggggtggcctagagcgcaggggaaggattcctccccagccgcctgcacccctaccccggtagcggtccctgggatcgtccgtgtctccaggagaaccggaccgctctcccctccctccccgagcgagaaaggaggaccacagagatgcggcgccctccgccgtcctagagcaaccggagcggcccgagccccggcctcccggatgctggggcctggcgggagtcagtgaccttcgaggatgtggccgtctacttctctgagaacgaatggatcggcctgggccctgctcagagagccctgtacagggatgtgatgctggagaattatggggctgtggcttccctggcagcatttccatttcccaaaccggctctgatttcccagctggagcgaggggaaacaccctggtgctcggttcctcggggagctctggatggagaggccccaaggggcatctcctcaggatatccatttctaaagcctgctgggatttcccatcctgagcaggtggaagagccattaaacctgaaactgcaaggagagggtccaagcctgatttgtccggagggtgtgttgaagaggaagaaagaagattttattctgaaggaggaaattattgaggaagcacaggacctcatggtcctatcaagtggaccccagtggtgtggatcccaggaattatggtttgggaaaacctgtgaagagaaaagcaggttagggagatggcctggttacctcaatgggggacgtatggaaagttctacaaatgatattatagaagtgattgtcaaggatgagatgatctcagtagaagagagttcagggaatactgatgtcaataacctccttggtatacatcacaaaattctaaatgagcaaatattctatatatgtgaggaatgcggcaagtgttttgatcaaaatgaggactttgatcaacaccagaaaactcataatggagagaaggtctatggatgtaaggaatgtgggaaggctttcagttttcgatcacattgcattgcacatcagagaattcacagtggggtgaaaccctatgaatgtcaagaatgtgctaaggcctttgtttggaagtcaaacctgattcgtcaccagagaatacatactggagagaaaccctttgaatgtaaggaatgtgggaagggctttagtcagaacacaagccttacgcaacatcaacggatccacactggtgagaaaccatacacatgtaaggaatgtgggaaaagctttactcgaaacccagcccttcttcgacatcagagaatgcacactggggagaagccttacgaatgtaaggactgtgggaagggcttcatgtggaactcagatctttctcagcaccagagggtccacactggggacaagcctcatgaatgtactgactgtgggaaaagcttcttttgcaaggcacatcttattcgacatcaaagaatccatactggggaaagaccctataaatgtaatgactgtgggaaggccttcagtcagaattctgtcttaattaagcaccagaggcgccatgctagagacaaaccctataactgtcagatctctcaccttcttgaacattagagagtgcataatggtgatacttgtttataattcttatgctgcaggaaccctagagacaaaatgagatgaccattcacaatttgctgtaacccttaacttaaatagccagtattatcttgcccttttgaacatttaccatgtactctagcaagactggtccctctgttctatgatgttttaacaaggcatcatttagttgggcagctactctgtatcaggtgctaaccactttacatacattaatttgcataacaatcctattaaggtaggtgctcttctccccattttacaaatgagaaatctgagttgaaagaggttataaaactcattcagggttgctcagttagtaagttatagagttgaaattggagccaggcctatctgactgcagagtttactgttctttacttaattgtacatatttatgtctctgcccatttttatttgcttattttcctgtgcttttagtttcccttcatcactcagatctagctccttcaactaagaagatctctcttcctcttctacttgtaatcagtaccacccaagttagtatttaattatgtgccatcttatatttttctaatagtctcatgtcttttaatcttaaccccagctaaatgactctgaggaccaacagtacatttcttttatgtttttcaaatcctgaaacattaatctttgactagatataacatgctcatgataaaaaagaattgaaatagttgaaaagggtgttcagtgaaaagtaaatttccttgtcattcctatctcttgagttctccccagaggcaatcactgctactggttgtgtatctctgtagatactctttgtatacaagtgtttattagtattgcttttcataattctgtctcactgaaaaccttatttgatggaagcaacattgcagttaaattgtgaactctaagaccttttcttcagaagttgctttccttttgaggccaccaaagtaatttagggaaacagcagagggtaatccaggtctttttttttttttttttttttttagacagagtctcactctgttgctctggctggagtgcagtggtgctatctcagctcactgcaagctccacctcctgggttcatgccattcttctgcctcagcctcccaagtagctgggactacaggtgcccgccaccatgcctggctaatattttttatttttagtagagacggggtttcaccatgttagccaggctggtctcgatctcctgaccttgtgatccacctgtctcggcctcccaaagtgctgggattacaggcctcagctaccacgcctggccaatccaggtcttaagagacctcattgcctttgttttatgagatatcattctgggattgggaatatgtaaactcaactggagattttttttcataaaaatttatatagttccagccctctcattgcttcctatcctaaatcctcttccagtctgtccatccctcactaccatgatagtctacattctgataagctgtgaggccactgccaagggagggagaaatggtcactttctggtggtggttaatgctttgttagatagcttcatccagtcaatagttgaaaagttttcacataatccagtattggcatcagagccagaaatgccctccctaggtccaggaccaaagataaaacaaacacgaggaacatgtagcgtctacacaggaaagtaaagaattatagaattaactaattctacttgaaatcaggagttttataaaacaacatttttagacgtggtcatcttttattggtttccatcatctcttccccttctctctgggaacagttacccgggtattctttgggaagctatcctttctcagctatgtggtttggcaccaccaccatcttcatgagtggaccctgtttggcttgtgtcaatcagtttatcccatccccttggccacagagccattgtgatatgaggagatactggctcttctggaaaagagaggcttttcttcatcgagagctaccagaggagatattatctgtcctctgtgtggcacataggaaaatgtgagacctagaattatagcaactttttttttctgttaaaaggggagattctcaagcttccaggtgctaccatatggagcctaaggataaagccaataccaaagaaaacagtgactaaacagagagaaactaggtccttggtgacatcttttgagccactagaccaagctttacctgaagcagagctacctcagaacttttcagctatgtgagccaataaacatctgtcaaacga

SEQ ID NO: 203383 - DNA, 436 bp, Homo sapiens
  Payload ID: 20104
  Gene Name: zinc finger protein 662
  ENST ID: ENST00000422021
  CDS Start-End: 94-414
gagtcagtgaccttcgaggatgtggccgtctacttctctgagaacgaatggatcggcctgggccctgctcagagagccctgtacagggatgtgatgctggagaattatggggctgtggcttccctggcagcatttccatttcccaaaccggctctgatttcccagctggagcgaggggaaacaccctggtgctcggttcctcggggagctctggatggagaggccccaaggggcatctcctcaggggagattctcaagcttccaggtgctaccatatggagcctaaggataaagccaataccaaagaaaacagtgactaaacagagagaaactaggtccttggtgacatcttttgagccactagaccaagctttacctgaagcagagctacctcagaacttttcagctatgtgagccaataaacatctgtcaaacg

SEQ ID NO: 203384 - DNA, 4227 bp, Homo sapiens
  Payload ID: 20105
  Gene Name: zinc finger protein 664
  Uniprot ID: Q8N3J9
  ENST ID: ENST00000337815
  CDS Start-End: 950-1735
gagagggaggtgggtgcgcggcgcccgcggcctggggcgctgactcccctcacttggaggcgccctgcgtccggcagaggaggcgagcatcccgctcaggtgatgaggaacccctcgcgcacccagcgcagaaggctgctgccgccggacgcctccattgtttgaccacaacaagggccggattctcacccagcaggatcctaaggcctttgtagtccttcagccactgtgggccctgcctctgcctgttcttctggaatgtcttgggggttttgatcctgtcactgtgacctgcaaatccaagagacacatctttggaagataagagagcttcttcaagaccaaaaaaggagacggcatgatacccatgtagggaattccccaaagcagggcttgccatacctggaccccgaggagcctgcttgctggaaaggctttcctgtctgatgtgcaggaggcagaatgccaaactgactcttcaaggggcaactgcaggggctcgagaccagccagcagtatctcatccttcgatacaggggatatactgtacagtcctttttctagaagtgagacatacaagattactctacaagaggaagattccaggggctcaaaaacgcaaaggtttgcactttgagagccccttggaatgttgacaactcaggatctaaaacaaagttctgtgttaatgagttacagaattcacgtggaagtcaatgtcactttataatcgataataatactgagtgaggaacactatgcaggaagaaaccttccgtagaaagacaggcagggaaaagcttaggctgaccttaaacttacctaatagagcaagcctgagatagactgccaaaatggccaaataagagactctatgaaataacagtcttgtaactgtagtaatcataaggaaattttctccttgaaatcacgataccaaataggaaaaatgatctacaagtgccccatgtgtagggaatttttctctgagagagcagatctttttatgcatcagaaaattcacacagctgagaagccccataaatgtgacaagtgtgataagggtttctttcatatatcagaacttcatattcattggagagaccatacaggagagaaggtctataaatgtgatgattgtggtaaggattttagcactacaacaaaacttaatagacataagaaaatccacacagtggagaagccctataaatgttacgagtgtggcaaagccttcaattggagctcccatcttcaaattcatatgagagttcatacaggtgagaaaccgtatgtctgtagtgagtgtggaaggggctttagtaatagttcaaacctttgcatgcatcagagagtccacaccggagagaagccctttaaatgtgaagagtgtgggaaggccttcaggcacacctccagcctctgcatgcatcaaagagtccacacaggagagaaaccctataaatgttatgagtgtgggaaggcgttcagtcagagttcgagcctctgcatccaccagagagtccacactggagagaaaccctatagatgttgtggatgtgggaaggccttcagtcagagttcgagcctgtgcatccaccagagagtccacacaggagagaaacctttcaaatgtgatgagtgcggaaaggccttcagtcagagtacgagcctctgcatccaccagagagtccacacaaaggagagaaaccatctcaaaatatcagttatataaaacgttttgctaagagtttaaaatcttaaaacccataagtgccactaggaaggaaaccctgtatatacctacattgacccaagaaatatttacgcaatccctagcagaacattgtttctgaggaggcatatgtgagattgatttgttggttcatgccaagtgtgttccacaggttgactttgaatgtggacctctgagcatccacgcaggatggctctcaggtcccagtcacagacgtcgcttcctgggattccagcacgatgcctccatagttgaaagactacacaaaaagccacaatcattgcccggcctcctgagtcaccttctatctatactttgcttaaaagctatcccagatactcccccttgaggagctcatgcccttccttcctctttattcgagcatactggcaatgcattggaaaacagacagctcccactaagatcacgttctggtatttctgaggttaacacttgatttagcccctacatatctttccatatatcctattatttctgaatatatgtcctcaaaatccccataaatatccatcccttcctagatggcattaactttcattttagattttaggtgactcataattcccattcacttagcctatcagaaaagtcattggcagacatatatgtccttgaaccttttttatttgtgtggattctgctcatcactgtctctgttagacttattttgtagtggctgcatcacatatttttcacttgaatttttttggaaatagctgaatgtaaatagcagggaggaagaagcaagcaaagtgagagcttttcttcatccagaattgccctctgggctcctttggtaacagatggagctccttcctagctagggagaccttatgagaagtggatggtaggaggagtcactaatgtttcaatctctatttctgtaatcttgggcaataatgcataggagttcttgataccccttcattgattactgtgtatcagttctttgttaggcatgaacgtctttattaatccatcattcttttcttcattcaacaaatatgtattgaacacctcctatatgccaggcactgtgctaggtgctgggaataccactgatgagacagacaaggtccctactcttgtggagtttacttctggtggaggagacagatgataagtaaacaaataaataatgtagtttgagatagtgattaagtgctatgaagaaaataaactagggtgatgattttagtggtggggtggggtgggggtggggtgacattagctagtggtcagggaggcctttccgcggtgggatgttgagctgaggccggaggagaagtagcagtcgctggcagagcacacaggctgctctgggggatgagctggtgcgtttaaggaacaggccagcactggcattcgcaagcagtggggaaggggagagatgccgaggtggtcagtatcctgactttcagaggcctttttttgtttgttttaatttttgctagattgatattaaaaactcatgtggaggaactcaaggaatgtttagaagaccaaaagtccccaatgacaggaacaaaagcaaccaatttttaactttctcttctcattcctgttttcattgatttcccacatgtagtccttttgctcaggaagtctttggggaaattaaggatctttgaagctctgaaataggtgatcaggttagtggtgtctgtcagctgtctaagaggttggaaaatgaactactcaagatagtcacgaaaatactgaaagtttgatttttctttccatatttgaattaattttttctgtttgactggaaggggtttttgtataactaaaacctcagcgcataaaggagatttaaaaggagcacatgatttagtgggtgggccatgaaactagagatgggatttgggggtgaatttgtcaatatctggattttaatccagacatctctgctaacaagcctttggtaagtcacttcagatacttttcctcctttttacaaagagagggctggcttagttatttgccaaagccccttccaggcctgaattccacaagtacgatttactgtagtgtcttatcactctttcatgtcacaatagcgtggagcattagagaaaagcctagacttttagttgatagccagttgaaatatcattgatagaattttagttttaggaaaaattggtttgatttctagctttattactattaggtatgtgagcttgggcaaatcgcttaatctttgagtctagttttctctcaaaatgagaacattaggctaaatgatttccgagtttccagctagtcctagagttctatatttctacatagttgaattattttatcatgctgttgctggggaatatgactaacccttttgaagctactaattttatgtcgagctttaaagtccataattgttatcttcagaaaatattatttgacctacagtatgtccaaatcaatttaataaaatcgctttataa

SEQ ID NO: 203385 - DNA, 4262 bp, Homo sapiens
  Payload ID: 20105
  Gene Name: zinc finger protein 664
  Uniprot ID: Q8N3J9
  ENST ID: ENST00000392404
  CDS Start-End: 981-1766
cgcgcgctgtcccccggaggcgtctgggtgtgcggagcgcgcgcgcgcgcggctcggaggcgcacctgtgaggtgtccctgaggagagggagggcgccctgcgtccggcagaggaggcgagcatcccgctcaggtgatgaggaacccctcgcgcacccagcgcagaaggctgctgccgccggacgcctccattgtttgaccacaacaagggccggattctcacccaggatcctaaggcctttgtagtccttcagccactgtgggccctgcctctgcctgttcttctggaatgtcttgggggttttgatcctgtcactgtgacctgcaaatccaagagacacatctttggaagataagagagcttcttcaagaccaaaaaaggagacggcatgatacccatgtagggaattccccaaagcagggcttgccatacctggaccccgaggagcctgcttgctggaaaggctttcctgtctgatgtgcaggaggcagaatgccaaactgactcttcaaggggcaactgcaggggctcgagaccagccagcagtatctcatccttcgatacaggggatatactgtacagtcctttttctagaagtgagacatacaagattactctacaagaggaagattccaggggctcaaaaacgcaaaggtttgcactttgagagccccttggaatgttgacaactcaggatctaaaacaaagttctgtgttaatgagttacagaattcacgtggaagtcaatgtcactttataatcgataataatactgagtgaggaacactatgcaggaagaaaccttccgtagaaagacaggcagggaaaagcttaggctgaccttaaacttacctaatagagcaagcctgagatagactgccaaaatggccaaataagagactctatgaaataacagtcttgtaactgtagtaatcataaggaaattttctccttgaaatcacgataccaaataggaaaaatgatctacaagtgccccatgtgtagggaatttttctctgagagagcagatctttttatgcatcagaaaattcacacagctgagaagccccataaatgtgacaagtgtgataagggtttctttcatatatcagaacttcatattcattggagagaccatacaggagagaaggtctataaatgtgatgattgtggtaaggattttagcactacaacaaaacttaatagacataagaaaatccacacagtggagaagccctataaatgttacgagtgtggcaaagccttcaattggagctcccatcttcaaattcatatgagagttcatacaggtgagaaaccgtatgtctgtagtgagtgtggaaggggctttagtaatagttcaaacctttgcatgcatcagagagtccacaccggagagaagccctttaaatgtgaagagtgtgggaaggccttcaggcacacctccagcctctgcatgcatcaaagagtccacacaggagagaaaccctataaatgttatgagtgtgggaaggcgttcagtcagagttcgagcctctgcatccaccagagagtccacactggagagaaaccctatagatgttgtggatgtgggaaggccttcagtcagagttcgagcctgtgcatccaccagagagtccacacaggagagaaacctttcaaatgtgatgagtgcggaaaggccttcagtcagagtacgagcctctgcatccaccagagagtccacacaaaggagagaaaccatctcaaaatatcagttatataaaacgttttgctaagagtttaaaatcttaaaacccataagtgccactaggaaggaaaccctgtatatacctacattgacccaagaaatatttacgcaatccctagcagaacattgtttctgaggaggcatatgtgagattgatttgttggttcatgccaagtgtgttccacaggttgactttgaatgtggacctctgagcatccacgcaggatggctctcaggtcccagtcacagacgtcgcttcctgggattccagcacgatgcctccatagttgaaagactacacaaaaagccacaatcattgcccggcctcctgagtcaccttctatctatactttgcttaaaagctatcccagatactcccccttgaggagctcatgcccttccttcctctttattcgagcatactggcaatgcattggaaaacagacagctcccactaagatcacgttctggtatttctgaggttaacacttgatttagcccctacatatctttccatatatcctattatttctgaatatatgtcctcaaaatccccataaatatccatcccttcctagatggcattaactttcattttagattttaggtgactcataattcccattcacttagcctatcagaaaagtcattggcagacatatatgtccttgaaccttttttatttgtgtggattctgctcatcactgtctctgttagacttattttgtagtggctgcatcacatatttttcacttgaatttttttggaaatagctgaatgtaaatagcagggaggaagaagcaagcaaagtgagagcttttcttcatccagaattgccctctgggctcctttggtaacagatggagctccttcctagctagggagaccttatgagaagtggatggtaggaggagtcactaatgtttcaatctctatttctgtaatcttgggcaataatgcataggagttcttgataccccttcattgattactgtgtatcagttctttgttaggcatgaacgtctttattaatccatcattcttttcttcattcaacaaatatgtattgaacacctcctatatgccaggcactgtgctaggtgctgggaataccactgatgagacagacaaggtccctactcttgtggagtttacttctggtggaggagacagatgataagtaaacaaataaataatgtagtttgagatagtgattaagtgctatgaagaaaataaactagggtgatgattttagtggtggggtggggtgggggtggggtgacattagctagtggtcagggaggcctttccgcggtgggatgttgagctgaggccggaggagaagtagcagtcgctggcagagcacacaggctgctctgggggatgagctggtgcgtttaaggaacaggccagcactggcattcgcaagcagtggggaaggggagagatgccgaggtggtcagtatcctgactttcagaggcctttttttgtttgttttaatttttgctagattgatattaaaaactcatgtggaggaactcaaggaatgtttagaagaccaaaagtccccaatgacaggaacaaaagcaaccaatttttaactttctcttctcattcctgttttcattgatttcccacatgtagtccttttgctcaggaagtctttggggaaattaaggatctttgaagctctgaaataggtgatcaggttagtggtgtctgtcagctgtctaagaggttggaaaatgaactactcaagatagtcacgaaaatactgaaagtttgatttttctttccatatttgaattaattttttctgtttgactggaaggggtttttgtataactaaaacctcagcgcataaaggagatttaaaaggagcacatgatttagtgggtgggccatgaaactagagatgggatttgggggtgaatttgtcaatatctggattttaatccagacatctctgctaacaagcctttggtaagtcacttcagatacttttcctcctttttacaaagagagggctggcttagttatttgccaaagccccttccaggcctgaattccacaagtacgatttactgtagtgtcttatcactctttcatgtcacaatagcgtggagcattagagaaaagcctagacttttagttgatagccagttgaaatatcattgatagaattttagttttaggaaaaattggtttgatttctagctttattactattaggtatgtgagcttgggcaaatcgcttaatctttgagtctagttttctctcaaaatgagaacattaggctaaatgatttccgagtttccagctagtcctagagttctatatttctacatagttgaattattttatcatgctgttgctggggaatatgactaacccttttgaagctactaattttatgtcgagctttaaagtccataattgttatcttcagaaaatattatttgacctacagtatgtccaaatcaatttaataaaatcgctttataacagg

SEQ ID NO: 203386 - DNA, 4321 bp, Homo sapiens
  Payload ID: 20105
  Gene Name: zinc finger protein 664
  Uniprot ID: Q8N3J9
  ENST ID: ENST00000538932
  CDS Start-End: 1027-1812
gcgctgtcccccggaggcgtctgggtgtgcggagcgcgcgcgcgcgcggctcggaggcgcacctgtgaggtgtccctgaggagagggaggtgggtgcgcggcgcccgcggcctggggcgctgactcccctcacttggaggcgccctgcgtccggcagaggaggcgagcatcccgctcaggtgatgaggaacccctcgcgcacccagcgcagaaggctgctgccgccggacgcctccattgtttgaccacaacaagggccggattctcacccaggatcctaaggcctttgtagtccttcagccactgtgggccctgcctctgcctgttcttctggaatgtcttgggggttttgatcctgtcactgtgacctgcaaatccaagagacacatctttggaagataagagagcttcttcaagaccaaaaaaggagacggcatgatacccatgtagggaattccccaaagcagggcttgccatacctggaccccgaggagcctgcttgctggaaaggctttcctgtctgatgtgcaggaggcagaatgccaaactgactcttcaaggggcaactgcaggggctcgagaccagccagcagtatctcatccttcgatacaggggatatactgtacagtcctttttctagaagtgagacatacaagattactctacaagaggaagattccaggggctcaaaaacgcaaaggtttgcactttgagagccccttggaatgttgacaactcaggatctaaaacaaagttctgtgttaatgagttacagaattcacgtggaagtcaatgtcactttataatcgataataatactgagtgaggaacactatgcaggaagaaaccttccgtagaaagacaggcagggaaaagcttaggctgaccttaaacttacctaatagagcaagcctgagatagactgccaaaatggccaaataagagactctatgaaataacagtcttgtaactgtagtaatcataaggaaattttctccttgaaatcacgataccaaataggaaaaatgatctacaagtgccccatgtgtagggaatttttctctgagagagcagatctttttatgcatcagaaaattcacacagctgagaagccccataaatgtgacaagtgtgataagggtttctttcatatatcagaacttcatattcattggagagaccatacaggagagaaggtctataaatgtgatgattgtggtaaggattttagcactacaacaaaacttaatagacataagaaaatccacacagtggagaagccctataaatgttacgagtgtggcaaagccttcaattggagctcccatcttcaaattcatatgagagttcatacaggtgagaaaccgtatgtctgtagtgagtgtggaaggggctttagtaatagttcaaacctttgcatgcatcagagagtccacaccggagagaagccctttaaatgtgaagagtgtgggaaggccttcaggcacacctccagcctctgcatgcatcaaagagtccacacaggagagaaaccctataaatgttatgagtgtgggaaggcgttcagtcagagttcgagcctctgcatccaccagagagtccacactggagagaaaccctatagatgttgtggatgtgggaaggccttcagtcagagttcgagcctgtgcatccaccagagagtccacacaggagagaaacctttcaaatgtgatgagtgcggaaaggccttcagtcagagtacgagcctctgcatccaccagagagtccacacaaaggagagaaaccatctcaaaatatcagttatataaaacgttttgctaagagtttaaaatcttaaaacccataagtgccactaggaaggaaaccctgtatatacctacattgacccaagaaatatttacgcaatccctagcagaacattgtttctgaggaggcatatgtgagattgatttgttggttcatgccaagtgtgttccacaggttgactttgaatgtggacctctgagcatccacgcaggatggctctcaggtcccagtcacagacgtcgcttcctgggattccagcacgatgcctccatagttgaaagactacacaaaaagccacaatcattgcccggcctcctgagtcaccttctatctatactttgcttaaaagctatcccagatactcccccttgaggagctcatgcccttccttcctctttattcgagcatactggcaatgcattggaaaacagacagctcccactaagatcacgttctggtatttctgaggttaacacttgatttagcccctacatatctttccatatatcctattatttctgaatatatgtcctcaaaatccccataaatatccatcccttcctagatggcattaactttcattttagattttaggtgactcataattcccattcacttagcctatcagaaaagtcattggcagacatatatgtccttgaaccttttttatttgtgtggattctgctcatcactgtctctgttagacttattttgtagtggctgcatcacatatttttcacttgaatttttttggaaatagctgaatgtaaatagcagggaggaagaagcaagcaaagtgagagcttttcttcatccagaattgccctctgggctcctttggtaacagatggagctccttcctagctagggagaccttatgagaagtggatggtaggaggagtcactaatgtttcaatctctatttctgtaatcttgggcaataatgcataggagttcttgataccccttcattgattactgtgtatcagttctttgttaggcatgaacgtctttattaatccatcattcttttcttcattcaacaaatatgtattgaacacctcctatatgccaggcactgtgctaggtgctgggaataccactgatgagacagacaaggtccctactcttgtggagtttacttctggtggaggagacagatgataagtaaacaaataaataatgtagtttgagatagtgattaagtgctatgaagaaaataaactagggtgatgattttagtggtggggtggggtgggggtggggtgacattagctagtggtcagggaggcctttccgcggtgggatgttgagctgaggccggaggagaagtagcagtcgctggcagagcacacaggctgctctgggggatgagctggtgcgtttaaggaacaggccagcactggcattcgcaagcagtggggaaggggagagatgccgaggtggtcagtatcctgactttcagaggcctttttttgtttgttttaatttttgctagattgatattaaaaactcatgtggaggaactcaaggaatgtttagaagaccaaaagtccccaatgacaggaacaaaagcaaccaatttttaactttctcttctcattcctgttttcattgatttcccacatgtagtccttttgctcaggaagtctttggggaaattaaggatctttgaagctctgaaataggtgatcaggttagtggtgtctgtcagctgtctaagaggttggaaaatgaactactcaagatagtcacgaaaatactgaaagtttgatttttctttccatatttgaattaattttttctgtttgactggaaggggtttttgtataactaaaacctcagcgcataaaggagatttaaaaggagcacatgatttagtgggtgggccatgaaactagagatgggatttgggggtgaatttgtcaatatctggattttaatccagacatctctgctaacaagcctttggtaagtcacttcagatacttttcctcctttttacaaagagagggctggcttagttatttgccaaagccccttccaggcctgaattccacaagtacgatttactgtagtgtcttatcactctttcatgtcacaatagcgtggagcattagagaaaagcctagacttttagttgatagccagttgaaatatcattgatagaattttagttttaggaaaaattggtttgatttctagctttattactattaggtatgtgagcttgggcaaatcgcttaatctttgagtctagttttctctcaaaatgagaacattaggctaaatgatttccgagtttccagctagtcctagagttctatatttctacatagttgaattattttatcatgctgttgctggggaatatgactaacccttttgaagctactaattttatgtcgagctttaaagtccataattgttatcttcagaaaatattatttgacctacagtatgtccaaatcaatttaataaaatcgctttataacagggttctgtgcttga

SEQ ID NO: 203387 - DNA, 5108 bp, Homo sapiens
  Payload ID: 20105
  Gene Name: zinc finger protein 664
  Uniprot ID: Q8N3J9
  ENST ID: ENST00000539644
  CDS Start-End: 1831-2616
ggaggcgggcggtgggggcgcgggccgggtggccgcgcatgcgtgcggcccccgctcccccggggcttccccggcctcgtgcgtgcgcacgcgcgctgtcccccggaggcgtctgggtgtgcggagcgcgcgcgcgcgcggctcggaggcgcacctgtgaggtgtccctgaggagagggaggtgggtgcgcggcgcccgcggcctggggcgctgactcccctcacttggagtgagttctcggcggccgggctgcagtctttctttctttcccggagggaggcgggggccgggggccagggagcgggctgggggtgggaaggaggtggagtggcttaaagaaaagaaaaacaacccatcccggaggatgggcctcgggatggcggggaaggtcagagcggctccgcgcagcctggcgggtcccgggctgagaagccgcccctcgggcctcgggcggtcggccgcgggcccgcagtgcgggggagcggggccggggggcgcagatggcggccggtgcgagcgagggctgggcagcgggcagggcgaggccgggcgaggcccctcgggagccggactcccgagccaggctccattgttgttggagccgagggaagggggagcgctgccgccctcgtcgcccgtggagccgcgtcttggagcccttccaggcgggtcccgggagaggcggtcatggccgcgccaggggaccggggagccgggcggctgcggaggagccggctgcatggggtgctgtgtgtttttcagggcgccctgcgtccggcagaggaggcgagcatcccgctcaggtgatgaggaacccctcgcgcacccagcgcagaaggctgctgccgccggacgcctccattgtttgaccacaacaagggccggattctcacccagcaggatcctaaggcctttgtagtccttcagccactgtgggccctgcctctgcctgttcttctggaatgtcttgggggttttgatcctgtcactgtgagtcttgctctgtcgcccaggctggagtgcagtggcacgatctcagctcattgcaacctctgtctcccaggttcaagcgattctcctgcctcagcctctggagtagctgggattacagatgggaccacctagttgcaggaaaacaagctcagggctcccactgattctacattatgacctgcaaatccaagagacacatctttggaagataagagagcttcttcaagaccaaaaaaggagacggcatgatacccatgtagggaattccccaaagcagggcttgccatacctggaccccgaggagcctgcttgctggaaaggctttcctgtctgatgtgcaggaggcagaatgccaaactgactcttcaaggggcaactgcaggggctcgagaccagccagcagtatctcatccttcgatacaggggatatactgtacagtcctttttctagaagtgagacatacaagattactctacaagaggaagattccaggggctcaaaaacgcaaaggtttgcactttgagagccccttggaatgttgacaactcaggatctaaaacaaagttctgtgttaatgagttacagaattcacgtggaagtcaatgtcactttataatcgataataatactgagtgaggaacactatgcaggaagaaaccttccgtagaaagacaggcagggaaaagcttaggctgaccttaaacttacctaatagagcaagcctgagatagactgccaaaatggccaaataagagactctatgaaataacagtcttgtaactgtagtaatcataaggaaattttctccttgaaatcacgataccaaataggaaaaatgatctacaagtgccccatgtgtagggaatttttctctgagagagcagatctttttatgcatcagaaaattcacacagctgagaagccccataaatgtgacaagtgtgataagggtttctttcatatatcagaacttcatattcattggagagaccatacaggagagaaggtctataaatgtgatgattgtggtaaggattttagcactacaacaaaacttaatagacataagaaaatccacacagtggagaagccctataaatgttacgagtgtggcaaagccttcaattggagctcccatcttcaaattcatatgagagttcatacaggtgagaaaccgtatgtctgtagtgagtgtggaaggggctttagtaatagttcaaacctttgcatgcatcagagagtccacaccggagagaagccctttaaatgtgaagagtgtgggaaggccttcaggcacacctccagcctctgcatgcatcaaagagtccacacaggagagaaaccctataaatgttatgagtgtgggaaggcgttcagtcagagttcgagcctctgcatccaccagagagtccacactggagagaaaccctatagatgttgtggatgtgggaaggccttcagtcagagttcgagcctgtgcatccaccagagagtccacacaggagagaaacctttcaaatgtgatgagtgcggaaaggccttcagtcagagtacgagcctctgcatccaccagagagtccacacaaaggagagaaaccatctcaaaatatcagttatataaaacgttttgctaagagtttaaaatcttaaaacccataagtgccactaggaaggaaaccctgtatatacctacattgacccaagaaatatttacgcaatccctagcagaacattgtttctgaggaggcatatgtgagattgatttgttggttcatgccaagtgtgttccacaggttgactttgaatgtggacctctgagcatccacgcaggatggctctcaggtcccagtcacagacgtcgcttcctgggattccagcacgatgcctccatagttgaaagactacacaaaaagccacaatcattgcccggcctcctgagtcaccttctatctatactttgcttaaaagctatcccagatactcccccttgaggagctcatgcccttccttcctctttattcgagcatactggcaatgcattggaaaacagacagctcccactaagatcacgttctggtatttctgaggttaacacttgatttagcccctacatatctttccatatatcctattatttctgaatatatgtcctcaaaatccccataaatatccatcccttcctagatggcattaactttcattttagattttaggtgactcataattcccattcacttagcctatcagaaaagtcattggcagacatatatgtccttgaaccttttttatttgtgtggattctgctcatcactgtctctgttagacttattttgtagtggctgcatcacatatttttcacttgaatttttttggaaatagctgaatgtaaatagcagggaggaagaagcaagcaaagtgagagcttttcttcatccagaattgccctctgggctcctttggtaacagatggagctccttcctagctagggagaccttatgagaagtggatggtaggaggagtcactaatgtttcaatctctatttctgtaatcttgggcaataatgcataggagttcttgataccccttcattgattactgtgtatcagttctttgttaggcatgaacgtctttattaatccatcattcttttcttcattcaacaaatatgtattgaacacctcctatatgccaggcactgtgctaggtgctgggaataccactgatgagacagacaaggtccctactcttgtggagtttacttctggtggaggagacagatgataagtaaacaaataaataatgtagtttgagatagtgattaagtgctatgaagaaaataaactagggtgatgattttagtggtggggtggggtgggggtggggtgacattagctagtggtcagggaggcctttccgcggtgggatgttgagctgaggccggaggagaagtagcagtcgctggcagagcacacaggctgctctgggggatgagctggtgcgtttaaggaacaggccagcactggcattcgcaagcagtggggaaggggagagatgccgaggtggtcagtatcctgactttcagaggcctttttttgtttgttttaatttttgctagattgatattaaaaactcatgtggaggaactcaaggaatgtttagaagaccaaaagtccccaatgacaggaacaaaagcaaccaatttttaactttctcttctcattcctgttttcattgatttcccacatgtagtccttttgctcaggaagtctttggggaaattaaggatctttgaagctctgaaataggtgatcaggttagtggtgtctgtcagctgtctaagaggttggaaaatgaactactcaagatagtcacgaaaatactgaaagtttgatttttctttccatatttgaattaattttttctgtttgactggaaggggtttttgtataactaaaacctcagcgcataaaggagatttaaaaggagcacatgatttagtgggtgggccatgaaactagagatgggatttgggggtgaatttgtcaatatctggattttaatccagacatctctgctaacaagcctttggtaagtcacttcagatacttttcctcctttttacaaagagagggctggcttagttatttgccaaagccccttccaggcctgaattccacaagtacgatttactgtagtgtcttatcactctttcatgtcacaatagcgtggagcattagagaaaagcctagacttttagttgatagccagttgaaatatcattgatagaattttagttttaggaaaaattggtttgatttctagctttattactattaggtatgtgagcttgggcaaatcgcttaatctttgagtctagttttctctcaaaatgagaacattaggctaaatgatttccgagtttccagctagtcctagagttctatatttctacatagttgaattattttatcatgctgttgctggggaatatgactaacccttttgaagctactaattttatgtcgagctttaaagtccataattgttatcttcagaaaatattatttgacctacagtatgtccaaatcaatttaataaaatcgctttataa

SEQ ID NO: 203388 - DNA, 4159 bp, Homo sapiens
  Payload ID: 20106
  Gene Name: zinc finger protein 665
  Uniprot ID: Q9H7R5
  ENST ID: ENST00000396424
  CDS Start-End: 91-2127
aaacccggaagcagatctcttggagtgaaggctgttagtcgccgcgtagaaccctggaagaagaggaagaggaaggcaaaggagtcagggatggctcttcctcagggacagttgacattcaaggatgtggccatagaattctctcaggaggagtggacatgcctggaccctgctcagaagactttgtacagggacgtcatgttggagaattataggaacctggtctccctggatatctcttgtaaatgtgtaaacacggatttgccaccaaaggggaagaacaatatgggagaagcgttctacacggtgaagttggagagacttgaaagctgtgacactgtaggcttgtccttccaggaagttcagaaaaatacatacgactttgagtgtcagtggaaagatgatgaaggaaattataaaacagtacttatgttgcaaaaagaaaatctccctggtagaagagctcaacgtgatagaagggctgcaggaaacaggcatattgaaaatcagcttggagtaagctttcagtcacatctccctgaactgcagcaatttcaacatgaagggaaaatttatgaatacaatcaagttgagaagtctcctaataatcgaggaaaacattataaatgtgatgaatgtggcaaggtcttcagtcaaaactcacggctaacaagtcataagagaattcatactggagagaagccttaccagtgtaataagtgtggcaaagcctttactgttcgttcaaacctaacaatccatcaggtcatccatactggagaaaaaccttacaaatgtaatgaatgtggaaaggtcttcagtcaaccttcaaaccttgcaggtcatcagagaattcatactggagagaaaccttacaagtgtaatgagtgtggcaaagcctttagagcacattcaaaactaactacacatcaggtcatccatactggagaaaaaccttacaaatgtaaggaatgtggcaagtgcttcactcaaaattcacaccttgcaagtcatcgaagaattcatactggggagaagccttacaagtgtaatgagtgtggcaaagcctttagtgttcgctcaagcctgactacccatcagacaatccacactggagaaaaaccttacaaatgtaatgaatgtggcaaggtcttcaggcacaattcataccttgcaaagcatcggcgaattcatactggtgagaaaccttacaagtgtaatgagtgtgggaaagccttcagtatgcattcaaacttaactaagcatcagatcatccataccggagaaaagcctttcaaatgtaatgaatgcgtcaaggttttcactcagtattcacacttagcaaatcatcgaagaattcatactggagagaaaccttacaggtgtgatgagtgtggcaaagcctttagtgtgcgatcaagcctaactacccatcaggcaattcatactggagaaaagccttacaaatgtaatgactgcggtaaggtcttcacacaaaattcacaccttgcaagtcatcggggaattcattctggagagaaaccttacaagtgtgatgaatgtggtaaagccttcagtcaaacatcacaacttgcaaggcattggagagttcatactggagaaaaaccttacaagtgtaatgagtgtggcaaagcctttagtgttcattcaagcctaactatacatcagacaatacatactggacaaaaaccatacaaatgtaatgattgcggcaaggtcttcagacacaattcgtaccttgcaattcatcagagaattcacactggtgagaaaccttataagtgtaatgagtgcggcaaagcatttagtgtacattcaaacctagctacccatcaggtcatccatactggagaaaaaccttacaaatgtaatgaatgtggcaaggtcttcactcaaaattcacatcttgcaaatcatagaagaattcacactggagaaaaaccttataggtgtaatgagtgtgggaaagccttcagtgttcgttcaaccctaactacccatatggcagtccatactggagacaaaccttacaaatgtaaccaatgtggcaaggtctttactcaaaattcaaaccttgcaaaacatcgaagaattcatagtggatagaaaccttacaaaggacgccgggcgtggtggctcacgcctgtaatcccagcactttgggaggccgaggcggggggatcacctgaggtctcgagttcgagaccaggctggccaacacggtgaaacgctgtctctactaaaaatacaaaaattagctgggtgtggtggtgcacgcctgtaatcccagctactcgggaggctgaggcaggagaatcacttgaacctgggaggcggaggttgcagtgagcgagatcatgccattgcactccagcctgggcaacaggagtgaaactccatctccaaaaaaaaaaaaaaaaaaaaagtaaccttacaaaggagtgcggccagtttttcagccacaaattctttcacaacatcagagaattcattcttgagacaattcttacaaatacagtgactgtggcaaactcctgatgagtttaagcattaacagacatcagagttcaaatcctgtgaatatactatgtatgacagaagctttatccaggtctcagagctcaatacgcatcaaaagatacatctttgatgaagtcacacaaacgtaacatgcatgctgagactattactcctggaccacaactgtaggtgaggattcataggaagagtagaactcagtctctagtttcctcataaccctctgatattatatacttcagcataatcagaagtccaaatgtgttaaaactcattacatgatacatatcaaaggttgtaggatgtttggaaatggccaattactttcagcttataaaatgttttgttgaagtatttaagatttattgaaaaggctactatttataacttccaaccagaactttgcaatgtgctgattttatacatgattatacgcctaacatggtgttgttcgggaaagaatcaaaggatggaagggctcactcacttcattaggtgaggattatttctctccaagctcctgaagaaaaaagactctgccttttaaaattaaatatagtctgaattagagagcacttggaaagggcagaggatgatgaactatgatgtcactcatcatccttattgcactgcaggtgcccttcttctgacagaagagcactgtgggtatgggaagaaattctctactggccgggcacagtggctcacgcctgtaatgccagcactttgggaggccaaggtgggtggatcacctgaggtcgggagttcgagaccagcctgaccaacatggagaaaccccatctctactaaaaatacaaaattagccaggcatggtggcgcatgcctgtaatcccagctactcaggaggctgaggcaggagactcgcttgaacccgggaggcagaggttgtggtgagccgagatcatgccactgcactccagtctgggcaataagagcgaaactctgactcaaaaaaagaaagaaagaaattctctaccagtagaccatgaaatagagccaggaagacactcggatttttattagaggagagtaatagcttattagggactgatgtgtggtacaaataatgcagaaaagtggaggctaccttctccatcaaatgccaatagctgttgcatagcaaagattgatttttttttttttttttgagatggagtcttgttctgttgcccaggctggagtgcagtgatgcaatctcagctcaccgcaacctccgcctcctgggttttagcgattctcctgcctcagcctcccaagtagctgggattacagacatgcaccaccacgcctggctaatgtttgtatttttagtagagatggagtttcactatgtttgccaggctggtctcgaactcctgacctcataatccgcccaccttggcctgccaaagtgctgggattacgggctggagccaccgtgcccggccggccgagcataagaagtttaatcaaagtaaccagaatcccatgtttgttactaggatttacattaactgctggaatcacattttgctactatttaagaatgcatcatagatttaatgttttaactaataaaatttgatgtattttataagta

SEQ ID NO: 203389 - DNA, 2273 bp, Homo sapiens
  Payload ID: 20106
  Gene Name: zinc finger protein 665
  Uniprot ID: Q9H7R5
  ENST ID: ENST00000600412
  CDS Start-End: 117-1958
gcgcgggcagtttcttgcaaacccggaagcagatctcttggagtgaaggctgttagtcgccgcatatctcttgtaaatgtgtaaacacggatttgccaccaaaggggaagaacaatatgggagaagcgttctacacggtgaagttggagagacttgaaagctgtgacactgtaggcttgtccttccaggaagttcagaaaaatacatacgactttgagtgtcagtggaaagatgatgaaggaaattataaaacagtacttatgttgcaaaaagaaaatctccctggtagaagagctcaacgtgatagaagggctgcaggaaacaggcatattgaaaatcagcttggagtaagctttcagtcacatctccctgaactgcagcaatttcaacatgaagggaaaatttatgaatacaatcaagttgagaagtctcctaataatcgaggaaaacattataaatgtgatgaatgtggcaaggtcttcagtcaaaactcacggctaacaagtcataagagaattcatactggagagaagccttaccagtgtaataagtgtggcaaagcctttactgttcgttcaaacctaacaatccatcaggtcatccatactggagaaaaaccttacaaatgtaatgaatgtggaaaggtcttcagtcaaccttcaaaccttgcaggtcatcagagaattcatactggagagaaaccttacaagtgtaatgagtgtggcaaagcctttagagcacattcaaaactaactacacatcaggtcatccatactggagaaaaaccttacaaatgtaaggaatgtggcaagtgcttcactcaaaattcacaccttgcaagtcatcgaagaattcatactggggagaagccttacaagtgtaatgagtgtggcaaagcctttagtgttcgctcaagcctgactacccatcagacaatccacactggagaaaaaccttacaaatgtaatgaatgtggcaaggtcttcaggcacaattcataccttgcaaagcatcggcgaattcatactggtgagaaaccttacaagtgtaatgagtgtgggaaagccttcagtatgcattcaaacttaactaagcatcagatcatccataccggagaaaagcctttcaaatgtaatgaatgcgtcaaggttttcactcagtattcacacttagcaaatcatcgaagaattcatactggagagaaaccttacaggtgtgatgagtgtggcaaagcctttagtgtgcgatcaagcctaactacccatcaggcaattcatactggagaaaagccttacaaatgtaatgactgcggtaaggtcttcacacaaaattcacaccttgcaagtcatcggggaattcattctggagagaaaccttacaagtgtgatgaatgtggtaaagccttcagtcaaacatcacaacttgcaaggcattggagagttcatactggagaaaaaccttacaagtgtaatgagtgtggcaaagcctttagtgttcattcaagcctaactatacatcagacaatacatactggacaaaaaccatacaaatgtaatgattgcggcaaggtcttcagacacaattcgtaccttgcaattcatcagagaattcacactggtgagaaaccttataagtgtaatgagtgcggcaaagcatttagtgtacattcaaacctagctacccatcaggtcatccatactggagaaaaaccttacaaatgtaatgaatgtggcaaggtcttcactcaaaattcacatcttgcaaatcatagaagaattcacactggagaaaaaccttataggtgtaatgagtgtgggaaagccttcagtgttcgttcaaccctaactacccatatggcagtccatactggagacaaaccttacaaatgtaaccaatgtggcaaggtctttactcaaaattcaaaccttgcaaaacatcgaagaattcatagtggatagaaaccttacaaaggacgccgggcgtggtggctcacgcctgtaatcccagcactttgggaggccgaggcggggggatcacctgaggtctcgagttcgagaccaggctggccaacacggtgaaacgctgtctctactaaaaatacaaaaattagctgggtgtggtggtgcacgcctgtaatcccagctactcgggaggctgaggcaggagaatcacttgaacctgggaggcggaggttgcagtgagcgagatcatgccattgcactccagcctgggcaacaggagtgaaactccatctccaaaaaaaaaaaaaaaaa

SEQ ID NO: 203390 - DNA, 3832 bp, Homo sapiens
  Payload ID: 20107
  Gene Name: zinc finger protein 667
  Uniprot ID: Q5HYK9
  ENST ID: ENST00000292069
  CDS Start-End: 163-1995
gcagcgcgcggtcccggggtcccggaggggagtgcgcaggcgctgagtccctgctcggctgtctcggtggtcgccgccggggtctgagcccgggaagaccgagccctgccttaccagctctctgcccatctctcagtgtggaccctaaagggggaggaaaggatgccttctgcacgggggaaatccaaatccaaggcacctataacatttggggacttagccatctacttctcccaggaggagtgggaatggctgagccccattcagaaggatttgtatgaagatgtcatgttggagaattaccggaacctggtctcgcttggtctttcctttcggagaccaaatgtgatcaccttattggagaaagggaaagcaccctggatggtagagccagtaagaagacgccgggctcctgactcggggtctaaatgtgagaccaagaagttacctccaaatcaatgcaacaaatctgggcaaagcatctgccagaaactagtttctgcacaacaaaaagctcctacacgaaagagtggctgcaacaaaaattcagtcctagtaaaacctaagaaagggcattcagggaagaaacctttaaaatgtaatgactgtggtaaaacctttagtcgaagcttctctcttaaacttcatcagaacattcatacaggagagaagccttttgaatgcagtaattgtagaaaagctttcagacagatctcatccatcctacttcatcagagaattcacagtggaaagaaaagccatgaatgcaataaatgtggggaaagcttcaatcaaagaacaacccttattctacatatgagaattcatgatggaaaggaaattcttgactgtgggaaggccttgagtcaatgtcagtctttcaatatacatcagaaaattcatgttgttgggaatgtctgccagtgcagaaagtgcggaaaagccttcaatcagatgtcatcccttttacttcataagaaaattcacaatggaaagaaaacacataaatataataaatgtgggagaggcttcaaaaagaaatcagtctttgttgtacataaaagaattcatgctggagagaaaatccctgaaaatgcgaaggccttaagtcagagtctacagcaaagaagtcaccatttagagaatccttttaaatgcagaaaatgtgggaaattatttaataggatttcacccctgatgcttcaccagagaattcacacttcagagaaaccgtacaaatgtgataaatgtgacaagttcttcaggcggctttcaacccttattctgcatctaagaattcataatggagaaaaactatacagatgcaataaatgtgagaaggtctgcaatcggcattcatcccttattcaacatcagaaagttcatacaaagaaaaagaaactatttgagtgtaaggaatgtgggaagatgttttctggaactgcaaaccttaaaatacatcagaatattcattctgaagagaaacctttcaaatgcaataaatgtagtaaagttttcggccgccaatcatttcttattgaacatcaaagaattcatactggagaaaaaccctaccagtgtgaggaatgtggaaaagccttcagccaccgaatatctctcacacgacataagagaattcatactgaagatagaccctatgaatgtgatcagtgtgggaaggccttcagccagagtgcacacctcgcccaacatgaaagaattcacactggagagaagccatatacatgcaaaacatgtggtaaggcctttagtcagcgcacatctcttattctacatgaaagaagtcatactggagagaaaccctatgaatgtaatgaatgtgggaaggcatttagcagtggctcagaccttattcgacatcagagaagtcattcttcagagaaaccctatgaatgtagtaaatgtgggaaggcatatagtcggagttcatccctgattcgacatcagaatacacattctgaagaaaaagcctaaggttgttttaaatctataaaatcaacgaatgaggctatcaaacatatggcaaatatgtatttgtctataatgtaaattttgtgtatatgggaccatttgatgatatgtcccactttgaaagccaaagagcaaaagtcattggtgattttgacctcaggatttgaaattaactgaaggaaactcagaagtttggtcagtcattgtgaatgaagatcatttttcatttgataagaattactggctgggcgcagtggcttacacctgtaaccccagcactttgggaggctgagacaggcggatcacgaggtcaagagtttgagaccacggtgaaaccctgtctctactaaaaaatacaaaattagctgggcgtggtggtgcgcacctgtaatctcagctactggagaggctgaggcaggagaatcgcttgaacccaggaggtgggggttgcaccgagcagagattgcaccactgcactccagtctgggcaacagagcaagactctgtgtcaaaaaaaaaaaaaattaccgatattttacttccagcatagttttaaagataatttattggtcacatacaacaaaatagaattgtgaagtccattatagggctctgagcctgatttaaggtcacagaaaaaagaatttgagtctgtttctcagatctagaattatcaaatataaggaacttctcggcaaaacagggtgccactttcagctgacaaacttgtgggtgagaataaagaaaagtgagtctttaggtagataaagttgtcactcataatggtgtgtaacagtagaaaccttactttaccatctccacggatatgaggatatatgatcttcatggtgtgaacgtctaacttggctgagacaagctatcagtaaaagaaccaagatatagtgaagaatgaggatttcagagccaggagaaatcagtattgttttatttggaaataaatcatctatatttatatgagtaaacattggtattttcatgtaacaatactggtatgcaataagtggtgtaatatgagttgttatggactgaatgtttatgtccctcccaaaactaattatgttaaaatcctcaccatcaatgtgatgttacttggaaatgaggcatttgggaggcaattaggattagatgaggtcatgagggtggagccctcgtgatgggattagtgcctttataagaagagacatcaggctgagcccggtggctcatgcctgtaatcccagcactttgggaggccaaggcgagtggatcatgaggtcaggagattgagacaatcctggctaacacggtgaaaccccgtctccactgaaaaaaaatacaaaaaattagccaggcacagtggcatgtgcctgtagtcccagctactcgggaggctgaaggagaagaatcgcttgaacccaggaggcggaggttgcagtgagccaggatcacgccactgtactccaccctgggcgacagagcgagactacgtctcaaaaagacatcagaaagcctgcttgctctctgcaccatgtgaggatgcaggaagaagccagctgtctacagaacaggaagagaaccctacgagaacctaaccatgctggcgacctgttctcagacttccagacttcagaactgtgagaagtaaattgttgtttaagccacccagtctatgatgttttgttatggcagccccagctaatatatggagtggaaagcctagatttatctactgggttcttttcctgtcagcagttcaacatgtgtagtagctttcagtctctgctgtttgtgccaaatatataagaaataaaatcagataacttttttgtaattggatcat

SEQ ID NO: 203391 - DNA, 4390 bp, Homo sapiens
  Payload ID: 20107
  Gene Name: zinc finger protein 667
  Uniprot ID: Q5HYK9
  ENST ID: ENST00000504904
  CDS Start-End: 721-2553
gagtccctgctcggctgtctcggtggtcgccgccggggtctgagcccgggaagaccgaggttccagccgtcctcacctcaggaggacatagctttgtgcctttcaaagccctttctcatctatcatcagggactcggaagacgagccaggtttacagccctgccttgatgtgtagtgccgagttccttgaagaaaattattttatggacaatgtatgagtctgttttcgtgctgctgataaagacatacccagactcacagttctacgtggctggggaggcctcacaatcgtgatggaaggtgaaagacacgtcttacatggccacagggagaatgagagtccctgtacagaaccatcagatcacatgagacttactcactgccatgagaacagcatgggggaaaccgcccccatgattcagttatctcccaccgggtccctcccacaacacgtggaaattatgggagctataattcaagatgagatttgagtggggacacagccagaccatatcagacaagaatcatcttctcaaatttggggtgcgtggctgagtgcacacacctgtgaaaactgcgggatgaatgcattacaacttcctggaacaagtcattttacctaagtaattggaaggggaaagccaactgatctgcttatctgccctgccttaccagctctctgcccatctctcagtgtggaccctaaagggggaggaaaggatgccttctgcacgggggaaatccaaatccaaggcacctataacatttggggacttagccatctacttctcccaggaggagtgggaatggctgagccccattcagaaggatttgtatgaagatgtcatgttggagaattaccggaacctggtctcgcttggtctttcctttcggagaccaaatgtgatcaccttattggagaaagggaaagcaccctggatggtagagccagtaagaagacgccgggctcctgactcggggtctaaatgtgagaccaagaagttacctccaaatcaatgcaacaaatctgggcaaagcatctgccagaaactagtttctgcacaacaaaaagctcctacacgaaagagtggctgcaacaaaaattcagtcctagtaaaacctaagaaagggcattcagggaagaaacctttaaaatgtaatgactgtggtaaaacctttagtcgaagcttctctcttaaacttcatcagaacattcatacaggagagaagccttttgaatgcagtaattgtagaaaagctttcagacagatctcatccatcctacttcatcagagaattcacagtggaaagaaaagccatgaatgcaataaatgtggggaaagcttcaatcaaagaacaacccttattctacatatgagaattcatgatggaaaggaaattcttgactgtgggaaggccttgagtcaatgtcagtctttcaatatacatcagaaaattcatgttgttgggaatgtctgccagtgcagaaagtgcggaaaagccttcaatcagatgtcatcccttttacttcataagaaaattcacaatggaaagaaaacacataaatataataaatgtgggagaggcttcaaaaagaaatcagtctttgttgtacataaaagaattcatgctggagagaaaatccctgaaaatgcgaaggccttaagtcagagtctacagcaaagaagtcaccatttagagaatccttttaaatgcagaaaatgtgggaaattatttaataggatttcacccctgatgcttcaccagagaattcacacttcagagaaaccgtacaaatgtgataaatgtgacaagttcttcaggcggctttcaacccttattctgcatctaagaattcataatggagaaaaactatacagatgcaataaatgtgagaaggtctgcaatcggcattcatcccttattcaacatcagaaagttcatacaaagaaaaagaaactatttgagtgtaaggaatgtgggaagatgttttctggaactgcaaaccttaaaatacatcagaatattcattctgaagagaaacctttcaaatgcaataaatgtagtaaagttttcggccgccaatcatttcttattgaacatcaaagaattcatactggagaaaaaccctaccagtgtgaggaatgtggaaaagccttcagccaccgaatatctctcacacgacataagagaattcatactgaagatagaccctatgaatgtgatcagtgtgggaaggccttcagccagagtgcacacctcgcccaacatgaaagaattcacactggagagaagccatatacatgcaaaacatgtggtaaggcctttagtcagcgcacatctcttattctacatgaaagaagtcatactggagagaaaccctatgaatgtaatgaatgtgggaaggcatttagcagtggctcagaccttattcgacatcagagaagtcattcttcagagaaaccctatgaatgtagtaaatgtgggaaggcatatagtcggagttcatccctgattcgacatcagaatacacattctgaagaaaaagcctaaggttgttttaaatctataaaatcaacgaatgaggctatcaaacatatggcaaatatgtatttgtctataatgtaaattttgtgtatatgggaccatttgatgatatgtcccactttgaaagccaaagagcaaaagtcattggtgattttgacctcaggatttgaaattaactgaaggaaactcagaagtttggtcagtcattgtgaatgaagatcatttttcatttgataagaattactggctgggcgcagtggcttacacctgtaaccccagcactttgggaggctgagacaggcggatcacgaggtcaagagtttgagaccacggtgaaaccctgtctctactaaaaaatacaaaattagctgggcgtggtggtgcgcacctgtaatctcagctactggagaggctgaggcaggagaatcgcttgaacccaggaggtgggggttgcaccgagcagagattgcaccactgcactccagtctgggcaacagagcaagactctgtgtcaaaaaaaaaaaaaattaccgatattttacttccagcatagttttaaagataatttattggtcacatacaacaaaatagaattgtgaagtccattatagggctctgagcctgatttaaggtcacagaaaaaagaatttgagtctgtttctcagatctagaattatcaaatataaggaacttctcggcaaaacagggtgccactttcagctgacaaacttgtgggtgagaataaagaaaagtgagtctttaggtagataaagttgtcactcataatggtgtgtaacagtagaaaccttactttaccatctccacggatatgaggatatatgatcttcatggtgtgaacgtctaacttggctgagacaagctatcagtaaaagaaccaagatatagtgaagaatgaggatttcagagccaggagaaatcagtattgttttatttggaaataaatcatctatatttatatgagtaaacattggtattttcatgtaacaatactggtatgcaataagtggtgtaatatgagttgttatggactgaatgtttatgtccctcccaaaactaattatgttaaaatcctcaccatcaatgtgatgttacttggaaatgaggcatttgggaggcaattaggattagatgaggtcatgagggtggagccctcgtgatgggattagtgcctttataagaagagacatcaggctgagcccggtggctcatgcctgtaatcccagcactttgggaggccaaggcgagtggatcatgaggtcaggagattgagacaatcctggctaacacggtgaaaccccgtctccactgaaaaaaaatacaaaaaattagccaggcacagtggcatgtgcctgtagtcccagctactcgggaggctgaaggagaagaatcgcttgaacccaggaggcggaggttgcagtgagccaggatcacgccactgtactccaccctgggcgacagagcgagactacgtctcaaaaagacatcagaaagcctgcttgctctctgcaccatgtgaggatgcaggaagaagccagctgtctacagaacaggaagagaaccctacgagaacctaaccatgctggcgacctgttctcagacttccagacttcagaactgtgagaagtaaattgttgtttaagccacccagtctatgatgttttgttatggcagccccagctaatatatggagtggaaagcctagatttatctactgggttcttttcctgtcagcagttcaacatgtgtagtagctttcagtctctgctgtttgtgccaaatatataagaaataaaatcagataacttttttgtaattggatcat

SEQ ID NO: 203392 - DNA, 522 bp, Homo sapiens
  Payload ID: 20107
  Gene Name: zinc finger protein 667
  ENST ID: ENST00000589946
  CDS Start-End: 270-522
tgcgtgggttctcggcccgccacggcgtggggtttgcgcccttcgctgctgtggttctcggggcttgtgcgcccaagtgtgaagttggcgccgcgtgtgaggcgagccgtgtgtgcctgtgtgtgagggagctatgtcgggaccgcggatgtgtatcgctgcgtgacccacgcgaaggaaacaatggagccattgggaagccgggagtggccctgccttaccagctctctgcccatctctcagtgtggaccctaaagggggaggaaaggatgccttctgcacgggggaaatccaaatccaaggcacctataacatttggggacttagccatctacttctcccaggaggagtgggaatggctgagccccattcagaaggatttgtatgaagatgtcatgttggagaattaccggaacctggtctcgcttggtctttcctttcggagaccaaatgtgatcaccttattggagaaagggaaagcaccctggatggtagagccagtaagaagacgccgggctcctg

SEQ ID NO: 203393 - DNA, 3921 bp, Homo sapiens
  Payload ID: 20107
  Gene Name: zinc finger protein 667
  ENST ID: ENST00000592189
  CDS Start-End: 156-431
gcggtcccggggtcccggaggggagtgcgcaggcgctgagtccctgctcggctgtctcggtggtcgccgccggggtctgagcccgggaagaccgagccctgccttaccagctctctgcccatctctcagtgtggaccctaaagggggaggaaaggatgccttctgcacgggggaaatccaaatccaaggcacctataacatttggggacttagccatctacttctcccaggaggagtgggaatggctgagccccattcagaaggatttgtatgaagatgtcatgttggagaattaccggaacctggtctcgcttggtctttcctttcggagaccaaatgtgatcaccttattggagaaagggaaagcaccctggatggtagagccagtaagaagacgccgggctcctggctggactacaatgatggcatgatctcggctcactgcaacctccgcctcctgggttcaagcaattctcgtgcctcagcctcccgagcggctgggattacagactcggggtctaaatgtgagaccaagaagttacctccaaatcaatgcaacaaatctgggcaaagcatctgccagaaactagtttctgcacaacaaaaagctcctacacgaaagagtggctgcaacaaaaattcagtcctagtaaaacctaagaaagggcattcagggaagaaacctttaaaatgtaatgactgtggtaaaacctttagtcgaagcttctctcttaaacttcatcagaacattcatacaggagagaagccttttgaatgcagtaattgtagaaaagctttcagacagatctcatccatcctacttcatcagagaattcacagtggaaagaaaagccatgaatgcaataaatgtggggaaagcttcaatcaaagaacaacccttattctacatatgagaattcatgatggaaaggaaattcttgactgtgggaaggccttgagtcaatgtcagtctttcaatatacatcagaaaattcatgttgttgggaatgtctgccagtgcagaaagtgcggaaaagccttcaatcagatgtcatcccttttacttcataagaaaattcacaatggaaagaaaacacataaatataataaatgtgggagaggcttcaaaaagaaatcagtctttgttgtacataaaagaattcatgctggagagaaaatccctgaaaatgcgaaggccttaagtcagagtctacagcaaagaagtcaccatttagagaatccttttaaatgcagaaaatgtgggaaattatttaataggatttcacccctgatgcttcaccagagaattcacacttcagagaaaccgtacaaatgtgataaatgtgacaagttcttcaggcggctttcaacccttattctgcatctaagaattcataatggagaaaaactatacagatgcaataaatgtgagaaggtctgcaatcggcattcatcccttattcaacatcagaaagttcatacaaagaaaaagaaactatttgagtgtaaggaatgtgggaagatgttttctggaactgcaaaccttaaaatacatcagaatattcattctgaagagaaacctttcaaatgcaataaatgtagtaaagttttcggccgccaatcatttcttattgaacatcaaagaattcatactggagaaaaaccctaccagtgtgaggaatgtggaaaagccttcagccaccgaatatctctcacacgacataagagaattcatactgaagatagaccctatgaatgtgatcagtgtgggaaggccttcagccagagtgcacacctcgcccaacatgaaagaattcacactggagagaagccatatacatgcaaaacatgtggtaaggcctttagtcagcgcacatctcttattctacatgaaagaagtcatactggagagaaaccctatgaatgtaatgaatgtgggaaggcatttagcagtggctcagaccttattcgacatcagagaagtcattcttcagagaaaccctatgaatgtagtaaatgtgggaaggcatatagtcggagttcatccctgattcgacatcagaatacacattctgaagaaaaagcctaaggttgttttaaatctataaaatcaacgaatgaggctatcaaacatatggcaaatatgtatttgtctataatgtaaattttgtgtatatgggaccatttgatgatatgtcccactttgaaagccaaagagcaaaagtcattggtgattttgacctcaggatttgaaattaactgaaggaaactcagaagtttggtcagtcattgtgaatgaagatcatttttcatttgataagaattactggctgggcgcagtggcttacacctgtaaccccagcactttgggaggctgagacaggcggatcacgaggtcaagagtttgagaccacggtgaaaccctgtctctactaaaaaatacaaaattagctgggcgtggtggtgcgcacctgtaatctcagctactggagaggctgaggcaggagaatcgcttgaacccaggaggtgggggttgcaccgagcagagattgcaccactgcactccagtctgggcaacagagcaagactctgtgtcaaaaaaaaaaaaaattaccgatattttacttccagcatagttttaaagataatttattggtcacatacaacaaaatagaattgtgaagtccattatagggctctgagcctgatttaaggtcacagaaaaaagaatttgagtctgtttctcagatctagaattatcaaatataaggaacttctcggcaaaacagggtgccactttcagctgacaaacttgtgggtgagaataaagaaaagtgagtctttaggtagataaagttgtcactcataatggtgtgtaacagtagaaaccttactttaccatctccacggatatgaggatatatgatcttcatggtgtgaacgtctaacttggctgagacaagctatcagtaaaagaaccaagatatagtgaagaatgaggatttcagagccaggagaaatcagtattgttttatttggaaataaatcatctatatttatatgagtaaacattggtattttcatgtaacaatactggtatgcaataagtggtgtaatatgagttgttatggactgaatgtttatgtccctcccaaaactaattatgttaaaatcctcaccatcaatgtgatgttacttggaaatgaggcatttgggaggcaattaggattagatgaggtcatgagggtggagccctcgtgatgggattagtgcctttataagaagagacatcaggctgagcccggtggctcatgcctgtaatcccagcactttgggaggccaaggcgagtggatcatgaggtcaggagattgagacaatcctggctaacacggtgaaaccccgtctccactgaaaaaaaatacaaaaaattagccaggcacagtggcatgtgcctgtagtcccagctactcgggaggctgaaggagaagaatcgcttgaacccaggaggcggaggttgcagtgagccaggatcacgccactgtactccaccctgggcgacagagcgagactacgtctcaaaaagacatcagaaagcctgcttgctctctgcaccatgtgaggatgcaggaagaagccagctgtctacagaacaggaagagaaccctacgagaacctaaccatgctggcgacctgttctcagacttccagacttcagaactgtgagaagtaaattgttgtttaagccacccagtctatgatgttttgttatggcagccccagctaatatatggagtggaaagcctagatttatctactgggttcttttcctgtcagcagttcaacatgtgtagtagctttcagtctctgctgtttgtgccaaatatataagaaataaaatcagataacttttttgtaattgg

SEQ ID NO: 203394 - DNA, 567 bp, Homo sapiens
  Payload ID: 20107
  Gene Name: zinc finger protein 667
  ENST ID: ENST00000587555
  CDS Start-End: 93-567
aaaggactgtgggcctcttcgcaaaacgtgcagccctgccttaccagctctctgcccatctctcagtgtggaccctaaagggggaggaaaggatgccttctgcacgggggaaatccaaatccaaggcacctataacatttggggacttagccatctacttctcccaggaggagtgggaatggctgagccccattcagaaggatttgtatgaagatgtcatgttggagaattaccggaacctggtctcgcttggtctttcctttcggagaccaaatgtgatcaccttattggagaaagggaaagcaccctggatggtagagccagtaagaagacgccgggctcctgactcggggtctaaatgtgagaccaagaagttacctccaaatcaatgcaacaaatctgggcaaagcatctgccagaaactagtttctgcacaacaaaaagctcctacacgaaagagtggctgcaacaaaaattcagtcctagtaaaacctaagaaagggcattcagggaagaaacctttaaaatgtaatgactgtggtaaaacctttagtcgaagcttctctc

SEQ ID NO: 203395 - DNA, 5250 bp, Homo sapiens
  Payload ID: 20107
  Gene Name: zinc finger protein 667
  ENST ID: ENST00000591790
  CDS Start-End: 1430-1813
taaggttgctggattaaagagtacaacaggggtaaataacgtgtatcttcggtcttaaagacattgccaaattgccctccattgaatttacaccaatttatctcctccagcactggataagaattctaatctcagcctttttagtgggtctcagtcttcgttggtctcttggatgcttggtatgtggttgacccttgaacagtgcaggggttagtggtaccaaccccctgtactgtagaaaatccacatagagttttcactccccaaagacttaagtactaatagtctactggtcaccttactgacacctaagcaataacctacacagtctattaacacatattttgtgtgttacatgtattgcatactctattcttacaataagctagagagaagaaaatgttattaagaaaatcataaggaaaatatatttactgttcatgaagtagagtggttttcatcgtcatggccttcaagttgagtaggctgaggaggaagaggaggagctggtcttactgtctcagaggtggaagaggtggaggagccggaagggggaggccggagaggtaggcacactcagtgtaacttctattgaaaaaaatctgcatataagtggaccctcacaattcaaactaacatggctcaagggtcaactgtattgtgagttgaaaaggaaaaggaaggcaagcaatgaccatgttccagttaccgaagacatcacatgtaaatatcctaacagcagaggtgaggtaggttttctttaccccattgtatagatgagcaaacaggctttgtgtaactttttcacagccagtaattggcagaggcaagctttgaatccaggattacctaatatcaaactgctgttctttcttccccagtagtgccgagttccttgaagaaaattattttatggacaatgtatgagtctgttttcgtgctgctgataaagacatacccagactcacagttctacgtggctggggaggcctcacaatcgtgatggaaggtgaaagacacgtcttacatggccacagggagaatgagagtccctgtacagaaccatcagatcacatgagacttactcactgccatgagaacagcatgggggaaaccgcccccatgattcagttatctcccaccgggtccctcccacaacacgtggaaattatgggagctataattcaagatgagatttgagtggggacacagccagaccatatcagacaagaatcatcttctcaaatttggggtgcgtggctgagtgcacacacctgtgaaaactgcgggatgaatgcattacaacttcctggaacaagtcattttacctaagtaattggaaggggaaagccaactgatctgcttatctgccctgccttaccagctctctgcccatctctcagtgtggaccctaaagggggaggaaaggatgccttctgcacgggggaaatccaaatccaaggcacctataacatttggggacttagccatctacttctcccaggaggagtgggaatggctgagccccattcagaaggatttgtatgaagatgtcatgttggagaattaccggaacctggtctcgcttggtctttcctttcggagaccaaatgtgatcaccttattggagaaagggaaagcaccctggatggtagagccagtaagaagacgccgggctcctgagctcactgaggcctccccagaagccaaggaggtgccagcaccatgcttgtacagcctactgaaccaggagccaattgaacctcttttgtttataaattacccactcaagtatttatttatagcaatataggaacttcctaatacaaacagactcggggtctaaatgtgagaccaagaagttacctccaaatcaatgcaacaaatctgggcaaagcatctgccagaaactagtttctgcacaacaaaaagctcctacacgaaagagtggctgcaacaaaaattcagtcctagtaaaacctaagaaagggcattcagggaagaaacctttaaaatgtaatgactgtggtaaaacctttagtcgaagcttctctcttaaacttcatcagaacattcatacaggagagaagccttttgaatgcagtaattgtagaaaagctttcagacagatctcatccatcctacttcatcagagaattcacagtggaaagaaaagccatgaatgcaataaatgtggggaaagcttcaatcaaagaacaacccttattctacatatgagaattcatgatggaaaggaaattcttgactgtgggaaggccttgagtcaatgtcagtctttcaatatacatcagaaaattcatgttgttgggaatgtctgccagtgcagaaagtgcggaaaagccttcaatcagatgtcatcccttttacttcataagaaaattcacaatggaaagaaaacacataaatataataaatgtgggagaggcttcaaaaagaaatcagtctttgttgtacataaaagaattcatgctggagagaaaatccctgaaaatgcgaaggccttaagtcagagtctacagcaaagaagtcaccatttagagaatccttttaaatgcagaaaatgtgggaaattatttaataggatttcacccctgatgcttcaccagagaattcacacttcagagaaaccgtacaaatgtgataaatgtgacaagttcttcaggcggctttcaacccttattctgcatctaagaattcataatggagaaaaactatacagatgcaataaatgtgagaaggtctgcaatcggcattcatcccttattcaacatcagaaagttcatacaaagaaaaagaaactatttgagtgtaaggaatgtgggaagatgttttctggaactgcaaaccttaaaatacatcagaatattcattctgaagagaaacctttcaaatgcaataaatgtagtaaagttttcggccgccaatcatttcttattgaacatcaaagaattcatactggagaaaaaccctaccagtgtgaggaatgtggaaaagccttcagccaccgaatatctctcacacgacataagagaattcatactgaagatagaccctatgaatgtgatcagtgtgggaaggccttcagccagagtgcacacctcgcccaacatgaaagaattcacactggagagaagccatatacatgcaaaacatgtggtaaggcctttagtcagcgcacatctcttattctacatgaaagaagtcatactggagagaaaccctatgaatgtaatgaatgtgggaaggcatttagcagtggctcagaccttattcgacatcagagaagtcattcttcagagaaaccctatgaatgtagtaaatgtgggaaggcatatagtcggagttcatccctgattcgacatcagaatacacattctgaagaaaaagcctaaggttgttttaaatctataaaatcaacgaatgaggctatcaaacatatggcaaatatgtatttgtctataatgtaaattttgtgtatatgggaccatttgatgatatgtcccactttgaaagccaaagagcaaaagtcattggtgattttgacctcaggatttgaaattaactgaaggaaactcagaagtttggtcagtcattgtgaatgaagatcatttttcatttgataagaattactggctgggcgcagtggcttacacctgtaaccccagcactttgggaggctgagacaggcggatcacgaggtcaagagtttgagaccacggtgaaaccctgtctctactaaaaaatacaaaattagctgggcgtggtggtgcgcacctgtaatctcagctactggagaggctgaggcaggagaatcgcttgaacccaggaggtgggggttgcaccgagcagagattgcaccactgcactccagtctgggcaacagagcaagactctgtgtcaaaaaaaaaaaaaattaccgatattttacttccagcatagttttaaagataatttattggtcacatacaacaaaatagaattgtgaagtccattatagggctctgagcctgatttaaggtcacagaaaaaagaatttgagtctgtttctcagatctagaattatcaaatataaggaacttctcggcaaaacagggtgccactttcagctgacaaacttgtgggtgagaataaagaaaagtgagtctttaggtagataaagttgtcactcataatggtgtgtaacagtagaaaccttactttaccatctccacggatatgaggatatatgatcttcatggtgtgaacgtctaacttggctgagacaagctatcagtaaaagaaccaagatatagtgaagaatgaggatttcagagccaggagaaatcagtattgttttatttggaaataaatcatctatatttatatgagtaaacattggtattttcatgtaacaatactggtatgcaataagtggtgtaatatgagttgttatggactgaatgtttatgtccctcccaaaactaattatgttaaaatcctcaccatcaatgtgatgttacttggaaatgaggcatttgggaggcaattaggattagatgaggtcatgagggtggagccctcgtgatgggattagtgcctttataagaagagacatcaggctgagcccggtggctcatgcctgtaatcccagcactttgggaggccaaggcgagtggatcatgaggtcaggagattgagacaatcctggctaacacggtgaaaccccgtctccactgaaaaaaaatacaaaaaattagccaggcacagtggcatgtgcctgtagtcccagctactcgggaggctgaaggagaagaatcgcttgaacccaggaggcggaggttgcagtgagccaggatcacgccactgtactccaccctgggcgacagagcgagactacgtctcaaaaagacatcagaaagcctgcttgctctctgcaccatgtgaggatgcaggaagaagccagctgtctacagaacaggaagagaaccctacgagaacctaaccatgctggcgacctgttctcagacttccagacttcagaactgtgagaagtaaattgttgtttaagccacccagtctatgatgttttgttatggcagccccagctaatatatggagtggaaagcctagatttatctactgggttcttttcctgtcagcagttcaacatgtgtagtagctttcagtctctgctgtttgtgccaaatatataagaaataaaatcagataacttttttgtaattggatcat

SEQ ID NO: 203396 - DNA, 3265 bp, Homo sapiens
  Payload ID: 20107
  Gene Name: zinc finger protein 667
  ENST ID: ENST00000629654
  CDS Start-End: 408-1586
tttcagactcggggtctaaatgtgagaccaagaagttacctccaaatcaatgcaacaaatctgggcaaagcatctgccagaaactagtttctgcacaacaaaaagctcctacacgaaagagtggctgcaacaaaaattcagtcctagtaaaacctaagaaagggcattcagggaagaaacctttaaaatgtaatgactgtggtaaaacctttagtcgaagcttctctcttaaacttcatcagaacattcatacaggagagaagccttttgaatgcagtaattgtagaaaagctttcagacagatctcatccatcctacttcatcagagaattcacagtggaaagaaaagccatgaatgcaataaatgtggggaaagcttcaatcaaagaacaacccttattctacatatgagaattcatgatggaaaggaaattcttgactgtgggaaggccttgagtcaatgtcagtctttcaatatacatcagaaaattcatgttgttgggaatgtctgccagtgcagaaagtgcggaaaagccttcaatcagatgtcatcccttttacttcataagaaaattcacaatggaaagaaaacacataaatataataaatgtgggagaggcttcaaaaagaaatcagtctttgttgtacataaaagaattcatgctggagagaaaatccctgaaaatgcgaaggccttaagtcagagtctacagcaaagaagtcaccatttagagaatccttttaaatgcagaaaatgtgggaaattatttaataggatttcacccctgatgcttcaccagagaattcacacttcagagaaaccgtacaaatgtgataaatgtgacaagttcttcaggcggctttcaacccttattctgcatctaagaattcataatggagaaaaactatacagatgcaataaatgtgagaaggtctgcaatcggcattcatcccttattcaacatcagaaagttcatacaaagaaaaagaaactatttgagtgtaaggaatgtgggaagatgttttctggaactgcaaaccttaaaatacatcagaatattcattctgaagagaaacctttcaaatgcaataaatgtagtaaagttttcggccgccaatcatttcttattgaacatcaaagaattcatactggagaaaaaccctaccagtgtgaggaatgtggaaaagccttcagccaccgaatatctctcacacgacataagagaattcatactgaagatagaccctatgaatgtgatcagtgtgggaaggccttcagccagagtgcacacctcgcccaacatgaaagaattcacactggagagaagccatatacatgcaaaacatgtggtaaggcctttagtcagcgcacatctcttattctacatgaaagaagtcatactggagagaaaccctatgaatgtaatgaatgtgggaaggcatttagcagtggctcagaccttattcgacatcagagaagtcattcttcagagaaaccctatgaatgtagtaaatgtgggaaggcatatagtcggagttcatccctgattcgacatcagaatacacattctgaagaaaaagcctaaggttgttttaaatctataaaatcaacgaatgaggctatcaaacatatggcaaatatgtatttgtctataatgtaaattttgtgtatatgggaccatttgatgatatgtcccactttgaaagccaaagagcaaaagtcattggtgattttgacctcaggatttgaaattaactgaaggaaactcagaagtttggtcagtcattgtgaatgaagatcatttttcatttgataagaattactggctgggcgcagtggcttacacctgtaaccccagcactttgggaggctgagacaggcggatcacgaggtcaagagtttgagaccacggtgaaaccctgtctctactaaaaaatacaaaaaaaaaaaaaattaccgatattttacttccagcatagttttaaagataatttattggtcacatacaacaaaatagaattgtgaagtccattatagggctctgagcctgatttaaggtcacagaaaaaagaatttgagtctgtttctcagatctagaattatcaaatataaggaacttctcggcaaaacagggtgccactttcagctgacaaacttgtgggtgagaataaagaaaagtgagtctttaggtagataaagttgtcactcataatggtgtgtaacagtagaaaccttactttaccatctccacggatatgaggatatatgatcttcatggtgtgaacgtctaacttggctgagacaagctatcagtaaaagaaccaagatatagtgaagaatgaggatttcagagccaggagaaatcagtattgttttatttggaaataaatcatctatatttatatgagtaaacattggtattttcatgtaacaatactggtatgcaataagtggtgtaatatgagttgttatggactgaatgtttatgtccctcccaaaactaattatgttaaaatcctcaccatcaatgtgatgttacttggaaatgaggcatttgggaggcaattaggattagatgaggtcatgagggtggagccctcgtgatgggattagtgcctttataagaagagacatcaggctgagcccggtggctcatgcctgtaatcccagcactttgggaggccaaggcgagtggatcatgaggtcaggagattgagacaatcctggctaacacggtgaaaccccgtctccactgaaaaaaaatacaaaaaattagccaggcacagtggcatgtgcctgtagtcccagctactcgggaggctgaaggagaagaatcgcttgaacccaggaggcggaggttgcagtgagccaggatcacgccactgtactccaccctgggcgacagagcgagactacgtctcaaaaagacatcagaaagcctgcttgctctctgcaccatgtgaggatgcaggaagaagccagctgtctacagaacaggaagagaaccctacgagaacctaaccatgctggcgacctgttctcagacttccagacttcagaactgtgagaagtaaattgttgtttaagccacccagtctatgatgttttgttatggcagccccagctaatatatggagtggaaagcctagatttatctactgggttcttttcctgtcagcagttcaacatgtgtagtagctttcagtctctgctgtttgtgccaaatatataagaaataaaatcagataacttttttgtaattgg

SEQ ID NO: 203397 - DNA, 2762 bp, Homo sapiens
  Payload ID: 20108
  Gene Name: zinc finger protein 668
  Uniprot ID: Q96K58
  ENST ID: ENST00000300849
  CDS Start-End: 685-2544
acttccggcgctaagttctaggtctgcacggctgactccgcccacgtaggtcacaacgcggcgtctttgcacgctaagctagccacacttccggcaagagcagctagaatcgttccggtgcatattgaataggcgcagaaagggagaaaaagattctacagccctggccacagtactttggtgacacttttcgtggggctctctggaggacttttcccaaggcagatggagaaaacttcgtgaaacccactccttgctattaaaggaaatgttgtggaatataattggacttaggttttgcagagcttgagcatggcctttttgtcctcccaccttctggttcttgaagacattgccggtgacctggccccagactaacacaaggcgggcgtataccgtcagcctgcctggcgtccccttgcctcagcacacacagagacctcttgcaagatgcttctctgccgccataggctggaggttccccgggaactttcccttccttcctagctgaggaagatccctcacttccgctcgccgcgccaccggtcccacctccccgccccccgctgggtcctagcgccggcccctgtttggcagggtccgggctccgtcggtgcgaggagccgacgccgacgccacggagtcagcacaagtctcatcagagaaaccccgttcaccaaggccatggaagtggaggctgcagaggcccggtccccagcccccggctacaagcgctcgggccgccgctacaagtgcctgtcctgtaccaagacatttccaaacgcgcccagggcagcgcgccacgctgccacacatgggccggcagactgctctgaagaggtggccgaggtgaagccaaagccagagacagaagctaaggcagaggaagccagtggggagaaggtgtcaggctccgcggccaagcctaggccctatgcgtgtccgctatgccccaaggcctacaagacggcacccgagctgcgcagccacgggcgcagccacacgggggagaagccctttccgtgccccgagtgcggccgccgcttcatgcagcccgtgtgcctgcgcgtgcacctggcctcgcacgctggcgaactgcccttccgctgtgcgcactgcccgaaggcctatggcgcgctctccaagctcaagatccaccagcgtggccacacaggcgagcggccttacgcctgcgccgactgcggcaagagctttgctgacccttcagtgttccgcaagcaccggcgtactcacgctggcctgcggccctacagctgtgagcgttgcggcaaagcctatgcggagctcaaggacctccgcaaccatgagcggtcccacaccggcgagcgccccttcctctgctccgagtgcgggaagagcttctcccgctcatcctcgctcacgtgccaccagcgcatccacgcggcacagaagccctaccgctgcccggcctgcggcaagggcttcacgcagctcagttcctaccagagccacgagcgcacgcactcgggggagaagcccttcctgtgcccgcgctgcggccgcatgttctccgacccctcgagcttccgtcgccaccagcgcgcccatgaaggggtgaagccataccactgcgagaagtgcggcaaggacttccggcagccggcggacctggccatgcaccggcgtgtgcacacaggcgaccggccgttcaagtgcctgcaatgtgacaagacgttcgtggcgtcctgggacctcaagcggcacgcgctggtgcactctggccagcggcccttccgctgtgaggagtgcgggcgagccttcgccgagcgtgccagcctcacgaagcatagccgggtgcactcgggggagcgccccttccactgtaacgcatgtgggaaatcctttgtggtgtcgtcgagcctgaggaagcacgagcggacccatcgaagcagtgaggccgcgggtgtgccccctgcacaggagctggtggtggggttggcgctgcctgtgggcgtggcaggtgagagttcagccgccccggcagcaggggcggggctgggggaccctccagcagggctgctagggctgcccccggagtcaggtggtgtgatggccacacagtggcaggtggtgggcatgacggtggagcatgtggaatgccaagatgctggtgtccgggaggctcctggtcccttggaaggggcaggcgaggcggggggtgaggaggctgacgagaagcccccccagtttgtgtgccgagagtgcaaggagaccttctccacaatgacgctgctgcgtcggcacgagcgctcacacccggagctccggcccttcccctgcacccagtgcggcaagagcttctctgaccgggctgggctgcgcaaacacagccgcactcacagctcagtgcgcccctacacctgcccccattgtcccaaggccttcttgagtgccagcgacttgcgcaagcatgaacgcacccaccctgtgcccatggggacccccacacccctggagcccctggtggctttgctaggaatgcctgaagaggggccggcctgaagcccatgaccccccagcaccacactccgggagcccagcccccatcgggggcttcctgtacctccttttgcctggctctgctctttagactccagatccctacccctcagcaactagctcccctgtcggccagctaagagagctgggacagtggaggctggcagaagctgagacgtgactgtctaggagtaacactcattaaagctttcattttggca

SEQ ID NO: 203398 - DNA, 2717 bp, Homo sapiens
  Payload ID: 20108
  Gene Name: zinc finger protein 668
  Uniprot ID: Q96K58
  ENST ID: ENST00000394983
  CDS Start-End: 640-2499
attgcgggcccagcaggtcctagaacccgccggctgtctccgcggttctgggctgcggacacccaggctcggcccgcgcggctgctggcccggcgcggtgtggtcccgggggtcctagagcccgccatgttttgggtttttgtcccggtcgcgtggcccgcgctgcaagatcccaggcgccggcggccccctcccctgctgaggcccggccaccactcccgcggtcctagagaacgccatcttgcaagcctttgtccctcattcggccttccgtccattcatttgttcatctcctcatccttcgttcagtcctccttgccacgtcctccgaagccacgttttctgaggcttataaccggggtcctgccctccaggggctgcctggctggcgggggcgccgcgtacagacggttgcgaggagcgaggagctccgggtttctgcaactctcggctcctcggcgcgcttcgtaggccccaccgcccttcaaactcccacaaacttaagggaccccattttactgatgaggaaactgaggtccagagcggcgtggggcccttacctctctactgccataaagtattcctgagggcactagggaagggggttcttgaaggatagaaaccccgttcaccaaggccatggaagtggaggctgcagaggcccggtccccagcccccggctacaagcgctcgggccgccgctacaagtgcctgtcctgtaccaagacatttccaaacgcgcccagggcagcgcgccacgctgccacacatgggccggcagactgctctgaagaggtggccgaggtgaagccaaagccagagacagaagctaaggcagaggaagccagtggggagaaggtgtcaggctccgcggccaagcctaggccctatgcgtgtccgctatgccccaaggcctacaagacggcacccgagctgcgcagccacgggcgcagccacacgggggagaagccctttccgtgccccgagtgcggccgccgcttcatgcagcccgtgtgcctgcgcgtgcacctggcctcgcacgctggcgaactgcccttccgctgtgcgcactgcccgaaggcctatggcgcgctctccaagctcaagatccaccagcgtggccacacaggcgagcggccttacgcctgcgccgactgcggcaagagctttgctgacccttcagtgttccgcaagcaccggcgtactcacgctggcctgcggccctacagctgtgagcgttgcggcaaagcctatgcggagctcaaggacctccgcaaccatgagcggtcccacaccggcgagcgccccttcctctgctccgagtgcgggaagagcttctcccgctcatcctcgctcacgtgccaccagcgcatccacgcggcacagaagccctaccgctgcccggcctgcggcaagggcttcacgcagctcagttcctaccagagccacgagcgcacgcactcgggggagaagcccttcctgtgcccgcgctgcggccgcatgttctccgacccctcgagcttccgtcgccaccagcgcgcccatgaaggggtgaagccataccactgcgagaagtgcggcaaggacttccggcagccggcggacctggccatgcaccggcgtgtgcacacaggcgaccggccgttcaagtgcctgcaatgtgacaagacgttcgtggcgtcctgggacctcaagcggcacgcgctggtgcactctggccagcggcccttccgctgtgaggagtgcgggcgagccttcgccgagcgtgccagcctcacgaagcatagccgggtgcactcgggggagcgccccttccactgtaacgcatgtgggaaatcctttgtggtgtcgtcgagcctgaggaagcacgagcggacccatcgaagcagtgaggccgcgggtgtgccccctgcacaggagctggtggtggggttggcgctgcctgtgggcgtggcaggtgagagttcagccgccccggcagcaggggcggggctgggggaccctccagcagggctgctagggctgcccccggagtcaggtggtgtgatggccacacagtggcaggtggtgggcatgacggtggagcatgtggaatgccaagatgctggtgtccgggaggctcctggtcccttggaaggggcaggcgaggcggggggtgaggaggctgacgagaagcccccccagtttgtgtgccgagagtgcaaggagaccttctccacaatgacgctgctgcgtcggcacgagcgctcacacccggagctccggcccttcccctgcacccagtgcggcaagagcttctctgaccgggctgggctgcgcaaacacagccgcactcacagctcagtgcgcccctacacctgcccccattgtcccaaggccttcttgagtgccagcgacttgcgcaagcatgaacgcacccaccctgtgcccatggggacccccacacccctggagcccctggtggctttgctaggaatgcctgaagaggggccggcctgaagcccatgaccccccagcaccacactccgggagcccagcccccatcgggggcttcctgtacctccttttgcctggctctgctctttagactccagatccctacccctcagcaactagctcccctgtcggccagctaagagagctgggacagtggaggctggcagaagctgagacgtgactgtctaggagtaacactcattaaagctttcattttggca

SEQ ID NO: 203399 - DNA, 386 bp, Homo sapiens
  Payload ID: 20108
  Gene Name: zinc finger protein 668
  ENST ID: ENST00000417935
  CDS Start-End: 111-386
catctagaggtggaggattgagaattgtggctggaggttcggtcgctgccgggaggaggactctgtcgctggagctgaggctggaaaaagaaaccccgttcaccaaggccatggaagtggaggctgcagaggcccggtccccagcccccggctacaagcgctcgggccgccgctacaagtgcctgtcctgtaccaagacatttccaaacgcgcccagggcagcgcgccacgctgccacacatgggccggcagactgctctgaagaggtggccgaggtgaagccaaagccagagacagaagctaaggcagaggaagccagtggggagaaggtgtcaggctccgcggccaagcctaggccctatgcgtgtccgctatgccccaaggcc

SEQ ID NO: 203400 - DNA, 2282 bp, Homo sapiens
  Payload ID: 20108
  Gene Name: zinc finger protein 668
  Uniprot ID: Q96K58
  ENST ID: ENST00000426488
  CDS Start-End: 134-2062
ctgtcacttccagacagtgccagctaccagatttagcccattggctcagcccttttctggtcccagtggctctgcggacacttggtccaactcctttcttcaatgagcagatcagggaggaaacgaacgcaggatgtcagagccaggaatgctgggcaggaaggatgtgtgggttccgagagaaaccccgttcaccaaggccatggaagtggaggctgcagaggcccggtccccagcccccggctacaagcgctcgggccgccgctacaagtgcctgtcctgtaccaagacatttccaaacgcgcccagggcagcgcgccacgctgccacacatgggccggcagactgctctgaagaggtggccgaggtgaagccaaagccagagacagaagctaaggcagaggaagccagtggggagaaggtgtcaggctccgcggccaagcctaggccctatgcgtgtccgctatgccccaaggcctacaagacggcacccgagctgcgcagccacgggcgcagccacacgggggagaagccctttccgtgccccgagtgcggccgccgcttcatgcagcccgtgtgcctgcgcgtgcacctggcctcgcacgctggcgaactgcccttccgctgtgcgcactgcccgaaggcctatggcgcgctctccaagctcaagatccaccagcgtggccacacaggcgagcggccttacgcctgcgccgactgcggcaagagctttgctgacccttcagtgttccgcaagcaccggcgtactcacgctggcctgcggccctacagctgtgagcgttgcggcaaagcctatgcggagctcaaggacctccgcaaccatgagcggtcccacaccggcgagcgccccttcctctgctccgagtgcgggaagagcttctcccgctcatcctcgctcacgtgccaccagcgcatccacgcggcacagaagccctaccgctgcccggcctgcggcaagggcttcacgcagctcagttcctaccagagccacgagcgcacgcactcgggggagaagcccttcctgtgcccgcgctgcggccgcatgttctccgacccctcgagcttccgtcgccaccagcgcgcccatgaaggggtgaagccataccactgcgagaagtgcggcaaggacttccggcagccggcggacctggccatgcaccggcgtgtgcacacaggcgaccggccgttcaagtgcctgcaatgtgacaagacgttcgtggcgtcctgggacctcaagcggcacgcgctggtgcactctggccagcggcccttccgctgtgaggagtgcgggcgagccttcgccgagcgtgccagcctcacgaagcatagccgggtgcactcgggggagcgccccttccactgtaacgcatgtgggaaatcctttgtggtgtcgtcgagcctgaggaagcacgagcggacccatcgaagcagtgaggccgcgggtgtgccccctgcacaggagctggtggtggggttggcgctgcctgtgggcgtggcaggtgagagttcagccgccccggcagcaggggcggggctgggggaccctccagcagggctgctagggctgcccccggagtcaggtggtgtgatggccacacagtggcaggtggtgggcatgacggtggagcatgtggaatgccaagatgctggtgtccgggaggctcctggtcccttggaaggggcaggcgaggcggggggtgaggaggctgacgagaagcccccccagtttgtgtgccgagagtgcaaggagaccttctccacaatgacgctgctgcgtcggcacgagcgctcacacccggagctccggcccttcccctgcacccagtgcggcaagagcttctctgaccgggctgggctgcgcaaacacagccgcactcacagctcagtgcgcccctacacctgcccccattgtcccaaggccttcttgagtgccagcgacttgcgcaagcatgaacgcacccaccctgtgcccatggggacccccacacccctggagcccctggtggctttgctaggaatgcctgaagaggggccggcctgaagcccatgaccccccagcaccacactccgggagcccagcccccatcgggggcttcctgtacctccttttgcctggctctgctctttagactccagatccctacccctcagcaactagctcccctgtcggccagctaagagagctgggacagtggaggctggcagaagctgagacgtgactgtctaggagtaacactcattaaagctttcattttggcacc

SEQ ID NO: 203401 - DNA, 400 bp, Homo sapiens
  Payload ID: 20108
  Gene Name: zinc finger protein 668
  ENST ID: ENST00000414399
  CDS Start-End: 77-400
cgtcggtgcgaggagccgacgccgacgccacggagtcagcacaagtctcatcagagaaaccccgttcaccaaggccatggaagtggaggctgcagaggcccggtccccagcccccggctacaagcgctcgggccgccgctacaagtgcctgtcctgtaccaagacatttccaaacgcgcccagggcagcgcgccacgctgccacacatgggccggcagactgctctgaagaggtggccgaggtcccacaccggcgagcgccccttcctctgctccgagtgcgggaagagcttctcccgctcatcctcgctcacgtgccaccagcgcatccacgcggcacagaagccctaccgctgcccggcctgcggcaagggcttcacgcagctcagttcctaccagag

SEQ ID NO: 203402 - DNA, 802 bp, Homo sapiens
  Payload ID: 20108
  Gene Name: zinc finger protein 668
  ENST ID: ENST00000442862
  CDS Start-End: 312-802
agattccagtctggggcggaggcccgtacagctgtgcaaggccagaattctgtgtgaacagttgctgtctctgaggactaaccatccagaggaggaaagaaaacacaaatgctggggacctgtcacttccagacagtgccagctaccagatttagcccattggctcagcccttttctggtcccaggtctgtcttttctgggcgcttggagaccttcaggccaggcccacgtctgggtacactctttatcctggcatagttcttggacactgagctgaagaaggaagatgagaaaccccgttcaccaaggccatggaagtggaggctgcagaggcccggtccccagcccccggctacaagcgctcgggccgccgctacaagtgcctgtcctgtaccaagacatttccaaacgcgcccagggcagcgcgccacgctgccacacatgggccggcagactgctctgaagaggtggccgaggtgaagccaaagccagagacagaagctaaggcagaggaagccagtggggagaaggtgtcaggctccgcggccaagcctaggccctatgcgtgtccgctatgccccaaggcctacaagacggcacccgagctgcgcagccacgggcgcagccacacgggggagaagccctttccgtgccccgagtgcggccgccgcttcatgcagcccgtgtgcctgcgcgtgcacctggcctcgcacgctggcgaactgcccttccgctgtgcgcactgcccgaaggcctatggcgcgctctccaagctcaagatccaccagcgtggccacacagg

SEQ ID NO: 203403 - DNA, 2865 bp, Homo sapiens
  Payload ID: 20108
  Gene Name: zinc finger protein 668
  Uniprot ID: Q96K58
  ENST ID: ENST00000538906
  CDS Start-End: 786-2645
attgcgggcccagcaggtcctagaacccgccggctgtctccgcggttctgggctgcggacacccaggctcggcccgcgcggctgctggcccggcgcggtgtggtcccgggggtcctagagcccgccatgttttgggtttttgtcccggtcgcgtggcccgcgctgcaagatcccaggcgccggcggccccctcccctgctgaggcccggccaccactcccgcggtcctagagaacgccatcttgcaagcctttgtccctcattcggccttccgtccattcatttgttcatctcctcatccttcgttcagtcctccttgccacgtcctccgaagccacgttttctgaggcttataaccggggtcctgccctccaggggctgcctggctggcgggggcgccgcgtacagacggttgcgaggagcgaggagctccgggtttctgcaactctcggctcctcggcgcgcttcgtaggccccaccgcccttcaaactcccacaaacttaagggaccccattttactgatgaggaaactgaggtccagagcggcgtggggcccttacctctctactgccataaagtattcctgagggcactagggaagggggttcttgaaggatgtaaaggggctttcccgttggagaaggcaggcaagggctccccgagcccaggaaactgcatctagaggtggaggattgagaattgtggctggaggttcggtcgctgccgggaggaggactctgtcgctggagctgaggctggaaaaagaaaccccgttcaccaaggccatggaagtggaggctgcagaggcccggtccccagcccccggctacaagcgctcgggccgccgctacaagtgcctgtcctgtaccaagacatttccaaacgcgcccagggcagcgcgccacgctgccacacatgggccggcagactgctctgaagaggtggccgaggtgaagccaaagccagagacagaagctaaggcagaggaagccagtggggagaaggtgtcaggctccgcggccaagcctaggccctatgcgtgtccgctatgccccaaggcctacaagacggcacccgagctgcgcagccacgggcgcagccacacgggggagaagccctttccgtgccccgagtgcggccgccgcttcatgcagcccgtgtgcctgcgcgtgcacctggcctcgcacgctggcgaactgcccttccgctgtgcgcactgcccgaaggcctatggcgcgctctccaagctcaagatccaccagcgtggccacacaggcgagcggccttacgcctgcgccgactgcggcaagagctttgctgacccttcagtgttccgcaagcaccggcgtactcacgctggcctgcggccctacagctgtgagcgttgcggcaaagcctatgcggagctcaaggacctccgcaaccatgagcggtcccacaccggcgagcgccccttcctctgctccgagtgcgggaagagcttctcccgctcatcctcgctcacgtgccaccagcgcatccacgcggcacagaagccctaccgctgcccggcctgcggcaagggcttcacgcagctcagttcctaccagagccacgagcgcacgcactcgggggagaagcccttcctgtgcccgcgctgcggccgcatgttctccgacccctcgagcttccgtcgccaccagcgcgcccatgaaggggtgaagccataccactgcgagaagtgcggcaaggacttccggcagccggcggacctggccatgcaccggcgtgtgcacacaggcgaccggccgttcaagtgcctgcaatgtgacaagacgttcgtggcgtcctgggacctcaagcggcacgcgctggtgcactctggccagcggcccttccgctgtgaggagtgcgggcgagccttcgccgagcgtgccagcctcacgaagcatagccgggtgcactcgggggagcgccccttccactgtaacgcatgtgggaaatcctttgtggtgtcgtcgagcctgaggaagcacgagcggacccatcgaagcagtgaggccgcgggtgtgccccctgcacaggagctggtggtggggttggcgctgcctgtgggcgtggcaggtgagagttcagccgccccggcagcaggggcggggctgggggaccctccagcagggctgctagggctgcccccggagtcaggtggtgtgatggccacacagtggcaggtggtgggcatgacggtggagcatgtggaatgccaagatgctggtgtccgggaggctcctggtcccttggaaggggcaggcgaggcggggggtgaggaggctgacgagaagcccccccagtttgtgtgccgagagtgcaaggagaccttctccacaatgacgctgctgcgtcggcacgagcgctcacacccggagctccggcccttcccctgcacccagtgcggcaagagcttctctgaccgggctgggctgcgcaaacacagccgcactcacagctcagtgcgcccctacacctgcccccattgtcccaaggccttcttgagtgccagcgacttgcgcaagcatgaacgcacccaccctgtgcccatggggacccccacacccctggagcccctggtggctttgctaggaatgcctgaagaggggccggcctgaagcccatgaccccccagcaccacactccgggagcccagcccccatcgggggcttcctgtacctccttttgcctggctctgctctttagactccagatccctacccctcagcaactagctcccctgtcggccagctaagagagctgggacagtggaggctggcagaagctgagacgtgactgtctaggagtaacactcattaaagctttcattttggcacc

SEQ ID NO: 203404 - DNA, 2396 bp, Homo sapiens
  Payload ID: 20108
  Gene Name: zinc finger protein 668
  Uniprot ID: Q96K58
  ENST ID: ENST00000535577
  CDS Start-End: 312-2171
agattccagtctggggcggaggcccgtacagctgtgcaaggccagaattctgtgtgaacagttgctgtctctgaggactaaccatccagaggaggaaagaaaacacaaatgctggggacctgtcacttccagacagtgccagctaccagatttagcccattggctcagcccttttctggtcccaggtctgtcttttctgggcgcttggagaccttcaggccaggcccacgtctgggtacactctttatcctggcatagttcttggacactgagctgaagaaggaagatgagaaaccccgttcaccaaggccatggaagtggaggctgcagaggcccggtccccagcccccggctacaagcgctcgggccgccgctacaagtgcctgtcctgtaccaagacatttccaaacgcgcccagggcagcgcgccacgctgccacacatgggccggcagactgctctgaagaggtggccgaggtgaagccaaagccagagacagaagctaaggcagaggaagccagtggggagaaggtgtcaggctccgcggccaagcctaggccctatgcgtgtccgctatgccccaaggcctacaagacggcacccgagctgcgcagccacgggcgcagccacacgggggagaagccctttccgtgccccgagtgcggccgccgcttcatgcagcccgtgtgcctgcgcgtgcacctggcctcgcacgctggcgaactgcccttccgctgtgcgcactgcccgaaggcctatggcgcgctctccaagctcaagatccaccagcgtggccacacaggcgagcggccttacgcctgcgccgactgcggcaagagctttgctgacccttcagtgttccgcaagcaccggcgtactcacgctggcctgcggccctacagctgtgagcgttgcggcaaagcctatgcggagctcaaggacctccgcaaccatgagcggtcccacaccggcgagcgccccttcctctgctccgagtgcgggaagagcttctcccgctcatcctcgctcacgtgccaccagcgcatccacgcggcacagaagccctaccgctgcccggcctgcggcaagggcttcacgcagctcagttcctaccagagccacgagcgcacgcactcgggggagaagcccttcctgtgcccgcgctgcggccgcatgttctccgacccctcgagcttccgtcgccaccagcgcgcccatgaaggggtgaagccataccactgcgagaagtgcggcaaggacttccggcagccggcggacctggccatgcaccggcgtgtgcacacaggcgaccggccgttcaagtgcctgcaatgtgacaagacgttcgtggcgtcctgggacctcaagcggcacgcgctggtgcactctggccagcggcccttccgctgtgaggagtgcgggcgagccttcgccgagcgtgccagcctcacgaagcatagccgggtgcactcgggggagcgccccttccactgtaacgcatgtgggaaatcctttgtggtgtcgtcgagcctgaggaagcacgagcggacccatcgaagcagtgaggccgcgggtgtgccccctgcacaggagctggtggtggggttggcgctgcctgtgggcgtggcaggtgagagttcagccgccccggcagcaggggcggggctgggggaccctccagcagggctgctagggctgcccccggagtcaggtggtgtgatggccacacagtggcaggtggtgggcatgacggtggagcatgtggaatgccaagatgctggtgtccgggaggctcctggtcccttggaaggggcaggcgaggcggggggtgaggaggctgacgagaagcccccccagtttgtgtgccgagagtgcaaggagaccttctccacaatgacgctgctgcgtcggcacgagcgctcacacccggagctccggcccttcccctgcacccagtgcggcaagagcttctctgaccgggctgggctgcgcaaacacagccgcactcacagctcagtgcgcccctacacctgcccccattgtcccaaggccttcttgagtgccagcgacttgcgcaagcatgaacgcacccaccctgtgcccatggggacccccacacccctggagcccctggtggctttgctaggaatgcctgaagaggggccggcctgaagcccatgaccccccagcaccacactccgggagcccagcccccatcgggggcttcctgtacctccttttgcctggctctgctctttagactccagatccctacccctcagcaactagctcccctgtcggccagctaagagagctgggacagtggaggctggcagaagctgagacgtgactgtctaggagtaacactcattaaagctttcattttggcaccaggtc

SEQ ID NO: 203405 - DNA, 2469 bp, Homo sapiens
  Payload ID: 20108
  Gene Name: zinc finger protein 668
  Uniprot ID: Q96K58
  ENST ID: ENST00000539836
  CDS Start-End: 324-2252
gtgcaaggccagaattctgtgtgaacagttgctgtctctgaggactaaccatccagaggaggaaagaaaacacaaatgctggggacctgtcacttccagacagtgccagctaccagatttagcccattggctcagcccttttctggtcccaggtctgtcttttctgggcgcttggagaccttcaggccaggcccacgtctgggtacactctttatcctggcatagttcttggacactgagctgaagaaggaagatgtggctctgcggacacttggtccaactcctttcttcaatgagcagatcagggaggaaacgaacgcaggatgtcagagccaggaatgctgggcaggaaggatgtgtgggttccgagagaaaccccgttcaccaaggccatggaagtggaggctgcagaggcccggtccccagcccccggctacaagcgctcgggccgccgctacaagtgcctgtcctgtaccaagacatttccaaacgcgcccagggcagcgcgccacgctgccacacatgggccggcagactgctctgaagaggtggccgaggtgaagccaaagccagagacagaagctaaggcagaggaagccagtggggagaaggtgtcaggctccgcggccaagcctaggccctatgcgtgtccgctatgccccaaggcctacaagacggcacccgagctgcgcagccacgggcgcagccacacgggggagaagccctttccgtgccccgagtgcggccgccgcttcatgcagcccgtgtgcctgcgcgtgcacctggcctcgcacgctggcgaactgcccttccgctgtgcgcactgcccgaaggcctatggcgcgctctccaagctcaagatccaccagcgtggccacacaggcgagcggccttacgcctgcgccgactgcggcaagagctttgctgacccttcagtgttccgcaagcaccggcgtactcacgctggcctgcggccctacagctgtgagcgttgcggcaaagcctatgcggagctcaaggacctccgcaaccatgagcggtcccacaccggcgagcgccccttcctctgctccgagtgcgggaagagcttctcccgctcatcctcgctcacgtgccaccagcgcatccacgcggcacagaagccctaccgctgcccggcctgcggcaagggcttcacgcagctcagttcctaccagagccacgagcgcacgcactcgggggagaagcccttcctgtgcccgcgctgcggccgcatgttctccgacccctcgagcttccgtcgccaccagcgcgcccatgaaggggtgaagccataccactgcgagaagtgcggcaaggacttccggcagccggcggacctggccatgcaccggcgtgtgcacacaggcgaccggccgttcaagtgcctgcaatgtgacaagacgttcgtggcgtcctgggacctcaagcggcacgcgctggtgcactctggccagcggcccttccgctgtgaggagtgcgggcgagccttcgccgagcgtgccagcctcacgaagcatagccgggtgcactcgggggagcgccccttccactgtaacgcatgtgggaaatcctttgtggtgtcgtcgagcctgaggaagcacgagcggacccatcgaagcagtgaggccgcgggtgtgccccctgcacaggagctggtggtggggttggcgctgcctgtgggcgtggcaggtgagagttcagccgccccggcagcaggggcggggctgggggaccctccagcagggctgctagggctgcccccggagtcaggtggtgtgatggccacacagtggcaggtggtgggcatgacggtggagcatgtggaatgccaagatgctggtgtccgggaggctcctggtcccttggaaggggcaggcgaggcggggggtgaggaggctgacgagaagcccccccagtttgtgtgccgagagtgcaaggagaccttctccacaatgacgctgctgcgtcggcacgagcgctcacacccggagctccggcccttcccctgcacccagtgcggcaagagcttctctgaccgggctgggctgcgcaaacacagccgcactcacagctcagtgcgcccctacacctgcccccattgtcccaaggccttcttgagtgccagcgacttgcgcaagcatgaacgcacccaccctgtgcccatggggacccccacacccctggagcccctggtggctttgctaggaatgcctgaagaggggccggcctgaagcccatgaccccccagcaccacactccgggagcccagcccccatcgggggcttcctgtacctccttttgcctggctctgctctttagactccagatccctacccctcagcaactagctcccctgtcggccagctaagagagctgggacagtggaggctggcagaagctgagacgtgactgtctaggagtaacactcattaaagctttcattttggc

SEQ ID NO: 203406 - DNA, 1951 bp, Homo sapiens
  Payload ID: 20109
  Gene Name: zinc finger protein 669
  Uniprot ID: Q96BR6
  ENST ID: ENST00000343381
  CDS Start-End: 174-1568
gcctggcggttgctttgtctctccttcgccggagccggctcttcctgttagtctccgctgctagttcttggctctgggaggcccaggtggctctgcagcagcctctgccaccctgtgacctgcgagtattgggacatccctagctgacgccaggacacccgggaagccgaggaatggtgagtggactgcgcctggcttcccgaagtggagaagagggctggttgaaacctgctgtggcgcgactcgggcctccacgccatcggctccggaacctgcggaccgagtcgccgtggcgtagccggggctcagtcctcttctgttcagggccgggccgggcggggcgggcagcggaacccctgcatcctgtctgtacctgcgggcgccacttccgccggccggagccctgtcgggaacccctcgcctcccctatccaggactcggtggcttttgaggatgtggctgtgaactttacccaggaggaatgggctttgctagattcttctcagaagaatctctacagagaagtgatgcaggaaacctgcaggaacctggcttctgtaggaagccaatggaaagaccagaatattgaagatcacttcgaaaaacctgggaaagatataagaaatcatatcgtacagagactgtgtgaaagtaaagaagatggtcagtatggagaagttgtcagccaaattccaaatcttgatctgaacgagaacatttctactggattaaaaccatgtgaatgcagtatttgtggaaaagtctttgtacgtcattccctccttaataggcatatcctagctcactcaggatacaaaccatatggagagaagcaatataaatgtgaacagtgtgggaaattcttcgtttctgttccaggtgttagaagacacatgataatgcacagtggaaatccagcttataaatgtacgatatgtgggaaagctttttattttctcaattcagttgaaagacatcagagaactcacacaggagaaaaaccctataaatgtaaacaatgtggtaaagcattcactgtttccggttcttgtctaatacatgaacgaactcacactggagagaaaccctacgaatgtaaggaatgtgggaaaacattcagattttcttgttcttttaagacgcatgaaaggactcacactggagaaagaccctataaatgtaccaaatgtgataaagccttcagctgttccacttcccttcgttaccatggaagcattcatactggagagagaccctatgagtgtaaacaatgtggcaaagcctttagtcgtttgagttccctttgtaaccatagaagtactcataccggagagaaaccctatgaatgtaaacaatgtgatcaagccttcagtcgcctcagttcccttcacctccacgaaagaattcatactggagaaaaaccctatgaatgtaagaaatgcggtaaagcctacactcgttccagtcaccttactcgccatgaaagaagtcatgatatagaggctgggtgtagtgactcagcctataatcccagcactttgggaggccaaggcgtgtggattgcttgagcccaggagttcataaccagcctggattaaaacaatgtgaaacaacctgggcaacatggtgaaaccctgtctttacaaaaaataaaataatgccgggcacggtggcttacgcctgtaatcccagcactttgggaggccgaggcgggtggatcacgaggtcaggagatcgagaccatcctggccaacacggtgaaaccccgtctctactaaaaatacaaaaaattagctgggcgtggtggcagacgcctgtggtcccagttactcgggaggctgaggcaggagaatggcatgaacccgggaggcggaacttgcagtgagccgagatcgcaccactgcacttcagcctgggtgacagagtgagactctgtctcaaaaaataagat

SEQ ID NO: 203407 - DNA, 489 bp, Homo sapiens
  Payload ID: 20109
  Gene Name: zinc finger protein 669
  ENST ID: ENST00000366500
  CDS Start-End: 91-306
caggtggctctgcagcagcctctgccaccctgtgacctgcgagtattgggacatccctagctgacgccaggacacccgggaagccgaggaatggactcggtggcttttgaggatgtggctgtgaactttacccaggaggaatgggctttgctagattcttctcagaagaatctctacagagaagtgatgcaggaaacctgcaggaacctggcttctgtagaaatcatatcgtacagagactgtgtgaaagtaaagaagatggtcagtatggagaagttgtcagccaaattccaaatcttgatctgaacgagaacatttctactggattaaaaccatgtgaatgcagtatttgtggaaaagtctttgtacgtcattccctccttaataggcatatcctagctcactcaggatacaaaccatatggagagaagcaatataaatgtgaacagtgtgggaaattcttcgtttctgttccaggtgttagaagac

SEQ ID NO: 203408 - DNA, 730 bp, Homo sapiens
  Payload ID: 20109
  Gene Name: zinc finger protein 669
  ENST ID: ENST00000366501
  CDS Start-End: 80-265
gcagcagcctctgccaccctgtgacctgcgagtattgggacatccctagctgacgccaggacacccgggaagccgaggaatggactcggtggcttttgaggatgtggctgtgaactttacccaggaggaatgggctttgctagattcttctcagaagaatctctacagagaagtgatgcaggaaacctgcaggaacctggcttctgaagccaatggaaagaccagaatattgaagatcacttcgaaaaacctgggaaagatataagaaatcatatcgtacagagactgtgtgaaagtaaagaagatggtcagtatggagaagttgtcagccaaattccaaatcttgatctgaacgagaacatttctactggattaaaaccatgtgaatgcagtatttgtggaaaagtctttgtacgtcattccctccttaataggcatatcctagctcactcaggatacaaaccatatggagagaagcaatataaatgtgaacagtgtgggaaattcttcgtttctgttccaggtgttagaagacacatgataatgcacagtggaaatccagcttataaatgtacgatatgtgggaaagctttttattttctcaattcagttgaaagacatcagagaactcacacaggagaaaaaccctataaatgtaaacaatgtggtaaagcattcactgtttccggttcttgtctaatacatgaacgaactcacactggagagaaac

SEQ ID NO: 203409 - DNA, 1718 bp, Homo sapiens
  Payload ID: 20109
  Gene Name: zinc finger protein 669
  Uniprot ID: Q96BR6
  ENST ID: ENST00000448299
  CDS Start-End: 170-1306
ggcggttgctttgtctctccttcgccggagccggctcttcctgttagtctccgctgctagttcttggctctgggaggcccaggtggctctgcagcagcctctgccaccctgtgacctgcgagtattgggacatccctagctgacgccaggacacccgggaagccgaggaatggactcggtggcttttgaggatgtggctgtgaactttacccaggaggaatgggctttgctagattcttctcagaagaatctctacagagaagtgatgcaggaaacctgcaggaacctggcttctgtaggaagccaatggaaagaccagaatattgaagatcacttcgaaaaacctgggaaagatataagaaatcatatcgtacagagactgtgtgaaagtaaagaagatggtcagtatggagaagttgtcagccaaattccaaatcttgatctgaacgagaacatttctactggattaaaaccatgtgaatgcagtatttgtggaaaagtctttgtacgtcattccctccttaataggcatatcctagctcactcaggatacaaaccatatggagagaagcaatataaatgtgaacagtgtgggaaattcttcgtttctgttccaggtgttagaagacacatgataatgcacagtggaaatccagcttataaatgtacgatatgtgggaaagctttttattttctcaattcagttgaaagacatcagagaactcacacaggagaaaaaccctataaatgtaaacaatgtggtaaagcattcactgtttccggttcttgtctaatacatgaacgaactcacactggagagaaaccctacgaatgtaaggaatgtgggaaaacattcagattttcttgttcttttaagacgcatgaaaggactcacactggagaaagaccctataaatgtaccaaatgtgataaagccttcagctgttccacttcccttcgttaccatggaagcattcatactggagagagaccctatgagtgtaaacaatgtggcaaagcctttagtcgtttgagttccctttgtaaccatagaagtactcataccggagagaaaccctatgaatgtaaacaatgtgatcaagccttcagtcgcctcagttcccttcacctccacgaaagaattcatactggagaaaaaccctatgaatgtaagaaatgcggtaaagcctacactcgttccagtcaccttactcgccatgaaagaagtcatgatatagaggctgggtgtagtgactcagcctataatcccagcactttgggaggccaaggcgtgtggattgcttgagcccaggagttcataaccagcctggattaaaacaatgtgaaacaacctgggcaacatggtgaaaccctgtctttacaaaaaataaaataatgccgggcacggtggcttacgcctgtaatcccagcactttgggaggccgaggcgggtggatcacgaggtcaggagatcgagaccatcctggccaacacggtgaaaccccgtctctactaaaaatacaaaaaattagctgggcgtggtggcagacgcctgtggtcccagttactcgggaggctgaggcaggagaatggcatgaacccgggaggcggaacttgcagtgagccgagatcgcaccactgcacttcagcctgggtgacagagtgagactctgtctcaaaaaataagataaaataaaataaaaaaataattagctggg

SEQ ID NO: 203410 - DNA, 584 bp, Homo sapiens
  Payload ID: 20109
  Gene Name: zinc finger protein 669
  ENST ID: ENST00000476158
  CDS Start-End: 167-584
ggttgctttgtctctccttcgccggagccggctcttcctgttagtctccgctgctagttcttggctctgggaggcccaggtggctctgcagcagcctctgccaccctgtgacctgcgagtattgggacatccctagctgacgccaggacacccgggaagccgaggaatggtgagtggactgcgcctggcttcccgaagtggagaagagggctggttgaaacctgctgtggcgcgactcgggcctccacgccatcggctccggaacctgcggaccgagtcgccgtggcgtagccggggctcagtcctcttctgttcagggccgggccgggcggggcgggcagcggaacccctgcatcctgtctgtacctgcgggcgccacttccgccggccggagccctgtcgggaacccctcgcctcccctatccaggactcggtggcttttgaggatgtggctgtgaactttacccaggaggaatgggctttgctagattcttctcagaagaatctctacagagaagtgatgcaggaaacctgcaggaacctggcttctgtagaaatcatatcgtacagagactgtgtgaaag

SEQ ID NO: 203411 - DNA, 1994 bp, Homo sapiens
  Payload ID: 20110
  Gene Name: zinc finger protein 670
  Uniprot ID: Q9BS34
  ENST ID: ENST00000366503
  CDS Start-End: 160-1329
gtgttgggcagcgcgaatgtggcgagctcggtgcgtctccgctgctccttccccttatccctgggaggtccaagtggtcccgcggcagcttctgttgctctgggacctgcaggtcccggaaggtccttagggaggaccccagacaccggagactgggaaatggattcagtgtcatttgaagatgtggctgtggcctttactcaggaggagtgggctttgctggatccttctcaaaagaatctctacagagatgtgatgcaagaaatcttcaggaacctggcttctgtaggaaacaaatcagaagaccagaatatccaagatgacttcaaaaatcctgggagaaatctaagcagtcatgtggtagagagactgtttgaaattaaagaaggcagtcaatatggagaaaccttcagccaggattcaaatttgaatctgaataagaaagtttctactggagtaaagccatgtgaatgcagtgtgtgtggaaaagtcttcatatgtcattcagcccttcataggcacatcctgtctcacattggaaacaaactatttgagtgtgaggaatgtccagagaagttatatcattgcaaacaatgtgggaaagcctttatctctctcaccagtgttgacagacacatggtaacacacactagtaatgggccttataagggtccagtgtatgagaagccttttgattttcctagtgtatttcaaatgcctcagagcacttacactggagagaaaacatataaatgtaaacattgtgataaagccttcaattattcaagttatcttcgtgaacatgaaagaactcatactggagagaaaccctatgcatgtaagaaatgtggtaaatcattcactttttccagttctcttcgccaacatgaaagatctcatactggagagaaaccctatgaatgtaaggaatgtggcaaagccttcagtcgttccacttacttgggaatacatgaaagaacgcatactggagaaaaaccctatgaatgtataaaatgtggcaaagcctttagatgttccagagtcctcagagtccatgaaaggactcacagtggagaaaagccctatgaatgtaaacaatgtggtaaagccttcaaatattctagtaacctatgtgagcatgaaagaactcacactggagtgaaaccttatggatgtaaggaatgtggtaagtcgtttacttcttccagtgcccttcgaagccatgaaaggactcatactggagaaaaaccctatgaatgtaagaaatgtggtaaagccttcagttgttccagttcccttcgaaagcatgaaagagcttatatgtggtaaaaaacaacaacaacaaaacacctctgtcaatgtaagaagtgtgttaaagctttcagttattctagtttcattagaacacgtgaaaaaattaaaaactcaaattagagagaaacccaacacatgtaaggaagattagaatgtatgcaattttcctagttcccttctaaaacttagaaggacccgtcctgggaaagaacgtcataaaatacgaaaaatgtgttagaacactttattttcccagccgctttcaaatatatttttatcagtggttcattgttaaagaaggtgtctatactttagattttcagttttttgcagggaatcatggagctgagaatttcacagatactttataagccatagtacatgagcttaataggctgtgttttgtttctcatcagttaacataatttttgtctattcatttaaaaatttgttggatccctagactaagttgaaatgtatttctaatagtaggcaattttaattttcatgtagttgtttaattgttctctaattaatggaccaatgaaaaatgagttcatgtgtgtgtgtgtgtgtgtgtgtgtgtgtgtgtattctacctttttatgggaaaactacttttttgttgtaaagattttcttctgttttctttgctaataaagaattgttattaatttgca

SEQ ID NO: 203412 - DNA, 2431 bp, Homo sapiens
  Payload ID: 20111
  Gene Name: zinc finger protein 671
  Uniprot ID: Q8TAW3
  ENST ID: ENST00000317398
  CDS Start-End: 97-1701
gtagcggacattttgtttctgtcaggctgtccctggccggggttctgtaacgcttgtgtgggccgcaggtggaggtgttgggaaagcgcggaggagatgttgtccccagtgtcccgagacgcgtctgatgctctgcagggacggaagtgcctgcgtccccgatcgagacgcctgccgctcccggcagctgtccgcgcccacggtcctatggcggagctaacggactccgcgcggggctgtgtggtctttgaggatgtgtttgtatacttctctcgggaagaatgggagcttcttgatgatgctcagagacttttgtaccatgatgtgatgctggagaactttgcacttttagcctcactgggaattgcattttccagatcacgtgcagtcatgaaactagagcgaggagaagagccctgggtgtatgaccaggtggatatgacttcagccacagaaagagaggcccagaggggacttagacctggttgttggcatggagtggaggatgaagaggtatcttctgagcagagcatttttgtagcaggagtgtcagaggtcaggactctcatggcagagctggagtctcacccatgtgacatatgtggcccaatattgaaagataccttacacctggctaaataccatgggggaaaagccaggcagaaaccatacttgtgtggggcatgtggaaagcaattctggttcagtacagactttgaccagcaccagaaccagcccaatggagggaaacttttcccaaggaaggagggcagagactctgtgaaaagctgcagagtccatgtgccagagaagaccctcacatgtgggaaaggtaggagagacttttcagccacatctggccttcttcagcatcaggcctctctcagcagcatgaagccccacaagagcactaagcttgtgagtggctttctcatgggacagaggtatcacaggtgtggtgaatgtgggaaagccttcacccgcaaagacacacttgctcggcatcagagaatccacactggagaaaggccttatgagtgtaacgaatgtgggaaattcttcagccaaagctatgacctctttaaacaccagacagttcacactggagaaaggccatacgagtgcagcgaatgtgggaaattctttagacaaatctccggcctgattgagcacaggcgagttcacacgggtgaaagactctatcagtgtggcaaatgtgggaaattttttagcagtaagtctaatctcattcgacaccaggaagttcacacaggagccaggccttatgtatgcagcgaatgtgggaaagagttcagtcggaaacacacacttgttctgcaccaacgaactcacactggagaaaggccttatgagtgcagtgaatgtgggaaggcctttagccaaagctcccaccttaatgtacactggagaattcacagcagtgattatgagtgtagcagatgtggtaaagctttcagctgcatctccaaactcattcagcaccagaaagttcactctggagaaaagccttatgagtgcagcaagtgcgggaaagccttcactcaaagacccaacctcatcaggcactggaaagtccacactggggaaaggccttatgtgtgtagtgagtgcgggagagaattcatccggaaacagacacttgttctgcaccagagggttcatgctggagaaaagctttaagagtgtagcaaatgtgggggaaagtcttaggccaatgcccctgacttactatatggtggggaactagcagtagttaatgagtgcagcagatgcaggaaagccttcccctggaggctgaaccttacccgccattgggaatttcacaccggacacaggccttagcagtctaagcaatgtgctgtctctgttcagcccaacagctcaccctagagtggaactctgggagcagccattgggagggaaccatcagtaagaagtgaaacttcatagatatggacattcccactggggagattccctgtgagtgtcaagtatgtgagatgctttcagcagctgtgttgcactttttaaatggctattggcctttgctggggcaggagccatctgctcctaccatctggcagaatcatactgcgtttaccatttaccccagcatgcttgtgacgggcagacctctcttctctccccagtccctaaaaggtgttgtgagtggtctcacagcccactaggggtcttaatttcctctcttttgatgtaaatggcatggaaataatcagctttgttcaagaggacacagaaggattctgcaaatagcctgcagagacttacctgtgttgattgatttcatatgatgctcgttatggatatatccaatatccaagtcacccagctctggaactgcctgcttcacattgctcatgataataaaggcctgttctttaagccacca

SEQ ID NO: 203413 - DNA, 2379 bp, Homo sapiens
  Payload ID: 20111
  Gene Name: zinc finger protein 671
  ENST ID: ENST00000335820
  CDS Start-End: 47-1717
cgcttgtgtgggccgcaggtggaggtgttgggaaagcgcggaggagatgttgtccccagtgtcccgagacgcgtctgatgctctgcagggacggaagtgcctgcgtccccgatcgagacgcctgccgctcccggcagctgtccgcgcccacggtcctatggcggagctaacggactccgcgcggggctgtgtggtctttgaggatgtgtttgtatacttctctcgggaagaatgggagcttcttgatgatgctcagagacttttgtaccatgatgtgatgctggagaactttgcacttttagcctcactgggaattgcattttccagatcacgtgcagtcatgaaactagagcgaggagaagagccctgggtgtatgaccaggtggatatgacttcagccacagaaagagaggcccagaggggacttagacctggttgttggcatggagtggaggatgaagaggtatcttctgagcagagcatttttgtagcaggagtgtcagaggtcaggactctcatggcagagctggagtctcacccatgtgacatatgtggcccaatattgaaagataccttacacctggctaaataccatgggggaaaagccaggcagaaaccatacttgtgtggggcatgtggaaagcaattctggttcagtacagactttgaccagcaccagaaccagcccaatggagggaaacttttcccaaggaaggagggcagagactctgtgaaaagctgcagagtccatgtgccagagaagaccctcacatgtgggaaaggtaggagagacttttcagccacatctggccttcttcagcatcaggcctctctcagcagcatgaagccccacaagagcactaagcttgtgagtggctttctcatgggacagaggtatcacaggtgtggtgaatgtgggaaagccttcacccgcaaagacacacttgctcggcatcagagaatccacactggagaaaggccttatgagtgtaacgaatgtgggaaattcttcagccaaagctatgacctctttaaacaccagacagttcacactggagaaaggccatacgagtgcagcgaatgtgggaaattctttagacaaatctccggcctgattgagcacaggcgagttcacacgggtgaaagactctatcagtgtggcaaatgtgggaaattttttagcagtaagtctaatctcattcgacaccaggaagttcacacaggagccaggccttatgtatgcagcgaatgtgggaaagagttcagtcggaaacacacacttgttctgcaccaacgaactcacactggagaaaggccttatgagtgcagtgaatgtgggaaggcctttagccaaagctcccaccttaatgtacactggagaattcacagcagtgattatgagtgtagcagatgtggtaaagctttcagctgcatctccaaactcattcagcaccagaaagttcactctggagaaaagccttatgagtgcagcaagtgcgggaaagccttcactcaaagacccaacctcatcaggcactggaaagtccacactggggaaaggccttatgtgtgtagtgagtgcgggagagaattcatccggaaacagacacttgttctgcaccagagggttcatgctggagaaaagcttaagagtgtagcaaatgtgggggaaagtcttaggccaatgcccctgacttactatatggtggggaactagcagtagttaatgagtgcagcagatgcaggaaagccttcccctggaggctgaaccttacccgccattgggaatttcacaccggacacaggccttagcagtctaagcaatgtgctgtctctgttcagcccaacagctcaccctagagtggaactctgggagcagccattgggagggaaccatcagtaagaagtgaaacttcatagatatggacattcccactggggagattccctgtgagtgtcaagtatgtgagatgctttcagcagctgtgttgcactttttaaatggctattggcctttgctggggcaggagccatctgctcctaccatctggcagaatcatactgcgtttaccatttaccccagcatgcttgtgacgggcagacctctcttctctccccagtccctaaaaggtgttgtgagtggtctcacagcccactaggggtcttaatttcctctcttttgatgtaaatggcatggaaataatcagctttgttcaagaggacacagaaggattctgcaaatagcctgcagagacttacctgtgttgattgatttcatatgatgctcgttatggatatatccaatatccaagtcacccagctctggaactgcctgcttcacattgctcatgataataaaggcctgttctttaagccacc

SEQ ID NO: 203414 - DNA, 977 bp, Homo sapiens
  Payload ID: 20111
  Gene Name: zinc finger protein 671
  ENST ID: ENST00000596939
  CDS Start-End: 88-258
attttgtttctgtcaggctgtccctggccggggttctgtaacgcttgtgtgggccgcaggtggaggtgttgggaaagcgcggaggagatgttgtccccagtgtcccgagacgcgtctgatgctctgcagggacggaagtgcctgcgtccccgatcgagacgcctgccgctcccggcagctgtccgcgcccacggtcctatggcggagctaacggactccgcgcgggaattgcattttccagatcacgtgcagtcatgaaactagagcgaggagaagagccctgggtgtatgaccaggtggatatgacttcagccacagaaagagaggcccagaggggacttagacctggtgagtggacatcggggaagggcacgatgtcaaagctgggttcaaaactggcaacattaactgttcacatcagtgtttgtttccagggccagtggccacacagcgtttctatctgtcctttcctgttcttgacacgaagatatatcatttctagtttgttagccccttgccaccctcacctctggccttcaccttacacccatgtttcaccacttctctgtctacattttttggcagtattgacctgcaattaatgttcacaagatgtgcatatattcttaaatagtctttgaacaccagctgctcacttgtagttggattttcctgggactggatacatttttcatagcactcacgagtcactaacagtcaaggccctactggaagccatttgtttggttccattcttatatcctggcccttcattggcactcccccatggtatgacctccagaggctcactacctcaaagccattccttcctcactctgaccatgcctctcattctgaaaacagtttcatgaacttattcctgcatgtgtcaaatgcacatatacaatgaggttgccccttcccacccgtaaatatgcatttaatcagcatttgtgtgttcttcaggttgttggcat

SEQ ID NO: 203415 - DNA, 1932 bp, Homo sapiens
  Payload ID: 20111
  Gene Name: zinc finger protein 671
  ENST ID: ENST00000601584
  CDS Start-End: 95-265
agcggacattttgtttctgtcaggctgtccctggccggggttctgtaacgcttgtgtgggccgcaggtggaggtgttgggaaagcgcggaggagatgttgtccccagtgtcccgagacgcgtctgatgctctgcagggacggaagtgcctgcgtccccgatcgagacgcctgccgctcccggcagctgtccgcgcccacggtcctatggcggagctaacggactccgcgcgggaattgcattttccagatcacgtgcagtcatgaaactagagcgaggagaagagccctgggtgtatgaccaggtggatatgacttcagccacagaaagagaggcccagaggggacttagacctggttgttggcatggagtggaggatgaagaggtatcttctgagcagagcatttttgtagcaggagtgtcagaggtcaggactctcatggcagagctggagtctcacccatgtgacatatgtggcccaatattgaaagataccttacacctggctaaataccatgggggaaaagccaggcagaaaccatacttgtgtggggcatgtggaaagcaattctggttcagtacagactttgaccagcaccagaaccagcccaatggagggaaacttttcccaaggaaggagggcagagactctgtgaaaagctgcagagtccatgtgccagagaagaccctcacatgtgggaaaggtaggagagacttttcagccacatctggccttcttcagcatcaggcctctctcagcagcatgaagccccacaagagcactaagcttgtgagtggctttctcatgggacagaggtatcacaggtgtggtgaatgtgggaaagccttcacccgcaaagacacacttgctcggcatcagagaatccacactggagaaaggccttatgagtgtaacgaatgtgggaaattcttcagccaaagctatgacctctttaaacaccagacagttcacactggagaaaggccatacgagtgcagcgaatgtgggaaattctttagacaaatctccggcctgattgagcacaggcgagttcacacgggtgaaagactctatcagtgtggcaaatgtgggaaattttttagcagtaagtctaatctcattcgacaccaggaagttcacacaggagccaggccttatgtatgcagcgaatgtgggaaagagttcagtcggaaacacacacttgttctgcaccaacgaactcacactggagaaaggccttatgagtgcagtgaatgtgggaaggcctttagccaaagctcccaccttaatgtacactggagaattcacagcagtgattatgagtgtagcagatgtggtaaagctttcagctgcatctccaaactcattcagcaccagaaagttcactctggagaaaagccttatgagtgcagcaagtgcgggaaagccttcactcaaagacccaacctcatcaggcactggaaagtccacactggggaaaggccttatgtgtgtagtgagtgcgggagagaattcatccggaaacagacacttgttctgcaccagagggttcatgctggagaaaagctttaagagtgtagcaaatgtgggggaaagtcttaggccaatgcccctgacttactatatggtggggaactagcagtagttaatgagtgcagcagatgcaggaaagccttcccctggaggctgaaccttacccgccattgggaatttcacaccggacacaggccttagcagtctaagcaatgtgctgtctctgttcagcccaacagctcaccctagagtggaactctgggagcagccattgggagggaaccatcagtaagaagtgaaacttcatagatatggacattcccactggggagattccctgtgagtgtcaagtatgtgagatgctttcagcagctgtgttgcactttttaaatggctatt

SEQ ID NO: 203416 - DNA, 2903 bp, Homo sapiens
  Payload ID: 20111
  Gene Name: zinc finger protein 671
  ENST ID: ENST00000600125
  CDS Start-End: 86-409
tttgtttctgtcaggctgtccctggccggggttctgtaacgcttgtgtgggccgcaggtggaggtgttgggaaagcgcggaggagatgttgtccccagtgtcccgagacgcgtctgatgctctgcagggacggaagtgcctgcgtccccgatcgagacgcctgccgctcccggcagctgtccgcgcccacggtcctatggcggagctaacggactccgcgcgggtgggtgctgcgtcctccgggccctcagtcaccctttctccgactccgaatcgtaaagtgcctgcagcccctgtgtcccaggacagcgacgcactcttggggcggggtcctatctcggtgtgggtgggtgtgggagagttacgggcggaggggacggcgcaggtaaaggctcgggggtgctgctgacccccaaacatttgggagacagggttctcatcaacacagagcagagtttgaggaactgtgactggaatggcaggctgagaagttgtcgcttcattctgagggcgttgagattaactgagggttttgaatagaaggacgtgatcttagctgggattttaagtgtctcgaaatttgctcaggggagaacattagtttggggtggggactgcgaggatggatacgaggagaccggtaaggaggctactgcagtggattccaggaatgctttggtggtggatgtaccaagagtaatggcagggctgtgtggtctttgaggatgtgtttgtatacttctctcgggaagaatgggagcttcttgatgatgctcagagacttttgtaccatgatgtgatgctggagaactttgcacttttagcctcactgggaattgcattttccagatcacgtgcagtcatgaaactagagcgaggagaagagccctgggtgtatgaccaggtggatatgacttcagccacagaaagagaggcccagaggggacttagacctggttgttggcatggagtggaggatgaagaggtatcttctgagcagagcatttttgtagcaggagtgtcagaggtcaggactctcatggcagagctggagtctcacccatgtgacatatgtggcccaatattgaaagataccttacacctggctaaataccatgggggaaaagccaggcagaaaccatacttgtgtggggcatgtggaaagcaattctggttcagtacagactttgaccagcaccagaaccagcccaatggagggaaacttttcccaaggaaggagggcagagactctgtgaaaagctgcagagtccatgtgccagagaagaccctcacatgtgggaaaggtaggagagacttttcagccacatctggccttcttcagcatcaggcctctctcagcagcatgaagccccacaagagcactaagcttgtgagtggctttctcatgggacagaggtatcacaggtgtggtgaatgtgggaaagccttcacccgcaaagacacacttgctcggcatcagagaatccacactggagaaaggccttatgagtgtaacgaatgtgggaaattcttcagccaaagctatgacctctttaaacaccagacagttcacactggagaaaggccatacgagtgcagcgaatgtgggaaattctttagacaaatctccggcctgattgagcacaggcgagttcacacgggtgaaagactctatcagtgtggcaaatgtgggaaattttttagcagtaagtctaatctcattcgacaccaggaagttcacacaggagccaggccttatgtatgcagcgaatgtgggaaagagttcagtcggaaacacacacttgttctgcaccaacgaactcacactggagaaaggccttatgagtgcagtgaatgtgggaaggcctttagccaaagctcccaccttaatgtacactggagaattcacagcagtgattatgagtgtagcagatgtggtaaagctttcagctgcatctccaaactcattcagcaccagaaagttcactctggagaaaagccttatgagtgcagcaagtgcgggaaagccttcactcaaagacccaacctcatcaggcactggaaagtccacactggggaaaggccttatgtgtgtagtgagtgcgggagagaattcatccggaaacagacacttgttctgcaccagagggttcatgctggagaaaagctttaagagtgtagcaaatgtgggggaaagtcttaggccaatgcccctgacttactatatggtggggaactagcagtagttaatgagtgcagcagatgcaggaaagccttcccctggaggctgaaccttacccgccattgggaatttcacaccggacacaggccttagcagtctaagcaatgtgctgtctctgttcagcccaacagctcaccctagagtggaactctgggagcagccattgggagggaaccatcagtaagaagtgaaacttcatagatatggacattcccactggggagattccctgtgagtgtcaagtatgtgagatgctttcagcagctgtgttgcactttttaaatggctattggcctttgctggggcaggagccatctgctcctaccatctggcagaatcatactgcgtttaccatttaccccagcatgcttgtgacgggcagacctctcttctctccccagtccctaaaaggtgttgtgagtggtctcacagcccactaggggtcttaatttcctctcttttgatgtaaatggcatggaaataatcagctttgttcaagaggacacagaaggattctgcaaatagcctgcagagacttacctgtgttgattgatttcatatgatgctcgttatggatatatccaatatccaagtcacccagctctggaactgcctgcttcacattgctcatgataataaaggcctgttctttaagccacca

SEQ ID NO: 203417 - DNA, 2989 bp, Homo sapiens
  Payload ID: 20112
  Gene Name: zinc finger protein 672
  Uniprot ID: Q499Z4
  ENST ID: ENST00000306562
  CDS Start-End: 747-2105
ctgctcgctggcctcccagtcttcccagcaaccggtgacactgcccgcgccagactgaccactagccgacgcgggcgagagggacaggagcgtgacctccccatcccgaggggccggacgctcgggcgcctccccgctccccccactcggaggccgcgcgcgccgttagccccttcctcgctcccccgccccagtcccgcagtccgggaggcgggggtcggcagccggctgagtgggaaccgcgcggtgtctgaggaggcagtcggcgaccggtttccacttcaagcgtgacccttttgcctgtgggatgagctccagcatggggtgaggtacagaagagagacttgaagagcgtgccttgggactcaagcgccaaacctgtaccctagcgagtgtcctactccgcatccgtaatggaaggaaatgcacatcttactccagaggcacaagaggaggacatcccatgcggctactcctgcccagcgtggtggggcagcagaagctccagagcccagacttgcaggctcacggtgcagggtgaacctggccacagctcaccctggaacagccacaatgtctgccccttagagaagaaccctgaaatcagaccagtttttgcggcctccccctttcctctctgttacagtgccctttccaggccttaagagaagtaaaacttagctgcagcgtcaggaggtggaccccagagtgtgagtggcacgcttccctgtgaacccgtcctcaccatgtttgccacatctggggcagtggcagcggggaagccttactcgtgcagcgaatgtggcaagagcttctgctacagctcagtgctgctgcgacatgaacgagctcacggcggtgacggccgcttccgttgcctagaatgcggtgagcgctgtgcacgggctgctgacctccgagcgcacaggcgcacgcatgctggccagaccctctacatctgcagtgagtgcggacaaagcttccgccacagcggccgtcttgacctacacttgggcgcacaccggcagcgatgccgcacttgcccctgccgcacatgcggccggcgcttcccgcacctcccggcgctgctgctacaccggcgccgccagcatctgccagagcggccccgccgctgcccgctgtgcgcccgcaccttccggcagagcgcgctgctcttccaccaggcgcgggcgcaccccttggggacaacctctgaccctgctgccccaccccaccgctgcgcgcagtgcccgcgagccttccgaagcggcgccgggctgcggagtcacgcgcgcatccacgtgtcccggagccccacgcgaccccgtgtctcagacgcccaccagtgtggcgtgtgcggcaagtgctttggcaagagctctacgctgacgcgacacctgcagacgcactcgggggagaaacccttcaagtgcccggagtgcggcaagggcttcctggagagcgccacgctggtgcgccaccagcgcacacacacgggcgagaagccgtacgcatgtggcgactgtggacgctgcttcagcgagagttccacgctgctgcgccatcggcgcagccatcagggcgagcggccacatgcgtgcgccacttgcggcaagggtttcgggcagcgctccgacctggtggtgcaccagcgcatccacacgggcgagaagcccttcgcgtgccccgagtgcggccgccgcttcagcgaccgctcggacctcaccaagcaccggcgcacgcacacgggcgagaagccctaccgctgcgaactgtgcggcaagcggttcacgtgcgtgtccaatctcaacgtgcatcggcgcaaccatgccggccacaagccacacaaatgccccgagtgcagcaaggccttcagcgtcgcctccaagcttgcactgcaccgcaagacgcacctgggcgaacggccagcggagtgcgcagagtgcggcaagtgcttcagccacagccgctcgctgtcacagcatcagcgggcccacacgcgcgcccgcaccgctgccgccgttgccatccagtccgcagtgggcactgccctcgtctttgaggggccggctgaacaggaaaagccagggttctctgtgtcctagttgagggaggcttgctgaggcttctctaaaggtggttgggcaagcacctatatagtatcacggggacagttgaggcaactcgtagatggagatttgggaaaagacgatgtggcctcctacctttccagtttctgttggcagcccttcacgtagcctcctgcctcgcctctacacctactaccctgtcggcccttttgccatgctgtcctcgtataactcggattctctcctcaggtgtaggtgcagggagtcagggaacccttagactcccctgtgtgcaagagcccaggtgttggtgtgtccctttaatgctactgtgctctctggtgtttctgattttcctgcctttattctgtcttctcttgtcctatctcattccagcccacatcttctcctttcctgattacttttgttgtcctgcctcttcaggtaatggtcacagatttggctgtaggcacgttaccagccctgtggcttcttgactcttggttccctgttaactctgtttctgagaaatgtgggtatggaggtgggtgggaaagctcacttccatgaaggatgtctccatgctaggagctgcctgcaccctggcagaggtggccagtcacgtgaaggtgggcagggcccttagcatggccacacatgtccccagggcagatcaaggggcctctcagaaccatgttccccagccaggtgaggaccattttcactgggacccaggccaaaaccatgtgggtgcacaaagccaggcactgccaagtggaacatgaggttatttccaaatcatgggagccaccagcagggagagggcaggatggaaaatcccctggagccggtcaactttttgctcatggctagtgaaataaagttgtttgagtactaga

SEQ ID NO: 203418 - DNA, 583 bp, Homo sapiens
  Payload ID: 20112
  Gene Name: zinc finger protein 672
  ENST ID: ENST00000505503
  CDS Start-End: 573-583
agactgaccactagccgacgcgggcgagagggacaggagcgtgacctccccatcccgaggggccggacgctcgggcgcctccccgctccccccactcggaggccgcgcgcgccgttagccccttcctcgctcccccgccccagtcccgcagtccgggaggcgggggtcggcagccggctgagtgggaaccgcgcggtgtctgaggaggcagtcggcgaccggtttccacttcaagcgtgacccttttgcctgtgggatgagctccagcatggggtgaggtacagaagagagacttgaagagcgtgccttgggactcaagcgccaaacctgtaccctagcgagtgtcctactccgcatccgtaatggaaggaaatgcacatcttactccagaggcacaagaggaggacatcccatgcggctactcctgcccagcgtggtggggcagcagaagctccagagcccagacttgcagtgccctttccaggccttaagagaagtaaaacttagctgcagcgtcaggaggtggaccccagagtgtgagtggcacgcttccctgtgaacccgtcctcaccatgtttgccac

SEQ ID NO: 203419 - DNA, 883 bp, Homo sapiens
  Payload ID: 20112
  Gene Name: zinc finger protein 672
  ENST ID: ENST00000423362
  CDS Start-End: 773-883
ttcccttctttcatcttggagcccacagttcgcgcaagtggagctatggaaggcccatgctgtgctgttctaatcatgtgagggattcttaggggttgagggggaaggactgaaaacggctgcagaccgtttaggatgcctggagtggagacaggagttaagccccttactcagagtcgctcttaagaactgcccagggccgggcacagtggctcatgcctgttatcctagcactttgggaggccaaagtgggaggctctcttgagctcgggagttcaagaccagcctgggcaacatggtttccacttcaagcgtgacccttttgcctgtgggatgagctccagcatggggtgaggtacagaagagagacttgaagagcgtgccttgggactcaagcgccaaacctgtaccctagcgagtgtcctactccgcatccgtaatggaaggaaatgcacatcttactccagaggcacaagaggaggacatcccatgcggctactcctgcccagcgtggtggggcagcagaagctccagagcccagacttgcaggctcacggtgcagggtgaacctggccacagctcaccctggaacagccacaatgtctgccccttagagaagaaccctgaaatcagaccagtttttgcggcctccccctttcctctctgttacagtgccctttccaggccttaagagaagtaaaacttagctgcagcgtcaggaggtggaccccagagtgtgagtggcacgcttccctgtgaacccgtcctcaccatgtttgccacatctggggcagtggcagcggggaagccttactcgtgcagcgaatgtggcaagagcttctgctacagctcagtgctgctgcgacatgaacgagctcacggc

SEQ ID NO: 203420 - DNA, 930 bp, Homo sapiens
  Payload ID: 20112
  Gene Name: zinc finger protein 672
  ENST ID: ENST00000428515
  CDS Start-End: 722-930
ctgagccgacttaagggggcaacggccgccaccgggttctggcagcgttaaacgttccccactacgtttttggtgcccggtctcgccctccaagtcggctggcgccacgggcaaggggctagggtaggctcggggttgggaaggggctcgctcaaagaaagtttgcccagcaacttgtgacgcgcgccgactgaggcgccccaggattggctgcgctgctgtgggccacggaaagcgacctgttcaggtttccacttcaagcgtgacccttttgcctgtgggatgagctccagcatggggtgaggtacagaagagagacttgaagagcgtgccttgggactcaagcgccaaacctgtaccctagcgagtgtcctactccgcatccgtaatggaaggaaatgcacatcttactccagaggcacaagaggaggacatcccatgcggctactcctgcccagcgtggtggggcagcagaagctccagagcccagacttgcaggctcacggtgcagggtgaacctggccacagctcaccctggaacagccacaatgtctgccccttagagaagaaccctgaaatcagaccagtttttgcggcctccccctttcctctctgttacagtgccctttccaggccttaagagaagtaaaacttagctgcagcgtcaggaggtggaccccagagtgtgagtggcacgcttccctgtgaacccgtcctcaccatgtttgccacatctggggcagtggcagcggggaagccttactcgtgcagcgaatgtggcaagagcttctgctacagctcagtgctgctgcgacatgaacgagctcacggcggtgacggccgcttccgttgcctagaatgcggtgagcgctgtgcacgggctgctgacctccgagcgcacaggcgcacgcatgctggccagaccctcta

SEQ ID NO: 203421 - DNA, 2274 bp, Homo sapiens
  Payload ID: 20113
  Gene Name: zinc finger protein 674
  Uniprot ID: Q2M3X9
  ENST ID: ENST00000414387
  CDS Start-End: 141-1868
ggtcagagtgcagacctgagaccactgctcaccgatttcagactccagtttatctgtgcctcggcttccccacttagtcgcagaagacttaggctgaggccccaggaagagatctccatcctttgcaggagcacaacaagatggccatgtcccaggaatcattgaccttcaaggacgtgtttgtggacttcaccctggaggagtggcagcaactggactctgcccagaagaacctctacagggatgtcatgcttgagaactacagccacctggtgtccgtggggcatctagttgggaagccagatgtgatcttcaggttgggaccaggtgacgagtcctggatggcagatggagggaccccggtacggacctgtgcagtctgggaagttgacgagcagatagatcactacaaggaaagccaagacaaatttctgtggcaagctgcattcataggcaaggaaacactgaaggatgaaagtggtcaagaatgtaaaatatgtagaaaaatcatttatctcaacacagactttgtttctgtaaaacaaagactccctaaatattattcatgggaaaggtgttcaaaacatcatttaaactttcttggtcaaaatagaagctatgtaagaaagaaagatgatggatgtaaggcatattggaaagtatgcctccattataatcttcataaagctcaacctgcagagagattttttgaccctaatcaacgagggaaagccctccaccaaaagcaagcccttagaaaaagtcagagaagtcaaactggggagaaactctacaaatgtactgaatgtggaaaagtgtttatccagaaagcaaacttagttgtacatcaaagaactcacaccggagagaaaccttatgaatgctgcgaatgtgcaaaagccttcagccagaagtcaaccctcatagcacaccagagaactcacacaggggagaagccctatgaatgcagtgaatgtggaaaaacctttatccagaagtcaactctgattaaacatcaacgaactcatacaggagagaaaccatttgtatgtgacaaatgtccaaaagcctttaagagttcatatcatcttattagacatgaaaaaacacacattagacaagcattttataaaggtattaaatgtactacgtccagccttatatatcaaagaattcacacaagtgagaaacctcagtgcagtgaacatgggaaagcctctgatgagaagcccagtcccactaaacattggagaactcatacaaaagagaacatttatgagtgtagtaaatgtgggaaaagcttcagaggaaagtcacacctctctgttcatcagagaattcatacaggagagaaaccctatgaatgtagtatatgtgggaagactttcagtggaaagtcacacctctctgtccatcatagaactcatacaggagagaaaccttatgaatgcagaagatgtgggaaagcctttggggagaagtcaacccttattgtacatcagagaatgcatacaggagagaaaccctataaatgcaacgaatgtgggaaagcctttagtgagaagtcaccactgattaaacatcagagaattcatacaggagagagaccctatgaatgcactgactgtaaaaaagccttcagtaggaagtcaactctcatcaaacatcagagaattcatacaggagaaaaaccttacaaatgtagtgaatgtgggaaggccttcagtgtgaaatcaactctcattgtgcatcacagaactcatacaggagagaaaccttatgaatgcagagactgtgggaaagcattcagtgggaagtcaactctcattaaacatcagagaagtcacacaggagataaaaacctatgattatacttgagagtgggataattatactagtagttatttgtcatttgactattactagtctcattatttgtcaaataatcatggcgagtaatcttataaatgtccagaatattggaaattcttcatatgttaatgttcatttaacttaatacaaagtacaaaagtataattccagaggtgtcaataaatgtgatcagttttttcacccagaattcttcacccaggagtgaagaactgtatgtcaaataattcaaaaggggcaaaactgaatgtagttatgtgggaaagccttcagaaataatttaaatggcactgtttatcagagtatgtatgccgaggaaaactaagaatttagtgagcttataaaaccatggtagccaggcgtggtacgtagctcacacctgta

SEQ ID NO: 203422 - DNA, 4073 bp, Homo sapiens
  Payload ID: 20113
  Gene Name: zinc finger protein 674
  Uniprot ID: Q2M3X9
  ENST ID: ENST00000523374
  CDS Start-End: 212-1957
ccggagggtggcgcttcgttcacactggctgttgtcatccgcccctgaggtttcaggctgtcggcagtgaaggtcagagtgcagacctgagaccactgctcaccgatttcagactccagtttatctgtgcctcggcttccccacttagtcgcagaagacttaggctgaggccccaggaagagatctccatcctttgcaggagcacaacaagatggccatgtcccaggaatcattgaccttcaaggacgtgtttgtggacttcaccctggaggagtggcagcaactggactctgcccagaagaacctctacagggatgtcatgcttgagaactacagccacctggtgtccgtggggcatctagttgggaagccagatgtgatcttcaggttgggaccaggtgacgagtcctggatggcagatggagggaccccggtacggacctgtgcaggtgaggacaggccagaagtctgggaagttgacgagcagatagatcactacaaggaaagccaagacaaatttctgtggcaagctgcattcataggcaaggaaacactgaaggatgaaagtggtcaagaatgtaaaatatgtagaaaaatcatttatctcaacacagactttgtttctgtaaaacaaagactccctaaatattattcatgggaaaggtgttcaaaacatcatttaaactttcttggtcaaaatagaagctatgtaagaaagaaagatgatggatgtaaggcatattggaaagtatgcctccattataatcttcataaagctcaacctgcagagagattttttgaccctaatcaacgagggaaagccctccaccaaaagcaagcccttagaaaaagtcagagaagtcaaactggggagaaactctacaaatgtactgaatgtggaaaagtgtttatccagaaagcaaacttagttgtacatcaaagaactcacaccggagagaaaccttatgaatgctgcgaatgtgcaaaagccttcagccagaagtcaaccctcatagcacaccagagaactcacacaggggagaagccctatgaatgcagtgaatgtggaaaaacctttatccagaagtcaactctgattaaacatcaacgaactcatacaggagagaaaccatttgtatgtgacaaatgtccaaaagcctttaagagttcatatcatcttattagacatgaaaaaacacacattagacaagcattttataaaggtattaaatgtactacgtccagccttatatatcaaagaattcacacaagtgagaaacctcagtgcagtgaacatgggaaagcctctgatgagaagcccagtcccactaaacattggagaactcatacaaaagagaacatttatgagtgtagtaaatgtgggaaaagcttcagaggaaagtcacacctctctgttcatcagagaattcatacaggagagaaaccctatgaatgtagtatatgtgggaagactttcagtggaaagtcacacctctctgtccatcatagaactcatacaggagagaaaccttatgaatgcagaagatgtgggaaagcctttggggagaagtcaacccttattgtacatcagagaatgcatacaggagagaaaccctataaatgcaacgaatgtgggaaagcctttagtgagaagtcaccactgattaaacatcagagaattcatacaggagagagaccctatgaatgcactgactgtaaaaaagccttcagtaggaagtcaactctcatcaaacatcagagaattcatacaggagaaaaaccttacaaatgtagtgaatgtgggaaggccttcagtgtgaaatcaactctcattgtgcatcacagaactcatacaggagagaaaccttatgaatgcagagactgtgggaaagcattcagtgggaagtcaactctcattaaacatcagagaagtcacacaggagataaaaacctatgattatacttgagagtgggataattatactagtagttatttgtcatttgactattactagtctcattatttgtcaaataatcatggcgagtaatcttataaatgtccagaatattggaaattcttcatatgttaatgttcatttaacttaatacaaagtacaaaagtataattccagaggtgtcaataaatgtgatcagttttttcacccagaattcttcacccaggagtgaagaactgtatgtcaaataattcaaaaggggcaaaactgaatgtagttatgtgggaaagccttcagaaataatttaaatggcactgtttatcagagtatgtatgccgaggaaaactaagaatttagtgagcttataaaaccatggtagccaggcgtggtacgtagctcacacctgtaatcctagcacttttgggaggctgaggtgggcagattgcttgagctcacaagtttgagaccagcctgggcaacatggcaaaactctgtctctacaaaaaatacaaaagttatctgagtgtagtggtgcatacctttagtcccagctactcaggaggttgaagtaggagggtggcttgagcccaggaggcagaggttgcagtgaactgagatcgtgccactgcactccagcctgggcattatagccagaccttgtcaaataaataaataaacaaacccatggtataaatgagaggaatcatgctctatattcttttattaatagagacagggtcttgctatgttgcccaggctggtcttgaactcgtagcgttaattgatcctcccacctttgcctcccaaagcacttgtattatagatatgagccaccacacttaccatgttctttaccaaacattttgtggaagaggtgtagaggtggcaaacaattataaatttaagatatgttcactgtggagtagagtatgattatttatttatttagagatggagtttcgctcttctcgcccaggctggagtgcagtggcacgatcttggctcactgcagcctctgccttccaggttcaagtgattctcctgcctcagcctcccaagtagctgggattacaggcacccaccaccacacccggctaattctttttttttttttttttttttagtagagacgcagttttgccatgttgggcaggctggtctcgaactcctgacctcaggtaatccgcccgcctcagcctcccaaagtgctgggattataggcgagagccaccacgctcagtgagtatgacatttttaaaagaacagtataaagcataaaatatcccatgtggggcaaactcccagattattttcctaaacaaatagaaaaaatgcttcctgaaatagggtaagagaggatgagtcatcaggatccctgaaacaaagatctcaaacaggagaccttacgtatattattcatcaatatcttcagtgcaaaaatgcaaagccattacagaaagggcacatagtaagcttttacatactttccttaggaacagtgcttagaacttaaaattctccatgttttaataaagagtaataattttatggtgaagcaatataagatttaaaattttcagagtatcttccataacagcagtattatttaaagtagtgaaaaaataagacaatttaatatccaatgatagatgattaaaaattggtatgtcaggtgaaataacatgcaccaattaagactactggcaaatttgggaaaatgttcgtggtaaatcattaggtaaaaaatattataaaacaataaccatatgattaatattgtacaaacaggaagtatatgaaccattatatcagtgattctgggtggttgacatataaaaattttgtgatgagtaaagttatatgcacatataagtataaatttgtatttatttaagtataaatttgtattcacctatttcataggtgagtgtgtgtgtatagataaacacatggaacaaaaagttaggtatatctgtgtagtgtggagggaaaaagctaggaaagaaatacaccaaattattaagtaaattggcatttgaatgtggggattattgatgtgtaaaaatttttttgattgtagtctccagaaatcaccaataaagtatatcgtttaaagtg

SEQ ID NO: 203423 - DNA, 493 bp, Homo sapiens
  Payload ID: 20113
  Gene Name: zinc finger protein 674
  ENST ID: ENST00000518708
  CDS Start-End: 195-493
gttcacactggctgttgtcatccgcccctgaggtttcaggctgtcggcagtgaaggtcagagtgcagacctgagaccactgctcaccgatttcagactccagtttatctgtgcctcggcttccccacttagtcgcagaagacttaggctgaggccccaggaagagatctccatcctttgcaggagcacaacaagatggccatgtcccaggaatcattgaccttcaaggacgtgtttgtggacttcaccctggaggagtggcagcaactggactctgcccagaagaacctctacagggatgtcatgcttgagaactacagccacctggtgtccgtggggcatctagttgggaagccagatgtgatcttcaggttgggaccaggtgacgagtcctggatggcagatggagggaccccggtacggacctgtgcagtagagatggggtttctccatgttcatcaggctggtctcgaactcccagcctcaggtgatct

SEQ ID NO: 203424 - DNA, 2301 bp, Homo sapiens
  Payload ID: 20114
  Gene Name: zinc finger protein 675
  Uniprot ID: Q8TD23
  ENST ID: ENST00000359788
  CDS Start-End: 170-1876
gcttccgggatttggcggcgcctttgtctctcgctgcagccggagctccaggtctcgctttcattgctctgtgtcctctgctcctagaggtccagcctctgtgggcctgtgacctgcagaaattgagagatccacagctaagactccaggaccccctggaagcctagaaatgggactgttgacatttagggatgtggccatagaattctctctggaagaatggcaatgcctggacactgcacagcggaatttatataaaaatgtgattttagagaactacagaaacctggtcttcctgggtattgctgtctctaagcaagacctgatcacctgtctggagcaagaaaaagagcctttgactgtgaagagacatgagatggtgaatgaacccccagtaatgtgttctcattttgcccaagagttttggccagagcagaacataaaagattcttttgaaaaagtgacactgagaagatatgaaaaatgtggaaatgataattttcagttaaaaggctgtaaaagtgtggatgaatgtaagttgcacaagggaggttataatggacttaaccaatgtttaccaactatgcagagcaaaatgtttcaatgtgataaatatgtgaaagtctttaataaattttcacattcagatagacataagataaaacatatggaaaataaacctttcaaatgtaaagaatgtggcagatcattttgcatgctttcacacctaactcgacatgaaagaaattataccaaggtgaatttctgcaaatgtgaagaatgtgaaaaagctgttaaccaatcttcaaagcttactaaacataaaagaatttatacttgtgagaaactctacaaatgtcaagaatgtgacagaacttttaaccaattctcaaaccttactgaatataaaaaagattatgctcgagagaaaccatacaaatgtgaagaatgtggcaaagcctttaaccagtcctcacaccttactacacataagataattcatacaggagagaaaccctacaaatgtgaagaatgtggcaaagcctttaaccagttctcaaatcttactacacataaaaaaattcatactggagagcaaccctacatatgtgaagaatgtggcaaggcttttacccaatcctcaacccttactacacataagagaattcatactggagaaaaaccctacaaatgtgaagaatgtggaaaagcttttaaccgatcctcaaaacttactgaacataaaaacattcatactggagagcaaccctacaaatgtgaggaatgcggcaaagcttttaaccgatcctcaaatcttacggaacataggaaaattcataccgaagagaaaccctacaaatgtaaagaatgtggcaaagcttttaaacactcctcagcccttactacacataagagaattcacactggagagaaaccctacaaatgtgaagaatgtggcaaagcttttaaccgatcctcaaaacttactgaacataagaaacttcatactggaaagaaaccctacaaatgtgaagaatgtggcaaagcttttatccaatcctcaaaacttactgaacataagaaaattcattctggagagataccctacaagtgtgaagaatgtggcaaagcttttaaacactcctcatcccttactacacataaaagaattcatactggggagaaaccctacaaatgtgaagaatgtggcaaagcttttagccgatcctcaaaacttactgaacataagataattcatactggagagaaaccctataaatgtgagagatgtgacaaagcttttaaccaatctgcaaaccttactaaacataaaaaaatacatactggagagaaactacagaactggaatgtgtgataatgattttgacaacacctcaaatttttctaaatataaaggaaatcatactggtgaaaaattctagaaatgtaaagaatgtgtcaaagactttaaatggttttcacacttcattgtatgtaagataattcatactggagaaaactacaagtgtgaagaatttggcaatactgttaattaaggctcaaaccttattgcacaggaaagcgtttatacttaagaaaaattgtacaaatataaagagtgtaaaatagccattaatatctgttgacatcttaatatcagaatgttggtacttaataaaagcattataaatgcaattactgtctaaagactttaagaaaatataagcctttaaagtgaagaagagtattcgttttgaagacaaagattacaaacataaagagggttgtagtacatttact

SEQ ID NO: 203425 - DNA, 592 bp, Homo sapiens
  Payload ID: 20114
  Gene Name: zinc finger protein 675
  ENST ID: ENST00000599168
  CDS Start-End: 188-421
gctggagcagacaagatggcttccgggatttggcggcgcctttgtctctcgctgcagccggagctccaggtctcgctttcattgctctgtgtcctctgctcctagaggtccagcctctgtgggcctgtgacctgcagaaattgagagatccacagctaagactccaggaccccctggaagcctagaaatgggactgttgacatttagggatgtggccatagaattctctctggaagaatggcaatgcctggacactgcacagcggaatttatataaaaatgtgattttagagaactacagaaacctggtcttcctgggtattgctgtctctaagcaagacctgatcacctgtctggagcaagaaaaagagcctttgactgtgaagagacatgagatggtgaatgaacccccaggtaagtgagaatgaaagtgaatacaacaggtgacactgatgagaggtccaaaggtcaaagagaaagccagtccttaaaatgtgatttgggaagccgtgttttaaaggaaataatttctggaaagcctgagtattttatgctctcacatttgagcattttctgtcttatgcttttaaatt

SEQ ID NO: 203426 - DNA, 1444 bp, Homo sapiens
  Payload ID: 20114
  Gene Name: zinc finger protein 675
  ENST ID: ENST00000601935
  CDS Start-End: 165-518
cgggatttggcggcgcctttgtctctcgctgcagccggagctccaggtctcgctttcattgctctgtgtcctctgctcctagaggtccagcctctgtgggcctgtgacctgcagaaattgagagatccacagctaagactccaggaccccctggaagcctagaaatgggactgttgacatttagggatgtggccatagaattctctctggaagaatggcaatgcctggacactgcacagcggaatttatataaaaatgtgattttagagaactacagaaacctggtcttcctgggtattgctgtctctaagcaagacctgatcacctgtctggagcaagaaaaagagcctttgactgtgaagagacatgagatggtgaatgaacccccaggatctgtgggacagacccagcaggtggtgccccatgtaagaagcaatgaaatgcatcatgatggaaccctcaaaaacgaaagtgaagttactgcacaccccttaggtcctctttggattccagcatgatgcatcaaaccttaccacggcatgactagggcccaacctgctaccagaaataaaggaaatgacgatgcagaacccacaaccctggatgatgtggcttccttggatgacacaggccccagacattacctggggaatgctgaagaacacaactcaggaggctgaacaaatctgcttcagacacagataccattcaatccatataatttgttctttgctatgctttttattccacattgcaactcttatagaatactgattcttcttattctctctttttgcctgcaacccacacctgctataaactattgggcccatcttctagatctgcctttcttacggcattttacttgggaaggtacccccttctcagcctctgacaacgtgaccaattggctgggaggtattgacttacccccggtggggtccctcagtaatggcacacattggactcaggtgccaagtaacattacatatcaatccttgattggaaaagaataatattgattatactcatgtttgtcttatgttatttactggttctagggtgcaaagctggaacacaaactgtaaccattgcaccagtcaaacctgtcgctgctcagatctgtatgcttcaatcaacaaaacctgatgcaaaaaaacagaaaaaggggagatgtgggagattggtcagagtggtggaaaaaggatagggaaagaacgcaaattttctgaaatgttggaaggtcctgcagagctccaggggagaatagctgaaggcagctgttctataaccctgaggcagagagcaagcagtaggtacaagggagtgtggaagaatttatcttaaacaggcttatttacttatgttgatcaggaactgacctttgatcatttgcgtgtgtgacattccctgaaaggggaacaataaatgttaattacctgca

SEQ ID NO: 203427 - DNA, 595 bp, Homo sapiens
  Payload ID: 20114
  Gene Name: zinc finger protein 675
  ENST ID: ENST00000597074
  CDS Start-End: 108-374
attgctctgtgtcctctgctcctagaggtccagcctctgtgggcctgtgacctgcagaaattgagagatccacagctaagactccaggaccccctggaagcctagaaatgggactgttgacatttagggatgtggccatagaattctctctggaagaatggcaatgcctggacactgcacagcggaatttatataaaaatgtgattttagagaactacagaaacctggtcttcctgggtattgctgtctctaagcaagacctgatcacctgtctggagcaagaaaaagagcctttgactgtgaagagacatgagatggtgaatgaacccccagccgttgacaaacacccttgcactttctatgagtgtgactaattaagatatctcacataagtggaatcatatagtatccattttgttactggcttacttcagtaatgtgttctcattttgcccaagagttttggccagagcagaacataaaagattcttttgaaaaagtgacactgagaagatatgaaaaatgtggaaatgataattttcagttaaaaggctgtaaaagtgtggatgaatgtaagttgcacaagggaggttat

SEQ ID NO: 203428 - DNA, 543 bp, Homo sapiens
  Payload ID: 20114
  Gene Name: zinc finger protein 675
  ENST ID: ENST00000600313
  CDS Start-End: 180-536
agacaagatggcttccgggatttggcggcgcctttgtctctcgctgcagccggagctccaggtctcgctttcattgctctgtgtcctctgctcctagaggtccagcctctgtgggcctgtgacctgcagaaattgagagatccacagctaagactccaggaccccctggaagcctagaaatgggactgttgacatttagggatgtggccatagaattctctctggaagaatggcaatgcctggacactgcacagcggaatttatataaaaatgtgattttagagaactacagaaacctggtcttcctgggtattgctgtctctaagcaagacctgatcacctgtctggagcaagaaaaagagcctttgactgtgaagagacatgagatggtgaatgaacccccaggtctccctctgatgccgagccgaagctggactgtactgctgccatctctgctcactgcaacctccctgcctgattctcctgcctcagcctgccgagtgcctgcgattgcaggtgcgcgcagccatgcctgactggttt

SEQ ID NO: 203429 - DNA, 721 bp, Homo sapiens
  Payload ID: 20114
  Gene Name: zinc finger protein 675
  ENST ID: ENST00000599535
  CDS Start-End: 408-721
gcactccagcctggttaacaagaccgaaactccgtcttaaaaaatatataaataaataagttaaataaataaataaattatggggatcaccacaaaaatattggagaatttaatcaaagagtgattcaaaaattgtggagcattcagctgtggtttggagcttgtgactttatgagagcagcttgaaggaaagacttttaaagggactgttgacatttagggatgtggccatagaattctctctggaagaatggcaatgcctggacactgcacagcggaatttatataaaaatgtgattttagagaactacagaaacctggtcttcctgggtattgctgtctctaagcaagacctgatcacctgtctggagcaagaaaaagagcctttgactgtgaagagacatgagatggtgaatgaacccccagtaatgtgttctcattttgcccaagagttttggccagagcagaacataaaagattcttttgaaaaagtgacactgagaagatatgaaaaatgtggaaatgataattttcagttaaaaggctgtaaaagtgtggatgaatgtaagttgcacaagggaggttataatggacttaaccaatgtttaccaactatgcagagcaaaatgtttcaatgtgataaatatgtgaaagtctttaataaattttcacattcagatagacataagataaaacatatggaaaataaacctttcaaatg

SEQ ID NO: 203430 - DNA, 669 bp, Homo sapiens
  Payload ID: 20114
  Gene Name: zinc finger protein 675
  ENST ID: ENST00000601010
  CDS Start-End: 156-461
gcggcgcctttgtctctcgctgcagccggagctccaggtctcgctttcattgctctgtgtcctctgctcctagaggtccagcctctgtgggcctgtgacctgcagaaattgagagatccacagctaagactccaggaccccctggaagcctagaaatgggactgttgacatttagggatgtggccatagaattctctctggaagaatggcaatgcctggacactgcacagcggaatttatataaaaatgtgattttagagaactacagaaacctggtcttcctgggtattgctgtctctaagcaagacctgatcacctgtctggagcaagaaaaagagcctttgactgtgaagagacatgagatggtgaatgaacccccagagtctcgccctgtcgtccagcctgaagttcagtggtacaatctctgcttactgcaacctccacctcccaggttcaagtgattctcctgtctcagcctcctgagtagctgggactataggcacatgccaccatgcctgactaatttttgtacttttagtagagatggggtttcaccatgttggccaagctggtcttgaactcctgacctcgtgatccatcttccttggcctcccaaagttctggtacaggtgtgagccacagagcctggcccaaaattgtctttgtttt

SEQ ID NO: 203431 - DNA, 581 bp, Homo sapiens
  Payload ID: 20114
  Gene Name: zinc finger protein 675
  ENST ID: ENST00000596211
  CDS Start-End: 180-419
agacaagatggcttccgggatttggcggcgcctttgtctctcgctgcagccggagctccaggtctcgctttcattgctctgtgtcctctgctcctagaggtccagcctctgtgggcctgtgacctgcagaaattgagagatccacagctaagactccaggaccccctggaagcctagaaatgggactgttgacatttagggatgtggccatagaattctctctggaagaatggcaatgcctggacactgcacagcggaatttatataaaaatgtgattttagagaactacagaaacctggtcttcctgggtattgctgtctctaagcaagacctgatcacctgtctggagcaagaaaaagagcctttgactgtgaagagacatgagatggtgaatgaacccccaggccaaaagcaatagccgatttggataccatcaagacacctgaaaccttatcatgagccagatgccaaggaagagactctgggaggatcccaaggaccccctggttgcagccatgtcaagactgacactgagaaggaccccaactgtcatgagcaacacccattgaacacagccacc

SEQ ID NO: 203432 - DNA, 2944 bp, Homo sapiens
  Payload ID: 20115
  Gene Name: zinc finger protein 676
  Uniprot ID: Q8N7Q3
  ENST ID: ENST00000395385
  CDS Start-End: 319-2085
attacatatacacagatgttatggatcttataccactttcttttctcagagttagagaatacattagtgaacatttctgtgttgaaaactattttattgaataatttcagtcattcatataagtcagaaccagctctctctactctctccattttaccttgagtcacattaaaagttctgcccatgaccaattggtaaatatatgtgtttgtgtgtgttttccagggagcattgacatttagggatgtggccatagaattctctctggaggagtggcaatgcctggattctacacagcagaatttatataggaatgtgatgttagagaactacagaaacctggtcttcctgggtattgctgcctttaagccagacctgatcatttttctggagcaaggaaaagagccctggaatatgaagagacatgagatggtggaagaacccccagttatatgttctcatttttcccaagagttttggccagagcaaggcatagaagattctttccaaaaaatgatattgagaagatatgacaaatgtggacatgagaatttacacttaaaaattagttgtaccaatgtggatgagtgtaacgtgcacaaagaaggttataataaacttaaccagagtttaacaactacacagagcaaagtatttcaatgtggcaaatatgcaaacgtctttcataaatgttcaaattcaaacagacataagataaggcatactggagagaaaggtttgaaatgtaaagaatatgtcagatcattttgcatgctttcacacctatctcaacatgaaagaatttatactagagagaattcctacaaatgtgaagaaaatggcaaagcttttaactggtcctcaacccttacttattataagagtattcatactggagagaaaccctacaaatgtgaagaatgtggcaaagcctttagtaagttctcaatccttactaaacataaggtaattcatactggagagaaaccctacaaatgtgaagaatgtggcaaagcttttaatcgatcctcaatccttactaaacataagataattcatactggagagaaaccctacaaatgtgaagaatgtggcaaaggatttagtagcgtctcaacccttaatacacataaggcaattcatgctgaagagaagccctacaaatgtgaagaatgtggcaaagcttccaactcgtcctcaaagctcatggaacataagagaattcatactggagagaaaccctacaagtgtgaagaatgtggcaaagccttcagctggtcctcaagccttactgaacacaagagaattcatgctggagagaaaccctacaaatgtgaagaatgcgggaaagcttttaatcgatcctcaatccttactaaacataagattattcatactggagagaaaccctacaaatgtgaaggatgtggcaaagcctttagtaaggtctcaacccttaatacacataaggcaattcatgctgaagagaagccctacaaatgtgaagaatgtggcaaagcttccaactcatcctcaaagctcatggaacataagagaattcatactggagagaaaccctacaagtgtgaagaatgtggcaaagccttcagctggtcctcaagccttactgaacacaagagaattcatgctggagagaaaccctacaaatgtgaagaatgtggcaaagccttcacctggtcctcaagctttactaaacacaagagaattcatgctgcagagaaaccttacaaatgtgaagaatgtggcaaaggctttagtacgttctcaatccttactaaacataagataattcatactggagagaaacgctacaaatgtgaagaatgtggcaaagccttcagctggtcctcgatccttactgaacataagataattcatactggagagaaaccctacaaatgtgaagaatgtggcaaagccttcagcagatcctcaagccttactagacacaagagaattcatactggagagaaaccctacaaatgtgaagaatgtggcaaagcttttaagtcatcctcaactgttagttatcataagaaaattcatactggagagaatccctaaaaatgtgaagaatgtggtaaatccttcagctgattctcagtctagtaaacataagaaaattcatactggagagaaaatctacaaaggtgaagaatgtggcaaagcttttaaacagtcctcaatctttattacacataagaaaattcatgctggagagaaacactacaaacgtgaagaatgtgacaaaggcttcaaccggtcctcaaaccttgtggaacataagagaattcatactggagagaaaccctacaaatgcgaagaatgtgataaagacttcaactgttcctcacaccttactactcataaaagaattcatactggaggaaaagccctacaaatgtgaaaaacgtggcaaagcttttcattagttctcaacccttactgaacataagggaatttatacaggagggaaaccctacaaatgtgaagaatgtggcaagccttttagctgttcctcaatccttactaaacattcatgtaattcatactggagggaattcctataattgtgtggaatgtggcaaagcctttaaccagtccttaaggcttactacatataagacaactcatactggagagaaaccatgcatgtgtgaagaatgtgggaaagcctctaacagatcctcaattcttaagaaacataggctaattcatacatgagagactctacaaacctgaaagatgtgacaatgcttttggcaacacctcagacttttctgaatataaaagaaatcatatgaatgagaaatcctagaaatgtgaagaatgtgacaaagcctttaaatggctgtcacacttgattgtaggtaagataatatactggagaaaactactagaataaacaatgtggcacacattt

SEQ ID NO: 203433 - DNA, 2944 bp, Homo sapiens; identical to SEQ ID NO: 203432
  Payload ID: 20115
  Gene Name: zinc finger protein 676
  Uniprot ID: Q8N7Q3
  ENST ID: ENST00000397121
  CDS Start-End: 319-2085

SEQ ID NO: 203434 - DNA, 1848 bp, Homo sapiens
  Payload ID: 20115
  Gene Name: zinc finger protein 676
  ENST ID: ENST00000621741
  CDS Start-End: 70-1776
gtggccctatgacctgcaggtattgggagatccacaactaagtcgccaggaccccctggaagcctagaaatggacaacccgaggtatggaatgcctttcaggagagcaggtgaatgccctggggctgagaggcatctactggtgccctgtttttttggaaagggagcattgacatttagggatgtggccatagaattctctctggaggagtggcaatgcctggattctacacagcagaatttatataggaatgtgatgttagagaactacagaaacctggtcttcctgggtattgctgcctttaagccagacctgatcatttttctggagcaaggaaaagagccctggaatatgaagagacatgagatggtggaagaacccccagttatatgttctcatttttcccaagagttttggccagagcaaggcatagaagattctttccaaaaaatgatattgagaagatatgacaaatgtggacatgagaatttacacttaaaaattagttgtaccaatgtggatgagtgtaacgtgcacaaagaaggttataataaacttaaccagagtttaacaactacacagagcaaagtatttcaatgtggcaaatatgcaaacgtctttcataaatgttcaaattcaaacagacataagataaggcatactggagagaaaggtttgaaatgtaaagaatatgtcagatcattttgcatgctttcacacctatctcaacatgaaagaatttatactagagagaattcctacaaatgtgaagaaaatggcaaagcttttaactggtcctcaacccttacttattataagagtattcatactggagagaaaccctacaaatgtgaagaatgtggcaaagcctttagtaagttctcaatccttactaaacataaggtaattcatactggagagaaaccctacaaatgtgaagaatgtggcaaagcttttaatcgatcctcaatccttactaaacataagataattcatactggagagaaaccctacaaatgtgaagaatgtggcaaaggatttagtagcgtctcaacccttaatacacataagagaattcatactggagagaaaccctacaagtgtgaagaatgtggcaaagccttcagctggtcctcaagccttactgaacacaagagaattcatgctggagagaaaccctacaaatgtgaagaatgcgggaaagcttttaatcgatcctcaatccttactaaacataagattattcatactggagagaaaccctacaaatgtgaaggatgtggcaaagcctttagtaaggtctcaacccttaatacacataagagaattcatactggagagaaaccctacaagtgtgaagaatgtggcaaagccttcagctggtcctcaagccttactgaacacaagagaattcatgctggagagaaaccctacaaatgtgaagaatgtggcaaagccttcacctggtcctcaagctttactaaacacaagagaattcatgctgcagagaaaccttacaaatgtgaagaatgtggcaaaggctttagtacgttctcaatccttactaaacataagataattcatactggagagaaacgctacaaatgtgaagaatgtggcaaagccttcagctggtcctcgatccttactgaacataagataattcatactggagagaaaccctacaaatgtgaagaatgtggcaaagccttcagcagatcctcaagccttactacacaagagaattcatactggagagaaaccctacaaatgtgaagaatgtggcaaagcttttaagtcatcctcaactgttagttatcataagaaaattcatactggagagaatcc

SEQ ID NO: 203435 - DNA, 3422 bp, Homo sapiens
  Payload ID: 20116
  Gene Name: zinc finger protein 677
  Uniprot ID: Q86XU0
  ENST ID: ENST00000333952
  CDS Start-End: 81-1835
taaacaacatatttttgacatacagactgacttacctgagaaagaaactcagaggaagaggaaagaaagaagaggagggaatggctctttctcagggactgtttacattcaaggatgtggccatagaattctctcaagaggagtgggagtgcctggaccctgcccagagggccttgtacagggacgtgatgttggagaactacaggaacctgctttctctcgatgaggataacatccctccagaagatgatatttctgttggatttacaagcaagggattatcaccaaaggaaaataataaagaggaattataccatctggtgatattagaaagaaaggaaagccatggcatcaacaattttgacctcaaggaagtctgggaaaatatgcctaagtttgacagcctgtgggactatgatgtaaaaaattacaaaggaatgcctttgacctgtaacaaaaatctcactcacagaaaagatcaacaacataataaatcctcaatacatttctctttaaagcagagtgtttctataagagatagtgcacaccagtatttcatccatgacaagccatttataaggaatttgttaaaactgaaaaataacataaggtatgccggaaacaaatacgtgaagtgttttgaaaataaaattggattaagcttacaggcacagctggctgaactacagagatttcaaactggggagaaaatgtatgaatgtaatccagttgagaagtctatcaatagttcctcagtttcaccacttcctccttgtgtcaaaaacatttgtaataaatataggaagattttgaaataccctttattacatacacagtatgggagaacacacattagagaaaaatcatacaagtgtaatgactgtggaaaggcttttagcaaaagttcgaacctcactaatcatcagagaattcactctggacagagaccttacaaatgtaacgagtgtggcaaagcctttaaccagtgttcgaacctcactaggcatcagagagtccatacaggagagaaaccatatcaatgtaatatatgtggcaaggtctgtagtcaaaattcaaatcttgcaagtcatcagaggatgcatactggagagaaaccttacaaatgtaatgaatgtggtaaggcatttatccagcgttcacacctttggggtcatgaaagaattcatactggagagaaaccttacaaatgtaatgaatgtgacaaagcctttgctgaacgttcaagccttacccaacataagagaatccatactggagagaagccttacatatgtaatgagtgtggcaaagcttttaagcagtgctcacatctcactaggcatcagaatatacatcctggagagaaaccacacaaatgtaatgtgtgtggcagggcttttatccaaagttcaagtcttgtggaacatcagagaattcacactggagaaaaaccttacaaatgtaataaatgtgataaagcttttatcaaacgttcacacctttggggtcatcagagaactcatactggagagaaaccttacaaatgtactgaatgtggcaaagcctttactgaacgttcaaatcttactcagcataagaaaatccatactggagagaaaccttacaaatgtactgaatgtggcaaagcttttacccaatttgcaaacctcactagacaccagaaaatacacattgaaaagaaacattgtaaacataatatacatggtaatgctttattccaaagttcaaaccttggagatcatcaaaaaagttataatagagaaaaacatatcaaatataatgagacaaaaattaagtattcaagctgtacctagcatcaggggctccattgtgaaaagaaaccatataaaacgaaaatgtggtaaagcctttagctatggcttatgtctcacttgataccagaatatacatctttgagataaaccacacaaagataacatgtatggcaaggcttatccaaagttcaagccttgtggaacatcatagaattcttactgtagagaagccttacaaatataatgaatgtgaacagctttataaaaatatttaccctattatggttataacagaagacattcaggatggaaaccatacaaatgtggcaagtcctttaagcaatgttctgacttcaggatacaccattcatattggagagaagcattacaagtgaaggtggtaaattattttaaatttctcaatggaaattcatccttatatgcaagcattttgtcatacaaaaattcaggctagagggaactaagtcttttttccttcttgaagattaagtgattgatgttaaattcacagacaattttaaaaagtcacaaactcatggtgtgtgtcagaggagcaaggacatctgtggaaagatgtaacttcagtgttaaaaattttttattcagttatttcatatttttaaaagtatgaaatctgttgctgttaaatcttcatggcatgcttttcatttatcatgattgtctcaaggaatggatgtaagatggaagggactacttccttaggtgtggcttctttatattactgaaacctggaaaaagcaagaacactaattttttctttttttggagacagagtcttgctctgtcacccaggctggagtgcagtggcaccatctcagctcactgcaacctctgtctcccgggttcaagcaattctcctgcctcagcctcacgagtagctgggattacaggcatgcgccatcatgcctggctagttttttgtttttttgtttttgtatttttagtagagacagagtttcgccatgttggccaggctgatcttgaactcctgacctcaggtgatccacctgccttggcctcccaaagtgctgggattacaggcatgagccaccgtgcccagccaagaacactaatatacaatatactataagagcatgggggtttgtgccagaagagaggtaaaactattgtctaacatatatgctttatgtggtcaggaccccttagaattgttgatgtgactggggacctttgtcgattataggagagattggttacagtacaagatgaccatgaaacaagaagagtagggtgggacattgagagattttcatggaagtgaaatggtcggttactagagactgcatatgtggtagaaagaaatggagggggaatgatagtcaccctctcttgaaaggtagttactgttgcatatcacagattattgaacatagataggtcttatttttggaaactgaagagagaatggttaccatagaggacagttccatcaaaagaaccagagtagtgttcttataggggattcacatttggcccctgagattgcatttgataccattttatttagaatatattatacttcttatgtcttaattagtaaaatataatcatttttagtaaccc

SEQ ID NO: 203436 - DNA, 3497 bp, Homo sapiens
  Payload ID: 20116
  Gene Name: zinc finger protein 677
  Uniprot ID: Q86XU0
  ENST ID: ENST00000598513
  CDS Start-End: 152-1906
ctcgcggggctactggcgctctcggcccacacaatatgacctcggggaggatgcgaggaagatgaactgtgatgatccacttcttcttaatgaatgactgacttacctgagaaagaaactcagaggaagaggaaagaaagaagaggagggaatggctctttctcagggactgtttacattcaaggatgtggccatagaattctctcaagaggagtgggagtgcctggaccctgcccagagggccttgtacagggacgtgatgttggagaactacaggaacctgctttctctcgatgaggataacatccctccagaagatgatatttctgttggatttacaagcaagggattatcaccaaaggaaaataataaagaggaattataccatctggtgatattagaaagaaaggaaagccatggcatcaacaattttgacctcaaggaagtctgggaaaatatgcctaagtttgacagcctgtgggactatgatgtaaaaaattacaaaggaatgcctttgacctgtaacaaaaatctcactcacagaaaagatcaacaacataataaatcctcaatacatttctctttaaagcagagtgtttctataagagatagtgcacaccagtatttcatccatgacaagccatttataaggaatttgttaaaactgaaaaataacataaggtatgccggaaacaaatacgtgaagtgttttgaaaataaaattggattaagcttacaggcacagctggctgaactacagagatttcaaactggggagaaaatgtatgaatgtaatccagttgagaagtctatcaatagttcctcagtttcaccacttcctccttgtgtcaaaaacatttgtaataaatataggaagattttgaaataccctttattacatacacagtatgggagaacacacattagagaaaaatcatacaagtgtaatgactgtggaaaggcttttagcaaaagttcgaacctcactaatcatcagagaattcactctggacagagaccttacaaatgtaacgagtgtggcaaagcctttaaccagtgttcgaacctcactaggcatcagagagtccatacaggagagaaaccatatcaatgtaatatatgtggcaaggtctgtagtcaaaattcaaatcttgcaagtcatcagaggatgcatactggagagaaaccttacaaatgtaatgaatgtggtaaggcatttatccagcgttcacacctttggggtcatgaaagaattcatactggagagaaaccttacaaatgtaatgaatgtgacaaagcctttgctgaacgttcaagccttacccaacataagagaatccatactggagagaagccttacatatgtaatgagtgtggcaaagcttttaagcagtgctcacatctcactaggcatcagaatatacatcctggagagaaaccacacaaatgtaatgtgtgtggcagggcttttatccaaagttcaagtcttgtggaacatcagagaattcacactggagaaaaaccttacaaatgtaataaatgtgataaagcttttatcaaacgttcacacctttggggtcatcagagaactcatactggagagaaaccttacaaatgtactgaatgtggcaaagcctttactgaacgttcaaatcttactcagcataagaaaatccatactggagagaaaccttacaaatgtactgaatgtggcaaagcttttacccaatttgcaaacctcactagacaccagaaaatacacattgaaaagaaacattgtaaacataatatacatggtaatgctttattccaaagttcaaaccttggagatcatcaaaaaagttataatagagaaaaacatatcaaatataatgagacaaaaattaagtattcaagctgtacctagcatcaggggctccattgtgaaaagaaaccatataaaacgaaaatgtggtaaagcctttagctatggcttatgtctcacttgataccagaatatacatctttgagataaaccacacaaagataacatgtatggcaaggcttatccaaagttcaagccttgtggaacatcatagaattcttactgtagagaagccttacaaatataatgaatgtgaacagctttataaaaatatttaccctattatggttataacagaagacattcaggatggaaaccatacaaatgtggcaagtcctttaagcaatgttctgacttcaggatacaccattcatattggagagaagcattacaagtgaaggtggtaaattattttaaatttctcaatggaaattcatccttatatgcaagcattttgtcatacaaaaattcaggctagagggaactaagtcttttttccttcttgaagattaagtgattgatgttaaattcacagacaattttaaaaagtcacaaactcatggtgtgtgtcagaggagcaaggacatctgtggaaagatgtaacttcagtgttaaaaattttttattcagttatttcatatttttaaaagtatgaaatctgttgctgttaaatcttcatggcatgcttttcatttatcatgattgtctcaaggaatggatgtaagatggaagggactacttccttaggtgtggcttctttatattactgaaacctggaaaaagcaagaacactaattttttctttttttggagacagagtcttgctctgtcacccaggctggagtgcagtggcaccatctcagctcactgcaacctctgtctcccgggttcaagcaattctcctgcctcagcctcacgagtagctgggattacaggcatgcgccatcatgcctggctagttttttgtttttttgtttttgtatttttagtagagacagagtttcgccatgttggccaggctgatcttgaactcctgacctcaggtgatccacctgccttggcctcccaaagtgctgggattacaggcatgagccaccgtgcccagccaagaacactaatatacaatatactataagagcatgggggtttgtgccagaagagaggtaaaactattgtctaacatatatgctttatgtggtcaggaccccttagaattgttgatgtgactggggacctttgtcgattataggagagattggttacagtacaagatgaccatgaaacaagaagagtagggtgggacattgagagattttcatggaagtgaaatggtcggttactagagactgcatatgtggtagaaagaaatggagggggaatgatagtcaccctctcttgaaaggtagttactgttgcatatcacagattattgaacatagataggtcttatttttggaaactgaagagagaatggttaccatagaggacagttccatcaaaagaaccagagtagtgttcttataggggattcacatttggcccctgagattgcatttgataccattttatttagaatatattatacttcttatgtcttaattagtaaaatataatcatttttagtaaccctgaa

SEQ ID NO: 203437 - DNA, 796 bp, Homo sapiens
  Payload ID: 20116
  Gene Name: zinc finger protein 677
  ENST ID: ENST00000599012
  CDS Start-End: 154-387
atctcgcggggctactggcgctctcggcccacacaatatgacctcggggaggatgcgaggaagatgaactgtgatgatccacttcttcttaatgaatgactgacttacctgagaaagaaactcagaggaagaggaaagaaagaagaggagggaatggctctttctcagggactgtttacattcaaggatgtggccatagaattctctcaagaggagtgggagtgcctggaccctgcccagagggccttgtacagggacgtgatgttggagaactacaggaacctgctttctctcgatgaggataacatccctccagaagatggcgatggacaacttttggtggactctcccatggaagaggtttccttggtgacagaacattcttgaaagagaacattaattaatctgtcacagtatcattctgctacatagaggtgcctcttgaagccactgagtagagtagcctgcatgtcccagtatgctgagagagaatcaggacagccggagggataagtgcttctgaccttctggtttctgtggagtttccagtgtctcccaagggcagtgtgacaacgctggttagatatatgctgatcatcctcttggagccagcagtacaaggtgtaggagtttctcctgggaagagcattctccaagttctcaacctcatatctgcgaacatgttgaccaaactgttgctcataccacattattcatcccatacgtgcagttgtacatttttcttcagtatgatttttatgcctttattgagggagcttacaaagttgaattaggc

SEQ ID NO: 203438 - DNA, 701 bp, Homo sapiens
  Payload ID: 20116
  Gene Name: zinc finger protein 677
  ENST ID: ENST00000598806
  CDS Start-End: 173-388
cctgccgacccggaagcggatctcgcggggctactggcgctctcggcccacacaatatgacctcggggaggatgcgaggaagatgaactgtgatgatccacttcttcttaatgaatgactgacttacctgagaaagaaactcagaggaagaggaaagaaagaagaggagggaatggctctttctcagggactgtttacattcaaggatgtggccatagaattctctcaagaggagtgggagtgcctggaccctgcccagagggccttgtacagggacgtgatgttggagaactacaggaacctgctttctctcgatgaggataacatccctccagaagatggttctcaccttgcagcctgtggacagagcacactgcctcttccttagaatcctacaaaatccgacccttttattttactcccgtaccttttatttctctcccttttctagctttctactctatccgggaacttagggagaccttagtcttcctgattccatattcttctaagatttgcctctgaaagttgcttttgaaatacacattccggatgggcgtggtgcctcacgcctataatcccagcactttgggaggccgaggtgggcagatcacctgaggtcgggagttcgagaccagcctgactaacatggaaaaaccccgtctctactaaaaatacaaaaattagccgggtgtgttggc

SEQ ID NO: 203439 - DNA, 719 bp, Homo sapiens
  Payload ID: 20116
  Gene Name: zinc finger protein 677
  ENST ID: ENST00000601828
  CDS Start-End: 140-346
ctggcgctctcggcccacacaatatgacctcggggaggatgcgaggaagatgaactgtgatgatccacttcttcttaatgaatgactgacttacctgagaaagaaactcagaggaagaggaaagaaagaagaggagggaatggctctttctcagggactgtttacattcaaggatgtggccatagaattctctcaagaggagtgggagtgcctggaccctgcccagagggccttgtacagggacgtgatgttggagaactacaggaacctgctttctctcgatgaggataacatccctccagaagatggtaaccacccttgtacatctttacatttttccttgtgagtctcttgggaggccctgatgtgcttgtctgaatccgatccctgttctaaaaggggagattgaaactttttgattgagagtggaaaggcttcataatgtagcatatagactttaaacttcccctttcttcagaagttctgcgcataatcaggtttgacgagtggtggttccagaatatcagtacttacaaaaccttatggaaaacgttttaaagtgtctggtatcatggttttatccctgtgcctttgattcagtagttttttcagagtctgcatatttaaaataatccctaagcattcagaagaaggcagtccgttgactaatttatgaaattgttttgggaaatagttttgcagacccatgtgtaatgtcc

SEQ ID NO: 203440 - DNA, 935 bp, Homo sapiens
  Payload ID: 20116
  Gene Name: zinc finger protein 677
  ENST ID: ENST00000594681
  CDS Start-End: 360-602
gagtctccgtctttcgggttcaagcctgcgcctcgcgggccacaggttcccacgctccgctgtcgggttttggggtcgccctgtaggttaaaaccccgaacctgctcattcctctcgcggcgtggccctaagacgttcccagtcccgtcgctccgagagggtctagagatctgcgtccatttcggattaaaatcgttctgaagtgggtactggccccgacctttttgctttagcccacacaatatgacctcggggaggatgcgaggaagatgaactgtgatgatccacttcttcttaatgaatgactgacttacctgagaaagaaactcagaggaagaggaaagaaagaagaggagggaatggctctttctcagggactgtttacattcaaggatgtggccatagaattctctcaagaggagtgggagtgcctggaccctgcccagagggccttgtacagggacgtgatgttggagaactacaggaacctgctttctctcgatgaggataacatccctccagaagatgctttctactctatccgggaacttagggagaccttagtcttcctgattccatattcttctaagatttgcctctgaaagttgcttttgaaatacacattccggatgggcgtggtgcctcacgcctataatcccagcactttgggaggccgaggtgggcagatcacctgaggtcgggagttcgagaccagcctgactaacatggaaaaaccccgtctctactaaaaatacaaaaattagccgggtgtgttggcgcatgcctgtaataccagctgctcgggaggctgaggcaggagagttgcttgaacccgagaggcagaggttgtggtgagccgagatcacgccattgcactccagcctgggcaacaagagcaaaactccatctcgaaaaaaaaaaaaagaaaaagaaaa

SEQ ID NO: 203441 - DNA, 622 bp, Homo sapiens
  Payload ID: 20116
  Gene Name: zinc finger protein 677
  ENST ID: ENST00000594517
  CDS Start-End: 186-622
cccgtcgctccgagagggtctagagatctgcgtccatttcggattaaaatcgttctgaacccacacaatatgacctcggggaggatgcgaggaagatgaactgtgatgatccacttcttcttaatgaatgactgacttacctgagaaagaaactcagaggaagaggaaagaaagaagaggagggaatggctctttctcagggactgtttacattcaaggatgtggccatagaattctctcaagaggagtgggagtgcctggaccctgcccagagggccttgtacagggacgtgatgttggagaactacaggaacctgctttctctcgatgaggataacatccctccagaagatgatatttctgttggatttacaagcaagggattatcaccaaaggaaaataataaagaggaattataccatctggtgatattagaaagaaaggaaagccatggcatcaacaattttgacctcaaggaagtctgggaaaatatgcctaagtttgacagcctgtgggactatgatgtaaaaaattacaaaggaatgcctttgacctgtaacaaaaatctcactcacagaaaagatcaacaacataataaatcctcaatacatttctctttaaa

SEQ ID NO: 203442 - DNA, 706 bp, Homo sapiens
  Payload ID: 20116
  Gene Name: zinc finger protein 677
  ENST ID: ENST00000601413
  CDS Start-End: 350-556
ctttcgggttcaagcctgcgcctcgcgggccacaggttcccacgctccgctgtcgggttttggggtcgccctgtaggttaaaaccccgaacctgctcattcctctcgcggcgtggccctaagacgttcccagtcccgtcgctccgagagggtctagagatctgcgtccatttcggattaaaatcgttctgaagtgggtactggccccgacctttttgctttagcccacacaatatgacctcggggaggatgcgaggaagatgaactgtgatgatccacttcttcttaatgaatgactgacttacctgagaaagaaactcagaggaagaggaaagaaagaagaggagggaatggctctttctcagggactgtttacattcaaggatgtggccatagaattctctcaagaggagtgggagtgcctggaccctgcccagagggccttgtacagggacgtgatgttggagaactacaggaacctgctttctctcgatgaggataacatccctccagaagatggtaaccacccttgtacatctttacatttttccttgtgagtctcttgggaggccctgatgtgcttgtctgaatccgatccctgttctaaaaggggagattgaaactttttgattgagagtggaaaggcttcataatgtagcatatagactttaaacttcccctttcttcagaagttctgcgcataatca

SEQ ID NO: 203443 - DNA, 8556 bp, Homo sapiens
  Payload ID: 20117
  Gene Name: zinc finger protein 678
  Uniprot ID: Q5SXM1
  ENST ID: ENST00000343776
  CDS Start-End: 346-1923
gatctggcggggcctttgtcttgtgctccagctggagctttggtcccgtattctcggctatttatccccagctgcgggaggccctggtgactctgctgctgcagtgtctggtttccctgtgacctgcaggtactgggagttacatagctaagatgccaggacaccccgaaagccggaaaacgggactactggcattcagtgatgtggtcatagaattctctccagaggagtgggcatgcctggaccctgcccagcgaaatttgtatagggatgtgatgttcgagaactacagaaacctggtctccctgggacttccaggactatgttaaaatagaagcattgataatgggcacaatatcactttgcattggtgtctgtgcatttgaaggagcaaacacctctaccagtttttataaactggtttatacagctattttatcttattccattcaagaccttttgccagagcaggatatgaaagatttatgccaaaaagtgacactgacaagacatagaagctggggccttgacaatttgcacttagtgaaagactggagaactgtgaatgaaggtaaggggcagaaagaatattgcaatagacttactcaatgttcatcaactaaaagcaaaatctttcaatgtattgaatgtggcagaaattttagctggaggtcaatccttactgaacataagagaattcatactggagagaagccatacaaatgtgaagaatgtggcaaagttttcaatcgatgttcaaacctaacaaaacataaaagaattcatactggagagaaaccctacaaatgtgacgaatgtggcaaagtttttaattggtggtcacaactaactaaccataagaaaattcatactggagagaaaccctacaaatgtgatgaatgtgacaaagtttttaattggtggtcacaactaactagccataagaaaattcatagtggagagaaaccatacccatgtgaagaatgtggcaaagcctttacccagttctcaaaccttacacaacataagagaattcatactggagagaaaccctacaaatgcaaagaatgttgcaaagcctttaacaagttctcaaaccttactcaacataagagaattcatactggagagaaaccttacaagtgtgaagaatgtggcaacgtttttaatgagtgctcacacctaactagacataggagaattcatactggagagaaaccctacaaatgtgaagaatgtggcaaagcctttacacagtttgcaagccttactcgtcataaaagaattcatactggagaaaaaccctaccaatgtgaagaatgtggcaaaacttttaatcggtgttcacacctaagtagccataagagaattcatactggagagaaaccctacaaatgtgaagaatgtggcagaacctttactcaattctcaaacctcactcagcataaaagaattcatactggagagaaaccctacaaatgcaaagaatgtggcaaagcgtttaacaagttctcaagccttactcaacataggagaattcatactggagtgaaaccctacaaatgtgaagaatgtgggaaagtttttaaacagtgctctcacctaactagccataagagaattcatactggagagaaaccctacaaatgtaaagaatgtggcaaagctttttaccaatcctcaatccttagtaagcataagagaattcatactgaagagaaaccctacaaatgtgaagaatgtggcaaagcctttaaccagttctcaagccttactcgtcataaaagaattcatactggagagaaacgctacaaatgtaaagaatgtggaaaaggtttttaccaatcctcaatccatagtaagtataagagaatttatactggagaggaacctgacaaatgtaaaaaatgtggcagtctttaaaaactgcttcattatacatggcttcactaatttcatactgaataaaagtggtatgagcataatgactgtttaaggatgtttcacaaaatgtaagcttcagagtgcacaacactatactgaatgaaatttataaatataaaagattacaatatctttatttcaaagatcttcctgtaaacagaatctgtactagaggaaaaacccttaaacaattattcagactttattcaactttagaggattttacgggggcaaaaaacctcctacaaatgtggaaaaacattttttcaagatatatgccttagaaaacaccagagtttatagtatagtagaatatattttacagatacagtgaatacaaacaaatgtccaaaattaagtctaaataaaacattacataatttactgtagaaagtactaaggcactaacagtttcagatgttactttaaagcagtgttgattgtcgagaataattcaaagttaaaatagataatttagttgtatgtaaatttaaatgaatcaagagatgatgtctttttgaagcacagttacattcatgttatacttttttgcattaaaagtttttatatttttgattatatattttaatattgatataattcatatctcaaataacttgatttttattatatttattgtttatgttaaagtatgtggtcagttgttgctgcataagagctatgagaagttcttctatattagatgaccatcatttatatgctttttcatgaatgattaagggcaccgaaatgtaacatttataaggaaaatctaagtagaaatgctttttgttgatgtataacagtgttttaagtaacacattaggtattcagagaagtattttgcattatagtaatagggaaacattttgaatttcagtagtaaattgttttatgagttgcacattaagataatacagtagcttttgaaatgttatttttagaatgcaatttcttttcataaaacaaaattatttttaatgtgttaagaatattttgcattgaatgaagtatatcttgccacaataattaacctataccaccttacccaaagttgtaggtaacagatagtaacaatacactactgggtaacagtgaaaggacacctctagtaatctcttttcccagtggcttttaatttcaaacaacttggggaggttttttttatgtgatatgctttggtttttttgtgccttacctcatgttgaaatgtgttcccccatgttggaggcggggtctagtggaaggtgtttaggtcatgggtgtagattactcatgaatggattggtgttcttaccactgcagttagtgtgttctctgttagttcatgtgaaagctggttgttaaaaacaaaaacaaacaaacaaaaaactgatattcctcttgctttgtcttttgccatgatacccctttgccttttattatgcataaaagcttcctgaggcctcatcagaagttaagcagatgttgatgtcatgcttgtatagccaacagaactgaggctaataaacctcttttctgtattaatttgccagtgttaagtattcccttctagcagcacaaaatggactaacatcccataggttatatttttatttttttcttttgtaaatactggacaatgatactcttatataatcttcagtataaccattataattgcccactataaaggagtataatgaaaggccatgtattttgaatcacgaatgactatttacaaaatgtcatactacgtttttctttgagcctgtgacccctctggcctgtaaaaacacatacatacatttagttttgattaacatggagttaattttataagtctgtcactctaaacataagtgttagctttaagagaattacagagcatgtaattgtgtttgagtgtaggtgtgtacttttttgagaagaaaacaaaaatattggaacaaaatataatttaaaaagtattggtaatttactagcaaactaggaatctcaaagattctgaaagtaaatatttattctctgctttgtattgaatttacttctgtaaaatcttatggctgctggctcagaatcttctcatgcaaatcctgtttttttcttgtctgttgatcatactaaacctaatgtatagttttctcattccaaagttcatgaaattttctctatattcctgagaaattctaagaataactttcataaaatgtattgatgttcacaagataattttaagatgtaattctacaatatgtgtgttactacattttatttaattagtatattttatttttgtatttcaattggagaaccctattttggccaatttttacttggtttttgtttccattttaatattttacataattgaatttttttcactttattgagccattttgtttagatgtacactgggaaggcttcataattcacaaagttgttttgacatataaatgaggtgaacaaacacaggaaagtgctaggtttcctgggggtataatagatgctctataattagcagtaaatattcttgtttaagtcactttttggctacaagtaagagattagaaatattcagcataaagagatggcattaactctgcatgtaaagaaaacacatgtatacccaggctgtacaactgcctctgaaattaagaggaattgtgtttatttcatagttatctctggtacttcactgttattttattttcacccccaactatgcgtcaatcatagccctttcccttctttgcttattatggctacagatttctcactgttctctgcagcccatgtaatttcatacagtattttgtaggttgtgataaggaatttgaaatttttaatatagtgaaaaattggatttaactggagagtttgaggacatttttaagttagaaatgcaccatttgaatcatttaattggcataattgggatgtactctacacagtttataggattaaattactgagttagtaatgtttgtatgaaagaaatgttattagattctaccacaaaatatagtaaacatgaaatcagttagaataggtaaagcattaataatggtaggctatatatcataatcactatataaagaaacatcagaatttggaaaccccttaagcaaaaatatatcttagaaatcttaaggacacttaatggcaagcaaaaaagtttaaatttagttttttataaattacatatagcacaatttatgtgtacatgtagaatcttttagtttttagtgtttatgtaatatattagacaataataaacatttacatttatgtttacatttatatttaatttttcaaatttaatttaaatttctaaatgcttctgtggatttaaattttggaataatcttttcttccccattgatactggaatcttgggaagtttcttactcatatcacaatatgttttatttaaatggatgcagcttacattgcagagtttatataaataatcacataacaagccaattccttagtcattttctgtattaaaaaactcagagatctagagagcttttggattgaaatatttccttggtgattttggatgcaaacctgatttctgtgttcacaccatggccagagatgggactgttagcaccacctgcttctttaatgtcgtccatatgatcagcatcagcaccagaaactccaggtgtcccaaacttaaagtgaaagccatagagtcctttggtgactcccatgttctgtgctggttctagaacatgctggtaaatatcagagtttctatgcttatggctgataagtagacatttttaaaaatcataaaaactgtattttctatatagttcagctaagtttatgaaaaagatgcagactcagtatttggagcattgctatcgctccatgatgtgtttaaaaattatttttaaattgacaaaattttatatctacatatatatatatcttgtaacacatgatgtttgaaatgcttaattctagccaattaaaaatgctttacctcaatagttatttttattgtgagaaaggtcaacatggtcttggcacttaaaaaaaaaaaaacaatatattctcaataactgtattcactctgcactacaataggtctcttgaactaattcctcctagctaacaggcattgtttatcatttaacagataattctctaagcccccttctcctaaaacttcagcatctcttaaccttctttctagtctctacttttatgagatcaacttgtttagattccacgtgagtgagaccatgaggtattcatctttctgtgttctgctccattggtctatttatctgtttttaatgccagtattggactgtttcagttactgtagctttgcagtatatttgactgtcaagtagtgcagtgcttccaaccttcagagtcttttactgtactatatgaatttttgtgttttttttgtgaaaaattttattgatattttgatagacattatgttaaatatatacatcattttgtgtaacatagactttttagcaatattaatttggccaatttatgaataagggataacttttcatttatttatgtttaattttatacctcagttttctttagcttttaatgtagagatctttaacatttttgaataattttatttggaagtaaactttctgtaactattgcaggtgtcaattgttttctttatttctttttcagatagtttgttgttagtgtatagaaatgctactgacccttatatcttgattttgtatcctgcaactttagtgaatttattctaagtatttttaaagttttctatttataagactatgatatctgcaaacagggacaattattttctttctttccaatttggttgtctttggttttgttttctaatttctctggcctggaaattcagtagcatgttaaataagagtgatgaagttagatatatttgccttactataactcttagaaaaaaggcttacaacttttgaaggtttagcatgatgtcagatgtccatttgtcatatatggcctttattggcttgaggtatgtatgttctatatgtaatttgttttgagattttgtcataaagtaatgttgaattttctaaaattctttttctgcattcacttaaaagttataattggttctgagatccttcatctttctcagaatctaggaggatgcatctgtacctagaggaggacacaaaggcatcatatgttacattctcgtgacatataatgtctactgcttataatgtctactgtgagtttctgactccccaaatgaaattgaggcccagaaactttcaactgctttgttcgttgaataatgccaagtgtctggaaatgtgactattcagattaaatgcttaatgtgtgtgtgttgactaaataaatctcaaccagaaccttctcagatattttgttgaacgtgggacctttgtttttttttgttgttttgttttgttttgtttttgttgttgttgttgttgttgtttaccagcaggggacccctgttttgtctatgtcaagaacaaagaccaggcaaaagaaatgtcaagccgcatttacaaatgcaaaaatggacttgtttttgatatgcttttcccaacaataagggacatgagtcattggggcatgttacagagagtttcagtaaaattcagaaaaaaataataaatatgaacagccacagcatgcccagaagcctttttatggagccaggcatggttgacctgctttccatgtctcaaaacattagtccctacaagaaccctatgaggtttatcttcttttcacccattttgagagaagaaaagttcagctcagagagctgcaggaacattggggacatctccaagtcacagccaataggtggcagtcatcagtgtgtcttggaagggacaaacattgagcttctgaacagctactccagaaactatggtgctgtggtgaagtcctggttaggagcctaggaaaatggtgaaggaaaagatggtcccagcctgcaaagctgaagtcaggaacccaccaggatctcccttctccctagcctggtggtccacatcatgcagatttactctagattcagcttagactcatttttatactactcgggggacaaggagggaactacagtcagtaacagcagcatgagcctcaggtgctttggggattgaaattcagaccaggaaattccaatacatcagtgcatgtggaggacatgagtatttaaggagaaggttctaggcttccgaagtaaaattggatgtggaggttggggattgattcaaacattaatactttcaagcgtttctatggtatttgtcagctgtggagcaacagcacacatctgtattaatagcctgtgttaagagattactgtgaatcctgaaaaacatcctcattgtagagatgagaaaacacaggcttttgcacatccaatgtctccttaaagcatgtggttcagaattgagaacgtgcagagtgagagtggtatgaattttcctgtaagctacctgaagttctgtttgctgtcatgtggaagaaaagagccttggagaagttttatttttttctgtttggaaagaatacacagagcaagatgatttacaataaaccttttgacctaacgca

SEQ ID NO: 203444 - DNA, 798 bp, Homo sapiens
  Payload ID: 20117
  Gene Name: zinc finger protein 678
  ENST ID: ENST00000440339
  CDS Start-End: 116-798
ctttggtcccgtattctcggctatttatccccagctgcgggaggccctggtgactctgctgctgcagtgtctggtttccctgtgacctgcaggtactgggagttacatagctaagatgccaggacaccccgaaagccggaaaacgagacgcattctcactatgttgcccaggctggtcttgaactccttccctcaagtgattcttctgcctaatcctcccaaagttcttagattacagggactactggcattcagtgatgtggtcatagaattctctccagaggagtgggcatgcctggaccctgcccagcgaaatttgtatagggatgtgatgttcgagaactacagaaacctggtctccctggctattttatcttattccattcaagaccttttgccagagcaggatatgaaagatttatgccaaaaagtgacactgacaagacatagaagctggggccttgacaatttgcacttagtgaaagactggagaactgtgaatgaaggtaaggggcagaaagaatattgcaatagacttactcaatgttcatcaactaaaagcaaaatctttcaatgtattgaatgtggcagaaattttagctggaggtcaatccttactgaacataagagaattcatactggagagaagccatacaaatgtgaagaatgtggcaaagttttcaatcgatgttcaaacctaacaaaacataaaagaattcatactggagagaaaccctacaaatgtgacgaatgtggcaaagtttttaattggtggtcacaactaactaaccataagaa

SEQ ID NO: 203445 - DNA, 8212 bp, Homo sapiens
  Payload ID: 20117
  Gene Name: zinc finger protein 678
  Uniprot ID: Q5SXM1
  ENST ID: ENST00000397097
  CDS Start-End: 1-1578
atgggcacaatatcactttgcattggtgtctgtgcatttgaaggagcaaacacctctaccagtttttataaactggtttatacagctattttatcttattccattcaagaccttttgccagagcaggatatgaaagatttatgccaaaaagtgacactgacaagacatagaagctggggccttgacaatttgcacttagtgaaagactggagaactgtgaatgaaggtaaggggcagaaagaatattgcaatagacttactcaatgttcatcaactaaaagcaaaatctttcaatgtattgaatgtggcagaaattttagctggaggtcaatccttactgaacataagagaattcatactggagagaagccatacaaatgtgaagaatgtggcaaagttttcaatcgatgttcaaacctaacaaaacataaaagaattcatactggagagaaaccctacaaatgtgacgaatgtggcaaagtttttaattggtggtcacaactaactaaccataagaaaattcatactggagagaaaccctacaaatgtgatgaatgtgacaaagtttttaattggtggtcacaactaactagccataagaaaattcatagtggagagaaaccatacccatgtgaagaatgtggcaaagcctttacccagttctcaaaccttacacaacataagagaattcatactggagagaaaccctacaaatgcaaagaatgttgcaaagcctttaacaagttctcaaaccttactcaacataagagaattcatactggagagaaaccttacaagtgtgaagaatgtggcaacgtttttaatgagtgctcacacctaactagacataggagaattcatactggagagaaaccctacaaatgtgaagaatgtggcaaagcctttacacagtttgcaagccttactcgtcataaaagaattcatactggagaaaaaccctaccaatgtgaagaatgtggcaaaacttttaatcggtgttcacacctaagtagccataagagaattcatactggagagaaaccctacaaatgtgaagaatgtggcagaacctttactcaattctcaaacctcactcagcataaaagaattcatactggagagaaaccctacaaatgcaaagaatgtggcaaagcgtttaacaagttctcaagccttactcaacataggagaattcatactggagtgaaaccctacaaatgtgaagaatgtgggaaagtttttaaacagtgctctcacctaactagccataagagaattcatactggagagaaaccctacaaatgtaaagaatgtggcaaagctttttaccaatcctcaatccttagtaagcataagagaattcatactgaagagaaaccctacaaatgtgaagaatgtggcaaagcctttaaccagttctcaagccttactcgtcataaaagaattcatactggagagaaacgctacaaatgtaaagaatgtggaaaaggtttttaccaatcctcaatccatagtaagtataagagaatttatactggagaggaacctgacaaatgtaaaaaatgtggcagtctttaaaaactgcttcattatacatggcttcactaatttcatactgaataaaagtggtatgagcataatgactgtttaaggatgtttcacaaaatgtaagcttcagagtgcacaacactatactgaatgaaatttataaatataaaagattacaatatctttatttcaaagatcttcctgtaaacagaatctgtactagaggaaaaacccttaaacaattattcagactttattcaactttagaggattttacgggggcaaaaaacctcctacaaatgtggaaaaacattttttcaagatatatgccttagaaaacaccagagtttatagtatagtagaatatattttacagatacagtgaatacaaacaaatgtccaaaattaagtctaaataaaacattacataatttactgtagaaagtactaaggcactaacagtttcagatgttactttaaagcagtgttgattgtcgagaataattcaaagttaaaatagataatttagttgtatgtaaatttaaatgaatcaagagatgatgtctttttgaagcacagttacattcatgttatacttttttgcattaaaagtttttatatttttgattatatattttaatattgatataattcatatctcaaataacttgatttttattatatttattgtttatgttaaagtatgtggtcagttgttgctgcataagagctatgagaagttcttctatattagatgaccatcatttatatgctttttcatgaatgattaagggcaccgaaatgtaacatttataaggaaaatctaagtagaaatgctttttgttgatgtataacagtgttttaagtaacacattaggtattcagagaagtattttgcattatagtaatagggaaacattttgaatttcagtagtaaattgttttatgagttgcacattaagataatacagtagcttttgaaatgttatttttagaatgcaatttcttttcataaaacaaaattatttttaatgtgttaagaatattttgcattgaatgaagtatatcttgccacaataattaacctataccaccttacccaaagttgtaggtaacagatagtaacaatacactactgggtaacagtgaaaggacacctctagtaatctcttttcccagtggcttttaatttcaaacaacttggggaggttttttttatgtgatatgctttggtttttttgtgccttacctcatgttgaaatgtgttcccccatgttggaggcggggtctagtggaaggtgtttaggtcatgggtgtagattactcatgaatggattggtgttcttaccactgcagttagtgtgttctctgttagttcatgtgaaagctggttgttaaaaacaaaaacaaacaaacaaaaaactgatattcctcttgctttgtcttttgccatgatacccctttgccttttattatgcataaaagcttcctgaggcctcatcagaagttaagcagatgttgatgtcatgcttgtatagccaacagaactgaggctaataaacctcttttctgtattaatttgccagtgttaagtattcccttctagcagcacaaaatggactaacatcccataggttatatttttatttttttcttttgtaaatactggacaatgatactcttatataatcttcagtataaccattataattgcccactataaaggagtataatgaaaggccatgtattttgaatcacgaatgactatttacaaaatgtcatactacgtttttctttgagcctgtgacccctctggcctgtaaaaacacatacatacatttagttttgattaacatggagttaattttataagtctgtcactctaaacataagtgttagctttaagagaattacagagcatgtaattgtgtttgagtgtaggtgtgtacttttttgagaagaaaacaaaaatattggaacaaaatataatttaaaaagtattggtaatttactagcaaactaggaatctcaaagattctgaaagtaaatatttattctctgctttgtattgaatttacttctgtaaaatcttatggctgctggctcagaatcttctcatgcaaatcctgtttttttcttgtctgttgatcatactaaacctaatgtatagttttctcattccaaagttcatgaaattttctctatattcctgagaaattctaagaataactttcataaaatgtattgatgttcacaagataattttaagatgtaattctacaatatgtgtgttactacattttatttaattagtatattttatttttgtatttcaattggagaaccctattttggccaatttttacttggtttttgtttccattttaatattttacataattgaatttttttcactttattgagccattttgtttagatgtacactgggaaggcttcataattcacaaagttgttttgacatataaatgaggtgaacaaacacaggaaagtgctaggtttcctgggggtataatagatgctctataattagcagtaaatattcttgtttaagtcactttttggctacaagtaagagattagaaatattcagcataaagagatggcattaactctgcatgtaaagaaaacacatgtatacccaggctgtacaactgcctctgaaattaagaggaattgtgtttatttcatagttatctctggtacttcactgttattttattttcacccccaactatgcgtcaatcatagccctttcccttctttgcttattatggctacagatttctcactgttctctgcagcccatgtaatttcatacagtattttgtaggttgtgataaggaatttgaaatttttaatatagtgaaaaattggatttaactggagagtttgaggacatttttaagttagaaatgcaccatttgaatcatttaattggcataattgggatgtactctacacagtttataggattaaattactgagttagtaatgtttgtatgaaagaaatgttattagattctaccacaaaatatagtaaacatgaaatcagttagaataggtaaagcattaataatggtaggctatatatcataatcactatataaagaaacatcagaatttggaaaccccttaagcaaaaatatatcttagaaatcttaaggacacttaatggcaagcaaaaaagtttaaatttagttttttataaattacatatagcacaatttatgtgtacatgtagaatcttttagtttttagtgtttatgtaatatattagacaataataaacatttacatttatgtttacatttatatttaatttttcaaatttaatttaaatttctaaatgcttctgtggatttaaattttggaataatcttttcttccccattgatactggaatcttgggaagtttcttactcatatcacaatatgttttatttaaatggatgcagcttacattgcagagtttatataaataatcacataacaagccaattccttagtcattttctgtattaaaaaactcagagatctagagagcttttggattgaaatatttccttggtgattttggatgcaaacctgatttctgtgttcacaccatggccagagatgggactgttagcaccacctgcttctttaatgtcgtccatatgatcagcatcagcaccagaaactccaggtgtcccaaacttaaagtgaaagccatagagtcctttggtgactcccatgttctgtgctggttctagaacatgctggtaaatatcagagtttctatgcttatggctgataagtagacatttttaaaaatcataaaaactgtattttctatatagttcagctaagtttatgaaaaagatgcagactcagtatttggagcattgctatcgctccatgatgtgtttaaaaattatttttaaattgacaaaattttatatctacatatatatatatcttgtaacacatgatgtttgaaatgcttaattctagccaattaaaaatgctttacctcaatagttatttttattgtgagaaaggtcaacatggtcttggcacttaaaaaaaaaaaaacaatatattctcaataactgtattcactctgcactacaataggtctcttgaactaattcctcctagctaacaggcattgtttatcatttaacagataattctctaagcccccttctcctaaaacttcagcatctcttaaccttctttctagtctctacttttatgagatcaacttgtttagattccacgtgagtgagaccatgaggtattcatctttctgtgttctgctccattggtctatttatctgtttttaatgccagtattggactgtttcagttactgtagctttgcagtatatttgactgtcaagtagtgcagtgcttccaaccttcagagtcttttactgtactatatgaatttttgtgttttttttgtgaaaaattttattgatattttgatagacattatgttaaatatatacatcattttgtgtaacatagactttttagcaatattaatttggccaatttatgaataagggataacttttcatttatttatgtttaattttatacctcagttttctttagcttttaatgtagagatctttaacatttttgaataattttatttggaagtaaactttctgtaactattgcaggtgtcaattgttttctttatttctttttcagatagtttgttgttagtgtatagaaatgctactgacccttatatcttgattttgtatcctgcaactttagtgaatttattctaagtatttttaaagttttctatttataagactatgatatctgcaaacagggacaattattttctttctttccaatttggttgtctttggttttgttttctaatttctctggcctggaaattcagtagcatgttaaataagagtgatgaagttagatatatttgccttactataactcttagaaaaaaggcttacaacttttgaaggtttagcatgatgtcagatgtccatttgtcatatatggcctttattggcttgaggtatgtatgttctatatgtaatttgttttgagattttgtcataaagtaatgttgaattttctaaaattctttttctgcattcacttaaaagttataattggttctgagatccttcatctttctcagaatctaggaggatgcatctgtacctagaggaggacacaaaggcatcatatgttacattctcgtgacatataatgtctactgcttataatgtctactgtgagtttctgactccccaaatgaaattgaggcccagaaactttcaactgctttgttcgttgaataatgccaagtgtctggaaatgtgactattcagattaaatgcttaatgtgtgtgtgttgactaaataaatctcaaccagaaccttctcagatattttgttgaacgtgggacctttgtttttttttgttgttttgttttgttttgtttttgttgttgttgttgttgttgtttaccagcaggggacccctgttttgtctatgtcaagaacaaagaccaggcaaaagaaatgtcaagccgcatttacaaatgcaaaaatggacttgtttttgatatgcttttcccaacaataagggacatgagtcattggggcatgttacagagagtttcagtaaaattcagaaaaaaataataaatatgaacagccacagcatgcccagaagcctttttatggagccaggcatggttgacctgctttccatgtctcaaaacattagtccctacaagaaccctatgaggtttatcttcttttcacccattttgagagaagaaaagttcagctcagagagctgcaggaacattggggacatctccaagtcacagccaataggtggcagtcatcagtgtgtcttggaagggacaaacattgagcttctgaacagctactccagaaactatggtgctgtggtgaagtcctggttaggagcctaggaaaatggtgaaggaaaagatggtcccagcctgcaaagctgaagtcaggaacccaccaggatctcccttctccctagcctggtggtccacatcatgcagatttactctagattcagcttagactcatttttatactactcgggggacaaggagggaactacagtcagtaacagcagcatgagcctcaggtgctttggggattgaaattcagaccaggaaattccaatacatcagtgcatgtggaggacatgagtatttaaggagaaggttctaggcttccgaagtaaaattggatgtggaggttggggattgattcaaacattaatactttcaagcgtttctatggtatttgtcagctgtggagcaacagcacacatctgtattaatagcctgtgttaagagattactgtgaatcctgaaaaacatcctcattgtagagatgagaaaacacaggcttttgcacatccaatgtctccttaaagcatgtggttcagaattgagaacgtgcagagtgagagtggtatgaattttcctgtaagctacctgaagttctgtttgctgtcatgtggaagaaaagagccttggagaagttttatttttttctgtttggaaagaatacacagagcaagatgatttacaataaaccttttgacctaacgcac

SEQ ID NO: 203446 - DNA, 929 bp, Homo sapiens
  Payload ID: 20117
  Gene Name: zinc finger protein 678
  ENST ID: ENST00000608949
  CDS Start-End: 439-669
gatctggcggggcctttgtcttgtgctccagctggagctttggtcccgtattctcggctatttatccccagctgcgggaggccctggtgactctgctgctgcagtgtctggtttccctgtgacctgcaggtactgggagttacatagctaagatgccaggacaccccgaaagccggaaaacgagacgcattctcactatgttgcccaggctggtcttgaactccttccctcaagtgattcttctgcctaatcctcccaaagttcttagattacagggactactggcattcagtgatgtggtcatagaattctctccagaggagtgggcatgcctggaccctgcccagcgaaatttgtatagggatgtgatgttcgagaactacagaaacctggtctccctgggacttccaggactatgttaaaatagaagcattgataatgggcacaatatcactttgcattggtgtctgtgcatttgaaggagcaaacacctctaccagtttttataaactggtttatacagctattttatcttattccattcaagaccttttgccagagcaggatatgaaagatttatgccaaaaagtgacactgacaagacatagaagctggggccttgacaatttgcacttagtgaaagactggagaactgtgaatgaaggttaaaaggactactgactcaaactctgcctcttgagttcatggttcaccacttccagcctggtgacttggtgctgattaaaacttggaaagaagacaagctccacccaagttgggaagctccctatcaagtgctcctgaccactaagatggctggatgtgcaaacagctgaacaaaggtggactcactacactcaagtcaagggactggtaaaagggaccccagaaggcaaggaaaaagaccagtggaaagtgcatgggtcacc

SEQ ID NO: 203447 - DNA, 1297 bp, Homo sapiens
  Payload ID: 20118
  Gene Name: zinc finger protein 679
  Uniprot ID: Q8IYX0
  ENST ID: ENST00000255746
  CDS Start-End: 1-1236
atggctaaaagaccgggatcccctggaagccgagaaatgggactgttgacattcagagatgtagtcatagaattctctctggaggagtggcaatgcctggatcacgctcagcagaatttatatagagatgtgatgttagagaactacagaaacctggtctccctgggtattgctgtctctaagccagacttgatcacctgtctggagcaaaataaagagccttggaatataaagagaaatgagatggtaaccaaacacccagttatgtgttctcatttcacccaagaccttccgccagagctaggcataaaagattcactccaaaaagtaataccaagaagatatggaaaaagtggacatgacaatttacaagtaaaaacatgtaaaagcatgggtgagtgtgaggtgcaaaaaggaggttgtaatgaagttaaccaatgtttgtcaactacccaaaacaaaatatttcagactcataaatgtgtcaaagtcttcggcaaattttcaaattccaatagacataagacaagacatactggaaagaaacatttcaaatgtaaaaaatatggcaaatcattttgcatggtttcacaactacatcaacatcagataattcatactagggagaattcctaccaatgtgaagaatgcggcaaacccttcaactgctcttcaaccctttctaaacataaaagaattcatactggagagaaaccctacagatgtgaggaatgtggcaaagcttttacctggtcctcaacccttactaaacataggagaattcatactggagaaaaaccctacacatgtgaagaatgtggccaagcctttagccgctcctcaacacttgctaaccacaagagaattcatactggagagaaaccatacacatgtgaagaatgtggcaaagcctttagcttatcctcatccctcacttaccacaagagaattcatactggagagaaaccctacacatgtgaagaatgtggcaaagcctttaactgctcctcaacccttaagaaacataagataattcatactggagagaaaccctacaaatgtaaagaatgtgggaaagcctttgccttctcctcaactcttaatactcataagaggattcatactggagaggaaccctacaaatgtgaagaatgtgacaaagcttttaagtggtcctcaagtcttgctaatcataagagtatgcatactggagagaaaccctacaaatgtgaataatgtgataaagtccagccttcagaccttataatacataaaataatttatacttgaaaaaatc

SEQ ID NO: 203448 - DNA, 1567 bp, Homo sapiens
  Payload ID: 20118
  Gene Name: zinc finger protein 679
  Uniprot ID: Q8IYX0
  ENST ID: ENST00000421025
  CDS Start-End: 270-1505
ggtacttgatccaggtatatgtcacattcccaactgttggctgggcccaagcaaattagtaaaataaattaggtgctgtgtgaaagtatacgccacaatcacacctgcgggaaggaccaggaataaatttcacaattctacgtatttcccagctttaggtctgagagtctacacttctgagctccagttcttctcttcactgctctgcgtcctctgttcctagaggccaagccactgtggccttgtgttctgcaggtatccgcagatttatggctaaaagaccgggatcccctggaagccgagaaatgggactgttgacattcagagatgtagtcatagaattctctctggaggagtggcaatgcctggatcacgctcagcagaatttatatagagatgtgatgttagagaactacagaaacctggtctccctgggtattgctgtctctaagccagacttgatcacctgtctggagcaaaataaagagccttggaatataaagagaaatgagatggtaaccaaacacccagttatgtgttctcatttcacccaagaccttccgccagagctaggcataaaagattcactccaaaaagtaataccaagaagatatggaaaaagtggacatgacaatttacaagtaaaaacatgtaaaagcatgggtgagtgtgaggtgcaaaaaggaggttgtaatgaagttaaccaatgtttgtcaactacccaaaacaaaatatttcagactcataaatgtgtcaaagtcttcggcaaattttcaaattccaatagacataagacaagacatactggaaagaaacatttcaaatgtaaaaaatatggcaaatcattttgcatggtttcacaactacatcaacatcagataattcatactagggagaattcctaccaatgtgaagaatgcggcaaacccttcaactgctcttcaaccctttctaaacataaaagaattcatactggagagaaaccctacagatgtgaggaatgtggcaaagcttttacctggtcctcaacccttactaaacataggagaattcatactggagaaaaaccctacacatgtgaagaatgtggccaagcctttagccgctcctcaacacttgctaaccacaagagaattcatactggagagaaaccatacacatgtgaagaatgtggcaaagcctttagcttatcctcatccctcacttaccacaagagaattcatactggagagaaaccctacacatgtgaagaatgtggcaaagcctttaactgctcctcaacccttaagaaacataagataattcatactggagagaaaccctacaaatgtaaagaatgtgggaaagcctttgccttctcctcaactcttaatactcataagaggattcatactggagaggaaccctacaaatgtgaagaatgtgacaaagcttttaagtggtcctcaagtcttgctaatcataagagtatgcatactggagagaaaccctacaaatgtgaataatgtgataaagtccagccttcagaccttataatacataaaataatttatacttgaaaaaatca

SEQ ID NO: 203449 - DNA, 3022 bp, Homo sapiens
  Payload ID: 20119
  Gene Name: zinc finger protein 680
  Uniprot ID: Q8NEM1
  ENST ID: ENST00000309683
  CDS Start-End: 153-1745
ggacaggacggcttccgggatttggcggggcctttgtctctagctgctgcgggagctccaggtctagtctttactgctctgtgtattctgctcctagaggcccagcctctgtgactccgttatctgcaggtattgggagatgcacagctaagatgccaggaccacctggaagcctagaaatgggaccactgacatttagggatgtggccatagaattctctctggaggagtggcaatgcctggacactgcacaacggaatttatataggaaagtgatgtttgagaactacagaaacctggtcttcctgggtattgctgtctctaagcctcacctgataacctgtttggagcaaggaaaagagccctggaataggaagagacaggagatggtagccaaacccccagttatatattctcatttcactgaagacctttggccagagcatagcataaaagattcttttcaaaaagtgatactgagaggatatggaaaatgtggacatgagaatttacaattaagaataagttgtaaaagtgtggatgagtctaaggtgttcaaagaaggttataatgaacttaaccaatgtttgagaactacccagagcaaaatatttcaatgtgataaatacgtgaaagtctttcataaattttcaaattcaaacagtcataagaaaagaaatactggaaagaaggttttcaaatgtaaagaatgtggcaaatcattttgcatgctttcacatctaacacaacatataagaattcacactagagagaattcttacaaatgtgaggaatgtggcaaagttcttaactggttctcagagcttattaaacataagggaattcatatgggagagaaaccctacaaatgtgaggaatgtggcaaagcctttaaccaatcctcaacccttattaaacataagaaaattcatattgaagagaaacccttcaaatgtgaagaatgtggcaaagcctttagtttattctcaatccttagtaaacataagataattcatactggagacaaaccttacaaatgtgatgaatgtcacaaagcctttaactggtttgcaacccttactaaccataagagaattcatactggagagaaacccttcaaatgtgaagaatgtggcaaagactttaaccagttttcaaaccttactaaacataagaaaattcatactggagagaaaccctacaaatgtgaagaatgtggcaaagcttttaaccagtttgcaaaccttactagacataagaaaattcatactggagagaaatcctacaaatgtgaagaatgcggcaaagcttttatacagtcctcaaaccttactgaacatatgagaattcatactggagagaaaccctacaaatgtgaagaatgtggcaaagcttttaatgggtgctccagccttactcgacataagagaattcacactagagagaatacctacaaatgtgaagaatgtggcaaaggctttactttattttcaacccttactaaccataaagtaattcatactggagagaaatcctacaaatgtgatgaatgtggcaatgtttttaactggcctgcaactcttgctaatcataagagaattcatgctagagagaaaccctacaaatgtgaagaatgtggcaaagcttttaaccggtcctcacaccttactagacataagaaaattcatactggtgagaaactctacaaacctgaaaaatgtgacaataattttgataacacctaaaacttttctaaacataaaagacaccatcctgttgagaaaccctaaaaatgtgaagaatttgacaaagccttccaatgattgttacacttgcttgtaggtaagataatttatattggagaaaactttataagtgtaaagaatgtgacaaaacttaaccaatactcacatcttattgcacaggaaagcatttttacttgagaaagattgtacaagtataaagaatgtgaaaaagtcattgatatcttttcacatcttactcaacaccagagtttatacttattaaaagcattataaatgcaattactgtcaaaagaaatttcagaaaacataacactttaaagtgaagaagcgtgtttattttgaagacaaacataacaaatataaggagcataggagggttgtagtacctttacttgtattacaaatcttattgtacgcattttgtactagagaaaaacactgaagcagttgctcaaactttgttcaacatcagggaatttatattggagaaaaatcctgcaaatgtaatgaatttggaaaaacattttttttcaaaaactacggcgtagaaaacatgaatttatattgaaatgtgtttttgcagatgcagtaagtatgaaaaatatttaatccaaaattgagtctatgtaaatattaaataatttacagtagaaataactaaggcactgacactttagacattacactaaaacagagtgttgagtataaaaaaatctataagttgttagattatttgtaaataactttaaaaggagtagaagattctttggagagttataattacattgaaagtatactttttttcttgaaaaaattatggcttatttgaaaagtaaataatgatgaaattcaactctcaaattactttatttcattcctattgtattcacatgtgaaagcatgtgataaattgttgctgtgtcagatataggagagattcttttttattagatgggcattatttatggttttttctgtggaagagtatgggcattaaaatgtaaggtttatgatgaaaatctaagtggagaggccctgttagtttacttttcatattgagtgatgcatgaggtaggtgtttggagtaatattctgcatcatagagaaaagcatttttaattttactttaaattaaatgtaattaaattactagtgaatcattttactaattgtacttttatgctataaatgcagtacatttgaaaatttttagattatgtataagcttaattttataattaaacatttctttaaca

SEQ ID NO: 203450 - DNA, 2159 bp, Homo sapiens
  Payload ID: 20119
  Gene Name: zinc finger protein 680
  Uniprot ID: Q8NEM1
  ENST ID: ENST00000447137
  CDS Start-End: 88-459
agtctttactgctctgtgtattctgctcctagaggcccagcctctgtgactccgttatctgcaggtattgggagatgcacagctaagatgccaggaccacctggaagcctagaaatgggaccactgacatttagggatgtggccatagaattctctctggaggagtggcaatgcctggacactgcacaacggaatttatataggaaagtgatgtttgagaactacagaaacctggtcttcctgggtattgctgtctctaagcctcacctgataacctgtttggagcaaggaaaagagccctggaataggaagagacaggagatggtagccaaacccccagagtcttactgtgttgctcaggctgatcttgaactcctggtctcaagttatcttactgccttggcctccctaaagatgtgggattacagaaataatccactttgccaggctactatgtagcccttcatgtagaactgtgctagtcataatgaatcataacactgtcaccttttattttgaaaagtctttatttttatctgtttttaaagtacactaatcttgaatcaagtattcttggttaggaattttattactgcatcaaaatttgggaagttcttagcctttttcatctacaagtaacctctacattactttttccctacattcttcttctaagagttttttaatgaatatattgatgtacttgatggtgtccaataagttttacatttcatgttttaattttcttttggaattttatatttttgttttatatattttaggatatgccacctcacatgagttaattgttttggttttttagtttatattataattgagtatgccagtatttaactctgtaaaatttaagacagtgtggaacaaagtcaaatatgaatcagccatatgtctactaccaatataacgatctctgtgtttacctgtataaatattttccctgttctttttatgacttgtatatttctggtataggtttgttgcaaatggttatttaatcttgactaggtgagaagtcatagaaattctcctaatttcaacatctatttattcatggatctatattatttttgtgtgggagaaaaacttttctatttaaagataatttacaaacgatcataatctcttttaggtatgtctatttttacttgtcaaaaacacataacatttacaatagaatatttttaaatgtttattttagtcctattatattgacattgttatgcaacatattcctaaaatgtttttatcttgcaaagctaaatatcaatacccattaaaaaactatgaattttacccatttcctggcacttttcaaacaccactctgttttctctaagagtgtaactgcttcatatatctcatacaatctctgtctttttgtgactggctcattttattttgcacaatatcatcaagctttatagttgttagaatattttctgctttttaaatactgggtgatatttaagtattttgtattttagattatatctactgagtaatttggtgacaaatttgcactgcttttacctattggctttcagtaacaatgctgcaataattacaggtatgcaaatgacctatatgatcatatatgtgtaagtttatatatgtgccgcattctgttctactagtgtacgtttttacctttgtactcataccaaattgttacaattctgtagctctgtaatgtgtttcaaaatcagaaactgtaatgccttcaaaattgtttattttattgcagatttttgggtactttattatctcttaagactttatatactttgggggttgctgtttctatttcttcaaaaatgcatgagaaatttgaacaacattgcattaaatctgtaaattacattgagcaggatggacatcttcacaagattaattattttaacatttcaacaagcatgctcaagagtgtattgttttaatttctatgtatttgtgaatttttcagttttttcttcttactgttctatactcatttcattttggtcatagaaagtaatccataaaaatttagttttaaataatttgttaagacttcttttttggtttaccaggttttctatcaaggagaatttcgtatgaggtattgagaaggctgtttatcattatgttgttgagtgttc

SEQ ID NO: 203451 - DNA, 6497 bp, Homo sapiens
  Payload ID: 20120
  Gene Name: zinc finger protein 681
  Uniprot ID: Q96N22
  ENST ID: ENST00000402377
  CDS Start-End: 143-2080
gtctctcccttcagcccgagctccgggtctcgtcttcactgctctgtgtcctcttcttctagaggcccagcctctatggccctctgacctgcaggtattggcgatccatagctaagacgccaggtcccccggaaacctagaaatggaaccattgaaatttagggatgtggccatagaattctctctggaggagtggcaatgcctggacactatacagcagaatttatataggaatgtgatgttagagaactacagaaacctggtcttcttgggtattgttgtctctaagccagacctgatcacctgtctggaacaagaaaaagagccttggactagaaagagacataggatggtggccgaacccccagttatttgttctcattttgcccaagacttttcaccagagcagaacataaaagattctttccaaaaagtgacaccaagaagatatggaaaatgtgaacatgagaatttacagttaagtaaaagtgtggatgagtgcaaagtgcaaaaaggaggttataatggacttaaccaatgtttgccaactacccagagcaaaatatttcaatgtgataaatatatgaaaatctttcataaattttcaaatttaaatggacataaggtaagacacaccagaaaaaaaccttttaaatataaagaatttggcaaatcattttgcatattttcaaacctaactcaacataaaataatttgtactagagtaaatttctacaaatgtgaagactgtggaaaagcctttaatggatcctcaatctttactaaacataaaagaattcatattggagagaaatcgtacatatgtgaagaatgtggcaaagcctgtaaccagttcacaaaccttactacacataagataatttatactagagacaaactctacaaacgtgaagaatgtagcaaagcctttaacctgtcgtcacacattacaacacatacaataattcatactggagagaatccctacaaacgtgaagaatgtgacaaagcctttaatcagtccttaacccttactacacataagataattcataccagagagaaactcaatgaatataaggaatgtggcaaagctttcaaccagtcctcacaccttaccagacataagataattcatactggagagaaaccctacaaatgtgaagaatgtggcaaagcctttaaccagtcctcacaccttaccagacataagataattcatactggagagaagccctacagatgtgaagaatgtggcaaagcctttaggcagtcctcacaccttactacacataagataattcatactggagagaaaccctacaaatgtgaagaatgtggcaaagcttttaacaagtcctcacaccttactagacataagagcattcatactggagaaaaaccctaccagtgtgaaaaatgtggcaaagcttctaaccaatcctcaaaccttactgaacataagaatattcatactgaagagaaaccatacaaatgtgaagaatgtgggaaagcctttaaccagttctcaaaccttactacacataaaagaattcatactggagagaaaccctacaaatgtgaagaatgtggcaaagcttttaaccagtcctcaatccttactacacataagagaattcatactggagagaaatcctacaaatgtgaagaatgtggcaaagctttctatcgatcctcaaaacttactgaacataagaaaattcatactggagagaaaccctacacatgtgaagaatgtggcaaagcctttaaccattcctcacatcttgctacacataaggtaattcatactggagagaaaccctaccaatgtgaagaatgtggtaaagcctttaaccagtcctcacaccttactagacataagagaattcatactggagagaaaccctaccaatgtgaaaaatgtggcaaagcttttaaccagtcctcaaaccttactggacataagaaaattcatactggtgagaaactctacaaacctaaaagatgtaacagtgattttgaaaacacttcaaagttttctaaacataaaagaaattatgctggtgagaaatcttagaaatgtgaagaatgtaacaaaacctttaaaagttgtcacacttgattgtgcataagataattcatactaaaaaaaaacctacaagtgtgaagaatgtggcaaaacttttaaccaatgctcacaccttattgcacaggaaagcatttgtactagaaaaaaatttcaaatatacagaatgtgaaaaagccattaatatctgttcacatcttactcaacatcagagatttcatacttaataaaagcattatacatgcaattactgtcaaaaatctttcagaaaatataagcctctaaagtgaagagtattcattttgaagacacacattatgaacataaggagggttgtggtacctttacttgtatcacagatctcattgtacacattttgtgctagaggaaaaccatggagcagttgcttaaactttgtgcaacataaggaaatttatattggagaaaaaccctgcaaatgtaataaatttgggaaaacattttttcaaaaacgacagcttagaaaacactagagggttcatactaaaatctatttttgcagatgcagtaaatatgaaaaaatatttaatccaaaattctatgtaaatatcagataattcacagtagaaatagttaaggcactgacacttcaggcattacactaaatcagattgctgagtatagaaaagaatctaaaactaaagttggtaaatgaattatttgtatataacattataagaagtagaaaatttttgcagagttgtaactacattcaaactatcctttgaaaaaaattaggttttatgaaaagtgaataatgtcatttaactcaagttatgctcttcattcctattgtattcacatgtgaaagcatgtgacttaattgttgctgcatcaaagatgagagattctttgttattaggtgtgcattatttacgaccttttttagtgaaagagttaaggacattaaaatgtaagatgcaagatgaaaatgtaagtggagaggctctttctggttaatttataatattgactgatgcatgaggtaggagttcagataaatatcctgtgttatattgagaaaaaaaattttctggtatatcattttactaattgtactttttttttttttgagacagagttttgctcttgttgcccaggctggagtgcaatggtgtgatcttggctcaccaaaacctccacctcccaggttcaagggattctcctgcctcagcctcccgagtagctgggattacaggcatgtgccaccatgcccggctaattttgtatttttaatagagatggggtttctctatgttggtcaggctggtctcaaactcccgacctcgggtgatccacccacctcggcctcccaaagtgctgggattacaggcgcgagtcaccatgcctggccaattgtacttttatgtaataaaatgtagtacattttaaaatttttagataatgtgtgaacttattaatcaggctttttaaaaaacatgttaagaccatcgtgcattcaatgaagcattattatgccattaaatttaacttatcccatcttactcaagggtataggtaaatgatggtaactatacactatttaataagataatggactaacatttctagtaatctgttttgccagtggctttaaattgcaaataagtcagagaatattattcctgtaggttgaattattactcattttttcttatttaaacttatttttcttaatttttgtgggtacatagtatgtgtaaatatggcatatatggcatattttgatacaggtatataatatgtaataattacatatgggtaaatgaaatattcattacctgcagcatttattgtttgtatttgtttgtattataaactaattctgcacttttcggtttttttttgagacgagtctcactatgtcacccaggctgtgcacgcctgggtgcattggcgtggtctcagctcactgcaacctccgcctactgggttcaagtgattcttccgcctcagcctcctgagtagttgggactacaggcgcatgccaccacactcagctaatttttgtatttttagtagaaacagtttcactacgttggccaggtttgtcttgaactcctgaccccatgattagccccctcggcctcccaaagtgctgggattacaggtgggagccaccacacccagccacttttagttgttttcaaatgtacattaaattgttgttggctacagggtctcttttatggtcataagaaaacaatataaacaaaatgcatacatttctgagacctgaattaacattaaaaaattgttatatatttttcttcaaacatgttgcctctctgcctgcaagcacatacagactattagttttgatttacacagagttaaatatatacatatattactttaaagataaagcttgggtttaaaaaaattatggagtaaataaatgccttctttgcgagtatgagtttctacctagtttcagaagagcaatattgaaacaaatcaaattattttaattagatgatgactgcaaaactaaaaaaacttaaaaatgctgaaaacaaatccatactctctgctttgtattgaattgattactgtaaaattgtatggcttataattcagaatctccctatgcaaatttttgtttttacttgcctgattcttaggctagacccataattttcttgtgtcttacatttttttctcttattttatataagatgctatgtgagctggtcagagattataaaaataatttttataaaattagtgcaaaaaatttagatttaatttcaaaattagtgtattgttatattttatgttgttagaatattttattttgttcttttaattggagaacgctgtataagcctactttttttagtttttgttcctttcagtttttataatgaaaataagtaaatattgattgagcccatttatttaggtgagtactaggggggcttcctaaatcatgaggatgtttttatatataaatatagcaaacaaacatgacagtgctttctgtgtcacagatgctttataataagccataaatattcctgttggagttagtttgtaacttcaagacagagatggaacatatcaattgtgagaaataacattgattttttatgtggagaggacatttattttcaggctgcaaagctcagttttgctgaattaaaaaattgtgcttcttttatttcctaattgtcttagttttgtttgtcttattatgtgtatttcagctgtgtatgcatcacagccctcctttttgctgtgctgtggctacagttttctcactgttctcttcacaccatgtcatttcacatggtatattgtaggttttgatgagaaatcggtatttttaatgcactgcaagattggttttaactggagattttgcatatcaatataattttctgatcagttaaattaaaacaaaaagcatacagtgtccacagatgaaaggattaaatcatttagcgttgtttttctctgtttgttaaagaataatcttattaaattcttacacaaagtgtggcaaatataaaatttgcttgaaaatatatcttagaaattaaacttttaatttaattttctacagtatacttatgccacaatgtacgtttccatgcaaaatcttctatttgtaagtgtgaacattaaacattgcaaaatagtaaaatgacctctgtgattttgaaacctggagtaatatttcttttccatattcatattacaatttgaagaaattttctcagttttatatgtttttttagtgggtgaagttcagtctacagtttttacatttagtcacctaactctagccaacttcttggtcatattctctggaaaacattcgaagatcatggcagcttttagataaaaacattttctattattttgcgtgcaaacttgtttactgtgttcacagagtggccagtcatgagaccataagaaacagctgcccttttagtgtctttcataccgtctgtaatatataaattgtgcatttattctgtgaagcatgacattttgaagtatatacacattgtcaaatgcttcattctaggtaattaatgctttacctaacatagttaacatttttgtggtaagagcacatgacaatgttttagcatttttcagaaatacaaatacattgttatgaactataggcaccatgcagtacaaaagcttttttgaacttatttctcctattcaactgtaattatgtatttgactgacatctttctaaacccctcttttttccaaatatgttggcatctggtggtcaccattttattctccacttcagttagattaatttttctagaatcatgtaagtgaaataatttggttaatctatgtaattgaaaataataaatttttttattttaaagatgaa

SEQ ID NO: 203452 - DNA, 628 bp, Homo sapiens
  Payload ID: 20120
  Gene Name: zinc finger protein 681
  ENST ID: ENST00000528059
  CDS Start-End: 172-628
tcttcttctagaggcccagcctctatggccctctgacctgcaggtattggcgatccatagctaagacgccaggtcccccggaaacctagaaatggtattgttgtctctaagccagacctgatcacctgtctggaacaagaaaaagagccttggactagaaagagacataggatggtggccgaacccccagttatttgttctcattttgcccaagacttttcaccagagcagaacataaaagattctttccaaaaagtgacaccaagaagatatggaaaatgtgaacatgagaatttacagttaagtaaaagtgtggatgagtgcaaagtgcaaaaaggaggttataatggacttaaccaatgtttgccaactacccagagcaaaatatttcaatgtgataaatatatgaaaatctttcataaattttcaaatttaaatggacataaggtaagacacaccagaaaaaaaccttttaaatataaagaatttggcaaatcattttgcatattttcaaacctaactcaacataaaataatttgtactagagtaaatttctacaaatgtgaagactgtggaaaagcctttaatggatcctcaatctttactaaacataaaagaattcatattg

SEQ ID NO: 203453 - DNA, 526 bp, Homo sapiens
  Payload ID: 20120
  Gene Name: zinc finger protein 681
  ENST ID: ENST00000531570
  CDS Start-End: 148-526
tcttctagaggcccagcctctatggccctctgacctgcaggtattggcgatccatagctaagacgccaggtcccccggaaacctagaaatgacctgatcacctgtctggaacaagaaaaagagccttggactagaaagagacataggatggtggccgaacccccagttatttgttctcattttgcccaagacttttcaccagagcagaacataaaagattctttccaaaaagtgacaccaagaagatatggaaaatgtgaacatgagaatttacagttaagtaaaagtgtggatgagtgcaaagtgcaaaaaggaggttataatggacttaaccaatgtttgccaactacccagagcaaaatatttcaatgtgataaatatatgaaaatctttcataaattttcaaatttaaatggacataaggtaagacacaccagaaaaaaaccttttaaatataaagaatttggcaaatcattttgcatattttcaaacctaactcaacataaaataatttgtactagagtaa

SEQ ID NO: 203454 - DNA, 2161 bp, Homo sapiens
  Payload ID: 20121
  Gene Name: zinc finger protein 682
  Uniprot ID: O95780
  ENST ID: ENST00000358523
  CDS Start-End: 423-1823
ggccgtcgatcacctccgggcacaggatgcgagaatcagtctcagtgtttcctgtttggattgccatgaggacatcaacccagagtgactgtagaccctcttcccagcacctgagagtctttgagacatttgaggttgttgtgtgcagactgggatgggagttgttccagttttcacttgggtgaaaaaaaaggagagctggagactgatcaaccaattactttcatttcatatggcgattagaaaaacagatgaggcaatcataatctctgcaatccaggaactgtgtctgtggcaaatgaataaatggctgaatttcacaccatggagaactgttgacattcagggatgtgaccatagaattctctctggaggagtgggagtttctgaaccctgctcagcagagtttgtataggaaagtgatgctagagaactacagaaacctggtctctctgggtcttactgtttctaagccagaactgattagccgtctggagcaaagacaggagccctggaatgtgaagagacatgagaccatagccaaacccccagctatgtcttctcattacactgaagaccttttgccagaacagtgcatgcaagattcattccaaaaagtgatactgagaagatatggaagctgtggacttgaggatttacacttaaggaaggatggggaaaatgtgggtgagtgtaaggatcaaaaagaaatttataatggacttaaccaatgtttgtcaactctacctagcaaaattttcccatataataaatgtgtgaaagtctttagtaaatcatcaaatctaaatagagaaaacataagacatactacagagaaacttttcaaatgtatgcaatgtggcaaagtctttaaatctcactcaggcctttcttatcataagataattcacactgaagagaaactctgcatatgtgaggaatgtggcaaaacctttaagtggttctcataccttactaaacataagagaattcacactggagagaaaccatacaaatgtgaagaatgtggcaaagcttttaactggtgctcgagtcttactaaacataagagaatccatactggtgagaaaccctacaaatgtgaagaatgtggaaaagcctttcactggtgttcaccctttgttagacataagaaaattcatacaggagaaaaaccctatacatgtgaagactgtggcagagcgtttaaccggcactcacatctcaccaaacataagacaattcacactggaaagaaaccctacaaatgtaaagaatgtgggaaagcctttaaccactgctcactacttactatacatgagagaacccatacgggagagaaaccctataaatgtgaagaatgtggcaaagcttttaactcatcatcaattcttactgaacataaggtaattcatagcggagagaaaccctacaaatgtgaaaaatgtgacaaagtctttaagaggttctcataccttactaaacacaagagaattcacactggagagaaaccctacaaatgtgaagaatgtggcaaagcttttaactggtcctcaatccttactgaacataagagaattcatactggagagaaaccctacaactgtgaagaatgtggaaaagcctttaatcggtgctcacaccttactagacataagaaaattcatactgccgtcaaacgctataaatgtgaagaatgtggcaaagcttttaaacggtgctcacatcttaatgaacataagagagttcaaagaggagagaaatcctgcaagtataaaaaatgtggggaagcttttaatcactgctcaaaccttactacgtaagaatttttactaaagagaaatcctacaaatgtaaagaatgtggcaaattccataaatcttgctcaaggcattgaaatcacaagataattcatactggagagaaacactacaaatgtgaagaatgtggggaaagtcttcaaccattgctgacagcttattgcacagaagaaaattcatgctgagaaaaattctgattttaaagaatgtggcaaagcatttaataactactatgaacttactcatcagaggttttgtgctagataaaagcaatgtaagtgtaatgatacacattacatttatctgtggaaagatgtcaccaaataaaagccttagagtac

SEQ ID NO: 203455 - DNA, 3164 bp, Homo sapiens
  Payload ID: 20121
  Gene Name: zinc finger protein 682
  Uniprot ID: O95780
  ENST ID: ENST00000397162
  CDS Start-End: 177-1577
agctgtcagctccggagtctgcggactggagtccccggcaggcacagctcggccgtcgatcacctccgggcacaggatgcgaggaactgttgacattcagggatgtgaccatagaattctctctggaggagtgggagtttctgaaccctgctcagcagagtttgtataggaaagtgatgctagagaactacagaaacctggtctctctgggtcttactgtttctaagccagaactgattagccgtctggagcaaagacaggagccctggaatgtgaagagacatgagaccatagccaaacccccagctatgtcttctcattacactgaagaccttttgccagaacagtgcatgcaagattcattccaaaaagtgatactgagaagatatggaagctgtggacttgaggatttacacttaaggaaggatggggaaaatgtgggtgagtgtaaggatcaaaaagaaatttataatggacttaaccaatgtttgtcaactctacctagcaaaattttcccatataataaatgtgtgaaagtctttagtaaatcatcaaatctaaatagagaaaacataagacatactacagagaaacttttcaaatgtatgcaatgtggcaaagtctttaaatctcactcaggcctttcttatcataagataattcacactgaagagaaactctgcatatgtgaggaatgtggcaaaacctttaagtggttctcataccttactaaacataagagaattcacactggagagaaaccatacaaatgtgaagaatgtggcaaagcttttaactggtgctcgagtcttactaaacataagagaatccatactggtgagaaaccctacaaatgtgaagaatgtggaaaagcctttcactggtgttcaccctttgttagacataagaaaattcatacaggagaaaaaccctatacatgtgaagactgtggcagagcgtttaaccggcactcacatctcaccaaacataagacaattcacactggaaagaaaccctacaaatgtaaagaatgtgggaaagcctttaaccactgctcactacttactatacatgagagaacccatacgggagagaaaccctataaatgtgaagaatgtggcaaagcttttaactcatcatcaattcttactgaacataaggtaattcatagcggagagaaaccctacaaatgtgaaaaatgtgacaaagtctttaagaggttctcataccttactaaacacaagagaattcacactggagagaaaccctacaaatgtgaagaatgtggcaaagcttttaactggtcctcaatccttactgaacataagagaattcatactggagagaaaccctacaactgtgaagaatgtggaaaagcctttaatcggtgctcacaccttactagacataagaaaattcatactgccgtcaaacgctataaatgtgaagaatgtggcaaagcttttaaacggtgctcacatcttaatgaacataagagagttcaaagaggagagaaatcctgcaagtataaaaaatgtggggaagcttttaatcactgctcaaaccttactacgtaagaatttttactaaagagaaatcctacaaatgtaaagaatgtggcaaattccataaatcttgctcaaggcattgaaatcacaagataattcatactggagagaaacactacaaatgtgaagaatgtggggaaagtcttcaaccattgctgacagcttattgcacagaagaaaattcatgctgagaaaaattctgattttaaagaatgtggcaaagcatttaataactactatgaacttactcatcagaggttttgtgctagataaaagcaatgtaagtgtaatgatacacattacatttatctgtggaaagatgtcaccaaataaaagccttagagtacacaaggtgtaatgatagtgatacattacatttgtacatggaaagacttcaaaaatataagccttagagtacacaagagtttttatactgaagaaaaacattacaaatataaagattgttgcaatacttttacttatgttacagattttgttgtacataggagaatttatactgaaaggtaaccctctaacagttgctcaaattttattccattttagataatttacattggaaagaaaccctacaactgtaatgaatatgaaaaaaattgtttaaaaagtacaccttagaaaacactagtttaaggccgggcgcggtggctcacacttataatcccagcactttgggaggccgaggcaggcggatcacgaggtcaggagatcgagaccacgatgaaaccctgtctctactaaaaatacaaaaaattagctgggcatgttgtcgggtgcctgtagtcccagctactgggagaggctgaggcaggagaatggcgtgaacccgagaggcggagcttgcagtgagccgagatcgcgccactgaactccaacctgggcgacagagactctgtctcaaaaaaaaagaaagaacgctagtttatatgaaagcatttaacagatgcagtaaatataaaaaattaataaaaaattaagtctaaatgaacatcagaagattcacagtagaaaccactaagacgctaacactttcaatgttattctaaatcagggcattgattataaagagtaattcaaggttaacataatttagttagcctaaacagaaataggagattaatattttgagacttaaacaattatattcaaagtacactttttgcattgaaagaattttagatttttacaaaggcaaattttgatgtaattgaactctcaaattacttgatgctgtgtctttattcctagtgtctgtatgaaagcatgtggtcaatttctgctgctcggggtttgagaagttctatattaggatgtcatttacatacttttcaacagaagattgaggacactgaaatatgaggtgtgtgaagaaagtacacagagaaacttttgtggttgacttataaaacttgtaagtgctgcatgagatagatgttcagagtaatagtcttgtgcattattcaaattttagtaaattgttttaccaattgcacattagatagtatagtggattttgtaatgcttttcttagactgtgtgaacttagtttcaataaaacaattatttttaatgtgttaa

SEQ ID NO: 203456 - DNA, 3245 bp, Homo sapiens
  Payload ID: 20121
  Gene Name: zinc finger protein 682
  Uniprot ID: O95780
  ENST ID: ENST00000397165
  CDS Start-End: 162-1658
ggcctttgtctcgctccagccagagctcagggtccatcttcattgcttagtatcctctgctctagtagttcccggtgactgtcgcagcctctgttgccctctgacttgcagatgctgtgagatccagagctaagactccacgacatcccggaagccgaaaaatggaactgttgacattcagggatgtgaccatagaattctctctggaggagtgggagtttctgaaccctgctcagcagagtttgtataggaaagtgatgctagagaactacagaaacctggtctctctgggtcttactgtttctaagccagaactgattagccgtctggagcaaagacaggagccctggaatgtgaagagacatgagaccatagccaaacccccagctatgtcttctcattacactgaagaccttttgccagaacagtgcatgcaagattcattccaaaaagtgatactgagaagatatggaagctgtggacttgaggatttacacttaaggaaggatggggaaaatgtgggtgagtgtaaggatcaaaaagaaatttataatggacttaaccaatgtttgtcaactctacctagcaaaattttcccatataataaatgtgtgaaagtctttagtaaatcatcaaatctaaatagagaaaacataagacatactacagagaaacttttcaaatgtatgcaatgtggcaaagtctttaaatctcactcaggcctttcttatcataagataattcacactgaagagaaactctgcatatgtgaggaatgtggcaaaacctttaagtggttctcataccttactaaacataagagaattcacactggagagaaaccatacaaatgtgaagaatgtggcaaagcttttaactggtgctcgagtcttactaaacataagagaatccatactggtgagaaaccctacaaatgtgaagaatgtggaaaagcctttcactggtgttcaccctttgttagacataagaaaattcatacaggagaaaaaccctatacatgtgaagactgtggcagagcgtttaaccggcactcacatctcaccaaacataagacaattcacactggaaagaaaccctacaaatgtaaagaatgtgggaaagcctttaaccactgctcactacttactatacatgagagaacccatacgggagagaaaccctataaatgtgaagaatgtggcaaagcttttaactcatcatcaattcttactgaacataaggtaattcatagcggagagaaaccctacaaatgtgaaaaatgtgacaaagtctttaagaggttctcataccttactaaacacaagagaattcacactggagagaaaccctacaaatgtgaagaatgtggcaaagcttttaactggtcctcaatccttactgaacataagagaattcatactggagagaaaccctacaactgtgaagaatgtggaaaagcctttaatcggtgctcacaccttactagacataagaaaattcatactgccgtcaaacgctataaatgtgaagaatgtggcaaagcttttaaacggtgctcacatcttaatgaacataagagagttcaaagaggagagaaatcctgcaagtataaaaaatgtggggaagcttttaatcactgctcaaaccttactacgtaagaatttttactaaagagaaatcctacaaatgtaaagaatgtggcaaattccataaatcttgctcaaggcattgaaatcacaagataattcatactggagagaaacactacaaatgtgaagaatgtggggaaagtcttcaaccattgctgacagcttattgcacagaagaaaattcatgctgagaaaaattctgattttaaagaatgtggcaaagcatttaataactactatgaacttactcatcagaggttttgtgctagataaaagcaatgtaagtgtaatgatacacattacatttatctgtggaaagatgtcaccaaataaaagccttagagtacacaaggtgtaatgatagtgatacattacatttgtacatggaaagacttcaaaaatataagccttagagtacacaagagtttttatactgaagaaaaacattacaaatataaagattgttgcaatacttttacttatgttacagattttgttgtacataggagaatttatactgaaaggtaaccctctaacagttgctcaaattttattccattttagataatttacattggaaagaaaccctacaactgtaatgaatatgaaaaaaattgtttaaaaagtacaccttagaaaacactagtttaaggccgggcgcggtggctcacacttataatcccagcactttgggaggccgaggcaggcggatcacgaggtcaggagatcgagaccacgatgaaaccctgtctctactaaaaatacaaaaaattagctgggcatgttgtcgggtgcctgtagtcccagctactgggagaggctgaggcaggagaatggcgtgaacccgagaggcggagcttgcagtgagccgagatcgcgccactgaactccaacctgggcgacagagactctgtctcaaaaaaaaagaaagaacgctagtttatatgaaagcatttaacagatgcagtaaatataaaaaattaataaaaaattaagtctaaatgaacatcagaagattcacagtagaaaccactaagacgctaacactttcaatgttattctaaatcagggcattgattataaagagtaattcaaggttaacataatttagttagcctaaacagaaataggagattaatattttgagacttaaacaattatattcaaagtacactttttgcattgaaagaattttagatttttacaaaggcaaattttgatgtaattgaactctcaaattacttgatgctgtgtctttattcctagtgtctgtatgaaagcatgtggtcaatttctgctgctcggggtttgagaagttctatattaggatgtcatttacatacttttcaacagaagattgaggacactgaaatatgaggtgtgtgaagaaagtacacagagaaacttttgtggttgacttataaaacttgtaagtgctgcatgagatagatgttcagagtaatagtcttgtgcattattcaaattttagtaaattgttttaccaattgcacattagatagtatagtggattttgtaatgcttttcttagactgtgtgaacttagtttcaataaaacaattatttttaatgtgttaa

SEQ ID NO: 203457 - DNA, 581 bp, Homo sapiens
  Payload ID: 20121
  Gene Name: zinc finger protein 682
  ENST ID: ENST00000593468
  CDS Start-End: 118-429
gcttagtatcctctgctctagtagttcccggtgactgtcgcagcctctgttgccctctgacttgcagatgctgtgagatccagagctaagactccacgacatcccggaagccgaaaaatggaactgttgacattcagggatgtgaccatagaattctctctggaggagtgggagtttctgaaccctgctcagcagagtttgtataggaaagtgatgctagagaactacagaaacctggtctctctgggtcttactgtttctaagccagaactgattagccgtctggagcaaagacaggagccctggaatgtgaagagacatgagaccatagccaaacccccagattacagccttaccattttgtgtaaaaagaagagcaacatattaataagtttccctagtattatctatgtcttctcattacactgaagaccttttgccagaacagtgcatgcaagattcattccaaaaagtgatactgagaagatatggaagctgtggacttgaggatttacacttaaggaaggatggggaaaatgtgggtgagtgtaaggatcaaaaagaaatttataatggactta

SEQ ID NO: 203458 - DNA, 474 bp, Homo sapiens
  Payload ID: 20121
  Gene Name: zinc finger protein 682
  ENST ID: ENST00000602079
  CDS Start-End: 1-157
tttgtataggaaagtgatgctagagaactacagaaacctggtctctctgggtcttactgtttctaagccagaactgattagccgtctggagcaaagacaggagccctggaatgtgaagagacatgagaccatagccaaacccccagtgtctgtatgaaagcatgtggtcaatttctgctgctcggggtttgagaagttctatattaggatgtcatttacatacttttcaacagaagattgaggacactgaaatatgaggtgtgtgaagaaagtacacagagaaacttttgtggttgacttataaaacttgtaagtgctgcatgagatagatgttcagagtaatagtcttgtgcattattcaaattttagtaaattgttttaccaattgcacattagatagtatagtggattttgtaatgcttttcttagactgtgtgaacttagtttcaataaaacaattatttttaatgtgtt

SEQ ID NO: 203459 - DNA, 603 bp, Homo sapiens
  Payload ID: 20121
  Gene Name: zinc finger protein 682
  ENST ID: ENST00000595534
  CDS Start-End: 97-327
tagttcccggtgactgtcgcagcctctgttgccctctgacttgcagatgctgtgagatccagagctaagactccacgacatcccggaagccgaaaaatggaactgttgacattcagggatgtgaccatagaattctctctggaggagtgggagtttctgaaccctgctcagcagagtttgtataggaaagtgatgctagagaactacagaaacctggtctctctgggtcttactgtttctaagccagaactgattagccgtctggagcaaagacaggagccctggaatgtgaagagacatgagaccatagccaaacccccaggctagattacagccttaccattttgtgtaaaaagaagagcaacatattaataagtttccctagtattatatgaggagtcatgagaattgttgtaaattcaacatctattcattggtggatgtatattttctttttgtgagagaaacacttgtgatttgaagctatgtcttctcattacactgaagaccttttgccagaacagtgcatgcaagattcattccaaaaagtgatactgagaagatatggaagctgtggacttgaggatttacacttaaggaagg

SEQ ID NO: 203460 - DNA, 1538 bp, Homo sapiens
  Payload ID: 20121
  Gene Name: zinc finger protein 682
  ENST ID: ENST00000597972
  CDS Start-End: 23-1537
tgcccattgacagttggtcactatgttttgttttgtttttcaggaactgttgacattcagggatgtgaccatagaattctctctggaggagtgggagtttctgaaccctgctcagcagagtttgtataggaaagtgatgctagagaactacagaaacctggtctctctgggtcttactgtttctaagccagaactgattagccgtctggagcaaagacaggagccctggaatgtgaagagacatgagaccatagccaaacccccagctatgtcttctcattacactgaagaccttttgccagaacagtgcatgcaagattcattccaaaaagtgatactgagaagatatggaagctgtggacttgaggatttacacttaaggaaggatggggaaaatgtgggtgagtgtaaggatcaaaaagaaatttataatggacttaaccaatgtttgtcaactctacctagcaaaattttcccatataataaatgtgtgaaagtctttagtaaatcatcaaatctaaatagagaaaacataagacatactacagagaaacttttcaaatgtatgcaatgtggcaaagtctttaaatctcactcaggcctttcttatcataagataattcacactgaagagaaactctgcatatgtgaggaatgtggcaaaacctttaagtggttctcataccttactaaacataagagaattcacactggagagaaaccatacaaatgtgaagaatgtggcaaagcttttaactggtgctcgagtcttactaaacataagagaatccatactggtgagaaaccctacaaatgtgaagaatgtggaaaagcctttcactggtgttcaccctttgttagacataagaaaattcatacaggagaaaaaccctatacatgtgaagactgtggcagagcgtttaaccggcactcacatctcaccaaacataagacaattcacactggaaagaaaccctacaaatgtaaagaatgtgggaaagcctttaaccactgctcactacttactatacatgagagaacccatacgggagagaaaccctataaatgtgaagaatgtggcaaagcttttaactcatcatcaattcttactgaacataaggtaattcatagcggagagaaaccctacaaatgtgaaaaatgtgacaaagtctttaagaggttctcataccttactaaacacaagagaattcacactggagagaaaccctacaaatgtgaagaatgtggcaaagcttttaactggtcctcaatccttactgaacataagagaattcatactggagagaaaccctacaactgtgaagaatgtggaaaagcctttaatcggtgctcacaccttactagacataagaaaattcatactgccgtcaaacgctataaatgtgaagaatgtggcaaagcttttaaacggtgctcacatcttaatgaacataagagagttcaaagaggagagaaatcctgcaagtataaaaaatgtggggaagcttttaatcactgctcaaaccttactacgtaag

SEQ ID NO: 203461 - DNA, 609 bp, Homo sapiens
  Payload ID: 20121
  Gene Name: zinc finger protein 682
  ENST ID: ENST00000601100
  CDS Start-End: 198-609
gtgacgggactggggcctcccagctgtcagctccggagtctgcggactggagtccccggcaggcacagctcggccgtcgatcacctccgggcacaggatgcgaggaactgttgacattcagggatgtgaccatagaattctctctggaggagtgggagtttctgaaccctgctcagcagagtttgtataggaaagtgatgctagagaactacagaaacctggtctctctgggtcttactgtttctaagccagaactgattagccgtctggagcaaagacaggagccctggaatgtgaagagacatgagaccatagccaaacccccagctatgtcttctcattacactgaagaccttttgccagaacagtgcatgcaagattcattccaaaaagtgatactgagaagatatggaagctgtggacttgaggatttacacttaaggaaggatggggaaaatgtgggtgagtgtaaggatcaaaaagaaatttataatggacttaaccaatgtttgtcaactctacctagcaaaattttcccatataataaatgtgtgaaagtctttagtaaatcatcaaatctaaatagagaaaacataagacatactacag

SEQ ID NO: 203462 - DNA, 1710 bp, Homo sapiens
  Payload ID: 20121
  Gene Name: zinc finger protein 682
  Uniprot ID: O95780
  ENST ID: ENST00000595736
  CDS Start-End: 104-1372
agtagttcccggtgactgtcgcagcctctgttgccctctgacttgcagatgctgtgagatccagagctaagactccacgacatcccggaagccgaaaaatgctatgtcttctcattacactgaagaccttttgccagaacagtgcatgcaagattcattccaaaaagtgatactgagaagatatggaagctgtggacttgaggatttacacttaaggaaggatggggaaaatgtgggtgagtgtaaggatcaaaaagaaatttataatggacttaaccaatgtttgtcaactctacctagcaaaattttcccatataataaatgtgtgaaagtctttagtaaatcatcaaatctaaatagagaaaacataagacatactacagagaaacttttcaaatgtatgcaatgtggcaaagtctttaaatctcactcaggcctttcttatcataagataattcacactgaagagaaactctgcatatgtgaggaatgtggcaaaacctttaagtggttctcataccttactaaacataagagaattcacactggagagaaaccatacaaatgtgaagaatgtggcaaagcttttaactggtgctcgagtcttactaaacataagagaatccatactggtgagaaaccctacaaatgtgaagaatgtggaaaagcctttcactggtgttcaccctttgttagacataagaaaattcatacaggagaaaaaccctatacatgtgaagactgtggcagagcgtttaaccggcactcacatctcaccaaacataagacaattcacactggaaagaaaccctacaaatgtaaagaatgtgggaaagcctttaaccactgctcactacttactatacatgagagaacccatacgggagagaaaccctataaatgtgaagaatgtggcaaagcttttaactcatcatcaattcttactgaacataaggtaattcatagcggagagaaaccctacaaatgtgaaaaatgtgacaaagtctttaagaggttctcataccttactaaacacaagagaattcacactggagagaaaccctacaaatgtgaagaatgtggcaaagcttttaactggtcctcaatccttactgaacataagagaattcatactggagagaaaccctacaactgtgaagaatgtggaaaagcctttaatcggtgctcacaccttactagacataagaaaattcatactgccgtcaaacgctataaatgtgaagaatgtggcaaagcttttaaacggtgctcacatcttaatgaacataagagagttcaaagaggagagaaatcctgcaagtataaaaaatgtggggaagcttttaatcactgctcaaaccttactacgtaagaatttttactaaagagaaatcctacaaatgtaaagaatgtggcaaattccataaatcttgctcaaggcattgaaatcacaagataattcatactggagagaaacactacaaatgtgaagaatgtggggaaagtcttcaaccattgctgacagcttattgcacagaagaaaattcatgctgagaaaaattctgattttaaagaatgtggcaaagcatttaataactactatgaacttactcatcagaggttttgtgctagataaaagcaatgtaagtgtaatgatacacattacatttatctgtggaaagatgtcaccaaataaaagccttagagtac

SEQ ID NO: 203463 - DNA, 450 bp, Homo sapiens
  Payload ID: 20121
  Gene Name: zinc finger protein 682
  ENST ID: ENST00000594127
  CDS Start-End: 1-133
ttacactgaagaccttttgccagaacagtgcatgcaagattcattccaaaaagtgatactgagaagatatggaagctgtggacttgaggatttacacttaaggaaggatggggaaaatgtggtgtctgtatgaaagcatgtggtcaatttctgctgctcggggtttgagaagttctatattaggatgtcatttacatacttttcaacagaagattgaggacactgaaatatgaggtgtgtgaagaaagtacacagagaaacttttgtggttgacttataaaacttgtaagtgctgcatgagatagatgttcagagtaatagtcttgtgcattattcaaattttagtaaattgttttaccaattgcacattagatagtatagtggattttgtaatgcttttcttagactgtgtgaacttagtttcaataaaacaattatttttaatgtgtt

SEQ ID NO: 203464 - DNA, 552 bp, Homo sapiens
  Payload ID: 20121
  Gene Name: zinc finger protein 682
  ENST ID: ENST00000596019
  CDS Start-End: 121-369
attgcttagtatcctctgctctagtagttcccggtgactgtcgcagcctctgttgccctctgacttgcagatgctgtgagatccagagctaagactccacgacatcccggaagccgaaaaatggaactgttgacattcagggatgtgaccatagaattctctctggaggagtgggagtttctgaaccctgctcagcagagtttgtataggaaagtgatgctagagaactacagaaacctggtctctctgggtcttactgtttctaagccagaactgattagccgtctggagcaaagacaggagccctggaatgtgaagagacatgagaccatagccaaacccccaggtacctacagagttggacagtaggaccccagtcctgtcctcttgaaactgacctggagatgaccccagctgatggagaaccctggaaacctggaggatcctcctgctcattctctgtgcccctggacacgtagctagaggagtgcatgcactggcttatagcagagctgccactattctgggtttttttttttttccttgtcttat

SEQ ID NO: 203465 - DNA, 1610 bp, Homo sapiens
  Payload ID: 20122
  Gene Name: zinc finger protein 683
  Uniprot ID: Q8IZ20
  ENST ID: ENST00000349618
  CDS Start-End: 82-1596
aggaacctgagcagatgccttgacccagaccagagacccaagccaaggaaagcccatgatcaccagacaggtaatggggatatgaaggaagaatcagctgcacaattaggttgttgtcataggcccatggccctgggaggtacagggggctccctgtcccccagcctggacttccagctcttccgaggtgaccaggtcttctcagcctgcagaccacttccagacatggtggatgctcatggcccatcctgtgccagctggctgtgtcccttgcccctggcaccgggcaggtctgcactgctggcctgcctacaggacctggacctgaacctgtgcaccccacagccggcacccctgggcacagacctgcagggcctccaagaggacgccttgagcatgaagcacgagccaccagggctgcaggccagctccaccgatgacaagaaattcacagtcaagtacccacagaacaaggacaagctgggaaaacagccagaaagagctggcgagggggccccctgcccagccttctcctctcataacagctcttccccaccaccgctgcagaacagaaagagccccagccccttggctttctgcccctgtccccctgtcaactccatctccaaggagctcccatttctcctccacgccttctaccctggatacccacttctcctgcctccaccccacctgttcacctatggggccctaccttctgaccaatgtccccacctcctcatgctgccccaagacccctcctaccccaccatggctatgcctagcctgctgatgatggtcaatgagctggggcaccccagcgctcggtgggagaccctgcttccctacccaggggccttccaagcctctggccaagctctgccttcccaggcccgaaatccaggtgctggagctgccccaaccgactccccaggcctggagcgtggtggcatggcatctccagcaaagcgggtcccattgagttcccagacaggcaccgcagccttgccttacccgctgaaaaagaagaatggcaaaatcctgtacgagtgcaacatatgtggcaagagctttgggcagctctccaatctcaaggtccacctgcgtgtgcacagtggagagcgtccattccagtgtgccttgtgccagaagagcttcactcaacttgcccacctgcagaagcaccacctggtgcacactggggagcggccccacaagtgctcggtgtgccacaagcgcttcagcagctccagtaacctcaagacccacctgcgcctgcactccggggcccggcccttccagtgcagtgtctgccggagtcgcttcacccagcacatccacctgaagctgcaccatcggctgcatgccccacagccctgtggcctggtgcacacccagctgcccctggcctctctggcctgccttgcccaatggcaccagggggcactagatcttatggcggtggcatctgagaaacacatgggctatgacatagatgaggtcaaagtgtcctcgacatcccaggggaaagcaagagcagtgagcctgagcagtgccgggactcccctggtgatggggcaggaccagaacaattaaaaatgtttcttctg

SEQ ID NO: 203466 - DNA, 1670 bp, Homo sapiens
  Payload ID: 20122
  Gene Name: zinc finger protein 683
  Uniprot ID: Q8IZ20
  ENST ID: ENST00000403843
  CDS Start-End: 79-1653
aggaacctgagcagatgccttgacccagaccagagacccaagccaaggaaagcccatgatcaccagagtaatggggatatgaaggaagaatcagctgcacaattaggttgttgtcataggcccatggccctgggaggtacagggggctccctgtcccccagcctggacttccagctcttccgaggtgaccaggtcttctcagcctgcagaccacttccagacatggtggatgctcatggcccatcctgtgccagctggctgtgtcccttgcccctggcaccgggcaggtctgcactgctggcctgcctacaggacctggacctgaacctgtgcaccccacagccggcacccctgggcacagacctgcagggcctccaagaggacgccttgagcatgaagcacgagccaccagggctgcaggccagctccaccgatgacaagaaattcacagtcaagtacccacagaacaaggacaagctgggaaaacagccagaaagagctggcgagggggccccctgcccagccttctcctctcataacagctcttccccaccaccgctgcagaacagaaagagccccagccccttggctttctgcccctgtccccctgtcaactccatctccaaggagctcccatttctcctccacgccttctaccctggatacccacttctcctgcctccaccccacctgttcacctatggggccctaccttctgaccaatgtccccacctcctcatgctgccccaagacccctcctaccccaccatggctatgcctagcctgctgatgatggtcaatgagctggggcaccccagcgctcggtgggagaccctgcttccctacccaggggccttccaagcctctggccaagctctgccttcccaggcccgaaatccaggtgctggagctgccccaaccgactccccaggcctggagcgtggtggcatggcatctccagcaaagcgggtcccattgagttcccagacaggcaccgcagccttgccttacccgctgaaaaagaagaatggcaaaatcctgtacgagtgcaacatatgtggcaagagctttgggcagctctccaatctcaaggtccacctgcgtgtgcacagtggagagcgtccattccagtgtgccttgtgccagaagagcttcactcaacttgcccacctgcagaagcaccacctggtgcacactggggagcggccccacaagtgctcgataccgtgggttccaggaagaaatcactggaaaagcttccaggcctggagggaaagagaggtgtgccacaagcgcttcagcagctccagtaacctcaagacccacctgcgcctgcactccggggcccggcccttccagtgcagtgtctgccggagtcgcttcacccagcacatccacctgaagctgcaccatcggctgcatgccccacagccctgtggcctggtgcacacccagctgcccctggcctctctggcctgccttgcccaatggcaccagggggcactagatcttatggcggtggcatctgagaaacacatgggctatgacatagatgaggtcaaagtgtcctcgacatcccaggggaaagcaagagcagtgagcctgagcagtgccgggactcccctggtgatggggcaggaccagaacaattaaaaatgtttcttctgtca

SEQ ID NO: 203467 - DNA, 1712 bp, Homo sapiens
  Payload ID: 20122
  Gene Name: zinc finger protein 683
  Uniprot ID: Q8IZ20
  ENST ID: ENST00000436292
  CDS Start-End: 122-1696
ggggaggtagcacaaagggaggaccatggtcttctaactgaggaacctgagcagatgccttgacccagaccagagacccaagccaaggaaagcccatgatcaccagacaggtaatggggatatgaaggaagaatcagctgcacaattaggttgttgtcataggcccatggccctgggaggtacagggggctccctgtcccccagcctggacttccagctcttccgaggtgaccaggtcttctcagcctgcagaccacttccagacatggtggatgctcatggcccatcctgtgccagctggctgtgtcccttgcccctggcaccgggcaggtctgcactgctggcctgcctacaggacctggacctgaacctgtgcaccccacagccggcacccctgggcacagacctgcagggcctccaagaggacgccttgagcatgaagcacgagccaccagggctgcaggccagctccaccgatgacaagaaattcacagtcaagtacccacagaacaaggacaagctgggaaaacagccagaaagagctggcgagggggccccctgcccagccttctcctctcataacagctcttccccaccaccgctgcagaacagaaagagccccagccccttggctttctgcccctgtccccctgtcaactccatctccaaggagctcccatttctcctccacgccttctaccctggatacccacttctcctgcctccaccccacctgttcacctatggggccctaccttctgaccaatgtccccacctcctcatgctgccccaagacccctcctaccccaccatggctatgcctagcctgctgatgatggtcaatgagctggggcaccccagcgctcggtgggagaccctgcttccctacccaggggccttccaagcctctggccaagctctgccttcccaggcccgaaatccaggtgctggagctgccccaaccgactccccaggcctggagcgtggtggcatggcatctccagcaaagcgggtcccattgagttcccagacaggcaccgcagccttgccttacccgctgaaaaagaagaatggcaaaatcctgtacgagtgcaacatatgtggcaagagctttgggcagctctccaatctcaaggtccacctgcgtgtgcacagtggagagcgtccattccagtgtgccttgtgccagaagagcttcactcaacttgcccacctgcagaagcaccacctggtgcacactggggagcggccccacaagtgctcgataccgtgggttccaggaagaaatcactggaaaagcttccaggcctggagggaaagagaggtgtgccacaagcgcttcagcagctccagtaacctcaagacccacctgcgcctgcactccggggcccggcccttccagtgcagtgtctgccggagtcgcttcacccagcacatccacctgaagctgcaccatcggctgcatgccccacagccctgtggcctggtgcacacccagctgcccctggcctctctggcctgccttgcccaatggcaccagggggcactagatcttatggcggtggcatctgagaaacacatgggctatgacatagatgaggtcaaagtgtcctcgacatcccaggggaaagcaagagcagtgagcctgagcagtgccgggactcccctggtgatggggcaggaccagaacaattaaaaatgtttcttctgtc

SEQ ID NO: 203468 - DNA, 744 bp, Homo sapiens
  Payload ID: 20122
  Gene Name: zinc finger protein 683
  ENST ID: ENST00000423508
  CDS Start-End: 154-744
acccaagccaaggaaagcccatgatcaccagagtaggttgggaagtgcggatagaggggaagtagtttttatttttttctaacagagaagttgtgcaaggtgttctgagagttgggagcagagtgtgatgccaggagagggcagagctggcagatggaagccaaaggtaatggggatatgaaggaagaatcagctgcacaattaggttgttgtcataggcccatggccctgggaggtacagggggctccctgtcccccagcctggacttccagctcttccgaggtgaccaggtcttctcagcctgcagaccacttccagacatggtggatgctcatggcccatcctgtgccagctggctgtgtcccttgcccctggcaccgggcaggtctgcactgctggcctgcctacaggacctggacctgaacctgtgcaccccacagccggcacccctgggcacagacctgcagggcctccaagaggacgccttgagcatgaagcacgagccaccagggctgcaggccagctccaccgatgacaagaaattcacagtcaagtacccacagaacaaggacaagctgggaaaacagccagaaagagctggcgagggggccccctgcccagccttctcctctcataacagctcttccccaccaccgctgcagaacagaaagagccccagccccttggctttctgcccctgtccccctgtcaactccatctccaaggagctcccatttctcctc

SEQ ID NO: 203469 - DNA, 853 bp, Homo sapiens
  Payload ID: 20122
  Gene Name: zinc finger protein 683
  ENST ID: ENST00000416125
  CDS Start-End: 288-853
ctcctggggcatttcctagccaagccagggagctttcaggattggagacctggaaatctccaaggccatttccttttttatttttttctaacagagaggttgtgcaaagtgttctgagagctgggagcagagtgtgatgccaggagggagcacagctggcagatggaagccaaagcctggagtgtagcagagccatctcagctcactgcaacctccgcctcccgggttcaagcaattctcctgcctcagtctcccaagtagctggaaatacagcaggtaatggggatatgaaggaagaatcagctgcacaattaggttgttgtcataggcccatggccctgggaggtacagggggctccctgtcccccagcctggacttccagctcttccgaggtgaccaggtcttctcagcctgcagaccacttccagacatggtggatgctcatggcccatcctgtgccagctggctgtgtcccttgcccctggcaccgggcaggtctgcactgctggcctgcctacaggacctggacctgaacctgtgcaccccacagccggcacccctgggcacagacctgcagggcctccaagaggacgccttgagcatgaagcacgagccaccagggctgcaggccagctccaccgatgacaagaaattcacagtcaagtacccacagaacaaggacaagctgggaaaacagccagaaagagctggcgagggggccccctgcccagccttctcctctcataacagctcttccccaccaccgctgcagaacagaaagagccccagccccttggctttctgcccctgtccccctgtcaactccatctccaaggagctcccatttctcct

SEQ ID NO: 203470 - DNA, 662 bp, Homo sapiens
  Payload ID: 20122
  Gene Name: zinc finger protein 683
  ENST ID: ENST00000453132
  CDS Start-End: 296-662
ttctaactgaggaacctgagcagatgccttgacccagaccagagacccaagccaaggaaagcccatgatcaccagagtaggttgggaagtgcggatagaggggaagtagtttttatttttttctaacagagaagttgtgcaaggtgttctgagagttgggagcagagtgtgatgccaggagagggcagagctggcagatggaagccaaaggtgtgcgggtcaccccttctgggtggggacatctgatcgacctagtccatgtatgcctgcatgaagtgctgcaggtaatggggatatgaaggaagaatcagctgcacaattaggttgttgtcataggcccatggccctgggaggtacagggggctccctgtcccccagcctggacttccagctcttccgaggtgaccagagcacgagccaccagggctgcaggccagctccaccgatgacaagaaattcacagtcaagtacccacagaacaaggacaagctgggaaaacagccagaaagagctggcgagggggccccctgcccagccttctcctctcataacagctcttccccaccaccgctgcagaacagaaagagccccagccccttggctttctgcccctgtccccctgtcaactccatctccaaggagctcccatttctcctccacgc

SEQ ID NO: 203471 - DNA, 1080 bp, Homo sapiens
  Payload ID: 20122
  Gene Name: zinc finger protein 683
  ENST ID: ENST00000455900
  CDS Start-End: 233-1080
cagcaaggaagggcttggcaggcagaggcttctccacgtgggaacctgagggagtctgtcctcagcccacctcctggggcatttcctagccaagccagggagctttcaggattggagacctggaaatctccaaggccatttccttttttatttttttctaacagagaggttgtgcaaagtgttctgagagctgggagcagagtgtgatgccaggagggagcacagctggcagatggaagccaaaggtaatggggatatgaaggaagaatcagctgcacaattaggttgttgtcataggcccatggccctgggaggtacagggggctccctgtcccccagcctggacttccagctcttccgaggtgaccaggtcttctcagcctgcagaccacttccagacatggtggatgctcatggcccatcctgtgccagctggctgtgtcccttgcccctggcaccgggcaggtctgcactgctggcctgcctacaggacctggacctgaacctgtgcaccccacagccggcacccctgggcacagacctgcagggcctccaagaggacgccttgagcatgaagcacgagccaccagggctgcaggccagctccaccgatgacaagaaattcacagtcaagtacccacagaacaaggacaagctgggaaaacagccagaaagagctggcgagggggccccctgcccagccttctcctctcataacagctcttccccaccaccgctgcagaacagaaagagccccagccccttggctttctgcccctgtccccctgtcaactccatctccaaggagctcccatttctcctccacgccttctaccctggatacccacttctcctgcctccaccccacctgttcacctatggggccctaccttctgaccaatgtccccacctcctcatgctgccccaagacccctcctaccccaccatggctatgcctagcctgctgatgatggtcaatgagctggggcaccccagcgctcggtgggagaccctgcttccctacccaggggccttccaagcctctggccaagctctgccttcccaggcccgaaatccagg

SEQ ID NO: 203472 - DNA, 936 bp, Homo sapiens
  Payload ID: 20122
  Gene Name: zinc finger protein 683
  ENST ID: ENST00000451801
  CDS Start-End: 128-936
ctcagccacaggcagctgtggcctggctgcccacctccttccttcccagccaggagcactgctgcagcaccgagtggagagccccacagccagcagcccttcgggggtccatgcaggtaatggggatatgaaggaagaatcagctgcacaattaggttgttgtcataggcccatggccctgggaggtacagggggctccctgtcccccagcctggacttccagctcttccgaggtgaccaggtcttctcagcctgcagaccacttccagacatggtggatgctcatggcccatcctgtgccagctggctgtgtcccttgcccctggcaccgggcaggtctgcactgctggcctgcctacaggacctggacctgaacctgtgcaccccacagccggcacccctgggcacagacctgcagggcctccaagaggacgccttgagcatgaagcacgagccaccagggctgcaggccagctccaccgatgacaagaaattcacagtcaagtacccacagaacaaggacaagctgggaaaacagccagaaagagctggcgagggggccccctgcccagccttctcctctcataacagctcttccccaccaccgctgcagaacagaaagagccccagccccttggctttctgcccctgtccccctgtcaactccatctccaaggagctcccatttctcctccacgccttctaccctggatacccacttctcctgcctccaccccacctgttcacctatggggccctaccttctgaccaatgtccccacctcctcatgctgccccaagacccctcctaccccaccatggctatgcctagcctgctgatgatggtcaatgagctggggcaccccagcgctcggtgggagaccctgcttccctacccaggggccttccaagcctctggccaagctctgccttccca

SEQ ID NO: 203473 - DNA, 592 bp, Homo sapiens
  Payload ID: 20122
  Gene Name: zinc finger protein 683
  ENST ID: ENST00000454975
  CDS Start-End: 130-592
ggggcctcagccacaggcagctgtggcctggctgcccacctccttccttcccagccaggagcactgctgcagcaccgagtggagagccccacagccagcagcccttcgggggtccatggtaatggggatatgaaggaagaatcagctgcacaattaggttgttgtcataggcccatggccctgggaggtacagggggctccctgtcccccagcctggacttccagctcttccgaggtgaccagccggcacccctgggcacagacctgcagggcctccaagaggacgccttgagcatgaagcacgagccaccagggctgcaggccagctccaccgatgacaagaaattcacagtcaagtacccacagaacaaggacaagctgggaaaacagccagaaagagctggcgagggggccccctgcccagccttctcctctcataacagctcttccccaccaccgctgcagaacagaaagagccccagccccttggctttctgcccctgtccccctgtcaactccatctccaaggagctcccatttctcctccacgccttctaccctggatacccacttctcctgcctccaccccacc

SEQ ID NO: 203474 - DNA, 1009 bp, Homo sapiens
  Payload ID: 20123
  Gene Name: zinc finger protein 684
  ENST ID: ENST00000372696
  CDS Start-End: 150-428
attcaatcttcaaatcagcgccgcgggaagtgcgggcgggtgttgctcccctgtctctggacgacgctgtgactgatcccaggcttggagccggagctgcgagcgaggcagtgaaagggtggcagatttctgtgtaagagctgcagaaaatgatcagcttccaggaatcagtgacattccaggatgtggctgtggatttcactgcagaggagtggcagctgcttgattgtgctgagagaaccctgtattgggatgtgatgttggagaactatagaaacctcatctcagtgggatgtccaattaccaaaacaaaagtgatcctcaaggtagagcaaggacaagagccatggatggtggagggagcgaatccacacgagagctctccaggctggagtgcagtggcgcaatctcagctcgggttcaagtgattctcctacctcagcctcccgaagagctggaactacaggcgcccgccaccatgcctggctaatttttgtatttttagtagagacacggtttcaccatgttggccaggatggtcttgatctcttgaccttgtgagccacccgccttggcctcccaaagtgctgggattacaggtgtgagccaccgtgcctggcccaaaaataaagtattttaaaattcaacaaacgagtatgaaacatttcttcaatgcacattaacattgcagttttgttctaattaactgtcaaaatgacagacagcagcagtgactatcttagaaattcatagaaaatggagcttaaagtttaaagtatgcaaaatttggagaagtcttttttttgaggtcatggaacagtggttcctccctaaagagtatctaagttctagataggacgagaggagataagggggggtgcaaatgaaggtggacaacgaacatgagcaaaagattgaatttaggaatctagaatccatggagtagaaggtatttgttgaggactagtgaaatgcatgcttcccatgagtgaattcatatcttgcataa

SEQ ID NO: 203475 - DNA, 1028 bp, Homo sapiens
  Payload ID: 20123
  Gene Name: zinc finger protein 684
  ENST ID: ENST00000372697
  CDS Start-End: 150-509
attcaatcttcaaatcagcgccgcgggaagtgcgggcgggtgttgctcccctgtctctggacgacgctgtgactgatcccaggcttggagccggagctgcgagcgaggcagtgaaagggtggcagatttctgtgtaagagctgcagaaaatgatcagcttccaggaatcagtgacattccaggatgtggctgtggatttcactgcagaggagtggcagctgcttgattgtgctgagagaaccctgtattgggatgtgatgttggagaactatagaaacctcatctcagtgggatgtccaattaccaaaacaaaagtgatcctcaaggtagagcaaggacaagagccatggatggtggagggagcgaatccacacgagagctctccagagtctcgctctgtcgccaggctggagtgcagtggcgcaatctcagctcgggttcaagtgattctcctacctcagcctcccgaagagctggaactacaggcgcccgccaccatgcctggctaatttttgtatttttagtagagacacggtttcaccatgttggccaggatggtcttgatctcttgaccttgtgagccacccgccttggcctcccaaagtgctgggattacaggtgtgagccaccgtgcctggcccaaaaataaagtattttaaaattcaacaaacgagtatgaaacatttcttcaatgcacattaacattgcagttttgttctaattaactgtcaaaatgacagacagcagcagtgactatcttagaaattcatagaaaatggagcttaaagtttaaagtatgcaaaatttggagaagtcttttttttgaggtcatggaacagtggttcctccctaaagagtatctaagttctagataggacgagaggagataagggggggtgcaaatgaaggtggacaacgaacatgagcaaaagattgaatttaggaatctagaatccatggagtagaaggtatttgttgaggactagtgaaatgcatgcttcccatgagtgaattcatatcttgcataa

SEQ ID NO: 203476 - DNA, 2097 bp, Homo sapiens
  Payload ID: 20123
  Gene Name: zinc finger protein 684
  Uniprot ID: Q5T5D7
  ENST ID: ENST00000372699
  CDS Start-End: 252-1388
atgggaaatgtggtctccgacggatggcctacacccgggaggagtccaggaactctaggtggacagttacttccgcacacgcgtagtaggacggtagccggtattcaatcttcaaatcagcgccgcgggaagtgcgggcgggtgttgctcccctgtctctggacgacgctgtgactgatcccaggcttggagccggagctgcgagcgaggcagtgaaagggtggcagatttctgtgtaagagctgcagaaaatgatcagcttccaggaatcagtgacattccaggatgtggctgtggatttcactgcagaggagtggcagctgcttgattgtgctgagagaaccctgtattgggatgtgatgttggagaactatagaaacctcatctcagtgggatgtccaattaccaaaacaaaagtgatcctcaaggtagagcaaggacaagagccatggatggtggagggagcgaatccacacgagagctctccagaatctgactacccacttgttgatgaaccagggaagcatcgggaaagcaaagacaattttttgaagtcagttttgctcacattcaataaaattctgactatggagagaatccaccattataatatgagcacaagtcttaatccaatgagaaaaaaatcatataaatcgtttgagaagtgtttgccacctaatttagacttacttaaatataatagaagttatactgtagaaaacgcttatgaatgcagtgaatgcgggaaagccttcaaaaagaagtttcatttcattagacatgaaaaaaatcatacaaggaaaaaaccttttgaatgcaatgactgtggaaaagcctatagcaggaaggcacaccttgcaactcatcagaaaattcataatggagagagaccctttgtgtgcaatgattgtgggaaggcgtttatgcataaagcccaactcgtggtccaccagagacttcacactggagagaagccttatgagtgcagtcaatgtgggaaaacattcacttggaactcctcatttaatcaacacgtgaaatctcatacacttgagaagtcatttgaatgtaaggaatgtgggaaaaccttcaggtatagttcatccctttataaacattccagatttcatacaggagagaaaccctaccagtgtatcatatgtggcaaagcttttggcaacacatccgtgcttgttacacaccaaagaattcatacaggagagaaaccttacagttgtattgaatgtggcaaagccttcatcaagaagtcccatctcctcagacatcagataactcatacaggagagaagccctatgaatgtaacagatgtgggaaagcattttcccagaagtcaaatcttattgtacatcagaaaattcatacataatattcactttatgaatatgagaaggccttattaaatatttgctaaatcttattaaatactaaagaattcatggtgagaagtctacaatttaaatgaatttggaagagtagattcccataaaaaacaaccaatgccaatcatgttctggaagtgataataaactttttacagaaaatatgacagaaaacaactataaataatagagcataaagcttggaaagtaagcataacttaaaaaatcaaagaaccagtgaaaactacatttgccattcctgacttttaatttttataataaaataattatgcaagtgtgagtttaaaatatatgcttatacattatattaaagtatgcctattaacagtttctgcagtaaataacattttttcttccagtctcaacatacataattaatcaagtgagaaaatgtgttttaatatgtcatatgaatttcagtgatattttcatccatttgctggcacttttaatgggcatgacagtgtttctgaatctgagtctcctttaattatacaagtgaagacttcttattaaaattaatataaagatattttcctatgtatgtaaataccagaacaaaaaacaagacactaattgaggagagaaaggcacttgtattctgtattacagtaagtattcagttgaggaaaagaattatttaaatatgtaaataaataatttgcacttcaaata

SEQ ID NO: 203477 - DNA, 5378 bp, Homo sapiens
  Payload ID: 20124
  Gene Name: zinc finger protein 687
  Uniprot ID: Q8N1G0
  ENST ID: ENST00000324048
  CDS Start-End: 971-4684
ggccgcggggagggcggcggtggctgcagcggctggagcggggtagagaccgccgggtctcggcccgcaccaggagcggaacaacctttcagatctgtgtggaccccagaagatccgtgaagaatatgaattgattccatgcggacatgaatgagtccttaaacctagaacatcatgtacatcatcctccttaataatagtattgattatttggttctatgctggggaccggaggggatgagatggtttccaccagaatgctcactgagctctattacccttccctgttccctgtattttttttttttttctgagacagtcttgctctgtcgcccaggtgggagtgcagtggcacgatctcagctcactgcaaactccacctcccaggttcaagcaattcttctgcctcagcctcccgagtagctgggactacaggtgtgtgctgccatgcccagctaatttttgtatttttagtagagacggggtttcactatcttggccaggatggtcttgatctcctgacctcgtgatccgcccgcctctgcctccccaagtgctgggattacaggcgtgagccaccatgcccagccccctatatttcttttttttgagacagggtctcgctctgtccaggctggagtgcagtggcgtgatcttggctcattgaaacctcaacctcatgggttcaggcgattctcctgcctcagcctcctttgtagctgcgattacaggcatgtgccaccacacctgtctagttttttgtatttttagtagagacaaggtttcaccatgttggccaagctggtctcaaactcctgacctcaagtgatccatctgcctcagcctcccaaaacgctgggattacaagcatgagccaccgcacctggccccttccctgtatttctaagaactctcttttcccctgctttctctggattttggagcccaccaaggtctgggatctgccgatatgggggatatgaagacccctgattttgatgacctccttgctgcctttgacatccctgacattgatgcgaatgaagccatccattctgggccagaagaaaatgaggggcctggaggcccagggaagccagaaccaggtgtaggaagtgaatctgaagacacagcagcagcctctgctggggatggccctggagttccagcccaggcctctgaccatggcctgccaccgccagacatttctgtagtcagtgtcattgtcaagaacactgtgtgtcccgagcagtctgaggccctggctggaggctcagcaggagacggggcccaggctgctggggtaactaaagaagggcctgtggggcctcatcgaatgcagaatggttttgggagccctgaaccttccctcccaggaactccccactctcctgctcctcccagtgggggcacctggaaagaaaaaggcatggaaggcaaaactcccttggacctgtttgctcattttggccctgagccaggggaccactcagatccgctgcctccctctgcaccctctcccactcgggagggggctctgaccccgcctcctttcccctcttcctttgagctggcccaggagaatggcccaggcatgcagccacctgtttcttccccaccattgggggccttgaagcaggagagctgcagcccccatcatccccaggtcctagcccaacaaggctcaggctccagccctaaggccacggacatccctgccagtgcctcgcctcccccagttgctggggtgcccttcttcaagcagtctccagggcaccagagccctcttgcctcccccaaagtgcccgtctgtcagcccttgaaggaagaagatgatgatgaggggccagtggacaagtcttccccaggaagtccccagagtccctctagtggggccgaggctgcagatgaggacagcaatgactcccctgcctccagctcctctaggcctcttaaggtgcggatcaagaccattaaaacatcctgcgggaatatcacaaggactgtaactcaggtcccctcagatcctgatccacctgcccccttggctgagggggccttcttggctgaggctagcctcttgaagctgtcccctgcaacacctacttctgagggtccaaaggtggtgagcgtacagttgggtgatggtacaaggctgaaaggcactgtgctgcctgtggccaccatccagaacgccagtactgccatgctgatggcagccagtgtggctcgcaaggctgtggtgctgcctggggggactgccaccagccctaagatgattgctaagaacgtgctaggcctggtgccccaagccctgcctaaggctgacgggcgggcagggctggggactgggggacagaaggtgaatggtgcctcggtggtgatggtgcaaccttcaaagacagctactgggccaagtacagggggcggcacagtgatatcacggacccagtccagcctggtggaggccttcaacaagatcctcaacagcaagaacctgctccctgcctataggccaaacctgagcccaccagctgaggctgggctggccctgcctcccaccggctaccgctgcctggagtgtggggatgccttctcattggagaagagcctggcacggcactatgaccgtcggagcatgcgcatcgaggtcacctgcaaccactgcgcccgccgcctggtcttcttcaacaagtgcagcctgctcctgcatgcacgtgaacacaaggacaaggggctcgtcatgcagtgctcacatttggtcatgaggcctgtagcccttgaccagatggtggggcagccggacatcacaccgctgctgcctgtagctgtcccacctgtctctggacctctggccttgcctgccttgggcaagggtgagggggccatcacctcctctgccattactacagttgctgctgaggcccctgtcctgccgctctccacagagccgcctgctgccccggccacctctgcttacacatgctttcgctgcctggagtgcaaggaacagtgccgggacaaggctggcatggcagctcacttccagcagctcggcccccctgcccctggggccaccagcaatgtgtgcccaacctgccccatgatgctccccaatcgctgcagcttcagcgcccaccagcgcatgcataagaatcgacccccccatgtctgtcctgagtgtgggggcaacttcctgcaagccaattttcagacccatctccgggaggcctgtctgcacgtctctcgccgtgtaggatacaggtgccccagctgttcagtggtgtttgggggtgtgaactccatcaagtcccacatccagacgtcgcactgcgaggttttccacaagtgccccatctgccccatggccttcaagtctgggccaagtgcccatgcccacctctactcccagcatcccagcttccaaactcagcaggccaagctgatctacaagtgcgccatgtgcgacacagtcttcactcacaaacccctcctctcctcacacttcgaccagcacttgctgccccagcgtgtcagtgtctttaagtgcccgtcttgtcctctgctctttgcccaaaaaaggaccatgctggaacatctcaagaacacccatcagtctgggcgcttggaggagactgctgggaaaggggccgggggtgccctgctgacccccaagactgagcctgaggagctggctgtttctcagggaggggcagcccctgctactgaggagtcgtcttcatcttcagaagaggaggaagtacccagctcccctgagcccccccgtccagccaaacggcctcggcgggaactagggagcaaaggcctcaagggtgggggtggggggcctggaggctggacctgtggcctgtgtcactcctggttccctgagcgtgatgaatacgtggcccacatgaagaaggagcatggcaagtcagtgaaaaagttcccctgtcgcctgtgtgagcgctccttctgctccgcccccagcctgaggcgccatgtcagagttaatcacgagggcatcaagcgagtttacccctgcaggtattgcacagagggaaaacgcaccttcagcagccgcctgatcctagagaaacatgtccaggtccggcacggcttgcagcttggggcccagtcccctggccgggggaccaccttggctcggggttccagtgccagagcccaggggccaggtcggaaacgccgccagtcttctgactcttgcagtgaggagcctgacagcacgacaccgccagccaagtcccccaggggcggacctggatctggaggccatggccctctgcgctaccggagcagcagctccacagaacagagcctcatgatggggttgagggtggaggatggtgcccagcagtgcctcgactgtggcttgtgctttgcctcccctggctccctgagccgacaccgtttcatcagccacaagaagagacggggtgtgggtaaagccagtgccctggggctgggggatggggaggaagaggcccctccatcaaggtctgaccccgatggtggagactcacccctgcctgcttctggaggcccactgacctgtaaggtctgtggcaagagctgcgacagccctctaaacctcaagacccacttccgcacgcatggcatggcgttcatcagggctcggcagggggctgttggggacaactagtctccaaggcctgggactgaccagccccttcctcttggagcctggttttccctactgctgcctgatccctcggctggggagttttcattaacattaatattttgttaattcctgtctctccaacctgaagaagaagagcatttgaggattattctagttatttgcaacctccctttgggtttggccctggagtcctagtagagtggaccctccattcctcctttctgagcccaacactaattaattttatgctcctgctgcagaacccccagtgtgggcctgggggtgggaggatgggacttaggtatgcctgctagacaggttcagggaaggactgatgggggtgtcatggatggacacacctctccacaattccttcaggcatggactggaactttcctcctctaggccgggccctgccctagtgcccacccccgcccccgcccccgcccaaccccaactcactggcactcaagccccctacccctgcagtgcctttcacttctttttttccccagaaatccggggcgggggggtggggggttggtagggatgagtcctgtcaagggggccacaggagaggaggggacaggctctcaggaatcctttattcttgtagtaataataatactaacaaacagttggggaactagggagaaaaccagaccattaaaactgtttgtggtcgaatctc

SEQ ID NO: 203478 - DNA, 4831 bp, Homo sapiens
  Payload ID: 20124
  Gene Name: zinc finger protein 687
  Uniprot ID: Q8N1G0
  ENST ID: ENST00000336715
  CDS Start-End: 147-3860
gagggagtggggaggccgaaccggagagaagcaggaagtagcggcggccgcggggagggcggcggtggctgcagcggctggagcggggtagagaccgccgggtctcggcccgcaccaggagcggaacaagtctgggatctgccgatatgggggatatgaagacccctgattttgatgacctccttgctgcctttgacatccctgacattgatgcgaatgaagccatccattctgggccagaagaaaatgaggggcctggaggcccagggaagccagaaccaggtgtaggaagtgaatctgaagacacagcagcagcctctgctggggatggccctggagttccagcccaggcctctgaccatggcctgccaccgccagacatttctgtagtcagtgtcattgtcaagaacactgtgtgtcccgagcagtctgaggccctggctggaggctcagcaggagacggggcccaggctgctggggtaactaaagaagggcctgtggggcctcatcgaatgcagaatggttttgggagccctgaaccttccctcccaggaactccccactctcctgctcctcccagtgggggcacctggaaagaaaaaggcatggaaggcaaaactcccttggacctgtttgctcattttggccctgagccaggggaccactcagatccgctgcctccctctgcaccctctcccactcgggagggggctctgaccccgcctcctttcccctcttcctttgagctggcccaggagaatggcccaggcatgcagccacctgtttcttccccaccattgggggccttgaagcaggagagctgcagcccccatcatccccaggtcctagcccaacaaggctcaggctccagccctaaggccacggacatccctgccagtgcctcgcctcccccagttgctggggtgcccttcttcaagcagtctccagggcaccagagccctcttgcctcccccaaagtgcccgtctgtcagcccttgaaggaagaagatgatgatgaggggccagtggacaagtcttccccaggaagtccccagagtccctctagtggggccgaggctgcagatgaggacagcaatgactcccctgcctccagctcctctaggcctcttaaggtgcggatcaagaccattaaaacatcctgcgggaatatcacaaggactgtaactcaggtcccctcagatcctgatccacctgcccccttggctgagggggccttcttggctgaggctagcctcttgaagctgtcccctgcaacacctacttctgagggtccaaaggtggtgagcgtacagttgggtgatggtacaaggctgaaaggcactgtgctgcctgtggccaccatccagaacgccagtactgccatgctgatggcagccagtgtggctcgcaaggctgtggtgctgcctggggggactgccaccagccctaagatgattgctaagaacgtgctaggcctggtgccccaagccctgcctaaggctgacgggcgggcagggctggggactgggggacagaaggtgaatggtgcctcggtggtgatggtgcaaccttcaaagacagctactgggccaagtacagggggcggcacagtgatatcacggacccagtccagcctggtggaggccttcaacaagatcctcaacagcaagaacctgctccctgcctataggccaaacctgagcccaccagctgaggctgggctggccctgcctcccaccggctaccgctgcctggagtgtggggatgccttctcattggagaagagcctggcacggcactatgaccgtcggagcatgcgcatcgaggtcacctgcaaccactgcgcccgccgcctggtcttcttcaacaagtgcagcctgctcctgcatgcacgtgaacacaaggacaaggggctcgtcatgcagtgctcacatttggtcatgaggcctgtagcccttgaccagatggtggggcagccggacatcacaccgctgctgcctgtagctgtcccacctgtctctggacctctggccttgcctgccttgggcaagggtgagggggccatcacctcctctgccattactacagttgctgctgaggcccctgtcctgccgctctccacagagccgcctgctgccccggccacctctgcttacacatgctttcgctgcctggagtgcaaggaacagtgccgggacaaggctggcatggcagctcacttccagcagctcggcccccctgcccctggggccaccagcaatgtgtgcccaacctgccccatgatgctccccaatcgctgcagcttcagcgcccaccagcgcatgcataagaatcgacccccccatgtctgtcctgagtgtgggggcaacttcctgcaagccaattttcagacccatctccgggaggcctgtctgcacgtctctcgccgtgtaggatacaggtgccccagctgttcagtggtgtttgggggtgtgaactccatcaagtcccacatccagacgtcgcactgcgaggttttccacaagtgccccatctgccccatggccttcaagtctgggccaagtgcccatgcccacctctactcccagcatcccagcttccaaactcagcaggccaagctgatctacaagtgcgccatgtgcgacacagtcttcactcacaaacccctcctctcctcacacttcgaccagcacttgctgccccagcgtgtcagtgtctttaagtgcccgtcttgtcctctgctctttgcccaaaaaaggaccatgctggaacatctcaagaacacccatcagtctgggcgcttggaggagactgctgggaaaggggccgggggtgccctgctgacccccaagactgagcctgaggagctggctgtttctcagggaggggcagcccctgctactgaggagtcgtcttcatcttcagaagaggaggaagtacccagctcccctgagcccccccgtccagccaaacggcctcggcgggaactagggagcaaaggcctcaagggtgggggtggggggcctggaggctggacctgtggcctgtgtcactcctggttccctgagcgtgatgaatacgtggcccacatgaagaaggagcatggcaagtcagtgaaaaagttcccctgtcgcctgtgtgagcgctccttctgctccgcccccagcctgaggcgccatgtcagagttaatcacgagggcatcaagcgagtttacccctgcaggtattgcacagagggaaaacgcaccttcagcagccgcctgatcctagagaaacatgtccaggtccggcacggcttgcagcttggggcccagtcccctggccgggggaccaccttggctcggggttccagtgccagagcccaggggccaggtcggaaacgccgccagtcttctgactcttgcagtgaggagcctgacagcacgacaccgccagccaagtcccccaggggcggacctggatctggaggccatggccctctgcgctaccggagcagcagctccacagaacagagcctcatgatggggttgagggtggaggatggtgcccagcagtgcctcgactgtggcttgtgctttgcctcccctggctccctgagccgacaccgtttcatcagccacaagaagagacggggtgtgggtaaagccagtgccctggggctgggggatggggaggaagaggcccctccatcaaggtctgaccccgatggtggagactcacccctgcctgcttctggaggcccactgacctgtaaggtctgtggcaagagctgcgacagccctctaaacctcaagacccacttccgcacgcatggcatggcgttcatcagggctcggcagggggctgttggggacaactagtctccaaggcctgggactgaccagccccttcctcttggagcctggttttccctactgctgcctgatccctcggctggggagttttcattaacattaatattttgttaattcctgtctctccaacctgaagaagaagagcatttgaggattattctagttatttgcaacctccctttgggtttggccctggagtcctagtagagtggaccctccattcctcctttctgagcccaacactaattaattttatgctcctgctgcagaacccccagtgtgggcctgggggtgggaggatgggacttaggtatgcctgctagacaggttcagggaaggactgatgggggtgtcatggatggacacacctctccacaattccttcaggcatggactggaactttcctcctctaggccgggccctgccctagtgcccacccccgcccccgcccccgcccaaccccaactcactggcactcaagccccctacccctgcagtgcctttcacttctttttttccccagaaatccggggcgggggggtggggggttggtagggatgagtcctgtcaagggggccacaggagaggaggggacaggctctcaggaatcctttattcttgtagtaataataatactaacaaacagttggggaactagggagaaaaccagaccattaaaactgtttgtggtcgaatctccattcaggcctctctttttctgtgacttggacaatgtggagttgaagcgggtgagagaacatggaaggcccgcccttctcagggaagaggtggtagtgaccaagacaggcagggaaaaagcaaacttctatgtagtgccttttgtatcttggacactgaggcatccgttcatacctcatcacccatctccccctgcactcccccagaaaacctggaaatgacacaagtggctaactaaggactttatttcaaacaaaaattaaaaataaaaaattga

SEQ ID NO: 203479 - DNA, 893 bp, Homo sapiens
  Payload ID: 20124
  Gene Name: zinc finger protein 687
  ENST ID: ENST00000443959
  CDS Start-End: 453-893
gttacgctgtcgcccaggagctgaaccgcgcgaggaccccatccatcagattatatggcgatttagacggtgggaagaccgcaaggaaatggtcagcggatgacgtaatgtttggggtggcgtcccattctgtaacttctgtacggcatcagtgacacgggtttagcttgaaacagcgcaaaaggacctacacttctgtgctccactccgactcaatgcggttctgctctcagtgcccaccacacagaagctgggttccttacattcgcgaaagtgaactgcagcttcaagcttcgagcggccagtagggagcgaggggcggagacgcacctgggtgctcccccttccagtaggcaagctgggaagcaggctggcttctttctaagcgacagtggcggaggccaatcgtttacgagactcgtagatggggcagacggaccccggcgcagccaatggggagaggtctgggatctgccgatatgggggatatgaagacccctgattttgatgacctccttgctgcctttgacatccctgacattgatgcgaatgaagccatccattctgggccagaagaaaatgaggggcctggaggcccagggaagccagaaccaggtgtaggaagtgaatctgaagacacagcagcagcctctgctggggatggccctggagttccagcccaggcctctgaccatggcctgccaccgccagacatttctgtagtcagtgtcattgtcaagaacactgtgtgtcccgagcagtctgaggccctggctggaggctcagcaggagacggggcccaggctgctggggtaactaaagaagggcctgtggggcctcatcgaatgcagaatggttttgggagccctgaaccttccctcccaggaactccc

SEQ ID NO: 203480 - DNA, 3277 bp, Homo sapiens
  Payload ID: 20124
  Gene Name: zinc finger protein 687
  ENST ID: ENST00000426871
  CDS Start-End: 1-2120
gcactgtgctgcctgtggccaccatccagaacgccagtactgccatgctgatggcagccagtgtggctcgcaaggctgtggtgctgcctggggggactgccaccagccctaagatgattgctaagaacgtgctaggcctggtgccccaagccctgcctaaggctgacgggcgggcagggctggggactgggggacagaaggtgaatggtgcctcggtggtgatggtgcaaccttcaaagacagctactgggccaagtacagggggcggcacagtgatatcacggacccagtccagcctggtggaggccttcaacaagatcctcaacagcaagaacctgctccctgcctataggccaaacctgagcccaccagctgaggctgggctggccctgcctcccaccggctaccgctgcctggagtgtggggatgccttctcattggagaagagcctggcacggcactatgaccgtcggagcatgcgcatcgaggtcacctgcaaccactgcgcccgccgcctggtcttcttcaacaagtgcagcctgctcctgcatgcacgtgaacacaaggacaaggggctcgtcatgcagtgctcacatttggtcatgaggcctgtagcccttgaccagatggtggggcagccggacatcacaccgctgctgcctgtagctgtcccacctgtctctggacctctggccttgcctgccttgggcaagggtgagggggccatcacctcctctgccattactacagttgctgctgaggcccctgtcctgccgctctccacagagccgcctgctgccccggccacctctgcttacacatgctttcgctgcctggagtgcaaggaacagtgccgggacaaggctggcatggcagctcacttccagcagctcggcccccctgcccctggggccaccagcaatgtgtgcccaacctgccccatgatgctccccaatcgctgcagcttcagcgcccaccagcgcatgcataagaatcgacccccccatgtctgtcctgagtgtgggggcaacttcctgcaagccaattttcagacccatctccgggaggcctgtctgcacgtctctcgccgtgtaggatacaggtgccccagctgttcagtggtgtttgggggtgtgaactccatcaagtcccacatccagacgtcgcactgcgaggttttccacaagtgccccatctgccccatggccttcaagtctgggccaagtgcccatgcccacctctactcccagcatcccagcttccaaactcagcaggccaagctgatctacaagtgcgccatgtgcgacacagtcttcactcacaaacccctcctctcctcacacttcgaccagcacttgctgccccagcgtgtcagtgtctttaagtgcccgtcttgtcctctgctctttgcccaaaaaaggaccatgctggaacatctcaagaacacccatcagtctgggcgcttggaggagactgctgggaaaggggccgggggtgccctgctgacccccaagactgagcctgaggagctggctgtttctcagggaggggcagcccctgctactgaggagtcgtcttcatcttcagaagaggaggaagtacccagctcccctgagcccccccgtccagccaaacggcctcggcgggaactagggagcaaaggcctcaagggtgggggtggggggcctggaggctggacctgtggcctgtgtcactcctggttccctgagcgtgatgaatacgtggcccacatgaagaaggagcatggcaagtcagtgaaaaagttcccctgtcgcctgtgtgagcgctccttctgctccgcccccagcctgaggcgccatgtcagagttaatcacgagggcatcaagcgagtttacccctgcagaagcaagggccctggccttcgggctgtgccgctgctgccatcctgtcctctcccatttcaggtattgcacagagggaaaacgcaccttcagcagccgcctgatcctagagaaacatgtccaggtccggcacggcttgcagcttggggcccagtcccctggccgggggaccaccttggctcggggttccagtgccagagcccaggggccaggtcggaaacgccgccagtcttctgactcttgcagtgaggagcctgacagcacgacaccgccagccaagtcccccaggggcggacctggatctggaggccatggccctctgcgctaccggagcagcagctccacagaacagagcctcatgatggggttgagggtggaggatggtgcccagcagtgcctcgactgtggcttgtgctttgcctcccctggctccctgagccgacaccgtttcatcagccacaagaagagacggggtgtgggtaaagccagtgccctggggctgggggatggggaggaagaggcccctccatcaaggtctgaccccgatggtggagactcacccctgcctgcttctggaggcccactgacctgtaaggtctgtggcaagagctgcgacagccctctaaacctcaagacccacttccgcacgcatggcatggcgttcatcagggctcggcagggggctgttggggacaactagtctccaaggcctgggactgaccagccccttcctcttggagcctggttttccctactgctgcctgatccctcggctggggagttttcattaacattaatattttgttaattcctgtctctccaacctgaagaagaagagcatttgaggattattctagttatttgcaacctccctttgggtttggccctggagtcctagtagagtggaccctccattcctcctttctgagcccaacactaattaattttatgctcctgctgcagaacccccagtgtgggcctgggggtgggaggatgggacttaggtatgcctgctagacaggttcagggaaggactgatgggggtgtcatggatggacacacctctccacaattccttcaggcatggactggaactttcctcctctaggccgggccctgccctagtgcccacccccgcccccgcccccgcccaaccccaactcactggcactcaagccccctacccctgcagtgcctttcacttctttttttccccagaaatccggggcgggggggtggggggttggtagggatgagtcctgtcaagggggccacaggagaggaggggacaggctctcaggaatcctttattcttgtagtaataataatactaacaaacagttggggaactagggagaaaaccagaccattaaaactgtttgtggtcgaatctc

SEQ ID NO: 203481 - DNA, 4185 bp, Homo sapiens
  Payload ID: 20124
  Gene Name: zinc finger protein 687
  ENST ID: ENST00000449313
  CDS Start-End: 126-2483
cggagagaagcaggaagtagcggcggccgcggggagggcggcggtggctgcagcggctggagcggggtagagaccgccgggtctcggcccgcaccaggagcggaacaagtctgggatctgccgatatgggggatatgaagacccctgattttgatgacctccttgctgcctttgacatccctgacattgatgcgaatgaagccatccattctgggccagaagaaaatgaggggcctggaggcccagggaagccagaaccaggtgtaggaagtgaatctgaagacacagcagcagcctctgctggggatggccctggagttccagcccaggcctctgaccatggcctgccaccgccagacatttctgtagtcagtgtcattgtcaagaacactgtgtgtcccgagcagtctgaggccctggctggaggctcagcaggagacggggcccaggctgctggggtaactaaagaagggcctgtggggcctcatcgaatgcagaatggttttgggagccctgaaccttccctcccaggaactccccactctcctgctcctcccagtgggggcacctggaaagaaaaaggcatggaaggcaaaactcccttggacctgtttgctcattttggccctgagccaggggaccactcagatccgctgcctccctctgcaccctctcccactcgggagggggctctgaccccgcctcctttcccctcttcctttgagctggcccaggagaatggcccaggcatgcagccacctgtttcttccccaccattgggggccttgaagcaggagagctgcagcccccatcatccccaggtcctagcccaacaaggctcaggctccagccctaaggccacggacatccctgccagtgcctcgcctcccccagttgctggggtgcccttcttcaagcagtctccagggcaccagagccctcttgcctcccccaaagtgcccgtctgtcagcccttgaaggaagaagatgatgatgaggggccagtggacaagtcttccccaggaagtccccagagtccctctagtggggccgaggctgcagatgaggacagcaatgactcccctgcctccagctcctctaggcctcttaaggtgcggatcaagaccattaaaacatcctgcgggaatatcacaaggactgtaactcaggtcccctcagatcctgatccacctgcccccttggctgagggggccttcttggctgaggctagcctcttgaagctgtcccctgcaacacctacttctgagggtccaaaggtggtgagcgtacagttgggtgatggtacaaggctgaaaggcactgtgctgcctgtggccaccatccagaacgccagtactgccatgctgatggcagccagtgtggctcgcaaggctgtggtgctgcctggggggactgccaccagccctaagatgattgctaagaacgtgctaggcctggtgccccaagccctgcctaaggctgacgggcgggcagggctggggactgggggacagaaggtgaatggtgcctcggtggtgatggtgcaaccttcaaagacagctactgggccaagtacagggggcggcacagtgatatcacggacccagtccagcctggtggaggccttcaacaagatcctcaacagcaagaacctgctccctgcctataggccaaacctgagcccaccagctgaggctgggctggccctgcctcccaccggctaccgctgcctggagtgtggggatgccttctcattggagaagagcctggcacggcactatgaccgtcggagcatgcgcatcgaggtcacctgcaaccactgcgcccgccgcctggtcttcttcaacaagtgcagcctgctcctgcatgcacgtgaacacaaggacaaggggctcgtcatgcagtgctcacatttggtcatgaggcctgtagcccttgaccagatggtggggcagccggacatcacaccgctgctgcctgtagctgtcccacctgtctctggacctctggccttgcctgccttgggcaagggtgagggggccatcacctcctctgccattactacagttgctgctgaggcccctgtcctgccgctctccacagagccgcctgctgccccggccacctctgcttacacatgctttcgctgcctggagtgcaaggaacagtgccgggacaaggctggcatggcagctcacttccagcagctcggcccccctgcccctggggccaccagcaatgtgtgcccaacctgccccatgatgctccccaatcgctgcagcttcagcgcccaccagcgcatgcataagaatcgacccccccatgtctgtcctgagtgtgggggcaacttcctgcaagccaattttcagacccatctccgggaggcctgtctgcacgtctctcgccgtgtaggatacagaacacccatcagtctgggcgcttggaggagactgctgggaaaggggccgggggtgccctgctgacccccaagactgagcctgaggagctggctgtttctcagggaggggcagcccctgctactgaggagtcgtcttcatcttcagaagaggaggaagtacccagctcccctgagcccccccgtccagccaaacggcctcggcgggaactagggagcaaaggcctcaagggtgggggtggggggcctggaggctggacctgtggcctgtgtcactcctggttccctgagcgtgatgaatacgtggcccacatgaagaaggagcatggcaagtcagtgaaaaagttcccctgtcgcctgtgtgagcgctccttctgctccgcccccagcctgaggcgccatgtcagagttaatcacgagggcatcaagcgagtttacccctgcaggtattgcacagagggaaaacgcaccttcagcagccgcctgatcctagagaaacatgtccaggtccggcacggcttgcagcttggggcccagtcccctggccgggggaccaccttggctcggggttccagtgccagagcccaggggccaggtcggaaacgccgccagtcttctgactcttgcagtgaggagcctgacagcacgacaccgccagccaagtcccccaggggcggacctggatctggaggccatggccctctgcgctaccggagcagcagctccacagaacagagcctcatgatggggttgagggtggaggatggtgcccagcagtgcctcgactgtggcttgtgctttgcctcccctggctccctgagccgacaccgtttcatcagccacaagaagagacggggtgtgggtaaagccagtgccctggggctgggggatggggaggaagaggcccctccatcaaggtctgaccccgatggtggagactcacccctgcctgcttctggaggcccactgacctgtaaggtctgtggcaagagctgcgacagccctctaaacctcaagacccacttccgcacgcatggcatggcgttcatcagggctcggcagggggctgttggggacaactagtctccaaggcctgggactgaccagccccttcctcttggagcctggttttccctactgctgcctgatccctcggctggggagttttcattaacattaatattttgttaattcctgtctctccaacctgaagaagaagagcatttgaggattattctagttatttgcaacctccctttgggtttggccctggagtcctagtagagtggaccctccattcctcctttctgagcccaacactaattaattttatgctcctgctgcagaacccccagtgtgggcctgggggtgggaggatgggacttaggtatgcctgctagacaggttcagggaaggactgatgggggtgtcatggatggacacacctctccacaattccttcaggcatggactggaactttcctcctctaggccgggccctgccctagtgcccacccccgcccccgcccccgcccaaccccaactcactggcactcaagccccctacccctgcagtgcctttcacttctttttttccccagaaatccggggcgggggggtggggggttggtagggatgagtcctgtcaagggggccacaggagaggaggggacaggctctcaggaatcctttattcttgtagtaataataatactaacaaacagttggggaactagggagaaaaccagaccattaaaactgtttgtggt

SEQ ID NO: 203482 - DNA, 766 bp, Homo sapiens
  Payload ID: 20124
  Gene Name: zinc finger protein 687
  ENST ID: ENST00000436614
  CDS Start-End: 1-300
cgcaccttcagcagccgcctgatcctagagaaacatgtccaggtccggcacggcttgcagcttggggcccagtcccctggccgggggaccaccttggctcggggttccagtgccagagcccagtttcttccacttttcttcaggggccaggtcggaaacgccgccagtcttctgactcttgcagtgaggagcctgacagcacgacaccgccagccaagtcccccaggggcggacctggatctggaggccatggccctctgcgctaccggagcagcagctccacagaacagagcctcatgatggggttgagggtggaggatggtgcccagcagtgcctcgactgtggcttgtgctttgcctcccctggctccctgagccgacaccgtttcatcagccacaagaagagacggggtgtgggtaaagccagtgccctggggctgggggatggggaggaagaggcccctccatcaaggtctgaccccgatggtggagactcacccctgcctgcttctggaggcccactgacctgtaaggtctgtggcaagagctgcgacagccctctaaacctcaagacccacttccgcacgcatggcatggcgttcatcagggctcggcagggggctgttggggacaactagtctccaaggcctgggactgaccagccccttcctcttggagcctggttttccctactgctgcctgatccctcggctggggagttttcattaacattaatattttgttaattcctgtctctccaacctga

SEQ ID NO: 203483 - DNA, 2506 bp, Homo sapiens
  Payload ID: 20125
  Gene Name: zinc finger protein 688
  Uniprot ID: P0C7X2
  ENST ID: ENST00000223459
  CDS Start-End: 1106-1936
gccaagcattgggtgtgcgcctgtggtcccagctactcgggaggctgaggtgagaagatcgcttcagcccgggaggtcgagtctgcagtgagctaggatcgcactgctgggccacagagcaagaccctgtctcaaaacaaacaaaaaataaattcatgtatgttagcaacaattactatttaatttaaaacttccccattccgattccatcctcaccaagcacgttccttcgcctgcagcttcggtctagagcctgagcgagccgagctgcggatgccaggggctgggtggactccgcagctaagctactgtaaaacacgcacctgcttctaccgcgggtgtacacatggtttgccagggtgtgcgcgtcttcccaaggggtctggggaccaaattccagctcccgccatcgggaggcacggtaagagaccgtaggggacacaatcccgagcaccgcagatgccgaggtctccgctgcgctccagtctgtcaacagaggcttcaggaccgcggggtcccttcaaatgccccgccagtcccaggccaatcaccgcgcagcttcttccgggatcgtcgccaatcatcggccgttgcgtattgcgggtacagaggggtaagtgaagcttcgggcccttacatctttcttgaaggcaagaagcctctcctctacttcccagacaccccgcctcccccactagaaaaagcagccgaagcggctttatttaagggcaagtgggacgatgaggccagagaagtcagaaaggctccatatttgatatggtcaaataatggcgcccttaagagcagcctgtgacaattgaagggtggtcgccatattttcagaaggcaccttccgggtcccttaacccgggtgtctatgtccaagcggccatgaagtgaataaacactgaggaattatatttgtccctatcagaatcctcgaatccctagcagccagtccctgctacttcggttgcctcggctgcgttcggacgccacggctgggcggggccgcccttcctgtggacaacgacagctgaggccgggagcggggaggcggcggctccagggacctggcggccgccgatcggggctgcgaggccccatggcgccgcccccagccccgctcctggcgccgaggcccggggagacccggcctggttgcaggaagcccgggactgtgagcttcgcggacgtggccgtgtacttctccccggaggagtggggctgtctgcggcccgcgcagagggctctgtaccgggacgtgatgcaggagacctacggccacctgggcgcgctcggattcccaggccccaaaccagccctcatctcttggatggaacaggagagtgaggcttggagccccgccgcccaggatcctgagaagggggaaagactgggaggagctcggagaggagatgtcccaaacaggaaggaagaggaaccggaggaagtcccaagagccaaagggcctagaaaggctcctgtgaaggagagtcctgaagtgctggtggaacgcaaccctgacccagctattagcgtggccccggcacgggcacagccacccaaaaatgctgcctgggacccgaccacaggagcacagcccccggcacccatacccagcatggatgctcaggccggccagcggcgccacgtgtgcacggactgcggccgccgcttcacctacccctcactgctggtcagccacaggcgcatgcactcgggggagcggcctttcccctgccccgagtgtggcatgcgcttcaagaggaagttcgcagtggaagcgcaccagtggatccaccgctcctgctccggggggcggcggggccggaggcctgggatccgggctgtgcctcgggcccccgtccgaggtgaccgggacccgcctgtgctcttccggcactacccagacatcttcgaggagtgcggctgagcggcaccgcaggctggagttgagcctgaccttggcacgaaggactgacggatccctgaggtgggccactgagtcggggactccggaactgaaattcatgccctgggctttcctcaaggatccctcaagtttccaacttgtaaaaagaaaagtgcctgtaaagattcgaatagattagacttgccacccatctccccagtcttttgtttaacaaaaaaaaaaaaaaaaaaaaaaaaaaagaagagagtgagaccctggactcatttcaaagtgttatctgaagatcaggtgcaacagagacctttatatcatctcaggaactagccactccttatctatttcagatgcagatgctgagggggaccagggcctggggaggggacctacatggagggcgtggtcaaaccctggctaattgtcatcagcaggggacccagacactggagtggatgggagtagaatagatgcaggtggcacaaatccagcctctgttgggagaccaaggagggaggatcgtttgagtccaggagttcagaccagcctgagcaacaggctatctagcgatatcta

SEQ ID NO: 203484 - DNA, 1492 bp, Homo sapiens
  Payload ID: 20125
  Gene Name: zinc finger protein 688
  Uniprot ID: P0C7X2
  ENST ID: ENST00000563276
  CDS Start-End: 460-1248
gccaagcattgggtgtgcgcctgtggtcccagctactcgggaggctgaggtgagaagatcgcttcagcccgggaggtcgagtctgcagtgagctaggatcgcactgctgggccacagagcaagaccctgtctcaaaacaaacaaaaaataaattcatgtatgttagcaacaattactatttaatttaaaacttccccattccgattccatcctcaccaagcacgttccttcgcctgcagcttcggtctagagcctgagcgagccgagctgcggatgccaggggctgggtggactccgcagctaagctactgtaaaacacgcacctgcttctaccgcgggtgtacacatggtttgccagggtgtgcgcgtcttcccaaggggtctggggaccaaattccagctcccgccatcgggaggcacggtaagagaccgtaggggacacaatcccgagcaccgcagatgccgaggtctccgctgcgctccagtctgtcaacagaggcttcaggaccgcggggtcccttcaaatgccccgccagtcccaggccaatcaccgcgcagcttcttccgggatcgtcgccaatcatcggccgttgcgtattgcgggtacagaggggattcccaggccccaaaccagccctcatctcttggatggaacaggagagtgaggcttggagccccgccgcccaggatcctgagaagggggaaagactgggaggagctcggagaggagatgtcccaaacaggaaggaagaggaaccggaggaagtcccaagagccaaagggcctagaaaggctcctgtgaaggagagtcctgaagtgctggtggaacgcaaccctgacccagctattagcgtggccccggcacgggcacagccacccaaaaatgctgcctgggacccgaccacaggagcacagcccccggcacccatacccagcatggatgctcaggccggccagcggcgccacgtgtgcacggactgcggccgccgcttcacctacccctcactgctggtcagccacaggcgcatgcactcgggggagcggcctttcccctgccccgagtgtggcatgcgcttcaagaggaagttcgcagtggaagcgcaccagtggatccaccgctcctgctccggggggcggcggggccggaggcctgggatccgggctgtgcctcgggcccccgtccgaggtgaccgggacccgcctgtgctcttccggcactacccagacatcttcgaggagtgcggctgagcggcaccgcaggctggagttgagcctgaccttggcacgaaggactgacggatccctgaggtgggccactgagtcggggactccggaactgaaattcatgccctgggctttcctcaaggatccctcaagtttccaacttgtaaaaagaaaagtgcctgtaaagattcgaatagattagacttgccacccatctccccagtcttttgtttaacaaaaaaaaaaaaaaaaaaaaaaaaaaagaaga

SEQ ID NO: 203485 - DNA, 427 bp, Homo sapiens
  Payload ID: 20125
  Gene Name: zinc finger protein 688
  ENST ID: ENST00000566632
  CDS Start-End: 1-427
cagccacctcccgttcccagggcttcaggtaccccctcgggagtgttttcacccgcatccatttcattcaggcagcagcactgcagccccttccaggattcccaggccccaaaccagccctcatctcttggatggaacaggagagtgaggcttggagccccgccgcccaggatcctgagaagggggaaagactgggaggagctcggagaggagatgtcccaaacaggaaggaagaggaaccggaggaagtcccaagagccaaagggcctagaaaggctcctgtgaaggagagtcctgaagtgctggtggaacgcaaccctgacccagctattagcgtggccccggcacgggcacagccacccaaaaatgctgcctgggacccgaccacaggagcacagcccccggcacccatacccagcatggatgc

SEQ ID NO: 203486 - DNA, 244 bp, Homo sapiens
  Payload ID: 20125
  Gene Name: zinc finger protein 688
  ENST ID: ENST00000563707
  CDS Start-End: 7-225
ggccccatggcgccgcccccagccccgctcctggcgccgaggcccggggagacccggcctggttgcaggaagcccgggactgtgagcttcgcggacgtggccgtgtacttctccccggaggagtggggctgtctgcggcccgcgcagagggctctgtaccgggacgtgatgcaggagacctacggccacctgggcgcgctcggcccccacttccagcatccctaaagaaattcaactgtgttgg

SEQ ID NO: 203487 - DNA, 540 bp, Homo sapiens
  Payload ID: 20125
  Gene Name: zinc finger protein 688
  ENST ID: ENST00000567855
  CDS Start-End: 24-356
gccgatcggggctgcgaggccccatggcgccgcccccagccccgctcctggcgccgaggcccggggagacccggcctggttgcaggaagcccgggactgtgagcttcgcggacgtggccgtgtacttctccccggaggagtggggctgtctgcggcccgcgcagagggctctgtaccgggacgtgatgcaggagacctacggccacctgggcgcgctcggattcccaggccccaaaccagccctcatctcttggatggaacaggagagtgaggcttggagccccgccgcccaggatcctgagaagggggaaagactgggaggagctcggagaggcccccacttccagcatccctaaagaaattcaactgtgttgggtactagaggagtaaagaaggcagacctggtacaaagttttcagaacatgggacagcggtcctgtgaggactgggagcccagtccaaccaggcactccagcctgggtgacagagtgagactccgtctcaaaaataaataaataaataaataaataaataaataaa

SEQ ID NO: 203488 - DNA, 3547 bp, Homo sapiens
  Payload ID: 20126
  Gene Name: zinc finger protein 689
  Uniprot ID: Q96CS4
  ENST ID: ENST00000287461
  CDS Start-End: 339-1841
ttgagggcaaagaggttaggaagccggcatggcgctccggtcaataaaatcgatagctggaagctgcctgtgttccaggcaaaggcggtgcggtagcagcgccgccattttccccgaaggcatcttccggtgcctttcacccaagttcgggcaggagtttcctgaataacagcaaaaggtttccgttagccccgcgggcgaccaattccgattccctccgggcctccccggccacgctcagccctggtccggcaggggctcctcgatcccaggggccgccagcgcccgagggccgaggcctggacacggaaggccgtggcgccggcttctcgggtcccatggcgccaccttcggctccgctccctgcgcagggaccaggaaaggccagacccagtcggaaaaggggcaggaggccgagggctctgaagttcgtggacgtggccgtgtacttctccccggaggagtggggctgcctgcggcccgcgcagagggccctgtaccgggacgtgatgcgggagacctacggtcacctgggcgcgctcgggtgcgcaggtcccaaaccagccctcatctcctggttggaacgaaacaccgatgactgggaaccggctgctctagatccgcaggagtacccgagagggctaacagtccagagaaaaagcagaaccagaaagaagaatggggagaaggaagtattcccgcctaaggaggcaccccgaaaggggaagcgaggccggaggcccagcaaaccccgactgattcctaggcagacgtccgggggccccatctgccctgactgcggctgtaccttccctgatcatcaggccctggagagccacaagtgcgcccagaatctaaaaaagccttacccttgcccagactgtgggcgccgcttttcctatccatccctgctggtcagtcaccggcgggcacactccggcgagtgcccctatgtttgtgaccagtgtggcaaacgtttctcccagcgcaagaacctctcccagcaccaggtcatccatacaggggagaagccctatcactgccctgactgtggtcgctgcttccggaggagccggtccttggccaatcaccggaccacacacacaggtgaaaaaccccaccagtgccctagctgtggacgtcgcttcgcctacccctccctgctagccatccaccagcgtacacacacgggagagaagccctacacttgcctcgagtgcaaccgccgcttccgccagcgcacggccctcgtcatccaccagcgcatccacacgggcgagaagccctacccgtgcccggactgcgagcggcgcttctcctcctcctctcgcctggtcagtcaccggcgtgtgcactctggggagcgtccctatgcctgcgagcactgtgaggcccgcttctcccagcgcagcacgctgctccagcaccagctcttgcacaccggagagaagccctacccctgcccagactgtgggcgtgccttccggcggagcggctccctggccatccatcgcagcacgcacacagaggagaagctgcacgcctgcgacgactgtggtcgccgctttgcctacccctcactgctggccagccaccggcgcgtgcactcgggcgagcggccctatgcctgcgacctttgctccaagcgttttgctcagtggagccacctggcccagcaccagctgctgcacacgggggagaagcctttcccctgcctcgagtgtggccggtgcttccgccagaggtggtctctggctgtccacaagtgtagccccaaggccccaaactgtagccctagatctgctatcgggggctccagtcagaggggcaacgcccattagaaggggaaggactgcctacgttcatttcattttatggagggtcccagaaaagggaaggaggagccccaggtcatacagggcagagtcagaactaaacccgggtctcctgctgcacagagctgaactttgtatcttgcaatgcgctggctgcctccctgtgcgtgtctggaacagtcccattaggagaggtgacgtcatttgcttaaagttttccaagctaccctatcctaaaatagtttgtgtggatatcagggctaaaagttctccccatctattttaggggctgtctgcttttctagtctgtccacacagggattacctgtcatcttgcatgcaatcaggagaatctcataggggcaggaccttcccctactctgcctcttcctccatactaggttggaaaaatctggtttagcccactttttgcaacactcctgccaagtggtcttctacccattgcttgaaaatctctcttgacagggagctcactacctcacaaggcaggtcatttcattgtgggatctatagaaggttaagtaccacattctcctctaaaccttgcctacgacatgtttaatacttcatctacatagcagcccttcagataatcacaaccactttgcccccaagttttcaggttaagtagcatgaatttggtcattccttaaagacagggtttcaatttccacacatgatctctgcaaacaggcactgggttttcagtgtcctttttgaagggtcatataaaaataaggtaacaccacagtgccactacaccttctggggctggacttgtttcagcagctttggttgcactgaatttgggggagctgcatggtaccaggggtttattgggttgcagatatataaatgccctaaacttaaaaaaaaaaaaaaaagctataaaactaagtcttcatcttgtatttggaaaattggttcaagctgggtatgagacataagtgtagtcagctctgggagaaggttgctcttaaggagaagcagggacctgtggtttagcagcaggaagtgcaaatgggactggcttgtgctctacctggcagacctggattggcttcaggcagccagtgcctggaaaagcctggagaattgggccgtacttgaccctgattctcatcaggcacagatgaatcacaggcacctaagaatcggcacagaacttccatgaggcctcagtcagcattttttcacaaaatgagctgaggccattcaaggaggctagaaagagggaactgaatccagagaggaagagtctatagtcatcaagttgtatccatgccagcctccctccacagaggtggcagcagcgtggctcaatctgatccacctccatggcacccactgggtaggtgcttcataaagctttaccgagttaaatgtgaacaaggcctaccactttgccttgggcagctgcaccaaattagaatttccagatgtgactcatctcatattccaacagctggagtgggtcatcctttacccctgtggctccttcctacagctctcctgatctcagcacaagcaggggagcagctgggggaacacagctttatgtaattacctctgttcaatatttagcaagttgcattgtaacattgtaactgtttgtttctccttggatgatgagctacccccaagaaggggtcatatcagattgggtctcattaaaatgtctgatgaatgaa

SEQ ID NO: 203489 - DNA, 2713 bp, Homo sapiens
  Payload ID: 20126
  Gene Name: zinc finger protein 689
  ENST ID: ENST00000611647
  CDS Start-End: 334-1830
ggcaaagaggttaggaagccggcatggcgctccggtcaataaaatcgatagctggaagctgcctgtgttccaggcaaaggcggtgcggtagcagcgccgccattttccccgaaggcatcttccggtgcctttcacccaagttcgggcaggagtttcctgaataacagcaaaaggtttccgttagccccgcgggcgaccaattccgattccctccgggcctccccggccacgctcagccctggtccggcaggggctcctcgatcccaggggccgccagcgcccgagggccgaggcctggacacggaaggccgtggcgccggcttctcgggtcccatggcgccaccttcggctccgctccctgcgcagggaccaggaaaggccagacccagtcggaaaaggggcaggaggccgagggctctgaagttcgtggacgtggccgtgtacttctccccggaggagtggggctgcctgcggcccgcgcagagggccctgtaccgggacgtgatgcgggagacctacggtcacctgggcgcgctcgggtgcgcaggtcccaaaccagccctcatctcctggttggaacgaaacaccgatgactgggaaccggctgctctagatccgcaggagtacccgagagggctaacagtccagagaaaaagcagaaccagaaagaagaatggggagaaggaagtattcccgcctaaggaggcaccccgaaaggggaagcgaggccggaggcccagcaaaccccgactgattcctaggcagacgtccgggggccccatctgccctgactgcggctgtaccttccctgatcatcaggccctggagagccacaagtgcgcccagaatctaaaaaagccttacccttgcccagactgtgggcgccgcttttcctatccatccctgctggtcagtcaccggcgggcacactccggcgagtgcccctatgtttgtgaccagtgtggcaaacgtttctcccagcgcaagaacctctcccagcaccaggtcatccatacaggggagaagccctatcactgccctgactgtggtcgctgcttccggaggagccggtccttggccaatcaccggaccacacacacaggtgaaaaaccccaccagtgccctagctgtggacgtcgcttcgcctacccctccctgctagccatccaccagcgtacacacacgggagagaagccctacacttgcctcgagtgcaaccgccgcttccgccagcgcacggccctcgtcatccaccagcgcatccacacgggcgagaagccctacccgtgcccggactgcgagcggcgcttctcctcctcctctcgcctggtcagtcaccggcgtgtgcactctggggagcgtccctatgcctgcgagcactgtgaggcccgcttctcccagcgcagcacgctgctccagcaccagctcttgcacaccggagagaagccctacccctgcccagactgtgggcgtgccttccggcggagcggctccctggccatccatcgcagcacgcacacagaggagaagctgcacgcctgcgacgactgtggtcgccgctttgcctacccctcactgctggccagccaccggcgcgtgcactcgggcgagcggccctatgcctgcgacctttgctccaagcgttttgctcagtggagccacctggcccagcaccagctgctgcacacgggggagaagcctttcccctgcctcgagccggtgcttccgccagaggtggtctctgctgtccacaagtgtagccccaaggccccaaactgtagccctagatctgctatcgggggctccagtcagaggggcaacgcccattagaaggggaaggactgcctacgttcatttcattttatggagggtcccagaaaagggaaggaggagccccaggtcatacagggcagagtcagaactaaacccgggtctcctgctgcacagagctgaactttgtatcttgcaatgcgctggctgcctccctgtgcgtgtctggaacagtcccattaggagaggtgacgtcatttgcttaaagttttccaagctaccctatcctaaaatagtttgtgtggatatcagggctaaaagttctccccatctattttaggggctgtctgcttttctagtctgtccacacagggattacctgtcatcttgcatgcaatcaggagaatctcataggggcaggaccttcccctactctgcctcttcctccatactaggttggaaaaatctggtttagcccactttttgcaacactcctgccaagtggtcttctacccattgcttgaaaatctctcttgacagggagctcactacctcacaaggcaggtcatttcattgtgggatctatagaaggttaagtaccacattctcctctaaaccttgcctacgacatgtttaatacttcatctacatagcagcccttcagataatcacaaccactttgcccccaagttttcaggttaagtagcatgaatttggtcattccttaaagacagggtttcaatttccacacatgatctctgcaaacaggcactgggttttcagtgtcctttttgaagggtcatataaaaataaggtaacaccacagtgccactacaccttctggggctggacttgtttcagcagctttggttgcactgaatttgggggagctgcatggtaccaggggtttattgggttgcagatatataaatgccctaaactt

SEQ ID NO: 203490 - DNA, 1438 bp, Homo sapiens
  Payload ID: 20127
  Gene Name: zinc finger protein 69
  Uniprot ID: Q9UC07
  ENST ID: ENST00000340180
  CDS Start-End: 70-519
ccggtctttccagccccgagagggacctggttcctctgcccaggcttctgtcactctgtcacctacgctatgccctgctgtagtcacaggaggtgtagagaggaccccgggacatctgaaagccaggaaatggaggagtgggctttgctggatatttcccagaggaaactctacaaggaagtgatgctggaaactttcaggaacctgacctctgtaggaaaaagttggaaagaccagaacattgaatatgagtaccaaaaccccaggagaaacttcaggagtctcatagaaaagaaagtcaatgaaattaaagatgacagtcattgtggagaaacttttacccaggttccagatgacaggctgaacttccaggagaagaaagcttctcctgaaataaaatcatgtgacagctttgtgtgtggagaagttggcctaggtaactcatcttttaatatgaacatcagaggtgacattggacacaaggcctatgagtatcaggaatatggaccgaagccataaaaaaatctcactctgtcacccaggctggagtgcagtggcatgatctcaggtcgctgcaacctctgcctccagggttcaagcaactctcctgcttcagcctcctgagtagctgggactacaggcatgcaccaccacgccaggctaattttttgtattttttagtagagacagggtttcaccatattggccaggctggtcttgaactccagacctcatgattcgcctgcctcggcctcccaaaatgctgggattacagatatgagccatcatgcccagccgcaaccctaatttttcattcagtcataataccaacagttatctcatgtacctctgagtgccttcttcccaaaagccagcagtaccatacctgctgtcagcaagtgtgtaatataccatagtgataaatatgaccaaaagccataaatgactgtgagatgtatgagaatgacacgtcacattagtaagaagagaaaaattttggccatgtttatgatttgaaatatgttttcctctatcacatttagaaatatagttacaaaatgcccttagttttatcctgattcatcatggtcactgaggagcatcgtctcatatgcctggtatgtgacatgtgtctcttcaacagtaaaagacttggcattggctgggcatggtggctcacgcctgtaatcccagcactttgggaggccgaggtcaggagttagagaccattctgaccaatatgatcaaaccccgtctctactaaaaatacaaaaattagcggggtgtggtggcatgctcctgtaatcctagctattcaggaggctgacgcaggagacttgcttgaatataggaggcagacgttgcagtgagccgaggtcacaccattcactccagcctgggcaacaagagcgaaactccgtttcaaaaaaaaaaaaaa

SEQ ID NO: 203491 - DNA, 569 bp, Homo sapiens
  Payload ID: 20127
  Gene Name: zinc finger protein 69
  ENST ID: ENST00000445911
  CDS Start-End: 107-569
acctcacctttgtccctgcgcgggctgcggctgggatccggtctttccagccccgagagggacctggttcctctgcccaggcttctgtcactctgtcacctacgctatgccctgctgtagtcacaggaggtgtagagaggaccccgggacatctgaaagccaggaaatggaggagtgggctttgctggatatttcccagaggaaactctacaaggaagtgatgctggaaactttcaggaacctgacctctgtaggaaaaagttggaaagaccagaacattgaatatgagtaccaaaaccccaggagaaacttcaggagtctcatagaaaagaaagtcaatgaaattaaagatgacagtcattgtggagaaacttttacccaggttccagatgacaggctgaacttccaggagaagaaagcttctcctgaaataaaatcatgtgacagctttgtgtgtggagaagttggcctaggtaactcatcttttaatatgaacatcagaggtgacattggacacaaggcctatgagtatcaggaatatggaccgaagccatgtaagtgtcaacaac

SEQ ID NO: 203492 - DNA, 2010 bp, Homo sapiens
  Payload ID: 20127
  Gene Name: zinc finger protein 69
  Uniprot ID: Q9UC07
  ENST ID: ENST00000429654
  CDS Start-End: 141-1841
tgttcctccagacactgagggggtcgcattccttacctcacctttgtccctgcgcgggctgcggctgggatccggtctttccagccccgagagggacctggttcctctgcccaggcttctgtcactctgtcacctacgctatgccctgctgtagtcacaggaggtgtagagaggaccccgggacatctgaaagccaggaaatggacccagtggcctttgatgatgttgctgtgaacttcacccaggaggagtgggctttgctggatatttcccagaggaaactctacaaggaagtgatgctggaaactttcaggaacctgacctctgtaggaaaaagttggaaagaccagaacattgaatatgagtaccaaaaccccaggagaaacttcaggagtctcatagaaaagaaagtcaatgaaattaaagatgacagtcattgtggagaaacttttacccaggttccagatgacaggctgaacttccaggagaagaaagcttctcctgaaataaaatcatgtgacagctttgtgtgtggagaagttggcctaggtaactcatcttttaatatgaacatcagaggtgacattggacacaaggcctatgagtatcaggaatatggaccgaagccatgtaagtgtcaacaacctaaaaaagccttcagatatcacccctcctttagaacaccacaaagggatcacactggagagaaaccctatgcttgtaaagaatgtggaaaaacttttatttcccattcaagcattcaaagacacgtggtaatgcacagtggggatggaccttataaatgtaaattttgtgggaaagccttccattgtctcagtttatatcttatccatgaaagaattcacactggagagaaaccatatgaatgtaaacaatgtggtaaatcctttagttattctgctacccttcgaatacacgaaagaactcacactggagaaaagccttatgaatgtcagcaatgtgggaaagcatttcatagtcccagatgctatcgtagacatgaaaggattcacacgggagagaaggcttatcaatgtaaggaatgtggaaaagcattcacgtgtccccagtatgttcgtatacatgaaaggacccactctaggaaaaaaccctatgaatgtacgcagtgtgggaaagcattatcctctcttacaagttttcaaacacacataagaatgcactctggagaaagaccttatgaatgtaagatatgtgggaaaggcttttgttctgccaattcatttcaaagacatgaaaaaactcacagtggagagaaaccctataaatgcaagcaatgtggtaaagccttcattcattccagttcccttcgttatcatgaaaggattcacactggagagaaaccctatgagtgtaagcaatgtgggaaggccttcagatcttcctcacaccttcaattgcatggtaggactcacactggagagaagccctatgaatgtcaggaatgtgggaaagccttcagatctatgaagaaccttcaaagtcatgaaaggacacaaacacacgtaagaatacactctggagaaagaccttataaatgtaagctatgtgggaaaggcttttattgtcccaaatcattgcaaagacatgaaaaaactcacactggagagaaactctatgaatgcaagcaatgtggtgaagccttcagtagttccagttcctttcgataccatgaaaggactcacactggagagaaaccctataaatgcaagcaatgtgggaaagccttcagagctgcctcagtccttcgaatgcatggtaggactcaccctgaagataaaccctatgagtgtaagcaatgagggaaagccttcagatctgcctcacacctttgaatgcatggtaggacacacaatcaagagaaaccatgaatgtaaagaatgtgggaaacccttcaggtctgcccagaaccttcgaattcagtaaaggacacaagcacacataagaatgcattctggatagctgaacaaa

SEQ ID NO: 203493 - DNA, 1910 bp, Homo sapiens
  Payload ID: 20128
  Gene Name: zinc finger protein 691
  Uniprot ID: Q5VV52
  ENST ID: ENST00000372502
  CDS Start-End: 303-1250
atccttcctgggttccggctccggctccagctccttccctcgcctacagaggcggcgctgtccctgatcgagcggcgggagcgagggcctggacgtagtgtcttcaacagttgtaacagcagctgccatttgctgaatgacagcatgtgtcacacactctgctgagtattacaggcatttttttctaatacaaagtcttgtagtgtggaaatacttgcagacttgaaggaattatcagtctttcattttctatcatcagtgtcctatgatagtttgtgcttccctccctcatccctttgttcatgtcactctgttcaccaacccactctgctgaaatgtcgttatttcttcaaggcccggaggaaatgctaccactctcatcagagggttcagagatgggcagtgagaaggagcagagtccagaaccacacctgcctgaggaaggggaagggggtaagccttggagagtggatgactcagagggttcttggatcccacctggggagaaggagcatgggcaagagagcctgtcggatgaactgcaagaaactcatccaaaaaagccatggcagaaagtcactgtccgggctcgagagctaggggaccccattgctcatccaaggcatgaggcagatgagaagccctttatatgtgcccagtgtggcaaaaccttcaataatacctccaacctgagaacacaccagcggatccacactggtgagaagccttacaagtgttctgaatgtggcaagagcttctcgagaagctccaaccgcatccggcacgagcggatccacctggaagagaaacactacaaatgccccaagtgccaggagagctttcggcggcgctcagacctcaccacgcaccagcaagatcacctaggcaagcggccataccgctgtgacatctgtggcaagagcttcagccagagtgccacgctagctgtgcatcaccggacccacctggagccagcaccctacatctgctgtgagtgtgggaagagcttcagcaacagctccagctttggcgtgcatcaccgcacccacacaggtgagagaccttatgagtgcactgagtgtgggcggaccttcagcgatatctccaactttggagcacaccagcggacccacagaggggagaagccctaccggtgcactgtgtgtgggaaacacttctcccggagctcgaatctcatccgccaccagaaaactcacttgggcgaacaggctgggaaagattccagctgaaggagagccccatttagagtgagggagagagagtgagagaccctaacctattggaggaagatcttcagcatcttttgctgctaccttgacctcaagcccttcatcccactttggagaatggttttgtatagcctctgaagtcaggatctcaggaagtcctgaggagggactctggaataaaaacccttgcctctttccaggccaatttctcgtgttggaaagtcagaagacccagtcttggctttactttcttggggtgaaagagaaatagggtaggctcagaacatgctcatgttattaaggcagcagtccccctggcctttgaggaagtacttatgagatgggtgtcactgtctgaaggttctccaaattgtctgtgaactgcttaggtaggagtgcactgcagtttcctgctagttcccacctgttgtgccccaactttgcttctagatctctggggtgggaggagtgaccttctcaatggaaggggcctccttggtctggagaagagatctgaggtcccaccttagaaatgaaagggaaaccctcagggagccatgacccagggaccttcacactcccccatgtttgttacttgttatccctcccccaacctgcctctgttttccccagagtgattagcagtaaaacccttcaatg

SEQ ID NO: 203494 - DNA, 993 bp, Homo sapiens
  Payload ID: 20128
  Gene Name: zinc finger protein 691
  ENST ID: ENST00000372503
  CDS Start-End: 105-993
ttttttccagaaatacttgcagacttgaaggaattatcagtctttcattttctatcatcagtgtcctatgatagtttgtgcttccctccctcatccctttgttcatgtcactctgttcaccaacccactctgctgaaatgtcgttatttcttcaaggcccggaggaaatgctaccactctcatcagagggttcagagatgggcagtgagaaggagcagagtccagaaccacacctgcctgaggaaggggaagggggtaagccttggagagtggatgactcagagggttcttggatcccacctggggagaaggagcatgggcaagagagcctgtcggatgaactgcaagaaactcatccaaaaaagccatggcagaaagtcactgtccgggctcgagagctaggggaccccattgctcatccaaggcatgaggcagatgagaagccctttatatgtgcccagtgtggcaaaaccttcaataatacctccaacctgagaacacaccagcggatccacactggtgagaagccttacaagtgttctgaatgtggcaagagcttctcgagaagctccaaccgcatccggcacgagcggatccacctggaagagaaacactacaaatgccccaagtgccaggagagctttcggcggcgctcagacctcaccacgcaccagcaagatcacctaggcaagcggccataccgctgtgacatctgtggcaagagcttcagccagagtgccacgctagctgtgcatcaccggacccacctggagccagcaccctacatctgctgtgagtgtgggaagagcttcagcaacagctccagctttggcgtgcatcaccgcacccacacaggtgagagaccttatgagtgcactgagtgtgggcggaccttcagcgatatctccaactttggagcacaccagcggacccacagaggggagaagccctaccggtgcactgtgtgtgggaaacacttctcccggagctcga

SEQ ID NO: 203495 - DNA, 1935 bp, Homo sapiens
  Payload ID: 20128
  Gene Name: zinc finger protein 691
  ENST ID: ENST00000372504
  CDS Start-End: 351-1271
tgatcgagcggcgggagcgagggcctggacgtagtgtcttcaacagttgtaacagcagctgccatttgctgaatgacagcatgtgtcacacactctgctgagtattacaggcatttttttctaatacaaagtcttgtagtgtggaaatacttgcagacttgaaggaattatcagtctttcattttctatcatcagtgtcctatgatagtttgtgcttccctccctcatccctttgttcatgtcactctgttcaccaacccactctgctgaaatgtcgttatttcttcaaggcccggaggaaatgctaccactctcatcagagtggtttcaagaagagtgacattattcaaatggcacaaatatcatctggtggtggtggacaaagccggtgccttctttttgctctgggttcagagatgggcagtgagaaggagcagagtccagaaccacacctgcctgaggaaggggaagggggtaagccttggagagtggatgactcagagggttcttggatcccacctggggagaaggagcatgggcaagagagcctgtcggatgaactgcaagaaactcatccaaaaaagccatggcagaaagtcactgtccgggctcgagagctaggggaccccattgctcatccaaggcatgaggcagatgagaagccctttatatgtgcccagtgtggcaaaaccttcaataatacctccaacctgagaacacaccagcggatccacactggtgagaagccttacaagtgttctgaatgtggcaagagcttctcgagaagctccaaccgcatccggcacgagcggatccacctggaagagaaacactacaaatgccccaagtgccaggagagctttcggcggcgctcagacctcaccacgcaccagcaagatcacctaggcaagcggccataccgctgtgacatctgtggcaagagcttcagccagagtgccacgctagctgtgcatcaccggacccacctggagccagcaccctacatctgctgtgagtgtgggaagagcttcagcaacagctccagctttggcgtgcatcaccgcacccacacaggtgagagaccttatgagtgcactgagtgtgggcggaccttcagcgatatctccaactttggagcacaccagcggacccacagaggggagaagccctaccggtgcactgtgtgtgggaaacacttctcccggagctcgaatctcatccgccaccagaaaactcacttgggcgaacaggctgggaaagattccagctgaaggagagccccatttagagtgagggagagagagtgagagaccctaacctattggaggaagatcttcagcatcttttgctgctaccttgacctcaagcccttcatcccactttggagaatggttttgtatagcctctgaagtcaggatctcaggaagtcctgaggagggactctggaataaaaacccttgcctctttccaggccaatttctcgtgttggaaagtcagaagacccagtcttggctttactttcttggggtgaaagagaaatagggtaggctcagaacatgctcatgttattaaggcagcagtccccctggcctttgaggaagtacttatgagatgggtgtcactgtctgaaggttctccaaattgtctgtgaactgcttaggtaggagtgcactgcagtttcctgctagttcccacctgttgtgccccaactttgcttctagatctctggggtgggaggagtgaccttctcaatggaaggggcctccttggtctggagaagagatctgaggtcccaccttagaaatgaaagggaaaccctcagggagccatgacccagggaccttcacactcccccatgtttgttacttgttatccctcccccaacctgcctctgttttccccagagtgattagcagtaaaacccttcaatgaaaa

SEQ ID NO: 203496 - DNA, 1859 bp, Homo sapiens
  Payload ID: 20128
  Gene Name: zinc finger protein 691
  Uniprot ID: Q5VV52
  ENST ID: ENST00000372506
  CDS Start-End: 341-1195
cgctgtccctgatcgagcggcgggagcgagggcctggacgtagtgtcttcaacagttgtaacagcagctgccatttgctgaatgacagcatgtgtcacacactctgctgagtattacaggcatttttttctaatacaaagtcttgtagtgtggaaatacttgcagacttgaaggaattatcagtctttcattttctatcatcagtgtcctatgatagtttgtgcttccctccctcatccctttgttcatgtcactctgttcaccaacccactctgctgaaatgtcgttatttcttcaaggcccggaggaaatgctaccactctcatcagagggttcagagatgggcagtgagaaggagcagagtccagaaccacacctgcctgaggaaggggaagggggtaagccttggagagtggatgactcagagggttcttggatcccacctggggagaaggagcatgggcaagagagcctgtcggatgaactgcaagaaactcatccaaaaaagccatggcagaaagtcactgtccgggctcgagagctaggggaccccattgctcatccaaggcatgaggcagatgagaagccctttatatgtgcccagtgtggcaaaaccttcaataatacctccaacctgagaacacaccagcggatccacactggtgagaagccttacaagtgttctgaatgtggcaagagcttctcgagaagctccaaccgcatccggcacgagcggatccacctggaagagaaacactacaaatgccccaagtgccaggagagctttcggcggcgctcagacctcaccacgcaccagcaagatcacctaggcaagcggccataccgctgtgacatctgtggcaagagcttcagccagagtgccacgctagctgtgcatcaccggacccacctggagccagcaccctacatctgctgtgagtgtgggaagagcttcagcaacagctccagctttggcgtgcatcaccgcacccacacaggtgagagaccttatgagtgcactgagtgtgggcggaccttcagcgatatctccaactttggagcacaccagcggacccacagaggggagaagccctaccggtgcactgtgtgtgggaaacacttctcccggagctcgaatctcatccgccaccagaaaactcacttgggcgaacaggctgggaaagattccagctgaaggagagccccatttagagtgagggagagagagtgagagaccctaacctattggaggaagatcttcagcatcttttgctgctaccttgacctcaagcccttcatcccactttggagaatggttttgtatagcctctgaagtcaggatctcaggaagtcctgaggagggactctggaataaaaacccttgcctctttccaggccaatttctcgtgttggaaagtcagaagacccagtcttggctttactttcttggggtgaaagagaaatagggtaggctcagaacatgctcatgttattaaggcagcagtccccctggcctttgaggaagtacttatgagatgggtgtcactgtctgaaggttctccaaattgtctgtgaactgcttaggtaggagtgcactgcagtttcctgctagttcccacctgttgtgccccaactttgcttctagatctctggggtgggaggagtgaccttctcaatggaaggggcctccttggtctggagaagagatctgaggtcccaccttagaaatgaaagggaaaccctcagggagccatgacccagggaccttcacactcccccatgtttgttacttgttatccctcccccaacctgcctctgttttccccagagtgattagcagtaaaacccttcaatgaaaa

SEQ ID NO: 203497 - DNA, 1683 bp, Homo sapiens
  Payload ID: 20128
  Gene Name: zinc finger protein 691
  Uniprot ID: Q5VV52
  ENST ID: ENST00000372507
  CDS Start-End: 165-1019
ggcgctgtccctgatcgagcggcgggagcgagggcctggacgtagtgtcttcaacagttgtaacagcagctgccatttgctgaatgacagcatgtgtcacacactctgctgagtattacaggcatttttttctaatacaaagtcttgtagtgtggggttcagagatgggcagtgagaaggagcagagtccagaaccacacctgcctgaggaaggggaagggggtaagccttggagagtggatgactcagagggttcttggatcccacctggggagaaggagcatgggcaagagagcctgtcggatgaactgcaagaaactcatccaaaaaagccatggcagaaagtcactgtccgggctcgagagctaggggaccccattgctcatccaaggcatgaggcagatgagaagccctttatatgtgcccagtgtggcaaaaccttcaataatacctccaacctgagaacacaccagcggatccacactggtgagaagccttacaagtgttctgaatgtggcaagagcttctcgagaagctccaaccgcatccggcacgagcggatccacctggaagagaaacactacaaatgccccaagtgccaggagagctttcggcggcgctcagacctcaccacgcaccagcaagatcacctaggcaagcggccataccgctgtgacatctgtggcaagagcttcagccagagtgccacgctagctgtgcatcaccggacccacctggagccagcaccctacatctgctgtgagtgtgggaagagcttcagcaacagctccagctttggcgtgcatcaccgcacccacacaggtgagagaccttatgagtgcactgagtgtgggcggaccttcagcgatatctccaactttggagcacaccagcggacccacagaggggagaagccctaccggtgcactgtgtgtgggaaacacttctcccggagctcgaatctcatccgccaccagaaaactcacttgggcgaacaggctgggaaagattccagctgaaggagagccccatttagagtgagggagagagagtgagagaccctaacctattggaggaagatcttcagcatcttttgctgctaccttgacctcaagcccttcatcccactttggagaatggttttgtatagcctctgaagtcaggatctcaggaagtcctgaggagggactctggaataaaaacccttgcctctttccaggccaatttctcgtgttggaaagtcagaagacccagtcttggctttactttcttggggtgaaagagaaatagggtaggctcagaacatgctcatgttattaaggcagcagtccccctggcctttgaggaagtacttatgagatgggtgtcactgtctgaaggttctccaaattgtctgtgaactgcttaggtaggagtgcactgcagtttcctgctagttcccacctgttgtgccccaactttgcttctagatctctggggtgggaggagtgaccttctcaatggaaggggcctccttggtctggagaagagatctgaggtcccaccttagaaatgaaagggaaaccctcagggagccatgacccagggaccttcacactcccccatgtttgttacttgttatccctcccccaacctgcctctgttttccccagagtgattagcagtaaaacccttcaatgaaaa

SEQ ID NO: 203498 - DNA, 1577 bp, Homo sapiens
  Payload ID: 20128
  Gene Name: zinc finger protein 691
  Uniprot ID: Q5VV52
  ENST ID: ENST00000372508
  CDS Start-End: 59-913
ccctcgcctacagaggcggcgctgtccctgatcgagcggcgggagcgagggttcagagatgggcagtgagaaggagcagagtccagaaccacacctgcctgaggaaggggaagggggtaagccttggagagtggatgactcagagggttcttggatcccacctggggagaaggagcatgggcaagagagcctgtcggatgaactgcaagaaactcatccaaaaaagccatggcagaaagtcactgtccgggctcgagagctaggggaccccattgctcatccaaggcatgaggcagatgagaagccctttatatgtgcccagtgtggcaaaaccttcaataatacctccaacctgagaacacaccagcggatccacactggtgagaagccttacaagtgttctgaatgtggcaagagcttctcgagaagctccaaccgcatccggcacgagcggatccacctggaagagaaacactacaaatgccccaagtgccaggagagctttcggcggcgctcagacctcaccacgcaccagcaagatcacctaggcaagcggccataccgctgtgacatctgtggcaagagcttcagccagagtgccacgctagctgtgcatcaccggacccacctggagccagcaccctacatctgctgtgagtgtgggaagagcttcagcaacagctccagctttggcgtgcatcaccgcacccacacaggtgagagaccttatgagtgcactgagtgtgggcggaccttcagcgatatctccaactttggagcacaccagcggacccacagaggggagaagccctaccggtgcactgtgtgtgggaaacacttctcccggagctcgaatctcatccgccaccagaaaactcacttgggcgaacaggctgggaaagattccagctgaaggagagccccatttagagtgagggagagagagtgagagaccctaacctattggaggaagatcttcagcatcttttgctgctaccttgacctcaagcccttcatcccactttggagaatggttttgtatagcctctgaagtcaggatctcaggaagtcctgaggagggactctggaataaaaacccttgcctctttccaggccaatttctcgtgttggaaagtcagaagacccagtcttggctttactttcttggggtgaaagagaaatagggtaggctcagaacatgctcatgttattaaggcagcagtccccctggcctttgaggaagtacttatgagatgggtgtcactgtctgaaggttctccaaattgtctgtgaactgcttaggtaggagtgcactgcagtttcctgctagttcccacctgttgtgccccaactttgcttctagatctctggggtgggaggagtgaccttctcaatggaaggggcctccttggtctggagaagagatctgaggtcccaccttagaaatgaaagggaaaccctcagggagccatgacccagggaccttcacactcccccatgtttgttacttgttatccctcccccaacctgcctctgttttccccagagtgattagcagtaaaacccttcaatgaaaa

SEQ ID NO: 203499 - DNA, 728 bp, Homo sapiens
  Payload ID: 20128
  Gene Name: zinc finger protein 691
  ENST ID: ENST00000397034
  CDS Start-End: 330-728
ggcctggacgtagtgtcttcaacagttgtaacagcagctgccatttgctgaatgacagcatgtgtcacacactctgctgagtattacaggcatttttttctaatacaaagtcttgtagtgtggaaatacttgcagacttgaaggaattatcagtctttcattttctatcatcagtgtcctatgatagtttgtgcttccctccctcatccctttgttcatgtcactctgttcaccaacccactctgctgaaatgtcgttatttcttcaaggcccggaggaaatgctaccactctcatcagagtggtttcaagaagagtgacattattcaaatggcacaaatatcatctggtggtggtggacaaagccggtgccttctttttgctctggtgttggccatttgtgttcattctcagggttcagagatgggcagtgagaaggagcagagtccagaaccacacctgcctgaggaaggggaagggggtaagccttggagagtggatgactcagagggttcttggatcccacctggggagaaggagcatgggcaagagagcctgtcggatgaactgcaagaaactcatccaaaaaagccatggcagaaagtcactgtccgggctcgagagctaggggaccccattgctcatccaaggcatgaggcagatgagaagccctttatatgtgcccagtgtggcaaaaccttcaataatacctccaacctgagaacacac

SEQ ID NO: 203500 - DNA, 1581 bp, Homo sapiens
  Payload ID: 20128
  Gene Name: zinc finger protein 691
  ENST ID: ENST00000630961
  CDS Start-End: 1-921
atggcacaaatatcatctggtggtggtggacaaagccggtgccttctttttgctctgggttcagagatgggcagtgagaaggagcagagtccagaaccacacctgcctgaggaaggggaagggggtaagccttggagagtggatgactcagagggttcttggatcccacctggggagaaggagcatgggcaagagagcctgtcggatgaactgcaagaaactcatccaaaaaagccatggcagaaagtcactgtccgggctcgagagctaggggaccccattgctcatccaaggcatgaggcagatgagaagccctttatatgtgcccagtgtggcaaaaccttcaataatacctccaacctgagaacacaccagcggatccacactggtgagaagccttacaagtgttctgaatgtggcaagagcttctcgagaagctccaaccgcatccggcacgagcggatccacctggaagagaaacactacaaatgccccaagtgccaggagagctttcggcggcgctcagacctcaccacgcaccagcaagatcacctaggcaagcggccataccgctgtgacatctgtggcaagagcttcagccagagtgccacgctagctgtgcatcaccggacccacctggagccagcaccctacatctgctgtgagtgtgggaagagcttcagcaacagctccagctttggcgtgcatcaccgcacccacacaggtgagagaccttatgagtgcactgagtgtgggcggaccttcagcgatatctccaactttggagcacaccagcggacccacagaggggagaagccctaccggtgcactgtgtgtgggaaacacttctcccggagctcgaatctcatccgccaccagaaaactcacttgggcgaacaggctgggaaagattccagctgaaggagagccccatttagagtgagggagagagagtgagagaccctaacctattggaggaagatcttcagcatcttttgctgctaccttgacctcaagcccttcatcccactttggagaatggttttgtatagcctctgaagtcaggatctcaggaagtcctgaggagggactctggaataaaaacccttgcctctttccaggccaatttctcgtgttggaaagtcagaagacccagtcttggctttactttcttggggtgaaagagaaatagggtaggctcagaacatgctcatgttattaaggcagcagtccccctggcctttgaggaagtacttatgagatgggtgtcactgtctgaaggttctccaaattgtctgtgaactgcttaggtaggagtgcactgcagtttcctgctagttcccacctgttgtgccccaactttgcttctagatctctggggtgggaggagtgaccttctcaatggaaggggcctccttggtctggagaagagatctgaggtcccaccttagaaatgaaagggaaaccctcagggagccatgacccagggaccttcacactcccccatgtttgttacttgttatccctcccccaacctgcctctgttttccccagagtgattagcagtaaaacccttcaatg

SEQ ID NO: 203501 - DNA, 1931 bp, Homo sapiens
  Payload ID: 20129
  Gene Name: zinc finger protein 692
  Uniprot ID: Q9BU19
  ENST ID: ENST00000306601
  CDS Start-End: 168-1727
agcagccgacgccgagaggcaccgtttcttcttaaaagagaaacgctgcgcgcgcgaggtgggcccctgtcttccagcagctccgggcctgctcgctaggcccgggaggcgcaggcgcaggcgcagtgggggtgagggcgcgtgggggcgcacagcctctggtgcacatggcttcctccccggcggtggacgtgtcctgcaggcggcgggagaagcggcggcagctggacgcgcgccgcagcaagtgccgcatccgcctgggcggccacatggagcagtggtgcctcctcaaggagcggctgggcttctccctgcactcgcagctcgccaagttcctgttggaccggtacacttcttcaggctgtgtcctctgtgcaggtcctgagcctttgcctccaaaaggtctgcagtatctggtgctcttgtctcatgcccacagccgagagtgcagcctggtgcccgggcttcgggggcctggcggccaagatggggggcttgtgtgggagtgctcagcaggccataccttctcctggggaccctctttgagccctacaccttcagaggcacccaagccagcctcccttccacatactactcggagaagttggtgttccgaggccacgagtgggcaggagcttgcagatttggaatctgagcatgatgagaggactcaagaggccaggttgcccaggagggtgggacccccaccagagaccttcccacctccaggagaggaagagggtgaggaagaagaggacaatgatgaggatgaagaggagatgctcagtgatgccagcttatggacctacagctcctccccagatgatagtgagcctgatgcccccagactactgccttcccctgtcacctgcacacctaaagagggggagacaccaccagcccctgcagcactctccagtcctcttgctgtgccggccttgtcagcatcctcattgagttccagagctcctccacctgcagaagtcagggtgcagccacagctcagcaggacccctcaagcggcccagcagactgaggccctggccagcactgggagtcaggcccagtctgctccaaccccggcctgggatgaggacactgcacaaattggccccaagagaattaggaaagctgccaaaagagagctgatgccttgtgacttccctggctgtggaaggatcttctccaaccggcagtatttgaatcaccacaaaaagtaccagcacatccaccagaagtctttctcctgcccagagccagcctgtgggaagtctttcaactttaagaaacacctgaaggagcacatgaagctgcacagtgacacccgggactacatctgtgagttctgcgcccggtctttccgcactagcagcaaccttgtcatccacagacgtatccacactggagaaaaacccctgcagtgtgagatatgcgggtttacctgccgccagaaggcttccctgaactggcaccagcgcaagcatgcagagacggtggctgccttgcgcttcccctgtgaattctgcggcaagcgctttgagaagccagacagtgttgcagcccaccgtagcaaaagtcacccagccctgcttctagcccctcaagagtcacccagtggtcccctagagccctgtcccagcatctctgcccctgggcctctgggatccagcgaggggtccaggccctctgcatctcctcaggctccaaccctgcttcctcagcaatgagctctcctccagctttggctttgggaagccagactccagggactgaaaaggagcaacaaggagagggtctgcttgagaaatgccagatgcttggtccccaggaactaaggcgacagagtgcagggtgggggcaagactgggctgtaggggagctggactactttagtcttcctaaaggacaaaataaacagtattttatgcagg

SEQ ID NO: 203502 - DNA, 1710 bp, Homo sapiens
  Payload ID: 20129
  Gene Name: zinc finger protein 692
  Uniprot ID: Q9BU19
  ENST ID: ENST00000366471
  CDS Start-End: 84-1508
agttccgggctacagcagccgacgccgagaggcaccgtttcttcttaaaagagaaacgctgcgcgcgcgagcctctggtgcacatggcttcctccccggcggtggacgtgtcctgcaggcggcgggagaagcggcggcagctggacgcgcgccgcagcaagtgccgcatccgcctgggcggccacatggagcagtggtgcctcctcaaggagcggctgggcttctccctgcactcgcagctcgccaagttcctgttggaccggtacacttcttcaggctgtgtcctctgtgcaggtcctgagcctttgcctccaaaaggtctgcagtatctggtgctcttgtctcatgcccacagccgagagtgcagcctggtgcccgggcttcgggggcctggcggccaagatggggggcttgtgtgggagtgctcagcaggccataccttctcctggggaccctctttgagccctacaccttcagaggcacccaagccagcctcccttccacatactactcggagaagttggtgttccgaggccacgagtgggcaggagcttgcagatttggaatctgagcatgatgagaggactcaagaggccaggttgcccagtagtgagcctgatgcccccagactactgccttcccctgtcacctgcacacctaaagagggggagacaccaccagcccctgcagcactctccagtcctcttgctgtgccggccttgtcagcatcctcattgagttccagagctcctccacctgcagaagtcagggtgcagccacagctcagcaggacccctcaagcggcccagcagactgaggccctggccagcactgggagtcaggcccagtctgctccaaccccggcctgggatgaggacactgcacaaattggccccaagagaattaggaaagctgccaaaagagagctgatgccttgtgacttccctggctgtggaaggatcttctccaaccggcagtatttgaatcaccacaaaaagtaccagcacatccaccagaagtctttctcctgcccagagccagcctgtgggaagtctttcaactttaagaaacacctgaaggagcacatgaagctgcacagtgacacccgggactacatctgtgagttctgcgcccggtctttccgcactagcagcaaccttgtcatccacagacgtatccacactggagaaaaacccctgcagtgtgagatatgcgggtttacctgccgccagaaggcttccctgaactggcaccagcgcaagcatgcagagacggtggctgccttgcgcttcccctgtgaattctgcggcaagcgctttgagaagccagacagtgttgcagcccaccgtagcaaaagtcacccagccctgcttctagcccctcaagagtcacccagtggtcccctagagccctgtcccagcatctctgcccctgggcctctgggatccagcgaggggtccaggccctctgcatctcctcaggctccaaccctgcttcctcagcaatgagctctcctccagctttggctttgggaagccagactccagggactgaaaaggagcaacaaggagagggtctgcttgagaaatgccagatgcttggtccccaggaactaaggcgacagagtgcagggtgggggcaagactgggctgtaggggagctggactactttagtcttcctaaaggacaaaataaacagtattttatgca

SEQ ID NO: 203503 - DNA, 2065 bp, Homo sapiens
  Payload ID: 20129
  Gene Name: zinc finger protein 692
  Uniprot ID: Q9BU19
  ENST ID: ENST00000451251
  CDS Start-End: 347-1921
attgggattagtccgctccactcactgtcagcattaagtgggggtgcccaagacggggtggatggggggcgccctccagacctctgaccacggcctcaccgccactcgacccaactatgaagagcgcccccagctgcacgccaggacacgacctttccttcccctagaaaccagtaaaggccgctgccctattcaagatgaaatgtgtggaccgcccccagcccagttgaaatttcccgtgaaagtctctcgccccttccccacagctccacttcagtggactggagggcgcaggcctttgttctgactgcttctgtctgcctgcctcccacccgacgacactcacatgcctctggtgcacatggcttcctccccggcggtggacgtgtcctgcaggcggcgggagaagcggcggcagctggacgcgcgccgcagcaagtgccgcatccgcctgggcggccacatggagcagtggtgcctcctcaaggagcggctgggcttctccctgcactcgcagctcgccaagttcctgttggaccggtacacttcttcaggctgtgtcctctgtgcaggtcctgagcctttgcctccaaaaggtctgcagtatctggtgctcttgtctcatgcccacagccgagagtgcagcctggtgcccgggcttcgggggcctggcggccaagatggggggcttgtgtgggagtgctcagcaggccataccttctcctggggaccctctttgagccctacaccttcagaggcacccaagccagcctcccttccacatactactcggagaagttggtgttccgaggccacgagtgggcaggagcttgcagatttggaatctgagcatgatgagaggactcaagaggccaggttgcccaggagggtgggacccccaccagagaccttcccacctccaggagaggaagagggtgaggaagaagaggacaatgatgaggatgaagaggagatgctcagtgatgccagcttatggacctacagctcctccccagatgatagtgagcctgatgcccccagactactgccttcccctgtcacctgcacacctaaagagggggagacaccaccagcccctgcagcactctccagtcctcttgctgtgccggccttgtcagcatcctcattgagttccagagctcctccacctgcagaagtcagggtgcagccacagctcagcaggacccctcaagcggcccagcagactgaggccctggccagcactgggagtcaggcccagtctgctccaaccccggcctgggatgaggacactgcacaaattggccccaagagaattaggaaagctgccaaaagagagctgatgccttgtgacttccctggctgtggaaggatcttctccaaccggcagtatttgaatcaccacaaaaagtaccagcacatccaccagaagtctttctcctgcccagagccagcctgtgggaagtctttcaactttaagaaacacctgaaggagcacatgaagctgcacagtgacacccgggactacatctgtgagttctgcgcccggtctttccgcactagcagcaaccttgtcatccacagacgtatccacactggagaaaaacccctgcagtgtgagatatgcgggtttacctgccgccagaaggcttccctgaactggcaccagcgcaagcatgcagagacggtggctgccttgcgcttcccctgtgaattctgcggcaagcgctttgagaagccagacagtgttgcagcccaccgtagcaaaagtcacccagccctgcttctagcccctcaagagtcacccagtggtcccctagagccctgtcccagcatctctgcccctgggcctctgggatccagcgaggggtccaggccctctgcatctcctcaggctccaaccctgcttcctcagcaatgagctctcctccagctttggctttgggaagccagactccagggactgaaaaggagcaacaaggagagggtctgcttgagaaatgccagatgcttggtccccaggaactaaggcgacagagtgcagggtgggggcaagactgggctg

SEQ ID NO: 203504 - DNA, 1916 bp, Homo sapiens
  Payload ID: 20129
  Gene Name: zinc finger protein 692
  ENST ID: ENST00000412341
  CDS Start-End: 164-481
gccgacgccgagaggcaccgtttcttcttaaaagagaaacgctgcgcgcgcgaggtgggcccctgtcttccagcagctccgggcctgctcgctaggcccgggaggcgcaggcgcaggcgcagtgggggtgagggcgcgtgggggcgcacagcctctggtgcacatggcttcctccccggcggtggacgtgtcctgcaggcggcgggagaagcggcggcagctggacgcgcgccgcagcaagtgccgcatccgcctgggcggccacatggagcagtggtgcctcctcaaggagcggctgggcttctccctgcactcgcagctcgccaagttcctgttggaccggtacacttcttcaggctgtgtcctctgtgcagccgagagtgcagcctggtgcccgggcttcgggggcctggcggccaagatggggggcttgtgtgggagtgctcagcaggccataccttctcctggggaccctctttgagccctacaccttcagaggcacccaagccagcctcccttccacatactactcggagaagttggtgttccgaggccacgagtgggcaggagcttgcagatttggaatctgagcatgatgagaggactcaagaggccaggttgcccaggagggtgggacccccaccagagaccttcccacctccaggagaggaagaggtagtgagcctgatgcccccagactactgccttcccctgtcacctgcacacctaaagagggggagacaccaccagcccctgcagcactctccagtcctcttgctgtgccggccttgtcagcatcctcattgagttccagagctcctccacctgcagaagtcagggtgcagccacagctcagcaggacccctcaagcggcccagcagactgaggccctggccaggtaacctgatggctgagacagaaagggcaggggcgtcctgggatgtggccctccctcgaggccctctgctccctctttgctgcccgtagcactgggagtcaggcccagtctgctccaaccccggcctgggatgaggacactgcacaaattggccccaagagaattaggaaagctgccaaaagagagctgatgccttgtgacttccctggctgtggaaggatcttctccaaccggcagtatttgaatcaccacaaaaagtaccagcacatccaccagaagtctttctcctgcccagagccagcctgtgggaagtctttcaactttaagaaacacctgaaggagcacatgaagctgcacagtggtaagggaggtccagacgggctccatgatttggataacaactaattagaacctgagcctcctgacctccaatacggtgcactctgacacccgggactacatctgtgagttctgcgcccggtctttccgcactagcagcaaccttgtcatccacagacgtatccacactggagaaaaacccctgcagtgtgagatatgcgggtttacctgccgccagaaggcttccctgaactggcaccagcgcaagcatgcagagacggtggctgccttgcgcttcccctgtgaattctgcggcaagcgctttgagaagccagacagtgttgcagcccaccgtagcaaaagtcacccagccctgcttctagcccctcaagagtcacccagtggtcccctagagccctgtcccagcatctctgcccctgggcctctgggatccagcgaggggtccaggccctctgcatctcctcaggctccaaccctgcttcctcagcaatgagctctcctccagctttggctttgggaagccagactccagggactgaaaaggagcaacaaggagagggtctgcttgagaaatgccagatgcttggtccccaggaactaaggcgacagagtgcagggtgggggcaagactgggctgtaggggagctggactacttta

SEQ ID NO: 203505 - DNA, 595 bp, Homo sapiens
  Payload ID: 20129
  Gene Name: zinc finger protein 692
  ENST ID: ENST00000530986
  CDS Start-End: 181-390
agttccgggctacagcagccgacgccgagaggcaccgtttcttcttaaaagagaaacgctgcgcgcgcgaggtgggcccctgtcttccagcagctccgggcctgctcgctaggcccgggaggcgcaggcgcaggcgcagtgggggtgagggcgcgtgggggcgcacagcctctggtgcacatggcttcctccccggcggtggacgtgtcctgcaggcggcgggagaagcggcggcagctggacgcgcgccgcagcaagtgccgcatccgcctgggcggccacatggagcagtggtgcctcctcaaggagcggctgggcttctccctgcactcgcagctcgccaagttcctgttggaccggtttctcactttaccaggacggcctgtgtgacttgtggcctccgagggtcctgctcccctcctcatggtctcagcgaatagcggcccttagggctggccccttacatgtgtgagtgcccagggctgagggtggctggccacctgagtcctgacctgcctcttctcctgctggcaggtacacttcttcaggctgtgtcctctgtgcaggtcctgagcctttgcctccaaaaggtctg

SEQ ID NO: 203506 - DNA, 1064 bp, Homo sapiens
  Payload ID: 20129
  Gene Name: zinc finger protein 692
  ENST ID: ENST00000496411
  CDS Start-End: 114-356
cgaggtgggcccctgtcttccagcagctccgggcctgctcgctaggcccgggaggcgcaggcgcaggcgcagtgggggtgagggcgcgtgggggcgcacagcctctggtgcacatggcttcctccccggcggtggacgtgtcctgcaggcggcgggagaagcggcggcagctggacgcgcgccgcagcaagtgccgcatccgcctgggcggccacatggagcagtggtgcctcctcaaggagcggctgggcttctccctgcactcgcagctcgccaagttcctgttggaccggacggcctgtgtgacttgtggcctccgagggtcctgctcccctcctcatggtctcagcgaatagcggcccttagggctggccccttacatgtgtgagtgcccagggctgagggtggctggccacctgagtcctgacctgcctcttctcctgctggcaggtacacttcttcaggctgtgtcctctgtgcaggtcctgagcctttgcctccaaaaggtctgcagtatctggtgctcttgtctcatgcccacagccgagagtgcagcctggtgcccgggcttcgggggcctggcggccaagatggggggcttgtgtgggagtgctcagcaggccataccttctcctggggaccctctttgagccctacaccttcagaggcacccaagccagcctcccttccacatactactcggagaagttggtgttccgaggccacgagtgggcaggagcttgcagatttggaatctgagcatgatgagaggactcaagaggccaggttgcccaggagggtgggacccccaccagagaccttcccacctccaggagaggaagaggtagtgagcctgatgcccccagactactgccttcccctgtcacctgcacacctaaagagggggagacaccaccagcccctgcagcactctccagtcctcttgctgtgccggccttgtcagcatcctcattgagttccagagctcctccacctgcagaagtcagggtgcagccacagctcagcaggacccctcaagcggcccagcagactgaggccctggc

SEQ ID NO: 203507 - DNA, 1006 bp, Homo sapiens
  Payload ID: 20129
  Gene Name: zinc finger protein 692
  ENST ID: ENST00000476503
  CDS Start-End: 1-820
tgagcctgatgcccccagactactgccttcccctgtcacctgcacacctaaagagggggagacaccaccagcccctgcagcactctccagtcctcttgctgtgccggccttgtcagcatcctcattgagttccagagctcctccacctgcagaagtcagggtgcagccacagctcagcaggacccctcaagcggcccagcagactgaggccctggccaggaaagctgccaaaagagagctgatgccttgtgacttccctggctgtggaaggatcttctccaaccggcagtatttgaatcaccacaaaaagtaccagcacatccaccagaagtctttctcctgcccagagccagcctgtgggaagtctttcaactttaagaaacacctgaaggagcacatgaagctgcacagtgacacccgggactacatctgtgagttctgcgcccggtctttccgcactagcagcaaccttgtcatccacagacgtatccacactggagaaaaacccctgcagtgtgagatatgcgggtttacctgccgccagaaggcttccctgaactggcaccagcgcaagcatgcagagacggtggctgccttgcgcttcccctgtgaattctgcggcaagcgctttgagaagccagacagtgttgcagcccaccgtagcaaaagtcacccagccctgcttctagcccctcaagagtcacccagtggtcccctagagccctgtcccagcatctctgcccctgggcctctgggatccagcgaggggtccaggccctctgcatctcctcaggctccaaccctgcttcctcagcaatgagctctcctccagctttggctttgggaagccagactccagggactgaaaaggagcaacaaggagagggtctgcttgagaaatgccagatgcttggtccccaggaactaaggcgacagagtgcagggtgggggcaagactgggctgtaggggagctggactactttagtcttcctaaaggacaaaata

SEQ ID NO: 203508 - DNA, 656 bp, Homo sapiens
  Payload ID: 20129
  Gene Name: zinc finger protein 692
  ENST ID: ENST00000496231
  CDS Start-End: 261-656
ccgacgccgagaggcaccgtttcttcttaaaagagaaacgctgcgcgcgcgaggtgggcccctgtcttccagcagctccgggcctgctcgctaggcccgggaggcgcaggcgcaggcgcagtgggggtgagggcgcgtgggggcgcacagttcactgatgaggaaactgaggccctaacggcaggtggagccgggtccccgacccccgagatcggcagggcgctgaagacgtcccttccaccctccagcctctggtgcacatggcttcctccccggcggtggacgtgtcctgcaggcggcgggagaagcggcggcagctggacgcgcgccgcagcaagtgccgcatccgcctgggcggccacatggagcagtggtgcctcctcaaggagcggctgggcttctccctgcactcgcagctcgccaagttcctgttggaccggtacacttcttcaggctgtgtcctctgtgcaggtcctgagcctttgcctccaaaaggtctgcagtatctggtgctcttgtctcatgcccacagccgagagtgcagcctggtgcccgggcttcgggggcctggcggccaagatggggggcttgtgtgggagtgctcagcaggccataccttctcctggggaccctctttgagccctacaccttcagag

SEQ ID NO: 203509 - DNA, 851 bp, Homo sapiens
  Payload ID: 20129
  Gene Name: zinc finger protein 692
  ENST ID: ENST00000482023
  CDS Start-End: 1-238
gaaagctgccaaaagagagctgatgccttgtgacttccctggctgtggaaggatcttctccaaccggcagtatttgaatcaccacaaaaagtaccagcacatccaccagaagtctttctcctgcccagagccagcctgtgggaagtctttcaactttaagaaacacctgaaggagcacatgaagctgcacagtggtaagggaggtccagacgggctccatgatttggataacaactaattagaacctgagcctcctgacctccaatacggtgcactctgacacccgggactacatctgtgagttctgcgcccggtctttccgcactagcagcaaccttgtcatccacagacgtatccacactggagaaaaacccctgcagtgtgagatatgcgggtttacctgccgccagaaggcttccctgaactggcaccagcgcaagcatgcagagacggtggctgccttgcgcttcccctgtgaattctgcggcaagcgctttgagaagccagacagtgttgcagcccaccgtagcaaaagtcacccagccctgcttctagcccctcaagagtcacccagtggtcccctagagccctgtcccagcatctctgcccctgggcctctgggatccagcgaggggtccaggccctctgcatctcctcaggctccaaccctgcttcctcagcaatgagctctcctccagctttggctttgggaagccagactccagggactgaaaaggagcaacaaggagagggtctgcttgagaaatgccagatgcttggtccccaggaactaaggcgacagagtgcagggtgggggcaagactgggctgtaggggagctggactacttta

SEQ ID NO: 203510 - DNA, 576 bp, Homo sapiens
  Payload ID: 20129
  Gene Name: zinc finger protein 692
  ENST ID: ENST00000528141
  CDS Start-End: 84-293
agttccgggctacagcagccgacgccgagaggcaccgtttcttcttaaaagagaaacgctgcgcgcgcgagcctctggtgcacatggcttcctccccggcggtggacgtgtcctgcaggcggcgggagaagcggcggcagctggacgcgcgccgcagcaagtgccgcatccgcctgggcggccacatggagcagtggtgcctcctcaaggagcggctgggcttctccctgcactcgcagctcgccaagttcctgttggaccggtttctcactttaccaggacggcctgtgtgacttgtggcctccgagggtcctgctcccctcctcatggtctcagcgaatagcggcccttagggctggccccttacatgtgtgagtgcccagggctgagggtggctggccacctgagtcctgacctgcctcttctcctgctggcaggtacacttcttcaggctgtgtcctctgtgcaggtcctgagcctttgcctccaaaaggtctgcagtatctggtgctcttgtctcatgcccacagccgagagtgcagcctggtgcccgggcttcgggggcctggcggccaa

SEQ ID NO: 203511 - DNA, 901 bp, Homo sapiens
  Payload ID: 20129
  Gene Name: zinc finger protein 692
  ENST ID: ENST00000483223
  CDS Start-End: 221-463
cccgacgacactcacatggtagcgctgagcttcaacaccctgtatcatagaaggacggggtttggctccacacctgccactgctattgaaatagtttagtcttgccccagttcactgatgaggaaactgaggccctaacggcaggtggagccgggtccccgacccccgagatcggcagggcgctgaagacgtcccttccaccctccagcctctggtgcacatggcttcctccccggcggtggacgtgtcctgcaggcggcgggagaagcggcggcagctggacgcgcgccgcagcaagtgccgcatccgcctgggcggccacatggagcagtggtgcctcctcaaggagcggctgggcttctccctgcactcgcagctcgccaagttcctgttggaccggacggcctgtgtgacttgtggcctccgagggtcctgctcccctcctcatggtctcagcgaatagcggcccttagggctggccccttacatgtgtgagtgcccagggctgagggtggctggccacctgagtcctgacctgcctcttctcctgctggcaggtacacttcttcaggctgtgtcctctgtgcaggtcctgagcctttgcctccaaaaggtctgcagtatctggtgctcttgtctcatgcccacagccgagagtgcagcctggtgcccgggcttcgggggcctggcggccaagatggggggcttgtgtgggagtgctcagcaggccataccttctcctggggaccctctttgagccctacaccttcagaggcacccaagccagcctcccttccacatactactcggagaagttggtgttccgaggccacgagtgggcaggagcttgcagatttggaatctgagcatgatgagaggactcaagaggccaggttgccca

SEQ ID NO: 203512 - DNA, 2704 bp, Homo sapiens
  Payload ID: 20129
  Gene Name: zinc finger protein 692
  Uniprot ID: Q9BU19
  ENST ID: ENST00000463519
  CDS Start-End: 405-695
acgacctttccttcccctagaaaccagtaaaggccgctgccctattcaagatgaaatgtgtggaccgcccccagcccagttgaaatttcccgtgaaagtctctcgccccttccccacagctccacttcagtggactggagggcgcaggcctttgttctgactgcttctgtctgcctgcctcccacccgacgacactcacatggtagcgctgagcttcaacaccctgtatcatagaaggacggggtttggctccacacctgccactgctattgaaatagtttagtcttgccccagttcactgatgaggaaactgaggccctaacggcaggtggagccgggtccccgacccccgagatcggcagggcgctgaagacgtcccttccaccctccagcctctggtgcacatggcttcctccccggcggtggacgtgtcctgcaggcggcgggagaagcggcggcagctggacgcgcgccgcagcaagtgccgcatccgcctgggcggccacatggagcagtggtgcctcctcaaggagcggctgggcttctccctgcactcgcagctcgccaagttcctgttggaccgggcctgtcctgctgctcttttccaccctcaggtttctcactttaccaggacggcctgtgtgacttgtggcctccgagggtcctgctcccctcctcatggtctcagcgaatagcggcccttagggctggccccttacatgtgtgagtgcccagggctgagggtggctggccacctgagtcctgacctgcctcttctcctgctggcaggtacacttcttcaggctgtgtcctctgtgcaggtaggtaggggatggcagggggtgagagccagagggaagagggaccacagggtgacccagaaacaccctcctttcaaagggagccctgagtaagtttgggaagggtggggtgagttggggagcacagggtagtttgatggaggcaacctctgggtggggaagggagcaatgtctcaggatctagtgtgtctaggttctgaagaatgataaattggactggggctgaggttgccctggggtttgagggaacagggctccctgggtatggctctccagggtaagaggaggagacttcccagttcagcctgactgcttcccccacccctccaggtcctgagcctttgcctccaaaaggtctgcagtatctggtgctcttgtctcatgcccacagccgagagtgcagcctggtgcccgggcttcgggggcctggcggccaagatggggggcttgtgtgggagtgctcagcaggccataccttctcctggggaccctctttgagccctacaccttcagaggcacccaagccagcctcccttccacatactactcggagaagttggtgttccgaggccacgagtgggcaggagcttgcagatttggaatctgagcatgatgagaggactcaagaggccaggttgcccaggagggtgggacccccaccagagaccttcccacctccaggagaggaagagggtgaggaagaagaggacaatgatgaggatgaagaggagatgctcagtgatgccagcttatggacctacagctcctccccagatgatagtgagcctgatgcccccagactactgccttcccctgtcacctgcacacctaaagagggggagacaccaccagcccctgcagcactctccagtcctcttgctgtgccggccttgtcagcatcctcattgagttccagagctcctccacctgcagaagtcagggtgcagccacagctcagcaggacccctcaagcggcccagcagactgaggccctggccagcactgggagtcaggcccagtctgctccaaccccggcctgggatgaggacactgcacaaattggccccaagagaattaggaaagctgccaaaagagagctgatgccttgtgacttccctggctgtggaaggatcttctccaaccggcagtatttgaatcaccacaaaaagtaccagcacatccaccagaagtctttctcctgcccagagccagcctgtgggaagtctttcaactttaagaaacacctgaaggagcacatgaagctgcacagtgacacccgggactacatctgtgagttctgcgcccggtctttccgcactagcagcaaccttgtcatccacagacgtatccacactggagaaaaacccctgcagtgtgagatatgcgggtttacctgccgccagaaggcttccctgaactggcaccagcgcaagcatgcagagacggtggctgccttgcgcttcccctgtgaattctgcggcaagcgctttgagaagccagacagtgttgcagcccaccgtagcaaaagtcacccagccctgcttctagcccctcaagagtcacccagtggtcccctagagccctgtcccagcatctctgcccctgggcctctgggatccagcgaggggtccaggccctctgcatctcctcaggctccaaccctgcttcctcagcaatgagctctcctccagctttggctttgggaagccagactccagggactgaaaaggagcaacaaggagagggtctgcttgagaaatgccagatgcttggtccccaggaactaaggcgacagagtgcagggtgggggcaagactgggctgtaggggagctggactactttagtcttcctaaaggacaaaataaacagtattttatgcagg

SEQ ID NO: 203513 - DNA, 1521 bp, Homo sapiens
  Payload ID: 20129
  Gene Name: zinc finger protein 692
  ENST ID: ENST00000477070
  CDS Start-End: 1-494
gtcctgagcctttgcctccaaaaggtctgcagtatctggtgctcttgtctcatgcccacagccgagagtgcagcctggtgcccgggcttcgggggcctggcggccaagatggggggcttgtgtgggagtgctcagcaggccataccttctcctggggaccctctttgagccctacaccttcagaggcacccaagccagcctcccttccacatactactcggagaagttggtgttccgaggccacgagtgggcaggagcttgcagatttggaatctgagcatgatgagaggactcaagaggccaggttgcccaggagggtgggacccccaccagagaccttcccacctccaggagaggaagaggtagtgagcctgatgcccccagactactgccttcccctgtcacctgcacacctaaagagggggagacaccaccagcccctgcagcactctccagtcctcttgctgtgccggccttgtcagcatcctcattgagttccagagctcctccacctgcagaagtcagggtgcagccacagctcagcaggacccctcaagcggcccagcagactgaggccctggccaggtaacctgatggctgagacagaaagggcaggggcgtcctgggatgtggccctccctcgaggccctctgctccctctttgctgcccgtagcactgggagtcaggcccagtctgctccaaccccggcctgggatgaggacactgcacaaattggccccaagagaattaggaaagctgccaaaagagagctgatgccttgtgacttccctggctgtggaaggatcttctccaaccggcagtatttgaatcaccacaaaaagtaccagcacatccaccagaagtctttctcctgcccagagccagcctgtgggaagtctttcaactttaagaaacacctgaaggagcacatgaagctgcacagtgacacccgggactacatctgtgagttctgcgcccggtctttccgcactagcagcaaccttgtcatccacagacgtatccacactggagaaaaacccctgcagtgtgagatatgcgggtttacctgccgccagaaggcttccctgaactggcaccagcgcaagcatgcagagacggtggctgccttgcgcttcccctgtgaattctgcggcaagcgctttgagaagccagacagtgttgcagcccaccgtagcaaaagtcacccagccctgcttctagcccctcaagagtcacccagtggtcccctagagccctgtcccagcatctctgcccctgggcctctgggatccagcgaggggtccaggccctctgcatctcctcaggctccaaccctgcttcctcagcaatgagctctcctccagctttggctttgggaagccagactccagggactgaaaaggagcaacaaggagagggtctgcttgagaaatgccagatgcttggtccccaggaactaaggcgacagagtgcagggtgggggcaagactgggctgtaggggagctggactactttagtc

SEQ ID NO: 203514 - DNA, 548 bp, Homo sapiens
  Payload ID: 20129
  Gene Name: zinc finger protein 692
  ENST ID: ENST00000533647
  CDS Start-End: 16-258
cagcctctggtgcacatggcttcctccccggcggtggacgtgtcctgcaggcggcgggagaagcggcggcagctggacgcgcgccgcagcaagtgccgcatccgcctgggcggccacatggagcagtggtgcctcctcaaggagcggctgggcttctccctgcactcgcagctcgccaagttcctgttggaccggacggcctgtgtgacttgtggcctccgagggtcctgctcccctcctcatggtctcagcgaatagcggcccttagggctggccccttacatgtgtgagtgcccagggctgagggtggctggccacctgagtcctgacctgcctcttctcctgctggcaggtacacttcttcaggctgtgtcctctgtgcagccgagagtgcagcctggtgcccgggcttcgggggcctggcggccaagatggggggcttgtgtgggagtgctcagcaggccataccttctcctggggaccctctttgagccctacaccttcagaggcacccaagccagcctcccttccacatactactcggagaa

SEQ ID NO: 203515 - DNA, 3340 bp, Homo sapiens
  Payload ID: 20130
  Gene Name: zinc finger protein 695
  Uniprot ID: Q8IW36
  ENST ID: ENST00000339986
  CDS Start-End: 149-1696
tttgtctccttgcggccggcggggtgctgggttcccgtctgctgcctctcggagagtcccgggtgactgccgcaggctccatcgccctgtggcctgcaggtattgcgagatttatagggaggacgctgggacccccaaaagctgggaaatgggactattggcattcagggatgtggctctagaattctctccagaggagtgggaatgcctggacccagctcagcggagtttgtatagggatgtgatgttagagaactacagaaacctgatctcccttggtgaggatagcttcaatatgcaattcctatttcacagtcttgctatgtctaagccagaactgatcatctgtctggaggcaaggaaagagccctggaacgtgaacacagagaagacagccagacactcagttttgtcttcttatcttactgaagacattttgccagagcagggcctgcaagtttcattccaaaaagtgatgctgagaagatatgaaagatgttgtcttgagaaattacgcttaaggaatgactgggaaattgtgggtgagtggaaagggcagaaggcaagttataatggacttgacctatgctcagcaactactcatagcaaaaactttcaatgcaataaatgtgtgaaaggttttagtaaatttgcaaatctaaataaatgtaagataagccatactggagaaaaaccattcaaatgcaaagaatgtggcaatgtctcttgcatgtctttaataatgactcaacagcagagaatccatattggagagaacccgtaccaatgtaaaaaatgtggcaaagcctttaatgagtgctcatgctttactgactgtaagagaattcatgttggagagaaacattgcaaatgtgaagaatgtaataacatttttaagtcttgctcaagtcttgctgttgttgagaaaaatcatactgaaaagaaaacctacagatgtgaagaatgtggcaaagcttttaacctgtgctcagttcttactaaacataagaaaattcatactggagagaaaccatacaaatgtgaagaatgtggcaaatcctttaagttgttcccataccttactcaacacaagagaattcatagtagagagaaaccctacaagtgtgaagaatgtggcaaagtctttaaattgttgtcataccttactcaacatagaagaattcatactggagagaaaaccttccgatgtgaagaatgtggaaaagcctttaaccagagctcacatctgactgaacataggagaattcatactggtgagaaaccatacaaatgtgaggaatgtggcaaagcttttacctggttctcataccttattcagcataagagaattcatactgggcagaaaccctacaaatgtgaggaatgtggcaaagcttttacctggttttcataccttactcaacataagagaattcatactggagagaaaccctacaaatgtgatgaatgtggcaaagcttttaactggttttcatatcttactaatcataagagaattcatactggagagaaaccctacaaatgtgaagaatgtggcaaagcctttggccagagctcacacctttctaaacataagacaattcataccagagagaaaccatacaagtgtgaggaatgtggcaaagcctttaaccactctgcacaacttgctgtacatgagaaaactcatacctgagaaaaaccctacaattctaaacaatatggcatagtctttaatacctattcacaacttcacagcagaatatttttactgaataagagtgttacaaatgtaatgactgtcaaaaggccatttacagtctatgagcctttgagtgcactaaaatgtttaggctacgaacaatacaaatagaccggttcaacacctccacttatatcacagctcttactgtacacagaagaatttatactggagggaaaccctccagttgctcaaactgtattcaatttcaaagactttgtattggagagaaaccctacaaatgtaataaatgcagaaacaacatttgttcaaaaaatatacctcagaaaacaccagagtgttcacactaaaaactgttttacagatgcagtaaatgtgaaaaaatgtctaatcaaaaattacatcaaaacacatccaagaattcatagtaaaaagcactaagtcactgacactttcagacattactgtaaatctgagtgttggttatagagaataattcaaagttaagttaaagtaagtaggagattcaccttttggggaagttataattacatttcaagtataccttttggtgccaggcacggtggctctttcctatagttgctgcacttttggatgccgaggtcgggggattgcttgagcccaggagtttgggaccaggctgggcaacatggcaaaacctcatctctacaaaaagtaaaataaaagccaggcttggtggcacatgcctgttgtcccagctacttggaaggctcaggtgggaggattgcttgagcctggaggttgaggatgcagtgagctgctatctggcaacttcactcctgcctgggcaacagagcaagaccctttctcaataataataataacaacataataataaagtatactcggtgcactgaaagagttttagcttttttgaaaatcacatatttatgtaattcaagtcttaaatcacttgataccatgccttcatttctagtgtttatgtgaaggcatgaggcctactgttgctacatgaaagctgtgagagtttcttctatattcgggtgggtgttgttcatatccttttctttggaagattatggacattgcattgtaagcttcctgaagaaatttaactggagaggctctttgtacttgtcttataatagggttgtaagtgattcatgagataggtcttcagagtactattctgcattatatttaagaaagaaacatttgagttttacaagtcagttgtttttcctattgcacattaaggtaataaaattcagtggattttgaaatgctctttttagactgtttgaacttaatttgttttaataagacattgttttaatgtctttggaccgttgtacattaagtgatgcgtatcctaccaccaacgttaacctatctcaccttagttacggttgtaggtaacaaatggtaacaatacaatagtgggtaacatggtggaatagtatctctaatgatcccttctcccagtggcattaaacttcaaataatttgaaaaatattgttcccacacgttacaccttcattctgtttgctctttttgtaatgacagtgtcattattaaggctataataaagcctatataggattataatcaaa

SEQ ID NO: 203516 - DNA, 862 bp, Homo sapiens
  Payload ID: 20130
  Gene Name: zinc finger protein 695
  Uniprot ID: Q8IW36
  ENST ID: ENST00000366504
  CDS Start-End: 92-493
cccgggtgactgccgcaggctccatcgccctgtggcctgcaggtattgcgagatttatagggaggacgctgggacccccaaaagctgggaaatgggactattggcattcagggatgtggctctagaattctctccagaggagtgggaatgcctggacccagctcagcggagtttgtatagggatgtgatgttagagaactacagaaacctgatctcccttggtgaggatagcttcaatatgcaattcctatttcacagtcttgctatgtctaagccagaactgatcatctgtctggaggcaaggaaagagccctggaacgtgaacacagagaagacagccagacactcagttttgtcttcttatcttactgaagacattttgccagagcagggcctgcaagtttcattccaaaaagtgatgctgagaagatatgaaagatgttgtcttgagaaattacgcttaaggaatgactgggaaattgtggccatgtgaagatgtgcttgcttcccctttgccttctgccatgattctaagtttcctgaggcctccccagaagcagaagcatgtaaagcccacagaaccggtccagtcgtcgaccatcgagctgctttgaagaccctgcggaggttccgtcgctgcttgaacacagtgcctggactccctgctccgtgaggcgaatttacaccgggtccagctgcgtcagcccgagttctgaattaaaacatgcctcccacagaatctatttctgatgaatatgaaaggaagattgttcttccatgttggtttttattgagatatctctttttttcccttttcatttggttgtcctaactccatgaatagaaaagaaaatgtattaat

SEQ ID NO: 203517 - DNA, 714 bp, Homo sapiens
  Payload ID: 20130
  Gene Name: zinc finger protein 695
  ENST ID: ENST00000491337
  CDS Start-End: 149-415
tttgtctccttgcggccggcggggtgctgggttcccgtctgctgcctctcggagagtcccgggtgactgccgcaggctccatcgccctgtggcctgcaggtattgcgagatttatagggaggacgctgggacccccaaaagctgggaaatgggactattggcattcagggatgtggctctagaattctctccagaggagtgggaatgcctggacccagctcagcggagtttgtatagggatgtgatgttagagaactacagaaacctgatctcccttggtgaggatagcttcaatatgcaattcctatttcacagtcttgctatgtctaagccagaactgatcatctgtctggaggcaaggaaagagccctggaacgtgaacacagagaagacagccagacactcagccatgtgaagatgtgcttgcttcccctttgccttctgccatgattctaagtttcctgaggcctccccagaagcagaagcatgtaaagcccacagaaccggtccagtcgtcgaccatcgagctgctttgaagaccctgcggaggttccgtcgctgcttgaacacagtgcctggactccctgctccgtgaggcgaatttacaccgggtccagctgcgtcagcccgagttctgaattaaaacatgcctcccacagaatctatttctgatgaatatgaaaggaagattgttcttccatgttggtttttatt

SEQ ID NO: 203518 - DNA, 826 bp, Homo sapiens
  Payload ID: 20130
  Gene Name: zinc finger protein 695
  Uniprot ID: Q8IW36
  ENST ID: ENST00000487338
  CDS Start-End: 186-704
agagaggaaggggcggccttggggatctggcggggcctttgtctccttgcggccggcggggtgctgggttcccgtctgctgcctctcggagagtcccgggtgactgccgcaggctccatcgccctgtggcctgcaggtattgcgagatttatagggaggacgctgggacccccaaaagctgggaaatgggactattggcattcagggatgtggctctagaattctctccagaggagtgggaatgcctggacccagctcagcggagtttgtatagggatgtgatgttagagaactacagaaacctgatctcccttggtgaggatagcttcaatatgcaattcctatttcacagtcttgctatgtctaagccagaactgatcatctgtctggaggcaaggaaagagccctggaacgtgaacacagagaagacagccagacactcagttttgtcttcttatcttactgaagacattttgccagagcagggcctgcaagtttcattccaaaaagtgatgctgagaagatatgaaagatgttgtcttgagaaattacgcttaaggaatgactgggaaattccatgtgaagatgtgcttgcttcccctttgccttctgccatgattctaagtttcctgaggcctccccagaagcagaagcatgtaaagcccacagaaccggtccagtcgtcgaccatcgagctgctttgaagaccctgcggaggttccgtcgctgcttgaacacagtgcctggactccctgctccgtgaggcgaatttacaccgggtccagctgcgtcagcccgagttctgaattaaaacatgcctcccaca

SEQ ID NO: 203519 - DNA, 885 bp, Homo sapiens
  Payload ID: 20130
  Gene Name: zinc finger protein 695
  ENST ID: ENST00000479214
  CDS Start-End: 149-514
tttgtctccttgcggccggcggggtgctgggttcccgtctgctgcctctcggagagtcccgggtgactgccgcaggctccatcgccctgtggcctgcaggtattgcgagatttatagggaggacgctgggacccccaaaagctgggaaatgggactattggcattcagggatgtggctctagaattctctccagaggagtgggaatgcctggacccagctcagcggagtttgtatagggatgtgatgttagagaactacagaaacctgatctcccttggtcttgctatgtctaagccagaactgatcatctgtctggaggcaaggaaagagccctggaacgtgaacacagagaagacagccagacactcagttttgtcttcttatcttactgaagacattttgccagagcagggcctgcaagtttcattccaaaaagtgatgctgagaagatatgaaagatgttgtcttgagaaattacgcttaaggaatgactgggaaattgtggccatgtgaagatgtgcttgcttcccctttgccttctgccatgattctaagtttcctgaggcctccccagaagcagaagcatgtaaagcccacagaaccggtccagtcgtcgaccatcgagctgctttgaagaccctgcggaggttccgtcgctgcttgaacacagtgcctggactccctgctccgtgaggcgaatttacaccgggtccagctgcgtcagcccgagttctgaattaaaacatgcctcccacagaatctatttctgatgaatatgaaaggaagattgttcttccatgttggtttttattgagatatctctttttttcccttttcatttggttgtcctaactccatgaatagaaaagaaaatgtattaattc

SEQ ID NO: 203520 - DNA, 2795 bp, Homo sapiens
  Payload ID: 20131
  Gene Name: zinc finger protein 696
  Uniprot ID: Q9H7X3
  ENST ID: ENST00000330143
  CDS Start-End: 410-1534
gtttccggcgcgcgacggggcggggaccgtagcgggtgcagtccagctgctctggacgctgaggccccggcttctcttgctggggtgtcgattcgggagggctgagggcgcggccgagagaacggggcggtcaccgccgccgtggcccgcgcgtcccgcgctctccttgcagtgcaggccccagccgctctcgggcgcggcgtgggggaggcggccctgcaggtgcgtacccggggtccgacacgtgcggggcttcctgcgagctgagtccccgctgcgcgtcttcaggcctttgtaagttgtcaaatttcccaccggcccagctcatcgagcttcttcccagctgtgaacaggagggcctgttccctaattcttgccgaaattgttccaactgctggtgttctgcaagatggagccaggaggagagcccacaggtgctaaagagagcagtaccctgatggagtcccttgcagctgtgaaggctgctttcctggcgcaggccccgagtggcagccggtcagccgaggtgcaggcagctcagagcacggagcctgccgcagaggcaggcgctcccgagggagagggccacagaggggggcctccccgggcgttggggtctcttggcctttgtgaaaaccaggaagccagagagaggcccggaggttcccctcgaggcccggtcacttctgagaaaactggaggacagagtggcctcgagtcagacgtccctccgaacgcaggccccggcgcagagggcgggggcagctggaaggggcggcctttcccgtgcggcgcctgtggccgcagcttcaagtgctcctcggacgcggcaaagcaccggagcatccactcgggggagaaaccgtacgagtgcagcgactgcgggaaggccttcatccacagctcgcacgtggtccggcaccagcgggcgcacagcggggagaggccctacgcgtgcgccgagtgcggcaaggccttcggccagagcttcaacctcctccggcaccagcgcgtgcacacgggcgagaagccctacgcgtgcgccgactgcggcaaggccttcggccagaggtcggacgccgccaagcaccgccgcacccacaccggggagaggctgtacgcgtgcggcgagtgcgggaagcgcttcctgcacagctcgaacgtggtccggcaccggcggacccaccacggggagaacccgtacgagtgccgggagtgcggccaggccttcagccagagctccaacctcctccagcaccagcgcgtgcacacgggggagcggcccttcgcctgccaggactgcggccgcgccttcagccgcagctccttcctccgcgagcaccgccgcatccacaccggggagaagccccaccagtgcggccactgcgggcgcgcgttccgggcgctgtcgggcttcttccggcaccagcgactccacacgggcgagaagccgttccgctgcaccgagtgcggccgcgccttccgcctgagcttccacctcatccagcaccggcgggtgcatggcgccgagtgagccggggctgcggcggaagagatgccggcggcctggtgggcgcgaggccgaggccgggggaggctcctgtccgccccgtgcgcggtgaggaagtaacagccggctgcgcgcctggttctcgggttgcgaaagcctcgccaggcctgcatccgccttggcttgggagcaatcaggagagacagggctcggggaaggcgagcgctgcccgcgggaggcgattcccagaggcggggaggtctcaggggtctgtcccgggccggccgcccgcctctgagactccccgcctcccacggtcagctgctgcggggcagtggccggtgattgaatcggtcattcctccgcaaccaggcctccatcaaaaccctgcatgagatgagggcctcgggcttcgggttggtgaaggcggggtgggggggcagttaggaagggggcgcccagacagggcatggaagcctcgcgtcctcccccgtaccttgcgggtcggtggttcatccatgtatttcaacgccttttcacagccggttcatatggtcccgacttctgtgtgcttagaaaattatggaacttggccgggtgcggtggctcccgcctgtaatcctagcactttgggaggccgaggcgggcggatcacacggtcaagagatcaagaccatcctggccaacatggcaaaacccccatctcgactaaaaatacaaaaaattaattgggcgtggtggcgtgcgcctgtaatctcagctacttgggagcctggggcaggagaatcacttgaacctgggaggcggaggttgcagtgagcggagatctgggcactgtactttagcctgggcgacagagagacccatctcaaaaaaaaaattggaacctgagaagggggtcgtggggtccccggggcccaccgtctgcacttggcatctgaagtcggggtggtcttgtgggactgaccccttaccctgtgggttctgcactagctccgggcaattggtgacagaatcgagttaaattgtaggacatcgcgttggtgtctgagagggagttggagagctggttggtgtggagggaaaggcttacacacatgtgatttcagaagcgttctgtgggtagaggaatcgttttctctttgagactgttatgagtatgtacaaatgttatttcctgtaaaatattttcattttttaaaatgttattttctagatagaaaagtagaagtgtctctttggggagcgtttttgggggcgtatagtaaagctctgtcatcatgaa

SEQ ID NO: 203521 - DNA, 1642 bp, Homo sapiens
  Payload ID: 20131
  Gene Name: zinc finger protein 696
  ENST ID: ENST00000518575
  CDS Start-End: 1031-1642
agcggagacgcgagggcggcgtcctgcagggaggcggggggcagcgcctggggcgctccaagctctcggccccaaggaagcccacgctcgggacccgcgtgctgccacagccccgggggcctggagggtcccgtgagccgagcgggacccgggacaagcgcgggacgccgcggggaacggacgggaacgcgcgtggccgccccacagcgggccttcgacacctcctgacacgtcctgcgggtgcccggtcctcagttggctcgagccggatcccggcgcgccaacggctcgaccttgccccccacgaggcagggcttcctgcccggcaggaaggactcggccggcgcctgcgggcaaccgatgagctgaaggcgccgcggctgggccgtcccgctctcccgccgccgagcgcgctgtcctcccgctgcccagagcgtcgccggaagtgccgagggggcgggccaggggtggagactggcgtttccggcgcgcgacggggcggggaccgtagcgggtgcagtccagctgctctggacgctgaggccccggcttctcttgctggggtgtcgattcgggagggctgagggcgcggccgagagaacggggcggtcaccgccgccgtggcccgcgcgtcccgcgctctccttgcagtgcaggccccagccgctctcgggcgcggcgtgggggaggcggccctgcaggtgcgtacccggggtccgacacgtgcggggcttcctgcgagctgagtccccgctgcgcgtcttcaggcctttgtaagttgtcaaatttcccaccggcccagctcatcgagcttcttcccagctgtgaacaggagggcctgttccctaattcttgccgagacggggtctcactatgttgcccaggctggtcaggaactcttgtaatcagtcagtcctccatcctgagccttttgaagtgctaggattacaactgtgagccacagcacccagccaaattacatttcttaattgcacttgagaaattgttccaactgctggtgttctgcaagatggagccaggaggagagcccacaggtgctaaagagagcagtaccctgatggagtcccttgcagctgtgaaggctgctttcctggcgcaggccccgagtggcagccggtcagccgaggtgcaggcagctcagagcacggagcctgccgcagaggcaggcgctcccgagggagagggccacagaggggggcctccccgggcgttggggtctcttggcctttgtgaaaaccaggaagccagagagaggcccggaggttcccctcgaggcccggtcacttctgagaaaactggaggacagagtggcctcgagtcagacgtccctccgaacgcaggccccggcgcagagggcgggggcagctggaaggggcggcctttcccgtgcggcgcctgtggccgcagcttcaagtgctcctcggacgcggcaaagcaccggagcatccactcgggggagaaaccgtacgagtgcagcgactgcgggaaggccttcatccacagctcgcacgtggtccggcaccagcgggcgcacagcggggagaggccctacgcgtgcgccgagtgcggcaaggccttcggccagagcttcaacctcctccggcaccagcgcgtgcacacg

SEQ ID NO: 203522 - DNA, 576 bp, Homo sapiens
  Payload ID: 20131
  Gene Name: zinc finger protein 696
  ENST ID: ENST00000523891
  CDS Start-End: 240-576
gaaagcggcacagggaacagcatgacacgggcctgaggcagggcacatttggaaaggggcgaggagagggcagtggcttctggcacggcagcagtgggcatacagaggcagtcgggacccgtctggaagagcctccgcccgggcattccagctggagatgcgtgaccttcggtctgcggcaggcggaagggcgagagacttggacaggaggtgcatcttgcccggggaaggctgaacgaatgagagctcggtccctgaaattgttccaactgctggtgttctgcaagatggagccaggaggagagcccacaggtgctaaagagagcagtaccctgatggagtcccttgcagctgtgaaggctgctttcctggcgcaggccccgagtggcagccggtcagccgaggtgcaggcagctcagagcacggagcctgccgcagaggcaggcgctcccgagggagagggccacagaggggggcctccccgggcgttggggtctcttggcctttgtgaaaaccaggaagccagagagaggcccggaggttcccctcgaggcccggtcacttctgagaaaactg

SEQ ID NO: 203523 - DNA, 545 bp, Homo sapiens
  Payload ID: 20131
  Gene Name: zinc finger protein 696
  ENST ID: ENST00000518432
  CDS Start-End: 225-545
gtagcgggtgcagtccagctgctctggacgctgaggccccggcttctcttgctggggtgtcgattcgggagggctgagggcgcggccgagagaacggggcggtcaccgccgccgtggcccgcgcgtcccgcgctctccttgcagtgcaggccccagccgctctcgggcgcggcgtgggggaggcggccctgcagaaattgttccaactgctggtgttctgcaagatggagccaggaggagagcccacaggtgctaaagagagcagtaccctgatggagtcccttgcagctgtgaaggctgctttcctggcgcaggccccgagtggcagccggtcagccgaggtgcaggcagctcagagcacggagcctgccgcagaggcaggcgctcccgagggagagggccacagaggggggcctccccgggcgttggggtctcttggcctttgtgaaaaccaggaagccagagagaggcccggaggttcccctcgaggcccggtcacttctgagaaaactggaggacagagtggcctcgagtcagacgtccct

SEQ ID NO: 203524 - DNA, 705 bp, Homo sapiens
  Payload ID: 20131
  Gene Name: zinc finger protein 696
  ENST ID: ENST00000521537
  CDS Start-End: 395-508
cggggcggggaccgtagcgggtgcagtccagctgctctggacgctgaggccccggcttctcttgctggggtgtcgattcgggagggctgagggcgcggccgagagaacggggcggtcaccgccgccgtggcccgcgcgtcccgcgctctccttgcagtgcaggccccagccgctctcgggcgcggcgtgggggaggcggccctgcaggtgcgtacccggggtccgacacgtgcggggcttcctgcgagctgagtccccgctgcgcgtcttcaggcctttgtaagttgtcaaatttcccaccggcccagctcatcgagcttcttcccagctgtgaacaggagggcctgttccctaattcttgccgaaattgttccaactgctggtgttctgcaagatggagccaggaggagagcccacaggtgctaaagagagcagtaccctgatggagtcccttgcaggtgaggggacatgtccacagtcgggcccagagttccagggcaggaattgaacaggaatacaggaaaaacaccatgtctcagtcactgacgcagagcatatactgtgtccttgggcgcagggtgagggagggaggtaaacgcaggcccatcagatctcctgggcatctgtttggtgactgtctttgccagtgaactgagagcttttggttagaaagtctggcagccccaggctctgcctctgggaagg

SEQ ID NO: 203525 - DNA, 605 bp, Homo sapiens
  Payload ID: 20131
  Gene Name: zinc finger protein 696
  ENST ID: ENST00000520333
  CDS Start-End: 377-538
gggtgcagtccagctgctctggacgctgaggccccggcttctcttgctggggtgtcgattcgggagggctgagggcgcggccgagagaacggggcggtcaccgccgccgtggcccgcgcgtcccgcgctctccttgcagtgcaggccccagccgctctcgggcgcggcgtgggggaggcggccctgcaggtgcgtacccggggtccgacacgtgcggggcttcctgcgagctgagtccccgctgcgcgtcttcaggcctttgtaagttgtcaaatttcccaccggcccagctcatcgagcttcttcccagctgtgaacaggagggcctgttccctaattcttgccgaaattgttccaactgctggtgttctgcaagatggagccaggaggagagcccacaggtgctaaagagagcagtaccctgatggagtcccttgcagagacaggatctcactatgttggccaggctggtcttgaactccaagtctcaagtggtcctcctgcctcagcctctgaaagtgcggagatacagctgtgaaggctgctttcctggcgcaggccccgagtggcagccggtcagccgaggtgcaggcagctcagagcac

SEQ ID NO: 203526 - DNA, 5041 bp, Homo sapiens
  Payload ID: 20132
  Gene Name: zinc finger protein 697
  Uniprot ID: Q5TEC3
  ENST ID: ENST00000421812
  CDS Start-End: 121-1758
accgtcccgccgaccaccgaagggggcatcagagaccctcggagaaaccaagcccagggaggagcttggaaggcaaggagaagggattcctggtcacctcccttgctcttttcttcctggatgaaacaagaagataatcagggtgtctgtgcacaccaggactcagaagacaaagggatgggttctgattttgaggactctgaggacagggaaggggacccagaagaaagagaaatgggctctaatccacatgacacaaacaagagagaaggccatccggagccggagatgggctccaacccacaggactcaaggcacagggaagcagtgcccgacatctgcacagaggggcagctgagtgaggaagaaggcgtttctgtccgtggggaagaggatgaccaatccggtgtagctgacatggcgatgttcccaggactgtctgagtctgacagcatatcccggagcctccgggaggacgacgacgagagtgctggggagaaccggctggaggaggaagaggagcagccggcccctcccgtacttccctggaggcgacatctctccctggggagtcggcaccgaggtgacaagcccgcccaccgccgcttccaccggctccaccaccccatggccgtggacctcggggagctggatagcctggtggccagcatcatggacgcgcccaccatctgccccgactgcggggagagcttcagtcctggcgccgccttcctgcagcaccagcgcattcaccgcctggctgaggccgctgccgccgccagcctggagcccttcggcctggcgggcgagtgcgacgcgatggtgggcatgatgggggtgggtgtggcggggggcttcggggccgggcccccgctggcccggcccccgcgcgaaaagcccttccgctgcggggagtgcggcaagggcttcagccgcaacacctacctgaccaaccacctgcgcctgcacacgggcgagcggcccaacctgtgcgccgactgcggcaagagcttcagctggcgcgccgacctgctcaagcaccggcgcctgcacacgggcgagaagccctacccgtgccccgagtgcggcgaggccttcagcctcagctcgcatctgttgagccaccggcgcgcgcacgcggcggccagcggcgcgggggcggcggcgctgcggcccttcgcctgcggggagtgcggcaagggcttcgtgcgccgttcgcacctggccaaccaccagcgcatccacacgggcgagaagccgcacggctgtggcgagtgcggcaagcgcttcagctggcgctcggacttggtgaagcaccagcgcgtgcacacgggcgagaagccctacatgtgctccgagtgcggcgagaccttcagcgtcagctcgcacctcttcacgcacaagcgcacgcactcgggtgagcggccctacgtgtgccgcgagtgcgggaagggcttcgggcgtaactcgcacctggtgaaccacctgcgcgtgcacaccggcgagaagcccttccgctgtggccagtgcgagaagcgcttcagcgacttctccacgctcacgcagcaccagcgcacgcacacgggcgagaagccctacacgtgcatcgagtgcggcaagagctttatccagagctcccacctgatccgccaccgccgcatccacacgggcaacaagccgcacaagtgtgcgggctgcggcaaaggcttccgctataaaacgcacctcgcgcagcaccagaagctgcacctgtgttaggggctgggtccgcgggaggctgccgtctggggagcctgtggggggtagatatcctgggactgacccaggggaaggaagtggggaaggggcgggagggacaatctgagagtgactggggagcctttggtgtttggggtttcctgaagtgggaggagtgttgagtaagttggtctttcccggtgctatacttgcctcctctccacggaagaattgttcaggagatgcgcttggggtgatgacttccttaaatacacgctgtagggggtgaagagcttggaggaccaggcactttgaggaagggcagttcgtgggctggggtgggaacaggatggcgggcaatagactagggtaggccgcgatggcctgtagaaggttgcggggagagggtttaaatgagggttatggggcgaaataaaaccaagtataagtgattctatcttggtcccaccaagagtttgcccgatctccacacatcacctgttgtctcacaaaaagtaggggaaccttgtcagtcacataggacaggatatttaatgtacttttcctttctctgagccacagttagctgctattttgaggcatccaaggggaagtgggctgaaaaacgccacactcatttcaaggggcaatgtctggggtttagaaattcatttataactggttctctgatgtgggaaatcctgattctgtcccgggttctttgctacttccttgaaaatactctagcttcatgctgggtcaaggtggtttacctggatgacccccctcccccgccctcgcccatcccaggtgtgtgccacacccagtatttctttcaggtctcaactgtggtgttttaagtgcagggaaaaggaacaatcacagctatgtgtgactttccttttcccacctcaccttgatgtaggtgtttcaagtgaactttagaccaacagttgcccagtgacctgctaaaaagtcaactagctcagagttttgctggcctttatgtgagaaatccaagaaagtgttcacttttttgggatgcgagactccttggtctcatttgccttcactttgcatttgttagtgacctccactaacccccacttccatgcatattgacgagggatctagtctaagtaagaatgtcttttgcctgcgcgtggaggcacagtagaaatctcaaggctttacccagaagagcccagtcagggagaggtgtaaatgcaaaattgccaaatagcacaaacaatgaatgttttctggttgttatatagatgccaaaatagcactttgatatttgcaaagtgctttatgctttttaataattgttagctgtttctcacatcattgtgagttagatcagtattatgaccgctgtcttagggaaggcctgggaacaggagtgtgcaggctgtcctgaagagaggctgaggacagtgtgaataattgtagcctgaccttttgcattctccagctcagctgctaggaagacttacttgtcatgatttatataataaaattaaggacactgaaaattcttatgcttgatgaaaaacttaaggctagcctagaagggccaaacatgtccttattgacaaagctggtctttgtcgcctaattagggtatcctagctatgttccatttctagtaaggggctgtagttagatgactcttgtatagatttcagttacttatgctgaagatccctgtgctaggttagcctttagaagttagagttgtggaaagcagtattgttttcttctctagtgattgttaccctacacatttcatggaagcatcttcacaaaatatcagacacagtggaagggggaaaaaaagctacgagattgtttttacacttttagcaaagtttctgtggatgctagtaatttatacttgatcagttgtattctagtaaagaacctctttggggactgtaggaaagcatgtttttgtggttataaaaacacttaaaaatcctgataattctgggcttgtataatgcctgttgatcttgccctcttaatcagtttattgttattcacaaatgcaaataggttttcaaactacagacagttttgaaagacattaattctcattttcttctagtcaggagtaatacaagcaaacaagtgtccgttttgaattctgatttgtaatctgaatactaaacatattagacccacctgaaaataatatagccaatttctaggtaatcttactgctttgtgggtttctttccatgtacatctacctcttccagctgttttaagttttctcaagtctgtgcctatgaaatctcatccaacttttgattattcatggattgattatccgctttttttttgcttttttgctgccattgctatgcctggtctcgtctgcatcaaatatactacatatcagcaactttagagaatgggttcaacagggagtggagagtgaagctaatgtaaaatagtttagtggcagtgggaatctttggacttcatttacctctctcattatttctattaccatggataaaaaagtcagctgctacgttgatatcccttctatgagcacattcttagcagaagaaaacaatccaactaccaacacccgactctattggtgcatttaaaatgtgattccattttttcttacaattcttcagggaacttacctgcattaagtgaggttaaatgcattcaggaggttgtttgtttcttctatctagttttagaataatatttcttcggcaaaccctgctaactgcggttcacccttgaaaacgttaatctgaggactttttccaccaactcattaatgatggtggaagcaagtgtattatttgtttcctggagaatttgatgaagagcagtcttcctctgctgccctttactaagcaaaacctggagcaatttaaataggctaaatggttttgattaaatcttgagctccgagttggaaggagaaaatgagaagttaaccccttgagccatgtggtctctttacaatcaagagactgtacatatgtgaaaaaatacaaattaaggacctgtgttcatagacaatctaaactgtgtttctgaagtttgtgcacatttttcttcactgtaatgttattttacagctgtttgttaaaatagtgaataatttaatgatcctaaaagtaacaggtttcgtgtgagtgtgcttgtatacgtgagatttgccttattttcaggttgttttatttaacgatggttccttggacagcattctggtgttcagcaaccaatatggaatatttgtcattaaatccatatcagtctttta

SEQ ID NO: 203527 - DNA, 2094 bp, Homo sapiens
  Payload ID: 20133
  Gene Name: zinc finger protein 699
  Uniprot ID: Q32M78
  ENST ID: ENST00000308650
  CDS Start-End: 1-1929
atggaggaagaaagaaaaactgctgagttacagaaaaatagaatacaggactcagtagtctttgaggatgtggctgtggactttacccaggaggaatgggctttgctggatcttgctcagagaaacctctacagagatgtgatgctggaaaacttccagaacctggcctcactagggtatccgctacacacaccccatctgatctcccagtgggaacaagaggaggacctgcagacagtgaagagagaacttatccagggcatctttatgggagagcaccgggaaggttttgagactcaacttaaaactaatgaatcagttgcttcacaagatatttgtggagaaaaaatatccaatgaacagaaaatagtaagattcaaaaggaatgattcctggttctccagtttacatgaaaaccaggagtcctgtggtattgattatcagaacaaaagccatgagagacatttgagaaatcatatggtagagaacatctatgaatgttatgaagaaaatcaagatggacagactttcagccaagttccaaatcttgattcactcaagagaaatactgaagtaaaatcctgtgaatgccatgagtgtggaaaggccttcgtggatcattcatcccttaagagtcacatcaggtctcatactggaagcaaaccctatcagtgcaaggaatgtgggaaggccttccattttcttgcttgtttcaagaagcatatgaaaacccccactgaagagaagccctatgaatgtaaggaatgtaccaaagccttcagctgttcctcattctttagggcacatatgaagattcacatcggaaagacaaactatgaatgtaaagaatgtgggaaaggttttagttgttcctcatcgctcacagaacacaaaagaattcacagtggagataagccttatgaatgtaaggaatgtgggaaggccttcagttgttcctcctcactctccaaacacaaaagaattcacagtggagataagccatatgaatgtaaggaatgtgggaaggcctttagctcttcctctcaccttataatacatataagaattcacactggagagaagccttatgaatgtaaagagtgtgggaaggccttcagcgagtcctcaaaactcactgtacatgggaggacacatactggagagaaaccctataaatgtaaggaatgtgggaaagcctacaattgtccctcctccttaagtatccatatgagaaaacacactggagaaaaaccgtatgaatgtctggaatgtggaaaggccttctaccttcccacttcccttaatacacatgtgaaaaatcaaagtcgagagaaaccctatgaatgtaaggaatgtgggaaggcctttagttgtccctcgtcctttagagcacatgtgagagatcacactggaaagatacagtatgaatgtaaggagtgtgggaagacctttagtcgttcctcatccctcaccgaacacctaagaactcacagcggagagaagccgtatgaatgtaaagaatgtgggaaagcctttattagttcctcccaccttacagtacatatcagaactcacactggagagaaaccctatgaatgtaagaaatgtgggaaagcctttatttatccctcagcccttaggatccacatgagaacgcacactggggaaaaaccctatgaatgtaaggaatgtgggaaagcatttcgtcattcttcataccttactgtacatgcaagaatgcacactggagagaaaccctttgaatgtctggaatgtggaaaagctttcagttgtccctcatcctttcgaaggcatgtgagaagccacactggagagaaaccctatgaatgtaaggaatgtgggaaagcctttgtttgtcctgcctactttcgaaggcatgtgaaaactcacactagagaaaacatataaatgtaaggaatatgggaatgtctgcaaagcttcagatcctaggcaacatgtgagatctcatactgtggagacaccctatgaatgtaagaaagtaggaaattgttgctcatcgttttgaagatttgaggacactttagagaaaccctgtgtatgtaagtcatgtgc

SEQ ID NO: 203528 - DNA, 3358 bp, Homo sapiens
  Payload ID: 20133
  Gene Name: zinc finger protein 699
  Uniprot ID: Q32M78
  ENST ID: ENST00000591998
  CDS Start-End: 230-2158
gctggtcccaaactcactgaatcgggaactctggtctgggtacagaaatcggggtgattctgatgcaggcgagagttggagaaccaatgtcgtagttcatcagcctccgaaagcatcctttgctctctttccagaaaggaagagcatctctgccattcgtgtctcaaggacaagcgcttcagcctcgttctctgtgagctgatctgtggatcgcggcgtgtcgggcgacatggaggaagaaagaaaaactgctgagttacagaaaaatagaatacaggactcagtagtctttgaggatgtggctgtggactttacccaggaggaatgggctttgctggatcttgctcagagaaacctctacagagatgtgatgctggaaaacttccagaacctggcctcactagggtatccgctacacacaccccatctgatctcccagtgggaacaagaggaggacctgcagacagtgaagagagaacttatccagggcatctttatgggagagcaccgggaaggttttgagactcaacttaaaactaatgaatcagttgcttcacaagatatttgtggagaaaaaatatccaatgaacagaaaatagtaagattcaaaaggaatgattcctggttctccagtttacatgaaaaccaggagtcctgtggtattgattatcagaacaaaagccatgagagacatttgagaaatcatatggtagagaacatctatgaatgttatgaagaaaatcaagatggacagactttcagccaagttccaaatcttgattcactcaagagaaatactgaagtaaaatcctgtgaatgccatgagtgtggaaaggccttcgtggatcattcatcccttaagagtcacatcaggtctcatactggaagcaaaccctatcagtgcaaggaatgtgggaaggccttccattttcttgcttgtttcaagaagcatatgaaaacccccactgaagagaagccctatgaatgtaaggaatgtaccaaagccttcagctgttcctcattctttagggcacatatgaagattcacatcggaaagacaaactatgaatgtaaagaatgtgggaaaggttttagttgttcctcatcgctcacagaacacaaaagaattcacagtggagataagccttatgaatgtaaggaatgtgggaaggccttcagttgttcctcctcactctccaaacacaaaagaattcacagtggagataagccatatgaatgtaaggaatgtgggaaggcctttagctcttcctctcaccttataatacatataagaattcacactggagagaagccttatgaatgtaaagagtgtgggaaggccttcagcgagtcctcaaaactcactgtacatgggaggacacatactggagagaaaccctataaatgtaaggaatgtgggaaagcctacaattgtccctcctccttaagtatccatatgagaaaacacactggagaaaaaccgtatgaatgtctggaatgtggaaaggccttctaccttcccacttcccttaatacacatgtgaaaaatcaaagtcgagagaaaccctatgaatgtaaggaatgtgggaaggcctttagttgtccctcgtcctttagagcacatgtgagagatcacactggaaagatacagtatgaatgtaaggagtgtgggaagacctttagtcgttcctcatccctcaccgaacacctaagaactcacagcggagagaagccgtatgaatgtaaagaatgtgggaaagcctttattagttcctcccaccttacagtacatatcagaactcacactggagagaaaccctatgaatgtaagaaatgtgggaaagcctttatttatccctcagcccttaggatccacatgagaacgcacactggggaaaaaccctatgaatgtaaggaatgtgggaaagcatttcgtcattcttcataccttactgtacatgcaagaatgcacactggagagaaaccctttgaatgtctggaatgtggaaaagctttcagttgtccctcatcctttcgaaggcatgtgagaagccacactggagagaaaccctatgaatgtaaggaatgtgggaaagcctttgtttgtcctgcctactttcgaaggcatgtgaaaactcacactagagaaaacatataaatgtaaggaatatgggaatgtctgcaaagcttcagatcctaggcaacatgtgagatctcatactgtggagacaccctatgaatgtaagaaagtaggaaattgttgctcatcgttttgaagatttgaggacactttagagaaaccctgtgtatgtaagtcatgtgctaaagcctttatgaacattgcttattatgtataagaaaatctctactagaaatgaagatcagtgcctcatccttaaagtagaatgctggctcgttgattaccagtgttttctgataggaacattgaaggtgataaatttaccttttcagctctagccacatactttttagtatgaggtgctttaattttggttctgatgtaaatatgatttccattacaaaatcttttggatcatggaggacacgaaatattttttctgtataggcagcagtggtcttttttaaaaaagtggtttctaattaatgttcattgttctttaaatgggtagtcgttataatattgacaaaccaatataatattgacaaaccaaaaaccaaatattgatttttgttgatgttttgtttttagtctacatggcagataatggaacttgcccactcaatatttttcttcctattcttttttgctaagagacgttagagtttctgagatgataaatttttactattaaaagcttttattgtctagtgagtaatttcagcagaaattaatttaatatactatttttatattttattctttgtccttgctcgtggctgggaattggatccagtgttttgagtgtaaaaattgtgttacattaactacatttcccagaatcacttttttctccagttctaggttagacttgtctaaaataagagtttgtacgagatttggaaggcataagggaagaaaaagctgttatgctatgtttagtggggccatcagacagagagacagatgtataaaggcctggtgacctctagttttcagctcatttttctgactgttggactcattgatcaatatttgctcaaaactgaatgttatagctggacgtgatggtgcatacctgtggtcccagctactcagggagctgaggctggaggatcacttgagcccaggagtttgaggctgcagtgaactatgatcatgccactgcactccagcctgagtgatagagtgagaccctttctcaaaaacaaaacaaaa

SEQ ID NO: 203529 - DNA, 592 bp, Homo sapiens
  Payload ID: 20134
  Gene Name: zinc finger protein 7
  ENST ID: ENST00000325217
  CDS Start-End: 96-575
gtttccggcggcgtcgcgcgtttgcgagcctcgggtggtcctcagggagggtctctcggccagaacacgtggatgcccacccaccactgagcctcatgggattcctggggtgctggtgtgtgtcctttcaggaggtggtaacatttggcgatgtggctgtgcacttctctcgggaggagtggcagtgtctggaccctggccagagggccctctacagggaagtgatgctggagaaccacagcagtgtggctggactagcaggattcctggttttcaagcctgagctgatctctcggctggagcagggagaagagccatgggtcctcgacctgcagggagcagaggggacagaggcaccaaggacctccaagacaggctttctgggccgcccaaccatgggacaagagccaaggcacccacatgcaccgcctgcaactcctgttcctggccttccaaaacactgctcacaaagactgaccctgcctcctcctgggctctcgtcatctcctcttggccacttcctggttcatgatcaggacagaaggaggggaacgtcagccatatggatggtctgaaaattccagattctgtg

SEQ ID NO: 203530 - DNA, 2242 bp, Homo sapiens
  Payload ID: 20134
  Gene Name: zinc finger protein 7
  Uniprot ID: P17097
  ENST ID: ENST00000446747
  CDS Start-End: 97-2190
cgtttccggcggcgtcgcgcgtttgcgagcctcgggtggtcctcagggagggtctctcggccagaacacgtggatgcccacccaccactgagcctcatgggattcctggggtgctggtgtgtgtcctttcaggaggtggtaacatttggcgatgtggctgtgcacttctctcgggaggagtggcagtgtctggaccctggccagagggccctctacagggaagtgatgctggagaaccacagcagtgtggctggactagcaggattcctggttttcaagcctgagctgatctctcggctggagcagggagaagagccatgggtcctcgacctgcagggagcagaggggacagaggcaccaaggacctccaagacagattctacgattaggactgaaaatgagcaggcctgtgaggacatggacatcctaaaatcagaatcctatgggacagtggtcagaatctccccacaggactttcctcagaatcctggctttggagacgtttctgattctgaggtctggttagacagtcatctgggcagtcccgggctgaaagtgacaggctttaccttccaaaataactgtttgaatgaggagactgtggttcccaagaccttcaccaaggacgcaccccagggatgtaaggagctgggaagcagcggcctggattgtcagcctcttgaaagtcagggagagagtgcggaagggatgtcccagagatgcgaggagtgtggcaaaggcatcagagccacttcagatatcgctctgcattgggaaattaatacacagaaaattagcagatgtcaagaatgccaaaaaaagttatctgactgcttgcaggggaaacatacaaataactgccatggagagaagccgtacgaatgtgcagagtgtgggaaagtcttcaggctctgctcgcagcttaatcagcatcagagaatccacacgggagagaaaccctttaaatgcactgagtgtggaaaagccttccgcctgagctcaaaacttattcagcatcaaagaatccacactggggagaagccctacagatgtgaggaatgtggaaaagcttttggtcagagctcaagcctcatccaccatcagagaatccacacaggagagaggccctatggttgtcgtgagtgtgggaaagccttcagccagcagtcgcagctggttagacaccagagaactcacactggggagaggccctacccttgcaaggagtgtgggaaggccttcagccagagctccaccctagcccagcatcaaaggatgcatactggggagaaagctcaaattctaaaagcctcagacagtccaagccttgttgcacatcagagaattcacgctgtagagaaaccatttaagtgtgatgagtgtgggaaagcttttaggtggatctctcgcctgagtcagcatcagctgattcacactggagagaagccttataaatgcaacaagtgtacaaaagcctttggttgtagttcacggcttattcgccatcagagaactcacactggagaaaaaccatttaaatgtgatgagtgtggcaaaggctttgttcagggctcacaccttattcagcatcagcgaatccacactggagagaaaccctatgtgtgtaatgactgtggaaaagccttcagtcagagttccagccttatttaccatcagagaatccataaaggagagaagccctacgaatgcctccaatgcggaaaagccttcagtatgagcacacagcttacaatacatcaaagggttcacactggagagaggccctataaatgtaatgaatgtgggaaagccttcagtcaaaactcaacccttttccaacaccagataattcatgcaggggtgaagccctatgagtgcagtgagtgtggaaaagccttcagccggagctcatatcttattgaacaccagagaatacacactagggcccagtggttttacgaatatgggaatgccctggaagggtccacctttgtgagccgtaaaaaggttaatactataaagaaactgcatcagtgtgaagactgtgagaagatatttaggtggcgttcacacctaattatacaccagagaattcacaccggggagaagccttataaatgcaatgactgtggcaaagcttttaatcgtagctcaaggcttacccagcatcaaaaaattcacatgggatagaccacttacatataaatgtgtatatatgtgaataaacctatagccttaactt

SEQ ID NO: 203531 - DNA, 915 bp, Homo sapiens
  Payload ID: 20134
  Gene Name: zinc finger protein 7
  ENST ID: ENST00000532777
  CDS Start-End: 192-915
aggcggggctgagaaccacagagatggccgggcctccgagcggcccagggcggccggaagtttgcggggcggggcggacgcgggtggccaaggcccgtttccggcggcgtcgcgcgtttgcgagcctcgggtggtcctcagggagggtctctcggccagaacacgtggatgcccacccaccactgagcctcatggaggtggtaacatttggcgatgtggctgtgcacttctctcgggaggagtggcagtgtctggaccctggccagagggccctctacagggaagtgatgctggagaaccacagcagtgtggctggactagcaggattcctggttttcaagcctgagctgatctctcggctggagcagggagaagagccatgggtcctcgacctgcagggagcagaggggacagaggcaccaaggacctccaagacagattctacgattaggactgaaaatgagcaggcctgtgaggacatggacatcctaaaatcagaatcctatgggacagtggtcagaatctccccacaggactttcctcagaatcctggctttggagacgtttctgattctgaggtctggttagacagtcatctgggcagtcccgggctgaaagtgacaggctttaccttccaaaataactgtttgaatgaggagactgtggttcccaagaccttcaccaaggacgcaccccagggatgtaaggagctgggaagcagcggcctggattgtcagcctcttgaaagtcagggagagagtgcggaagggatgtcccagagatgcgaggagtgtggcaaaggcatcagagccacttcagatatcgctctgcattgggaaattaatacacagaaaattagcagatgtcaagaatgccaaaaaaagttatctgactgcttgcaggggaaacatacaa

SEQ ID NO: 203532 - DNA, 2905 bp, Homo sapiens
  Payload ID: 20134
  Gene Name: zinc finger protein 7
  Uniprot ID: P17097
  ENST ID: ENST00000528372
  CDS Start-End: 241-2301
gcgcggcgggcgcggactcgggttgccctcggtccgagtgatccctggtcgcttccttagccctcccgccttcggcattggggtccccgcgtcccccgggcctccaggcgggaaagcgcgggggctttgcggggccttgagcgcctggtgtgggaggtggtcgagcccagccaccctcccccgcggcggcgcgaggtctctcggccagaacacgtggatgcccacccaccactgagcctcatggaggtggtaacatttggcgatgtggctgtgcacttctctcgggaggagtggcagtgtctggaccctggccagagggccctctacagggaagtgatgctggagaaccacagcagtgtggctggactagcaggattcctggttttcaagcctgagctgatctctcggctggagcagggagaagagccatgggtcctcgacctgcagggagcagaggggacagaggcaccaaggacctccaagacagattctacgattaggactgaaaatgagcaggcctgtgaggacatggacatcctaaaatcagaatcctatgggacagtggtcagaatctccccacaggactttcctcagaatcctggctttggagacgtttctgattctgaggtctggttagacagtcatctgggcagtcccgggctgaaagtgacaggctttaccttccaaaataactgtttgaatgaggagactgtggttcccaagaccttcaccaaggacgcaccccagggatgtaaggagctgggaagcagcggcctggattgtcagcctcttgaaagtcagggagagagtgcggaagggatgtcccagagatgcgaggagtgtggcaaaggcatcagagccacttcagatatcgctctgcattgggaaattaatacacagaaaattagcagatgtcaagaatgccaaaaaaagttatctgactgcttgcaggggaaacatacaaataactgccatggagagaagccgtacgaatgtgcagagtgtgggaaagtcttcaggctctgctcgcagcttaatcagcatcagagaatccacacgggagagaaaccctttaaatgcactgagtgtggaaaagccttccgcctgagctcaaaacttattcagcatcaaagaatccacactggggagaagccctacagatgtgaggaatgtggaaaagcttttggtcagagctcaagcctcatccaccatcagagaatccacacaggagagaggccctatggttgtcgtgagtgtgggaaagccttcagccagcagtcgcagctggttagacaccagagaactcacactggggagaggccctacccttgcaaggagtgtgggaaggccttcagccagagctccaccctagcccagcatcaaaggatgcatactggggagaaagctcaaattctaaaagcctcagacagtccaagccttgttgcacatcagagaattcacgctgtagagaaaccatttaagtgtgatgagtgtgggaaagcttttaggtggatctctcgcctgagtcagcatcagctgattcacactggagagaagccttataaatgcaacaagtgtacaaaagcctttggttgtagttcacggcttattcgccatcagagaactcacactggagaaaaaccatttaaatgtgatgagtgtggcaaaggctttgttcagggctcacaccttattcagcatcagcgaatccacactggagagaaaccctatgtgtgtaatgactgtggaaaagccttcagtcagagttccagccttatttaccatcagagaatccataaaggagagaagccctacgaatgcctccaatgcggaaaagccttcagtatgagcacacagcttacaatacatcaaagggttcacactggagagaggccctataaatgtaatgaatgtgggaaagccttcagtcaaaactcaacccttttccaacaccagataattcatgcaggggtgaagccctatgagtgcagtgagtgtggaaaagccttcagccggagctcatatcttattgaacaccagagaatacacactagggcccagtggttttacgaatatgggaatgccctggaagggtccacctttgtgagccgtaaaaaggttaatactataaagaaactgcatcagtgtgaagactgtgagaagatatttaggtggcgttcacacctaattatacaccagagaattcacaccggggagaagccttataaatgcaatgactgtggcaaagcttttaatcgtagctcaaggcttacccagcatcaaaaaattcacatgggatagaccacttacatataaatgtgtatatatgtgaataaacctatagccttaacttacttattttatatggaatcgtttatactgacaaacatgtagaatgttggtaaaggttcagaattgctctcaagaatatccaacttcaggccgagtgtggtggcttatgcctgtcatcccagcactttgggaggccaaggcgggcacatcacgaggtcaggaggttgagaccatcctgggtaacaggtgaaaccccatctctactaaaaatacaaaaatttagctgggcgtggtggcaggcacctgtggtcccagctgctcgggaggctgaggcaggagaatggcatcagcccaggaggcggagcttgcagtgagctgagatcgcgccactgcactccagcctgggtgacagagtgagactccctctcaaaaaaaaaaaaaaaaaaaaaaatccaacttcatacaaaatgtatgtttatttcctgaaatgtttgaccttaacctgttcaataaagcctgtgtccctcaaaatcagggtgcagtctgcagttttgagttgacaggtccctgtgaatgaggaagcagcacaaggagggctctacgagcgctgcta

SEQ ID NO: 203533 - DNA, 1134 bp, Homo sapiens
  Payload ID: 20134
  Gene Name: zinc finger protein 7
  ENST ID: ENST00000528130
  CDS Start-End: 47-451
ggtctctcggccagaacacgtggatgcccacccaccactgagcctcatggaggtggtaacatttggcgatgtggctgtgcacttctctcgggaggagtggcagtgtctggaccctggccagagggccctctacagggaagtgatgctggagaaccacagcagtgtggctggactagcaggattcctggttttcaagcctgagctgatctctcggctggagcagggagaagagccatgggtcctcgacctgcagggagcagaggggacagaggcaccaaggacctccaagacagctgtggaggccggaaatctgaaaccggggggtcagcaagcagggccgtgcccccctgtgaaggctttagggaaggatcctgtcctgcctctccgggcagctggtggttttctggcagtccttgggttccttggcttgtggatgcgtccctcactctgatctccgactccttcacacggctgccttctccctgcgtgtctgtgttcatgtggccatctccttagaaggacaccagtcatggtgggttaggggccaccccagtgacctcatggtgactaattaatctgcaacgactgtgtttccaaacaaggtcacattctgaggtgcttcaagttaggacttcagcctatcttggggtcctcagccctaaccagggcacccactgcctccggcatcagctcctgctgggcaggcgcccggcctggtgctctgctcccctgcttagccggtgtgctgcccagcatgacaagggagatgggtctgcgtgcatctcagctgcagaaaggaagcccctcacctccctttcagttgctgctgggtcatcaccgtcactcctgcagcagggcaggaccaggtcctacagaggccaccggcttgtaggggcctcgggaagcaagttggacagtccaaagttgtgaaaagtaggggccgtggagccgggcatggtggctcacgccggccattctagcgatttgggaggccgaggtgggcggatcacgaggtcaggagatcgagaccatcctggccaacacggtgaaaccctgtgtctactaaaaatacaaaaaattaaccaggcgtggtggcaggcgcctgtagtcccagctactcgggaggccgaggca

SEQ ID NO: 203534 - DNA, 516 bp, Homo sapiens
  Payload ID: 20134
  Gene Name: zinc finger protein 7
  ENST ID: ENST00000533314
  CDS Start-End: 77-516
gtttgcgagcctcgggtggtcctcagggagggtctctcggccagaacacgtggatgcccacccaccactgagcctcatggaggtggtaacatttggcgatgtggctgtgcacttctctcgggaggagtggcagtgtctggaccctggccagagggccctctacagggaagtgatgctggagaaccacagcagtgtggctggactagcttttagtgaccccactctctggtttggttatctgtgtccatgctttccacgtgatggcaacctgtgggcctggccatctagaggtgctgcagcttttccaggattcctggttttcaagcctgagctgatctctcggctggagcagggagaagagccatgggtcctcgacctgcagggagcagaggggacagaggcaccaaggacctccaagacagattctacgattaggactgaaaatgagcaggcctgtgaggacatggacatcctaaaatcagaatcctatgggacagtggtcagaatctccccaca

SEQ ID NO: 203535 - DNA, 545 bp, Homo sapiens
  Payload ID: 20134
  Gene Name: zinc finger protein 7
  ENST ID: ENST00000527218
  CDS Start-End: 77-545
gtttgcgagcctcgggtggtcctcagggagggtctctcggccagaacacgtggatgcccacccaccactgagcctcatggaggtggtaacatttggcgatgtggctgtgcacttctctcgggaggagtggcagtgtctggaccctggccagagggccctctacagggaagtgatgctggagaaccacagcagtgtggctggactaggattcctggttttcaagcctgagctgatctctcggctggagcagggagaagagccatgggtcctcgacctgcagggagcagaggggacagaggcaccaaggacctccaagacagattctacgattaggactgaaaatgagcaggcctgtgaggacatggacatcctaaaatcagaatcctatgggacagtggtcagaatctccccacaggactttcctcagaatcctggctttggagacgtttctgattctgaggtctggttagacagtcatctgggcagtcccgggctgaaagtgacaggctttaccttccaaaataactgtttgaatgaggagactg

SEQ ID NO: 203536 - DNA, 1874 bp, Homo sapiens
  Payload ID: 20134
  Gene Name: zinc finger protein 7
  Uniprot ID: P17097
  ENST ID: ENST00000525266
  CDS Start-End: 97-543
cgtttccggcggcgtcgcgcgtttgcgagcctcgggtggtcctcagggagggtctctcggccagaacacgtggatgcccacccaccactgagcctcatggaggtggtaacatttggcgatgtggctgtgcacttctctcgggaggagtggcagtgtctggaccctggccagagggccctctacagggaagtgatgctggagaaccacagcagtgtggctggactagcaggattcctggttttcaagcctgagctgatctctcggctggagcagggagaagagccatgggtcctcgacctgcagggagcagaggggacagaggcaccaaggacctccaagacaggctttctgggccgcccaaccatgggacaagagccaaggcacccacatgcaccgcctgcaactcctgttcctggccttccaaaacactgctcacaaagactgaccctgcctcctcctgggctctcgtcatctcctcttggccacttcctggttcatgatcaggacagaaggaggggaacgtcagccatatggatggtctgaaaattccagattctgtgctaaccataatgctgtgttcttttcactaacagcaaccagccaaaaaggggctggggtgcaagcttcattctgcttcagcacctggattctctctggattgacatggtcctaagtcaggggctggcaaaccattcgtagctttttacatttctgaatggttggggagaaaataagagacttgtgacatttgaaaactatgttaaaatcgaatttgactgtgcacagtgtccctgggcttggtgatgcccaagcgtcttcatggagcctctggcggctttcttgctgcagcagtgtttaccacaccagccaagtcaccttgaacttggaaaatgacttcatgccctccagccactgaaggattatttttcctctcagcccttagtggtttctttacctaaatgtcacggtacaactgagaataaggcagctgggtcagttcaatagaagtaaacctaaagtccaacaatccaggttagatattagccacggagggatgggaggaggagtcttctttttttttgagacggaatctcgctctgtccctcaggctgaagtgcagtggtgcggtctcggctcactgcaagctccgccacctgggttcacgccattctcctgcctcagcctcccgagtagctgggactacaggtgcctgctaccacgcccggctaatttttttgtatttttaatagagacggggtttcactgtgttagccagctggtctcgatcttctgacctcgtgatccgcccgcctcggcctccctaagtgctgggatgacaggcgtgagccaccatgccgagctgaggaggagtcctcttctagctgcacgatgtggaaatgacacatcatgtccatggggcagcttgctgagagccaagggtgtgagcacatgacttaaattcaagctactgcacagctttgagatctgagtatcacatggaagcatccaggtggcccctggcacacaggctggtggttcttttgtggagagggagaggaagaggggctgctcatggggtagtgcaggtgctagaatatcctgttaacctgttcacactgcactgcaattcgggcttcggtaagctcatctaaagagtttccaggccaggcacggtggctcacgcctgtaattccagcactttgagaggccaaggaaggatcacgtgaccccaggagttcggagaccacagtgagctgtgatcgcaccactgcactctagcctgggtgacagagtgaggccctgtctccacaatatataaataaaaacattttgggtttctgttttggagacaataaattaaatctataacctag

SEQ ID NO: 203537 - DNA, 513 bp, Homo sapiens
  Payload ID: 20134
  Gene Name: zinc finger protein 7
  ENST ID: ENST00000529819
  CDS Start-End: 122-382
tttgcgagcctcgggtggtcctcagggagggcctaggataagtgacagtggaggaaggaacggtgccttgggtggggtctctcggccagaacacgtggatgcccacccaccactgagcctcatggaggtggtaacatttggcgatgtggctgtgcacttctctcgggaggagtggcagtgtctggaccctggccagagggccctctacagggaagtgatgctggagaaccacagcagtgtggctggactaggattcctggttttcaagcctgagctgatctctcggctggagcagggagaagagccatgggtcctcgacctgcagggagcagaggggacagaggcaccaaggacctccaagacaggggaaacatacaaataactgccatggagagaagccgtacgaatgtgcagagtgtgggaaagtcttcaggctctgctcgcagcttaatcagcatcagagaatccacacgggagagaaaccctttaaatgcactgagtgtggaaaagcct

SEQ ID NO: 203538 - DNA, 2125 bp, Homo sapiens
  Payload ID: 20134
  Gene Name: zinc finger protein 7
  ENST ID: ENST00000544249
  CDS Start-End: 299-2071
cggaagtttgcggggcggggcggacgcgggtggccaaggcccgtttccggcggcgtcgcgcgtttgcgagcctcgggtggtcctcagggagggtctctcggccagaacacgtggatgcccacccaccactgagcctcatgcaggattcctggttttcaagcctgagctgatctctcggctggagcagggagaagagccatgggtcctcgacctgcagggagcagaggggacagaggcaccaaggacctccaagacagattctacgattaggactgaaaatgagcaggcctgtgaggacatggacatcctaaaatcagaatcctatgggacagtggtcagaatctccccacaggactttcctcagaatcctggctttggagacgtttctgattctgaggtctggttagacagtcatctgggcagtcccgggctgaaagtgacaggctttaccttccaaaataactgtttgaatgaggagactgtggttcccaagaccttcaccaaggacgcaccccagggatgtaaggagctgggaagcagcggcctggattgtcagcctcttgaaagtcagggagagagtgcggaagggatgtcccagagatgcgaggagtgtggcaaaggcatcagagccacttcagatatcgctctgcattgggaaattaatacacagaaaattagcagatgtcaagaatgccaaaaaaagttatctgactgcttgcaggggaaacatacaaataactgccatggagagaagccgtacgaatgtgcagagtgtgggaaagtcttcaggctctgctcgcagcttaatcagcatcagagaatccacacgggagagaaaccctttaaatgcactgagtgtggaaaagccttccgcctgagctcaaaacttattcagcatcaaagaatccacactggggagaagccctacagatgtgaggaatgtggaaaagcttttggtcagagctcaagcctcatccaccatcagagaatccacacaggagagaggccctatggttgtcgtgagtgtgggaaagccttcagccagcagtcgcagctggttagacaccagagaactcacactggggagaggccctacccttgcaaggagtgtgggaaggccttcagccagagctccaccctagcccagcatcaaaggatgcatactggggagaaagctcaaattctaaaagcctcagacagtccaagccttgttgcacatcagagaattcacgctgtagagaaaccatttaagtgtgatgagtgtgggaaagcttttaggtggatctctcgcctgagtcagcatcagctgattcacactggagagaagccttataaatgcaacaagtgtacaaaagcctttggttgtagttcacggcttattcgccatcagagaactcacactggagaaaaaccatttaaatgtgatgagtgtggcaaaggctttgttcagggctcacaccttattcagcatcagcgaatccacactggagagaaaccctatgtgtgtaatgactgtggaaaagccttcagtcagagttccagccttatttaccatcagagaatccataaaggagagaagccctacgaatgcctccaatgcggaaaagccttcagtatgagcacacagcttacaatacatcaaagggttcacactggagagaggccctataaatgtaatgaatgtgggaaagccttcagtcaaaactcaacccttttccaacaccagataattcatgcaggggtgaagccctatgagtgcagtgagtgtggaaaagccttcagccggagctcatatcttattgaacaccagagaatacacactagggcccagtggttttacgaatatgggaatgccctggaagggtccacctttgtgagccgtaaaaaggttaatactataaagaaactgcatcagtgtgaagactgtgagaagatatttaggtggcgttcacacctaattatacaccagagaattcacaccggggagaagccttataaatgcaatgactgtggcaaagcttttaatcgtagctcaaggcttacccagcatcaaaaaattcacatgggatagaccacttacatataaatgtgtatatatgtgaataaacctatagccttaacttac

SEQ ID NO: 203539 - DNA, 6924 bp, Homo sapiens
  Payload ID: 20135
  Gene Name: zinc finger protein 70
  Uniprot ID: Q9UC06
  ENST ID: ENST00000341976
  CDS Start-End: 462-1802
gccaggcagcgtcggccgcgtcggccgcgggttggagcagctcaggtgcggccccgccccgcccgcctgcggccccgccccggcccaggtgagctgccccgccccggcccaggtgagtggccccgcgtccgccggtgtgacctgagtccgcctgaccacctgtccctccggtggccctgggtgtgcgtgtccccaatcgcggggaagcctgtaggggcgccacgtcgccgcctgggcagcgtgtgcgggtccgtggcaactcttgggcccccagccaggaaaccttgactgcactaagagtttgcagggtgcccaggccctagggactctctggaggatgggatgacagatgcaggaggacccggagaaggccccgacagagattgtgagaacagtaagtgtggcccaaagaagaacatttttaaagaaatacaaccattggggatgatagcagattcacaatggaggttcccccagcaacaaagtttggtgagacctttgcatttgagaacaggttagagtcacaacaagggcttttcccaggggaggacctgggggacccttttcttcaggaaagaggtttggagcaaatggctgtgatctacaaggagatccctcttggtgagcaggacgaagaaaatgatgattacgaggggaatttcagtttgtgctcaagccctgttcagcatcaaagtatccccccaggaaccagaccccaggatgatgagctcttcggacaaaccttcctccagaaatccgacctcagcatgtgtcagataatccacagtgaagagcccagtccatgcgattgtgcagaaacagacagaggggactcaggacctaacgcacctcacagaaccccacaaccagccaagccctatgcgtgtcgagagtgtgggaaggccttcagccagagctcgcacctgctccgacacctggtgatccacactggggagaagccctatgagtgctgtgagtgcgggaaggccttcagccagagctcccacctgctcaggcaccagatcatccacaccggggagaagccctacgagtgccgggagtgtgggaaggccttccgccagagctcagccctcacgcaacaccaaaagatccacaccggaaagaggccctacgagtgcagggaatgcgggaaagatttcagccggagctccagcctcagaaaacacgagagaattcatacaggagagagaccttatcagtgtaaggaatgtgggaaatccttcaaccagagctcaggcctgagccagcatcggaagatccacaccctaaagaaacctcacgagtgcgatctctgtgggaaagccttttgtcacaggtcacacctcatccgacaccagcggatccacactgggaagaaaccatacaaatgcgatgagtgcgggaaggccttcagccagagctccaacctcattgagcaccgcaagacccacactggcgagaagccctacaaatgccagaagtgtgggaaagccttcagccagagctcctccctcattgagcaccagcgcatccacaccggtgagaagccctacgagtgctgtcagtgtggcaaggccttttgccacagctctgcgctgatccagcaccagagaatccacaccggcaagaagccctacacctgcgagtgtggcaaagccttccggcaccggtcagccctcattgagcactataaaacccacaccagagagaagccctacgtgtgcaatctgtgcggcaagtccttccgggggagctcgcacctgattcgccatcagaagattcattctggggagaagctatagaaagaggagcccacacaaagcttgaaagcctgtgccagatggagcctttattccacgtcgcgtggtctccaagaccccacctacctccctgatgctgaatggaaaccttcccacctaagcgctcttgaacatcccactagcaggaaggccctgtgtggccctgggccaagcacgccagctctcagcaggttttctgcatggaagggaaggtggggtgatagggagggcagccagaaaagacagctggccttcagtttctccttcttgcatttgactcccaagcctacaggatttcattttgccctgtcttcacatttcccagaatctagaagaataaatgccaagagggagaaagttgaattaaacccaggaaaatatcagaagaactctttaaaacaggctgcagtctggcacttttagaagacagaaaccacactcacagtccaaagcagtagaagaaaaatgaattcaaaagtagatgtgtcagcagcaaagtagaattttctcactgcgttgggcattggtggggacaaccaaaacaggtctgcagagcaaaggcaggtctggagggtgggtcttgagattggggatgagggtggtgagcccctgggcgtggcctcttaaccctctccttagccctagggcagtttccctcagacagctctgttacaggaggatagagatttgatcctgttggccagaggatgtttgacacccagccgtgactcagcctggacaccggacatgactgccctccaggaataacccctccctgagacatagtgtccccaagaccacagtgtgccttggacatcagcagggcctgggtctggtctgttctggcaatgatgcagccctcctgccccagtgtcaggggacctgggaagctgggtggcttgttggaggaggctgtgttctaatcagaaggtctgggttcaagtcctagttccaccccctcctacctgggtgagcttgaacaagtcctgtaacttccccaggctccattcccccatccaagagttggggtaatgggaactggccacgtgcctctaagggttggtgccaggctgtcattcagaacacagccactgtgaaagtgctttggcaactgtgagcagtcatggtgactgaggacagagacccagagtgacccctgccccacccctgtgcatttccacggactggagagatgttcccgtctggtttctgagcagtgggacctctcattgaacagggctttctctccctccaccccttgcagcctgggctgtgtatgcctgcggatgcagtgtcccacacaaggacacttcctctaggatgccatcctgagcctcctgtagcagcagtgtcattctgcacttccacattctgtctgtcttccccgcctgccaactaggagttcacgtggggcttgtttaaacagtaccattgcttgtgtcccacctggaccagttcagtcagccccagtggtggcatgttttaaagctccccaggtgattataacttcctagtgtgcagccaggctgtgggccctgtgctgggcttttttttttgagatggagtgttgccctgttgccaggctggaatgcagtggcgtgatcttggcttactgcaagctctgcctcctgggttcaagcgattcccctgcttcagcctcctgagtagctgggactacaggtgcgtgccaccatgcctggctaattttttgtatttttagtacagacggggtttcaccatgttggccaggatggtctcgatctcttgacctcgtgatctgcccgccttgacctcccaaagtgccgggattacaggcatgagcctccacacctggcccatgctgggtttttgtgcatccctcgacagcttccaatgtcagcctgctggctttggctgagcagagcttgaaggccattctgtctcagtgccctcactccctgctccccgcacccggagcctcagggatgggctcaggctgatggtcagctgggcgcttggaaagtgtttggctggggccttggggatctctttagtcctggcttcccttgggctcctcagagctagtggggaaggaggcagtctaggctgttttgaagtttcctaaacatttatggctgggctaacatgaactcatcatggtaacactgggtatttcagctgatcagaagctcagcatggccattatgcctagttttgatgaataaacatgggaaagccataactgttactaagtgggtcttgataggccagagatttccaaatgacagatatgatgggctggagaggtcatggtgggagttccagccatgcctctgtccagcccctgtctttgctacgtatgtgaaacatttaacatttaaccagcactccattgtccaccagaaccctctgtgtaaccagttggactgactggatggtgccctgggcattgcctgcaagtggcctgtcatttcaggcctgtctctatcaagagtgaagagagaatgctaggatgcagtggggacagcaggcggcatcaagcaggggtccctgaaagatctacctcctctttacacctgcccctcttccccaccgttatcatctggcaaatgtctgttacctatctttggtttctccctccccatccttcctgcacaccccagccaaattgatttttaaagcatcattttgcacaagtcaccactctccttaaaaccaactttcaggagctttcctgcacgtaaaccctcgtttcagccaacctggtttacccactctgagcaagccgcatggagatcaggccgcccctgcccactccagcatcactcccagctcataattctgtgctgttcttgcattttgaaatgtgcactttctcctcctctccctccctctctctttctaatttttgtgtaacgtggagatgaagatcccccctctctcccaagggttaacagataaacatggtaagaccaggttcttttttggaagtatgaccagagcctcattccctctgttcaaattctttccttgttttattagtttttttttttttttttttttttttgagacagagtctcactgtcacccaggctggagtgcagtggtgcgatcttggcttgctgcaacctctgcctcccgggttcaagtgattctcctgcctcagcctcctgagtagctgggattacaggcatgtgccaccacgcctggctaacttttgtatttttagtagagatggggtttcaccatgttggccaggctggtctcgaactcctgacctcctgatctgcctgccttggcctcctgaagtgttgggattacaggcgtgagccatgtgcccagccagcttattagatttttttttttaaactctctcattctatttagattctcaaacagtgtaaagttataaaagatcatccctggcaatattttaatcaattatcttttaatttagttgttctttgtttttgttgtcctacctttttttttcttttttcttttttctttttttgagatggagtcttgctttgtcacccaggctgtagtgcagtggggcgatctcggcttactgcaagctctacctcccaggttcagaccattctcctgcctcagcctcccaagtagctgggactacaggcacccgccaccacgcccggctaattttttgtatttttaatagagacggggtttcaccgtgttagccaagatggtatctatctcctgagctcgtgatccgcccgcctcggcctcccaaagtgctgggattacaggtgtgagccaccgcgctcggcatttttttatttcttcttctccttagagtgacagctttgtctgcactccgtaagttttgacgtggtgttttttgttatagtattaagaatttccttttgcccaaatgttattatttaaaaatatttctaagtgggccgggcatggtgactcacacctgtaatcccagcactttggaaggccgaggtgggtggatcacgaggtcaggagtttaagaccagcctggccaacatggtgaaaacccgtctctactaaaaatacaaaaattaactgggcatggtggcgggtgcctgtaatcccagctacacgggaggctgaggcaggagaatcgcttgaacccgggaggcggaggttgcagtgagccaagattgtgccactacccttcagcctgggtgacagggcaagactccatctcggggaaaacaacaacaacaaaaacaaaaaatagccgggagcggtggctcaagcctgtaatcccagcactttgggaggccaagacgggcagatcatgaggtcaggagatcgaaaccatcctggctaacacgatgaaaccctgtctctattaaaaatacaaaaaattagccgtgcgtggtggctacaggcagctgtgcgcctgtagtcccagctacttgggaggctgaggcaggagaatggtgtgaacccgggaggcagagcttgcagtgagccgaggtggtgccactgcactccagcctgggcaaaagagctagactctgtctcaaaaaaaatatatataaaaaaaatttctaagtgatgaatgcttagggtattgctgcttatttcttactgtactgtggtgtcaacatttctaagtgtccataggacttctttgggcctgaatatattatcagtttttataaaagcatttgtgtaatctcaaaatgtgtttttattctaccagttctatttgttaactcaattttttcattattttattcaaatccatattttctctgactttcatttactttagagttcttaatctgggggtccatggcctgcctaggagtctttagcatgtaggggtttaggagttgcagacccctagggatcgaacaaagctgggtatgtgcttgaaggaattttgctgggacaaggatctgtagtatttactatatttttaaatgcctctgtgacaccaaagcagttcagaacactcatttacctgatctaatcatagtttgatgtttgtgtgttatatctctatgtattcctgtttcacttttaatttctgtatgtgtattgtcgctatgttgtgcagtttttctcaagtcatttttgagaaataggcagggtatgaattatcaataaataagtatcatgtttggggcatata

SEQ ID NO: 203540 - DNA, 2882 bp, Homo sapiens
  Payload ID: 20136
  Gene Name: zinc finger protein 700
  Uniprot ID: Q9H0M5
  ENST ID: ENST00000254321
  CDS Start-End: 144-2372
actgcccacagttcatccggaaatggagggggtcgctttcctcaccttcctcgctgcgcgggcggcggttggtaaccggtcagaccagcccgagagggacctggtgcctgtacccaggcttctgtcgctctgtcgcctgcgctatgccctgctgtagtcacaggagctgtagagaggaccccggtacatctgaaagccgggaaatggacccagtggcctttgaggatgtggctgtgaacttcacccaggaagagtggacattgctggatatttcccagaagaatctcttcagggaagtgatgctggaaactttcaggaacctgacctctataggaaaaaaatggagtgaccagaacattgaatatgagtaccaaaaccccagaagaagcttcaggagtctcatagaagagaaagtcaatgaaattaaagaagacagtcattgtggagaaacttttacccaggttccagatgacagactgaacttccaggagaagaaagcttctcctgaagtaaaatcatgtgacagctttgtgtgtgcagaagttggcataggtaactcatcttttaatatgagcatcagaggtgacactggacacaaggcatatgagtatcaggaatatggaccaaagccatataagtgtcaacaacctaaaaataagaaagccttcaggtatcgcccatccattagaacacaagaaagggatcacactggagagaaaccctatgcttgtaaagtctgtggaaaaacctttattttccattcaagcattcgaagacacatggtaatgcacagtggggatggaacttataaatgtaaattttgtgggaaagccttccattctttcagtttatatcttatccatgaaagaactcacactggagagaaaccatatgaatgtaaacaatgtggtaaatcctttacttattctgctacccttcaaatacatgaaagaactcacactggggagaagccctatgaatgtagcaaatgtgataaagcatttcatagttctagttcctatcatagacatgaaagaagtcacatgggagagaagccttatcaatgcaaagaatgtggaaaagcatttgcatataccagttctcttcgtagacatgaaaggacccactctgggaaaaaaccgtatgaatgtaagcaatatggggaaggcttatcctatcttataagttttcaaacacacataagaatgaactctggagaaagaccttataaatgtaagatatgtgggaaaggcttttattctgccaagtcatttcaaacacatgaaaaaactcacactggagagaaacgctataaatgcaagcaatgtggtaaagccttcaatctttccagttcctttcgatatcatgaaaggattcacactggagagaaaccctatgagtgtaagcagtgtgggaaagccttcagatctgcctcacagcttcgagtgcacggtgggactcacactggagagaaaccctatgaatgtaaggaatgtgggaaagccttcagatctacctcacaccttcgagtgcatggtaggactcatactggagagaaaccctatgaatgtaaggaatgtgggaaagccttcagatatgtgaagcaccttcaaattcatgaaaggacagaaaaacacataagaatgccctctggagaaagaccttataaatgtagtatatgtgagaaaggcttttattctgccaagtcatttcaaacacatgaaaaaactcacactggagagaaaccctatgaatgcaaccaatgtggtaaagccttcagatgttgcaattcccttcgatatcatgaaaggactcacactggagagaaaccctatgagtgtaagcaatgtgggaaagccttcagatctgcctcacaccttcgaatgcatgaaaggactcacactggagagaaaccctatgagtgtaagcaatgtgggaaagccttcagttgtgcctcaaaccttcgaaagcatggtaggactcacactggagagaaaccctatgagtgtaagcaatgtgggaaagccttcagatctgcctcaaaccttcagatgcatgaaaggactcacactggagagaaaccctatgaatgtaaggaatgcgaaaaagcattctgtaaattctcttcttttcaaatacatgaaaggaagcacagaggagagaagccctatgaatgtaagcattgtgggaatggattcacatctgccaagattcttcaaatacatgcaagaacacacattggagagaaacactatgaatgtaaggaatgcggaaaagcattcaattatttttcttccttgcatatacacgcaaggactcatatgggagagaagccatatgaatgtaaggattgtgggaaagcattcagctagcctggttccttttatggacatgaatagactcacactggaaggaagcactatgaatgcaagcaatgtggcaaaactttcacattttccagttcttttcgatatcatgaaaggactcacactggggagaaaccctatcaatgtaagcagtgtgggaaagccttcattccttttacttcttttcaatgtcatgaaaggactcacacgggagagaaaccctatgagtgtattctagttccgtttgatatcatgaaaggacttacactggagtgaaaccctatgaatgtaagcaatgtgggaaagccttcagatgtgcctcgcaccttcaacggcatggaagggttcacacttgggagaaactctatgaatgtaagcagtatgggaaagccttcagatctgccaagattctttgaatacagataattaatgtaaacaattatcataagtatactaacatgttattctttttaaataagaaggtataataaaatatcccattggttttatgtatta

SEQ ID NO: 203541 - DNA, 3113 bp, Homo sapiens
  Payload ID: 20136
  Gene Name: zinc finger protein 700
  ENST ID: ENST00000482090
  CDS Start-End: 419-2593
taacatagttcctagtggggtgggcttactttgtgtctgacccatttttctttcgagacaagacaacactcacactacaagagggaaagggtaaaggtcactcacgcgtggtggtacatgcctataatcccagctactcgggaggctgaggcaggagaatcgcttgaaccccggtggtgagccaatatcacgccattgtactccagcctgggcaacaagagtgaaactctgtctcaaaaaataaataaataaataaattgctttatggaagaaagtaagtatagatggagagaaagggatctgataaccgaagcagggaataaatgtttggagtccacagcatcctgagaacttcttgggaatagagtctaggcctccagtgctgtcactctcacccatcttcctctacacatgtgagatgtttcaggacccagtggcctttgaggatgtggctgtgaacttcacccaggaagagtggacattgctggatatttcccagaagaatctcttcagggaagtgatgctggaaactttcaggaacctgacctctataggaaaaaaatggagtgaccagaacattgaatatgagtaccaaaaccccagaagaagcttcaggagtctcatagaagagaaagtcaatgaaattaaagaagacagtcattgtggagaaacttttacccaggttccagatgacagactgaacttccaggagaagaaagcttctcctgaagtaaaatcatgtgacagctttgtgtgtgcagaagttggcataggtaactcatcttttaatatgagcatcagaggtgacactggacacaaggcatatgagtatcaggaatatggaccaaagccatataagtgtcaacaacctaaaaataagaaagccttcaggtatcgcccatccattagaacacaagaaagggatcacactggagagaaaccctatgcttgtaaagtctgtggaaaaacctttattttccattcaagcattcgaagacacatggtaatgcacagtggggatggaacttataaatgtaaattttgtgggaaagccttccattctttcagtttatatcttatccatgaaagaactcacactggagagaaaccatatgaatgtaaacaatgtggtaaatcctttacttattctgctacccttcaaatacatgaaagaactcacactggggagaagccctatgaatgtagcaaatgtgataaagcatttcatagttctagttcctatcatagacatgaaagaagtcacatgggagagaagccttatcaatgcaaagaatgtggaaaagcatttgcatataccagttctcttcgtagacatgaaaggacccactctgggaaaaaaccgtatgaatgtaagcaatatggggaaggcttatcctatcttataagttttcaaacacacataagaatgaactctggagaaagaccttataaatgtaagatatgtgggaaaggcttttattctgccaagtcatttcaaacacatgaaaaaactcacactggagagaaacgctataaatgcaagcaatgtggtaaagccttcaatctttccagttcctttcgatatcatgaaaggattcacactggagagaaaccctatgagtgtaagcagtgtgggaaagccttcagatctgcctcacagcttcgagtgcacggtgggactcacactggagagaaaccctatgaatgtaaggaatgtgggaaagccttcagatctacctcacaccttcgagtgcatggtaggactcatactggagagaaaccctatgaatgtaaggaatgtgggaaagccttcagatatgtgaagcaccttcaaattcatgaaaggacagaaaaacacataagaatgccctctggagaaagaccttataaatgtagtatatgtgagaaaggcttttattctgccaagtcatttcaaacacatgaaaaaactcacactggagagaaaccctatgaatgcaaccaatgtggtaaagccttcagatgttgcaattcccttcgatatcatgaaaggactcacactggagagaaaccctatgagtgtaagcaatgtgggaaagccttcagatctgcctcacaccttcgaatgcatgaaaggactcacactggagagaaaccctatgagtgtaagcaatgtgggaaagccttcagttgtgcctcaaaccttcgaaagcatggtaggactcacactggagagaaaccctatgagtgtaagcaatgtgggaaagccttcagatctgcctcaaaccttcagatgcatgaaaggactcacactggagagaaaccctatgaatgtaaggaatgcgaaaaagcattctgtaaattctcttcttttcaaatacatgaaaggaagcacagaggagagaagccctatgaatgtaagcattgtgggaatggattcacatctgccaagattcttcaaatacatgcaagaacacacattggagagaaacactatgaatgtaaggaatgcggaaaagcattcaattatttttcttccttgcatatacacgcaaggactcatatgggagagaagccatatgaatgtaaggattgtgggaaagcattcagctagcctggttccttttatggacatgaatagactcacactggaaggaagcactatgaatgcaagcaatgtggcaaaactttcacattttccagttcttttcgatatcatgaaaggactcacactggggagaaaccctatcaatgtaagcagtgtgggaaagccttcattccttttacttcttttcaatgtcatgaaaggactcacacgggagagaaaccctatgagtgtattctagttccgtttgatatcatgaaaggacttacactggagtgaaaccctatgaatgtaagcaatgtgggaaagccttcagatgtgcctcgcaccttcaacggcatggaagggttcacacttgggagaaactctatgaatgtaagcagtatgggaaagccttcagatctgccaagattctttgaatacagataattaatgtaaacaattatcataagtatactaacatgttattctttttaaataagaaggtataataaaatatcccattggttttatgtattagatcaagctt

SEQ ID NO: 203542 - DNA, 2901 bp, Homo sapiens
  Payload ID: 20136
  Gene Name: zinc finger protein 700
  ENST ID: ENST00000622593
  CDS Start-End: 144-2381
actgcccacagttcatccggaaatggagggggtcgctttcctcaccttcctcgctgcgcgggcggcggttggtaaccggtcagaccagcccgagagggacctggtgcctgtacccaggcttctgtcgctctgtcgcctgcgctatgccctgctgtagtcacaggagctgtagagaggaccccggtacatctgaaagccgggaaatgatgtttcaggacccagtggcctttgaggatgtggctgtgaacttcacccaggaagagtggacattgctggatatttcccagaagaatctcttcagggaagtgatgctggaaactttcaggaacctgacctctataggaaaaaaatggagtgaccagaacattgaatatgagtaccaaaaccccagaagaagcttcaggagtctcatagaagagaaagtcaatgaaattaaagaagacagtcattgtggagaaacttttacccaggttccagatgacagactgaacttccaggagaagaaagcttctcctgaagtaaaatcatgtgacagctttgtgtgtgcagaagttggcataggtaactcatcttttaatatgagcatcagaggtgacactggacacaaggcatatgagtatcaggaatatggaccaaagccatataagtgtcaacaacctaaaaataagaaagccttcaggtatcgcccatccattagaacacaagaaagggatcacactggagagaaaccctatgcttgtaaagtctgtggaaaaacctttattttccattcaagcattcgaagacacatggtaatgcacagtggggatggaacttataaatgtaaattttgtgggaaagccttccattctttcagtttatatcttatccatgaaagaactcacactggagagaaaccatatgaatgtaaacaatgtggtaaatcctttacttattctgctacccttcaaatacatgaaagaactcacactggggagaagccctatgaatgtagcaaatgtgataaagcatttcatagttctagttcctatcatagacatgaaagaagtcacatgggagagaagccttatcaatgcaaagaatgtggaaaagcatttgcatataccagttctcttcgtagacatgaaaggacccactctgggaaaaaaccgtatgaatgtaagcaatatggggaaggcttatcctatcttataagttttcaaacacacataagaatgaactctggagaaagaccttataaatgtaagatatgtgggaaaggcttttattctgccaagtcatttcaaacacatgaaaaaactcacactggagagaaacgctataaatgcaagcaatgtggtaaagccttcaatctttccagttcctttcgatatcatgaaaggattcacactggagagaaaccctatgagtgtaagcagtgtgggaaagccttcagatctgcctcacagcttcgagtgcacggtgggactcacactggagagaaaccctatgaatgtaaggaatgtgggaaagccttcagatctacctcacaccttcgagtgcatggtaggactcatactggagagaaaccctatgaatgtaaggaatgtgggaaagccttcagatatgtgaagcaccttcaaattcatgaaaggacagaaaaacacataagaatgccctctggagaaagaccttataaatgtagtatatgtgagaaaggcttttattctgccaagtcatttcaaacacatgaaaaaactcacactggagagaaaccctatgaatgcaaccaatgtggtaaagccttcagatgttgcaattcccttcgatatcatgaaaggactcacactggagagaaaccctatgagtgtaagcaatgtgggaaagccttcagatctgcctcacaccttcgaatgcatgaaaggactcacactggagagaaaccctatgagtgtaagcaatgtgggaaagccttcagttgtgcctcaaaccttcgaaagcatggtaggactcacactggagagaaaccctatgagtgtaagcaatgtgggaaagccttcagatctgcctcaaaccttcagatgcatgaaaggactcacactggagagaaaccctatgaatgtaaggaatgcgaaaaagcattctgtaaattctcttcttttcaaatacatgaaaggaagcacagaggagagaagccctatgaatgtaagcattgtgggaatggattcacatctgccaagattcttcaaatacatgcaagaacacacattggagagaaacactatgaatgtaaggaatgcggaaaagcattcaattatttttcttccttgcatatacacgcaaggactcatatgggagagaagccatatgaatgtaaggattgtgggaaagcattcagctagcctggttccttttatggacatgaatagactcacactggaaggaagcactatgaatgcaagcaatgtggcaaaactttcacattttccagttcttttcgatatcatgaaaggactcacactggggagaaaccctatcaatgtaagcagtgtgggaaagccttcattccttttacttcttttcaatgtcatgaaaggactcacacgggagagaaaccctatgagtgtattctagttccgtttgatatcatgaaaggacttacactggagtgaaaccctatgaatgtaagcaatgtgggaaagccttcagatgtgcctcgcaccttcaacggcatggaagggttcacacttgggagaaactctatgaatgtaagcagtatgggaaagccttcagatctgccaagattctttgaatacagataattaatgtaaacaattatcataagtatactaacatgttattctttttaaataagaaggtataataaaatatcccattggttttatgtattagatcaagctt

SEQ ID NO: 203543 - DNA, 2610 bp, Homo sapiens
  Payload ID: 20137
  Gene Name: zinc finger protein 701
  Uniprot ID: Q9NV72
  ENST ID: ENST00000301093
  CDS Start-End: 36-1631
atcccgtggagtgaaggtcgcaccgcggcgtagagatggggtttctccatgttggtcaggatggtctcgaactcccgacatcaggtgatccgcctgcctcggcctcccaaagtgctgggattacaggtgtgagccaccgcactcagcctccctgttttgaaggattgacttctaaagacttggtacgtgaggaaaaaacacggaagaggaagaggaaagcaaaggagtcagggatggctcttcttcagggtctactgacattcagggatgtggccatagaattctctcaggaggagtggaaatgcctggaccctgctcagaggactctatacagagacgtgatgctggagaattataggaacctggtctccctggatacctcttccaaatgcatgatgaagatgttctcatcaacaggacaaggcaatacagaagtggtccacacagggacattgcaaatacatgcaagtcatcacattggagatacttgcttccaggaaattgagaaagatattcatgactttgtgtttcagtggcaagaaaatgaaacaaatggccatgaagcactcatgacaaaaaccaaaaagttgatgagtagtacagagcgacatgatcaaaggcatgctggaaacaaacctattaaaaatgagcttggatcaagctttcattcgcatctgcctgaagtgcacatatttcaccccgaagggaaaattggtaatcaagttgagaaggctatcaacgatgctttctcagtttcagcatcccaacgaatttcctgtaggccaaaaactcgtatttctaataagtataggaataatttcctccagtcttcattactcacacaaaaacgggaagtacacacaagagaaaaatctttccaacgtaatgagagtggcaaagcctttaatggtagctcactcttaaaaaaacatcagataatccatttaggagacaaacagtataaatgtgatgtatgcggcaaggactttcatcagaagcgataccttgcatgccatagatgtcacactggtgagaatccttacacgtgtaatgagtgtggcaagacattcagtcacaattcagccctgttagttcacaaggcaattcatactggagagaaaccttacaagtgtaatgaatgtggcaaggtttttaatcaacaatcaaaccttgcacgtcatcatagagttcatactggagagaaaccttacaaatgtgaagaatgtgacaaagttttcagtcgcaaatcacaccttgaaagacataggagaattcacactggagagaaaccatacaaatgtaaggtttgtgacaaggctttcagacgtgattcacacctggcacaacatactgtaattcacactggagagaaaccttacaagtgtaatgagtgtggcaagacctttgttcaaaattcatctcttgtaatgcataaggtcattcatactggagagaaacgttacaagtgtaatgaatgtggcaaggtttttaatcacaaatcaaaccttgcatgtcatcgtagacttcatactggagagaaaccttacaagtgtaatgaatgtggcaaggtttttaatcgaaaatcaaaccttgaacgtcatcatagacttcatactggaaagaaatcttagaagtgtaaatttgcaaggtttttaggcaacagtcaaaccttgcatgtcatcatagactttatactggagagaaaccttacaaatgtgaagaatgtgacaaaagttttcaatttcaaatcactccttgaaatacataggagagttcatactggagagaaaccatacaaatgtaaggtttgtgacaaggatttcgggtgtgattcacacctggcccaacatactggaattcacactggaaaggaactgtacaagtgtaatgagtgtggcagagcctttggtggtcagtcaacacttactcaccatcaagcaatccatggtatagggaaacttgactaatgtaatgattgtcacaaagtcttcagtaatattacagccattgcaaaacattggagaatccataatgaaggaggtcttacaagtgtaataaatgtggcaagtttttcagacatcattcataacttgcagttcattggcgatcttatacaggagagaaatcttacaaatgtgatgattgtggcaaggtcttcagtcaagcttcatcttttgcaaaacgggagaattcatacaggagagaaacctcacaagtgtgatgattgtgagcaaagcctttacttcacgttcacaccacattagatatcagaggatccatactggacagaaatcttacaaacgtcctatgtgtggcaaggtcttcagtccgaggttactccttgcagaatatcataacgttcatttttgaggtaatagttacaaatgcggtgagcacagcaaaccatcaaggattgacagtagagtcaattcagaattgacttgagtttgagttgacttaaaacattcagttgaagcattaattgacattaaagtgtttatgttaagaggattgggccaggcgtgtggctcacgcctgtaaatccagcactttaggagcccaaggtggatagatcacttgaggtcatgagtttgagatcagcctggccaa

SEQ ID NO: 203544 - DNA, 2634 bp, Homo sapiens
  Payload ID: 20137
  Gene Name: zinc finger protein 701
  Uniprot ID: Q9NV72
  ENST ID: ENST00000391785
  CDS Start-End: 128-1525
acacatccgcgcagaccaggaagcggatcccgtggagtgaaggtcgcaccgcggcggattgacttctaaagacttggtacgtgaggaaaaaacacggaagaggaagaggaaagcaaaggagtcagggatggctcttcttcagggtctactgacattcagggatgtggccatagaattctctcaggaggagtggaaatgcctggaccctgctcagaggactctatacagagacgtgatgctggagaattataggaacctggtctccctggatacctcttccaaatgcatgatgaagatgttctcatcaacaggacaaggcaatacagaagtggtccacacagggacattgcaaatacatgcaagtcatcacattggagatacttgcttccaggaaattgagaaagatattcatgactttgtgtttcagtggcaagaaaatgaaacaaatggccatgaagcactcatgacaaaaaccaaaaagttgatgagtagtacagagcgacatgatcaaaggcatgctggaaacaaacctattaaaaatgagcttggatcaagctttcattcgcatctgcctgaagtgcacatatttcaccccgaagggaaaattggtaatcaagttgagaaggctatcaacgatgctttctcagtttcagcatcccaacgaatttcctgtaggccaaaaactcgtatttctaataagtataggaataatttcctccagtcttcattactcacacaaaaacgggaagtacacacaagagaaaaatctttccaacgtaatgagagtggcaaagcctttaatggtagctcactcttaaaaaaacatcagataatccatttaggagacaaacagtataaatgtgatgtatgcggcaaggactttcatcagaagcgataccttgcatgccatagatgtcacactggtgagaatccttacacgtgtaatgagtgtggcaagacattcagtcacaattcagccctgttagttcacaaggcaattcatactggagagaaaccttacaagtgtaatgaatgtggcaaggtttttaatcaacaatcaaaccttgcacgtcatcatagagttcatactggagagaaaccttacaaatgtgaagaatgtgacaaagttttcagtcgcaaatcacaccttgaaagacataggagaattcacactggagagaaaccatacaaatgtaaggtttgtgacaaggctttcagacgtgattcacacctggcacaacatactgtaattcacactggagagaaaccttacaagtgtaatgagtgtggcaagacctttgttcaaaattcatctcttgtaatgcataaggtcattcatactggagagaaacgttacaagtgtaatgaatgtggcaaggtttttaatcacaaatcaaaccttgcatgtcatcgtagacttcatactggagagaaaccttacaagtgtaatgaatgtggcaaggtttttaatcgaaaatcaaaccttgaacgtcatcatagacttcatactggaaagaaatcttagaagtgtaaatttgcaaggtttttaggcaacagtcaaaccttgcatgtcatcatagactttatactggagagaaaccttacaaatgtgaagaatgtgacaaaagttttcaatttcaaatcactccttgaaatacataggagagttcatactggagagaaaccatacaaatgtaaggtttgtgacaaggatttcgggtgtgattcacacctggcccaacatactggaattcacactggaaaggaactgtacaagtgtaatgagtgtggcagagcctttggtggtcagtcaacacttactcaccatcaagcaatccatggtatagggaaacttgactaatgtaatgattgtcacaaagtcttcagtaatattacagccattgcaaaacattggagaatccataatgaaggaggtcttacaagtgtaataaatgtggcaagtttttcagacatcattcataacttgcagttcattggcgatcttatacaggagagaaatcttacaaatgtgatgattgtggcaaggtcttcagtcaagcttcatcttttgcaaaacgggagaattcatacaggagagaaacctcacaagtgtgatgattgtgagcaaagcctttacttcacgttcacaccacattagatatcagaggatccatactggacagaaatcttacaaacgtcctatgtgtggcaaggtcttcagtccgaggttactccttgcagaatatcataacgttcatttttgaggtaatagttacaaatgcggtgagcacagcaaaccatcaaggattgacagtagagtcaattcagaattgacttgagtttgagttgacttaaaacattcagttgaagcattaattgacattaaagtgtttatgttaagaggattgggccaggcgtgtggctcacgcctgtaaatccagcactttaggagcccaaggtggatagatcacttgaggtcatgagtttgagatcagcctggccaacagacgtgagtcacttttcccagcctgctttttgtttctttaacaaaaaccaataggggtttttataggtattgtgttgaatctgaatcacattggcttatataataacaatattgatttttccaaacca

SEQ ID NO: 203545 - DNA, 5538 bp, Homo sapiens
  Payload ID: 20137
  Gene Name: zinc finger protein 701
  Uniprot ID: Q9NV72
  ENST ID: ENST00000540331
  CDS Start-End: 226-1821
gtctcaacctttaggcgcctgaagcgcaaacgtcgcgatcccagtctcagggaggccgagttctctgcctggtgctgggatcttgtggaccccaccgaaggcgtcgtcgcaccccacctcccgcctcatgctgggccttgctgcaccccaagtctccccttagcagtcaccactttccttgagccagcgttggggaggtgccaggggccagtcctgtgacacgagatggggtttctccatgttggtcaggatggtctcgaactcccgacatcaggtgatccgcctgcctcggcctcccaaagtgctgggattacaggtgtgagccaccgcactcagcctccctgttttgaaggattgacttctaaagacttggtacgtgaggaaaaaacacggaagaggaagaggaaagcaaaggagtcagggatggctcttcttcagggtctactgacattcagggatgtggccatagaattctctcaggaggagtggaaatgcctggaccctgctcagaggactctatacagagacgtgatgctggagaattataggaacctggtctccctggatacctcttccaaatgcatgatgaagatgttctcatcaacaggacaaggcaatacagaagtggtccacacagggacattgcaaatacatgcaagtcatcacattggagatacttgcttccaggaaattgagaaagatattcatgactttgtgtttcagtggcaagaaaatgaaacaaatggccatgaagcactcatgacaaaaaccaaaaagttgatgagtagtacagagcgacatgatcaaaggcatgctggaaacaaacctattaaaaatgagcttggatcaagctttcattcgcatctgcctgaagtgcacatatttcaccccgaagggaaaattggtaatcaagttgagaaggctatcaacgatgctttctcagtttcagcatcccaacgaatttcctgtaggccaaaaactcgtatttctaataagtataggaataatttcctccagtcttcattactcacacaaaaacgggaagtacacacaagagaaaaatctttccaacgtaatgagagtggcaaagcctttaatggtagctcactcttaaaaaaacatcagataatccatttaggagacaaacagtataaatgtgatgtatgcggcaaggactttcatcagaagcgataccttgcatgccatagatgtcacactggtgagaatccttacacgtgtaatgagtgtggcaagacattcagtcacaattcagccctgttagttcacaaggcaattcatactggagagaaaccttacaagtgtaatgaatgtggcaaggtttttaatcaacaatcaaaccttgcacgtcatcatagagttcatactggagagaaaccttacaaatgtgaagaatgtgacaaagttttcagtcgcaaatcacaccttgaaagacataggagaattcacactggagagaaaccatacaaatgtaaggtttgtgacaaggctttcagacgtgattcacacctggcacaacatactgtaattcacactggagagaaaccttacaagtgtaatgagtgtggcaagacctttgttcaaaattcatctcttgtaatgcataaggtcattcatactggagagaaacgttacaagtgtaatgaatgtggcaaggtttttaatcacaaatcaaaccttgcatgtcatcgtagacttcatactggagagaaaccttacaagtgtaatgaatgtggcaaggtttttaatcgaaaatcaaaccttgaacgtcatcatagacttcatactggaaagaaatcttagaagtgtaaatttgcaaggtttttaggcaacagtcaaaccttgcatgtcatcatagactttatactggagagaaaccttacaaatgtgaagaatgtgacaaaagttttcaatttcaaatcactccttgaaatacataggagagttcatactggagagaaaccatacaaatgtaaggtttgtgacaaggatttcgggtgtgattcacacctggcccaacatactggaattcacactggaaaggaactgtacaagtgtaatgagtgtggcagagcctttggtggtcagtcaacacttactcaccatcaagcaatccatggtatagggaaacttgactaatgtaatgattgtcacaaagtcttcagtaatattacagccattgcaaaacattggagaatccataatgaaggaggtcttacaagtgtaataaatgtggcaagtttttcagacatcattcataacttgcagttcattggcgatcttatacaggagagaaatcttacaaatgtgatgattgtggcaaggtcttcagtcaagcttcatcttttgcaaaacgggagaattcatacaggagagaaacctcacaagtgtgatgattgtgagcaaagcctttacttcacgttcacaccacattagatatcagaggatccatactggacagaaatcttacaaacgtcctatgtgtggcaaggtcttcagtccgaggttactccttgcagaatatcataacgttcatttttgaggtaatagttacaaatgcggtgagcacagcaaaccatcaaggattgacagtagagtcaattcagaattgacttgagtttgagttgacttaaaacattcagttgaagcattaattgacattaaagtgtttatgttaagaggattgggccaggcgtgtggctcacgcctgtaaatccagcactttaggagcccaaggtggatagatcacttgaggtcatgagtttgagatcagcctggccaacagacgtgagtcacttttcccagcctgctttttgtttctttaacaaaaaccaataggggtttttataggtattgtgttgaatctgaatcacattggcttatataataacaatattgatttttccaaaccatcaatgtgggttgtatatatatgtttttaatcattttggttaatgtttgtagatttcaaggtgtgaaattctcagtttttttatgtttattcctaagtatttcttactttaagatctctagcaaatggaagtgttttttaattttcgtttaaattttttattgtttatggaaattcaattaatttttggtgctgctattgcattgtgcaaatccactgaatgtgttgattagttccagtagtattttggttgactcaggccccgcccacctcttcgcctcccgtctggcctgacccaggccccgcccacctcctcgggggtctccccgcgggtctggcttctgtactgtgctgattggcacagacccggaagctgatggcatggactgaaggttgccccgttgagtttgcgcttcccagttctctggtactgctataccggggacgtgggtgtctccacagacctggaaattccggcccctctttctcaactcagagcaaattgagacgtccgggtgggagtccgtgagtcttttccttttgagtttaaagtcgccctgaggctggtcccgtcccggtcttttctgcagtagggccgtgcagacacctcctgtagcgaaactttccttctcaaaacccttcccgacccgtcctcccgcctcgcgctgtttcaggtcctcaccagcgagttggactctcgccctgggctcctcatcggcgcctggagggcagcgctgcagccccactcccgggaaggccgcgtcctctgcctggtcctgggatcctgcagaccccacccctgtccgaaggcgccatcgcccaccacctccctcctcgtgccggccctgcttctccccagttccaaccccaggaaaacgtgcttctcctggaggcaaccctctttttccaccctcgccctgttgttcccggaaggcaggcctggaatgtgaagtttccaggtagatggatattaaacatagaattgaagaaaaaaaaaaaaaccccacaaagtaacaaaagaatgaagcggcgaaagcagaaatttactcaaccaagaaagcaccccacagggtgggggtgggcccaagcgagcgtctccagggccccatttacaaagtttttggaggttatttttttttgaggtccctatgggctaccccttatctggatgaagaatttggcccttggccaaggaaataactgaggtaaattggcctgaggccagagcagatgggtgccctatgcagatgaaggggtggccggtgcttggccttggccactcctgggctctttctctttccacctgcgacctggtggaagggggagggtgttagggagagtagcctttgatcctttgttactttgggtgggaagatggggtttttccttttagtctagttttggaaagttcgcgttaattggttttagattccctgcctccctagacccaggacccatgtggttttttttgtttttgtttttgtttttttgatggagatggggtcttactctgctgcgcaggccgaagagcggtgaccggatcacagctcactgcagcttcaacctcctgggctcaagggatcctcccacctcagcctgcagagtagctgggaccacagccgcgcgccaccacaccgcgccaatttttgtgttcttggtagagaccgggttttgccttgttgtctaggttgggctccaactgcagggctaaagcgatccaagagcatcagcctcccaaagtgctgggattacaggcttgagccaccatgcccgccttatttcttaatttaaaaaaaaaaatgtatatgtagactgaacgcggtggctcatgcctgtcatcccagcactttgtgaggccgattctcctctatccaggagacgggtttcaccattttgccaggtttgtctcaaactcctcggcttaactgatccgcttgctttggccttccaaagtgctaggattacaggagtgagccaccacacgtagccagtcctggcattttgtagaaggatggccaacgcagcctgttgacccttcctggccatcacatgaaaatcagcgactcttccttcttacaaaactcggagcttctcaggataacttggtgaaacgtcccccgctgtgaacctcagtgagcccacctgtaatatacaggtgagggagaagaccagaaaagctcagtcagagtgacactgacccctgaaatgatgggcacaatggagtgtgtggcttttcctgtaggacagggaggtatttagttgtagtttgaactttaaaggattccagtcctccgaaaaacaggattagactcaaatcaccttgaaccttatcatctcatggctttgacccacctacatggctccgtgtcccctgcaggcctcgccccggagctctacaatcctgtgtgcagttgtctccgcagctctctgctgggacatcaaacaggcatctccaccttcatgtgtctataagtgacttcctaaacccccaaacacattcccttacagtcctacacatctcagatgagggtgacagtgtacttctgggtgcttagctgaggttgacaccatgtattttaaatatggaaaataaattacattatttgtaa

SEQ ID NO: 203546 - DNA, 863 bp, Homo sapiens
  Payload ID: 20137
  Gene Name: zinc finger protein 701
  ENST ID: ENST00000593941
  CDS Start-End: 226-863
gtctcaacctttaggcgcctgaagcgcaaacgtcgcgatcccagtctcagggaggccgagttctctgcctggtgctgggatcttgtggaccccaccgaaggcgtcgtcgcaccccacctcccgcctcatgctgggccttgctgcaccccaagtctccccttagcagtcaccactttccttgagccagcgttggggaggtgccaggggccagtcctgtgacacgagatggggtttctccatgttggtcaggatggtctcgaactcccgacatcaggtgatccgcctgcctcggcctcccaaagtgctgggattacaggtgtgagccaccgcactcagcctccctgttttgaaggattgacttctaaagacttggtacgtgaggaaaaaacacggaagaggaagaggaaagcaaaggagtcagggatggctcttcttcagggtctactgacattcagggatgtggccatagaattctctcaggaggagtggaaatgcctggaccctgctcagaggactctatacagagacgtgatgctggagaattataggaacctggtctccctggatacctcttccaaatgcatgatgaagatgttctcatcaacaggacaaggcaatacagaagtggtccacacagggacattgcaaatacatgcaagtcatcacattggagatacttgcttccaggaaattgagaaagatattcatgactttgtgtttcagtggcaagaaaatgaaacaaatggccatgaagcactcatgacaaaaaccaaaaagttgatgagtagtacagagcgacatgatcaaaggcatgctggaaacaaacctattaaaaatgagcttggatcaagctttcattcgca

SEQ ID NO: 203547 - DNA, 579 bp, Homo sapiens
  Payload ID: 20137
  Gene Name: zinc finger protein 701
  ENST ID: ENST00000596514
  CDS Start-End: 144-579
gcacacatccgcgcagaccaggaagcggatcccgtggagtgaaggtcgcaccgcggcggccaccatgtaagaattccgttacatcttttcactcatctcagaccttctcagcgtgactcggtgaaaatgtccccgttctgaggatgtcacagctaaatctaaagcagatcatagtctcgctctgtcctccaggctgtgagtgcagtcttgtgatcttggctcactgcaacctttgtctcctgagttcaagcaattcttgtgccttagtctcccaagtagctgagattacaggattgacttctaaagacttggtacgtgaggaaaaaacacggaagaggaagaggaaagcaaaggagtcagggatggctcttcttcagggtctactgacattcagggatgtggccatagaattctctcaggaggagtggaaatgcctggaccctgctcagaggactctatacagagacgtgatgctggagaattataggaacctggtctccctggatacctcttccaaatgcatgatgaagatgttctcatcaacaggacaaggcaatacagaagtggtccacacaggga

SEQ ID NO: 203548 - DNA, 3349 bp, Homo sapiens
  Payload ID: 20138
  Gene Name: zinc finger protein 703
  Uniprot ID: Q9H7S9
  ENST ID: ENST00000331569
  CDS Start-End: 230-2002
gctatttgacgtgcggctcgaggaaggcgaaggtttttgtgttgctagccggggccagcggcggtggcggcggcggcggaggcgtcggtggaggaggggaggcggcgaggaggcgcagctcccgctgcaccgcgatcgacgctgcggagcgagcccacccgccccgggagctcgcctccccggtgctcccccgccctccccgcccccccagcggcgctgcctcctccaaatgagcgattcgcccgctggatctaacccaaggacacccgaaagcagcggcagcggcagcggcggcggcgggaagaggccggcggtgccggcagcggtgtccctcttgccaccggcggaccccctgcgccaggcgaaccggctcccgatcagggtcctgaagatgctgagcgctcacaccggtcacctcctgcacccggagtacctgcagccgctgtcctccactcccgtcagccccattgagctggacgccaagaagagccccttggcgctgctggctcagacctgctcgcagatcggcaagccggacccgccgccctcctccaaactcaactcggtggcggcggcggccaacgggctgggagcggagaaggaccccggccgctcagccccgggcgccgcctccgcagccgcggccctgaagcagctgggggactcaccggccgaggacaagtccagcttcaagccctactccaagggctccggcggcggcgactcccgcaaagacagcggctcctcctcggtgtcttccacctcctcctcgtcctcctcgtccccgggagacaaggcgggcttcagggtccccagcgccgcctgcccgccctttcccccgcatggagcgccggtctccgcatcctcgtcctcgtcgtcgcccggcggctcccgcggcggctccccgcaccactctgactgcaagaacggcggcggggttggcggcggggagctggacaagaaagaccaggagcccaagcccagcccggagccggcagccgtgagccgcggcggcggtggggagcccggggcgcacggtggcgccgagtccggggcctccgggcgcaagtccgagccgccctcggcgctggtgggggccggccacgtggcgccggtgtctccctacaagccgggccactcggtgttcccgctgccgccctccagcattggctaccacggctccatcgtgggcgcctacgccggctacccgtctcagttcgtgcctggcctggatcctagcaagtccggcctcgtgggaggccagctgtctgggggcctgggcctgccgccgggcaagccccccagctccagcccgctcaccggggcctccccgccctccttcctgcagggattatgccgcgacccctattgcttgggaggttaccacggcgcctcgcacctcggcggctccagctgctccacctgcagcgcgcacgaccctgccgggcccagcctgaaggcggggggctacccgctggtgtaccccgggcacccgctgcagcccgccgcgctctcgtccagcgccgcccaggccgcgctccccggccacccgctctacacctacggcttcatgctgcagaacgaaccgctgccgcacagctgcaactgggtggcagccagtgggccgtgcgacaagcgcttcgccacctcggaggagctgctcagccacctacggacccacacggccctgccgggagccgagaaacttctggccgcctaccccggggcctcgggcctgggcagcgccgccgccgccgccgccgccgccgcctcctgccatctgcacctccccccgcccgccgcccccggcagccccgggtcgctgtccttgcggaatccacacactttgggcctaagccggtaccacccctatggcaagagccacttatccacagcggggggcctggccgtgccgtccctccccacagccggaccctactattcgccatacgcgctgtatggacagagactagcttcagcctcggcgctgggataccagtaactacagctcttcctccaccccagccccctcaccctcctccctctccctcctcctccctccccacctgccgtcgccgctgcaacctccactactgcttgaccctgccgggattccccacccagcccttccccaccggactgtgtatttatttactataatgttagcttacaagctgggaatataagtgcattaacggcccacatgagtcaatggtatgcaaaaagtctgtgttctcccaaataataatattaatcccacaaataacgacatgatccccgcccctgttcctttctgttattttttcttagatataagttttacattttttattccttttcctctttttttggttttgattggtttggtttgagggagagttggggtctttgggttcttctagacgttttgttttcccttcctggggagtttcttgcatgagtcttaacttaaaactacgtttccgccttctctttttccctcttcccccttcattccctcttgtttccttccatttgcggttctgtttttgttttttgttttgttttgttttgttttttcctttgttgtacaagtaacagagaggaggttttttttgtaactcattttgggggtggagggggccacctgggtggcaggggccctggagctctattgacctggtacactgctccgggactcctcccccgccaccctccgcgcatagggtccttggtctggaccctgccccccaaaagtagggccttgctcctctaccttgctctgagcacggagagccctgaccccaccagtaggctcgcccccagaagggcccaagtggccgtctaccgtcaccttccagactcccgcccctaacacccagtggctacagtgcgcctgtcggggcacctggagcgctcacctggttgaattcaaagtcccagaaggccccgctggcgtgaagccggccccttacattttgcgaagtgcattatagtccttgtttttctctccctcgtgggggcaacgacccctcccctggcagtaggggtggggtaggtgactctcgctagatccctccaaagcagaccggtggcgatgtcagcggatgtcacgagctcgttagctgcgttcggggaaggttggggcgtcagggagctctcggatcacagcagcccccgccctctcctaggcctggcccggcagagcccccagagtggaccccccagcgactggggtcttctccccactcctccctccttctggtctgatgcggcagcgcgggggctgcggggcctgtttgggacgaacagagctctcccttggtaagacttattttgttaataaatggaatacttggctatattcaca

SEQ ID NO: 203549 - DNA, 14386 bp, Homo sapiens
  Payload ID: 20139
  Gene Name: zinc finger protein 704
  Uniprot ID: Q6ZNC4
  ENST ID: ENST00000327835
  CDS Start-End: 233-1471
acacaagctcaggagtagctgccatgcacatcagtgtccattaaaatgacttgtagcaaatctctacgttcaaagtctaactttgacagacaaccttacttccagcgaagtctactcccctccctccggagggaagaatgggctgcggttaagcgtttgccctggtgtcagggccaactgcttcgaagcgccagactttcggagactgtgggtggggagcattaagcgggaaatgaccttcacatttcagtcagaggacttaaaacgtgactgtggtaaaaaaatgtctcatcaacacgtgttttccttggccatggaggaagatgtgaaaacagcagacaccaaaaaagccagccggatccttgaccatgaaaaagaaaacactcgctccatctgtctccttgagcaaaaaagaaaagttgtttcctccaacattgatgttcctccagcaaggaaatcttcagaggaactagacatggacaaggtgacagcagcaatggtactaaccagcttgtcgactagccctttggttcgaagtcctcccgtgcggccgaacgagagcctcagcggatcctggaaggagggcggctgcgtgccttccagcaccagcagcagcggctactggagctggagcgcccccagcgaccagtccaacccgtccacgccgtcgccgccgctctcggctgacagcttcaagcccttccgcagccccgcgcagccagacgacggcatcgacgaggcggaggccagcaacctgctcttcgacgagcccattcccaggaaaagaaagaattccatgaaggtgatgttcaaatgcctctggaaaaactgtgggaaggtgctgagcactgcagcaggtatccagaaacacatccgaaccatccatctggggcgcgttggagactctgactacagtgatggagaagaggacttttactacactgagatcaagctcaacacagactcagtggcagacgggctgagcagcctggccccggtctcaccttcccagtccctggcttcacctcctactttccccatcccagattcaagccgaacagaaactccttgtgccaaaacggagactaagttgatgacgccgttgagccgctcagctcccaccaccctctacctcgtgcacactgaccatgcttaccaggccacaccccctgtgaccattccaggatcggccaagttcacccccaatggcagcagcttcagcatttcctggcaatctcctccggtcactttcacaggcatcccagtgtcacccacacatcatccggtgggcacaggagagcagagacagcatgcgcacacggtcctgtcctccccacccagaggcacagtcagcttaaggaagcccaggggagagggcaaaaagtgtcggaaggtgtacgggatggagaaccgagacatgtggtgtaccgcctgccgctggaagaaggcctgccagaggttcctcgactgagagacccccaggcagaggggctcagggccctgagccgctcctgccctggcctgccactgcaggtgttggaaagagcttttcctactgaataaaacacagttgaagccaggaaaagccctttcaggaaccttggaggaataacagcaaaaacacagaaaaattgtttaagtcaccacctatgacaaaagaaagttgctcttactgagaacccagcttggagcagctataactagttttttttccttcaaaagaaaagtcaactttttttgctgtatgtctagacttaaaactgtggacttctgtagcaattgaaccaacaaagcccattttacctagaaaggaggcatattttgataagctttctgaattatgccattttcaagatttttttgacacttaaaaaacaagctacaggttattcagtagcatttgtacaaagatcaatacttacttttgttgtgaataatcttttccgtatcttccatttgacttcttggagcagtatatgtcaggatgtgttgcaagacagcgcagcactctgggcatcttttctatggctttttgtttgtttttcttttaagaatggccccacactgaaccatggtagagctattagtttgtagggccccagatggcataaactcgagaagggattgtccacggaaatcaccagcagacttcagcccgaagctgagttcaggaagtccagctgtcactgttgggaaacatctaggagtcttccttggatccataagaagctcttcccctaaaggcagcacagctaactctactctctacctgccacaactcagtcaagaattggcacctgtagccatctgggtaagcctcgatgcttctttcagggatgtgacacaaatggcaactcggagctatttgttactgcttgtctgtcaagattgtagccaggttaatgggtcattttccttctctccagactccaccactgactgatttcagaagaggtagagaactccaaactgtcccagcaggtttgctttagacaacagagcacagcccacatggccctacctgttcagaaagtcatgttagatcaacaaaccacttccattctgagtgcacttttataggttttatgctttagcatgtccgggagatgagttaattaacaatataaacattatgtgagtaaatggaaggtccaaactttaagtttttcttataaaaatattggagctattcatttaagaatttgctcaaaagggaacataacgccaaaaggaaaatgcatgtaggtataggaatttctcagtttagtagggccagggcttgcactatgttccatttattgggcttcgtaacttacttgcttgtttgtttgggggatagtggtgtggggagaggggagtcgtcaagccctataaataagctcattctctatctacccgactctcaattgccctgctaaagagttatttctcctatacctatgcaaagtaggaagagcaccttataggaggcactgtatagggacaggggacatgggatcagccataggaatgttaaatgaaattgcacagaggaaagtttaatatatgtctagagattatacatacacttttttaagcgtaaaaagaagacatctagtaatgacagatattctttttatatacaagcaaaagaaagtataaggaggttctacagtgcaacatccacaatctgtgcattcacatattatgggacttttattttttaaactctcatataaattttttaaaattactccttggaagagatcctggtttttttcttcatttatttttttctttaaaaacatttattttaagagaagagaaaaagagcttcatctaattttgcatcttgattaccaatcagtactagtcacagcaccagcaatactgtatgttttagactgacaaggtcagccaggaaatggcatttttttaaacgcagaaatgtgtttgtttcctctactctaacacgtcctttctcctcctggtgtcctgtcaccccccatgcagcaccactgatgcgagatgatgctctggcctggtccaggaagccctgagccatgggcagattgcccagtggccttgggcggccagagcttgtcacctgtttaaacaagttcaccatgtgtttaaatgacagggtacagtcctggaccagaggtttttctcttcagcaaagctccctggcccttgatcgttggactgttactaatagaaaaagattcaagtcatgaagtataaaatccatcccccatcccagaactttgaaacacaaggagggagagatctttgctatggagcagtcctggagcaaagccccgtggcttccacccccagatatataccccataagtagtgctgagctccagcttagctgagccaagctcagtccttatctggtgttcagccagtgcacaggtataagcagaactacagagctgaatgtagcttccctgggatctcttctcctttctaaagcatttttcacacagttctgtacctcctacccaagttggggctgctttctgcctgctagcccacggctctgtgtactttcttttctggcttcaggtgcagacagaccctcagtaccttcctggacacagacacatattccctggaccaaggcgtggaataactagtagaccaccaagccacaggtggctggtcttgaagaaaagggattatactccttacaggccacccagaaagctatgaattccaatatacaccactgatcgtgcaagttagggttttttttttttaaacgtagcattattttgttatattttggaactaaatgaagtgccaaattaaccagacattcgtttgatgccatctctgtggaaccaagttctctgtgtgtgttcgtttggctgggaggagggggaggactgggcagactgctcccacagcaggctggcagtggaactggagccctggccaccgcagggagctcagaggccaatctacgcaaaaggcatgcaaaacaatggattctggtcccaaaatatttctaagtaaggcatgatgtagccttttgattttttttttatcctttgacaccccagccttcagaaaaggtttttcatctctctccaaagaagtcatttcatagtgactgacaggacattctccagagagcgacaaagcagagtggccagcaggcagtggtgttaagccttgggccttcccagcagatgtgtgctgcattggtgggtgggaggcagtgtgacagcctggagaaaacacacaggtagcaagggagtcaggggggaggtacaagagggctgtggacacctggctcttgctcatcttcttggtgctgatcagctggtggtcaccatccctaagtacctcccagggagctgccattttctcctctgggagcagctgcctgaagcaaggagagaatgacctgaagggaagtacctccggccaagagtgcagggctgctgtgcctagcctgagcgggccatctctagcagatatggacttctctccaccacactagctgaaaagttttctcccttggttggcaaaagccagtgtcaggaaaaaagctgtgggtttctgaccaagaatgtgtgcgcttagctgcaaagtgcctgtcagcagctccaggcaccaacaaggtgcccttttattagacaattcctgcccgaacataaccatattgcagatgaaaattttcaatagagaatgacacaattcttgacctttctaaaaacttttcaaagagatagtcacatgtgtatatgttgcaaaagatttttgaaactgaaatgtcctccattaaatctcaagagcactcgagttttaagtctgctgtttctggtgtcacactaagacacacttttgaaagcagccctgggttctgaattagttggcactgctgaatccatgttcccccttcatcagactccaaagtgcagcattcacttgcaaaggttgagagaaaagtggccagaattgtacatataacagagaataccttgagaatagtagcaaaatactgtaaataatattcatttcctcagggaaaaataaagggcatgcaaaaataggtctggagactcctgaaactaggaagaattttgttatcactaaagtcttttatagtcagaacaatttttttttcaaatgaacatggtatcatttcaagacaaatttatgtgaactgggcagtactgacatttgtgaggcataggggagtgccctgggaaaacggtttggagctgacctgtagcctaaggctaacatttgaaccacaggtgcaatgcctgggggtgggggagggggacggggtgggggtggtattcctagactcacgtaaggctttttctgaatgtaattgtgaatacaaagccttgctggtcctttttatcattacccaatggatgactgtttattagctatcagcagaattccgtaggcgaaagcaagccgtgaacgatgtacattttgctttaatagcatgttagcgaacaaacttccatggacttttgtggacaaggtgctgctttttctcatgaccctgtagaattgctatcgaccacatcttctgtagcactgacctgtgtgaactcagggaagaatttgtgcatacaaatgagtggaaacagagcaggattcatgaatatgaatgagaatgtgaatcattttggagaatgccctgggcacacgggtcaactggaaatttcatttctctaagaaagtagccctaccagcggcacggactgttcctgttcctcatacctgtggggattcctccatattggaactgtttcatgtatcttttttgcattgtaactagccaaacctgaagtcagtaaataaaatgagattagcactttttttaggtaccagttgtatcactgagtaatgcacaccaatagagcaagaaagtataaaatgtatttaagaccaactggtttgcttattatgactgactttgaaaaagcccatatccaatgatatacatgctttaaaaggtatatctatcgtaggaccaggaaccaaaatgggaattttacttctggtcctgttttgtaaatagttcctttttttgaagacaatctcatgttttataacttttgttgtgggtctgagaatcacaatggtaatatgtcttggcaaaacataacctttaaatacaaaaacaattataacttaattttccaaataaaacaagaaatacactgattaggcttctacagttctaagagacatgacactttggtaataagcgtcagtactctacttctcaagttaactggaaatattttacaagatgcagtgttttgtaatcacaaagaacgcagacattttgtgagaaatgaccttggttttatacattgtagcttattttttaaaatatagtattttaccaggcaggaagtattaatattataagtaattcttgctcaccaaacaaagggctatgtctcttttaagcaaatgttttgatgcatatctttttaattaaccctctgcagcaagggtagaaatacagatcagatggaatgggtattataggagaatcaagatagcaacagctactccttttaccattactagtgtgttttcaaagtatggaaaaagatgcctgaagagtcattttatatattttaaatctaaaaagtgttaacaggtatgcttataggccatgggagaaatattcttataaattttttagtgtaaaatgataaattctgtgtcacaaagacaagtttaccacttgacctaccagaatcacagatacttgcatttaactagcaagtatcatttggtggaaatttctaaaatcatagtagacaggcccaaagatagaattcttaggtgatcagtagtgtttaaaataattttgtcctcagcactaactatataactgtaatttctacataagaacaagtgcttccaaaatatagtggagggaaaaaataaaaaaggaaaataaaaaaacaaaacaaaaagaacaagtgcttgatttttcactgtgaagaactagcaggcacatgaggttgtgatcagaaagtgactgagttcccaagaaccaggaaacagaggggagttgtgaagagtttattaaaactgtacaaataattcagagctttgccaaaaccatttcataatgctgtacagttttttcaagcccactcactgttaaaacaagaaagcaccttttctttctaagattttagtaatccaaaagctagcctaattagccaagtatgcagataacatcaaaagcaaagctgagatagaacagccatacacccgttgggcagctcttatgaggtggtcagaaggtcactcagaccttggtttcaaataggctttagaatctgcacacttgaggactagaaatgcacagagttagggaaagccatgtacaggcttggctcctagtctttgagatgaggcgtcttgcaaatctctgttttcactccttggaatgtctccattgttagcattaaagtccccaagaagtttttattgctgtacggttttgaacccaatgagtctcatttccaaaagattcctaattctatataggagaggttgcaaatgtcagtgcctcagaaggaccaggcaagttctgtaaatgattgatgtggataaggcaaagaggaacacaagaatggtggagaccaggttgaactgcagaacacatgccctctttgaaggggtgcccacactcagctctagacaatcagaaccatgcagaaatcaggcccagggctgctagatcttctgacgtggaagtatgatattacctgacacgtaagtgttgacaactaactcaaactcttggccaacactgtgcagaccaaagagaagctgtacacagacaggtgcagcctgcagcccccagtttcaactattgggaaaagtggatttcacattccacagttgtcaggtcaggttcatccatcagccccacaaactcacatgtcggcactatctgggcaactaaaataaaagaggggaaagagatcatttctccccagatatcattctcatggcagacttgaatatagatacgctgagttatccagctctctcactctgcctccttttggcatgcccaggctgtgccccgtaaagtgttgaatcactgttatcctaattttcttagtgttttctaccgtggccactgtgatgaggggctggcaaagagcagcctcgtgccttccgagaaggctgccaggagcctctgaagcttgaagcgagcacacattgcctccttgtgccaaagcccttggccagcctccccacactccttccctctccatccggcctcatgagtcttcgttaccaagtaaaattaccactgcttcacctctgatacagcagaagccttgcttcagaactggtaggcatttaggctatttcagagtgtccactaacctcaaaaggaggtttttccacatacaaaaccctagcatctttgaggggaaagcaaaatgagaataaattatgtcatgaaaaaaattagaagttgcttccttcatttagatggactaagttattttaaactctatcttacatcagagtcctgatggtgttgggatagtcactgaccctttcacgtatgtaataagatacgtctcgttcacacactatttcatttgatctttgtaagaacccagtgtagaataggaatatttaaaatcaacattacccacctccaaggccaacccagagtagtcttgaacctgagtcagcctcagtattgcttgcaaggaagagggaaggggctcattaaaggcctggctcaaaccttagtcttccagactgactagggacgtaagaagacccagggacccaccatgttctcaaaccatctattcagtccaggcctttcagcatagacataaagagcccacccgttactcagtcatgttgccaagtgcaaactgatttatccccagatgaatccctttactgtagcagatccctaatccctaaatttcagccaatttggtagttaattataggagtttattagctaaatgtatgttctgagtaaaagttttgactctttggggaaaatttattttgctgctagcatacaacatttgctatgtatataaacttaagtcaatgccagaaattttaaaaccagctcaaatttataatctgtaatgatcaaatcaaaacatactgtaaactcagagttggaaacgcctggtaatatggttaagtcatgtttaaatatgaatgcaatttaaatgacattggcaatgcctgagatttctttcattgtgaatgattaaaaggcagtccaatatatgaatggatttcatcttacctttctcccgttaatttactaggtgtaacatcttgagtgtaaagtcattcacaggcagttgggttgtggagctagaaggagcctcaaaaaaaaactttttggccagactcctacatcatgaacagggtttttgatgaataatatttattattatgtttctaaagtaatacagtgttggagaatgaaacagtttagtcctttcctcttctgatggaaaagaatcatagcgccgttgccatgacaataacaggatgtagaaagacccatgaagaaagaaagaagaaagctatggttccgaaagcaggtaaccacagattttgaaaggaggcagagatggtgattaaactgtagtccttgttttttaaaatgttctttcatgttaggcaccaccacatagttaataactaccaacttctaaagagaagatccccttgatttatttatatcatgaaaatactaaaaatcaattctcaagtctaattaactattacattatcttgctaggtccttttccctaaatttttaattcagaaaattaaccagaattggccagatgcagtggttcacgcctataatcccagcactttgggagtccaaggcagatggatcacttgaggtcagtagttcaagaccagcctggccaacagaggaagaaagagtgaaaacaaaagaagaaagagggaaaccctgtctttactaaaaatacaaaaattagtcgggcgtggtggcgcacacctgtaattccagctacttgagaggctgaggcaggagaatcccttgaaactgcaggcagaggttgcagtgagccaagatttcactgctgcacctggggtgagactaccattaaggaaggaaatttcctttaaacagaaaaaaacaaaggtgctcatctatttcttctgaattctctctacatccttgacttaagaggaaaaccagcactcaagaaacagctttaaaagagaacagtccccattctagctaccagtcttgctttcccccatcttggcaagccccagtgaatttgccattgaaagattaccctcccctttgccctcatctgcctgagctagaggccaggctgttgttaatgttttttcagttccaaagcccctgatgggacattcttgtttctgtgctactgctttctctctcttaaattaaggtgcaaggggataaatattactataactgggatgtaaggctcagtcagtgtggctattccctcccttcgggggaaatattccatctgtctgaacggttttaggtgatcatgaggagagcggcttagtcacacagccagccacgctcatcacaaaagatttgttcagactcactgtaaagaatgacaaggcagatagctaatcctttcactgtgcctcaaagcccgccgtgcaagtcaccaaccctaccggtcctctccacgtgcgaggctaatagagtgatcagaaccaggaatgtgagctgggttccaccttaggaggggacaatgaggacagagcaagagggctccatgtttaattactccaggctctgacttctgcccacaattacagagcatgaaagcagaattggcctttagtaagtgaaaaggaagtggctcctgcagcatataattgttataatttcgtatttatggaaagagaaaaggacttcagtccactcatgttgttaagcacttgtccctcactccactggagcccccttcctatgttttgggcacagatggctgggaccgagaggaaagaggaagagcggctgccagagtgtgaatatacccctcagggatatacagcggagtttcatgataaactacccatactttcccaaaaaaggttgaggagcaatacataactttgcagattacaaacccttgttttactttttaaaccttttttccatactctgcttattggaaatcgatggctgtgatgtgaccaacacctgtgatgatagcaaagcccctcctttcacagtctcctgactgttcggggaacctccttggtcattggtagaaagctttagaaaagacttagctttttagggaagaactaaaaaatctccaaaacatactagtcccatgacttcgataactgaaaatgtcctgggtgtaaactaacccaggaatgtggatcatacatgttttttttaaaaaaaatccctgaatcaatattttcctacaacacaccctaaaattcctatttttgtaattaatggttggacagtgatcagccatttaaacataggctttctggaataaccagacactagaatagtttccaaagtgttttgcgtatcaaaatcctatatacttagaagaagaactcaggataagaaaaaatcgctaggtcccaaagggttcatgactatcatcagatgcaactgcgagtggcctacggtcattttttcaaatgagaagactggagagagagaacaacagtaatcacaaaacctctgttgcccttagtccatgacaatgtttaaggaaactttaaaaaattaagccatcttctgaattgttttctacaccaaatctaaaatattaaaatgaaattattaaatatttaaaatggggtatttagtggaaatgcaatcagtagaaaacattgctttttagtgcctgctaaacaagtaaaggagaaagaatgaagagaaaacagcagtccttcctgtgtgacactcgtgtggaaatgacaggcattcacatgtcattgagtgctaactcaaaagctaggtggcaatgctgtccaatgtttagagatcttttgaaatataattttaccaccattcagaggtaagtacttgcttaacagaagtctttaatgttagtgaatgaatgtataaaattataaactatgcattttcaaagagtagcatgtattttgtatcgaatccaagtaaatttttttcatagctacctaccacaactgcaaattattcaaaataaacttggatacatatccttatggggatatgggaagcccatctatattctcctacttgatgtttttaaagattgaaactttattctgaaacatcaggctctaaaaaattccatcattaagatgaataaatgggaaatggtttatttgttacttcgtaagcataaatgggaaatgttggctgttagaaaatgtgcccagttctttaaaggtggatgttctagtaacactggattaacaagcaaacaaaactgcatgaagtgaacgaatatttcattggataaagttagcataggttttatctgctgggtttaattctcaatcccagaaaaaaatattcttcaaggggtatcagttatagtttcaaagaacaaaatatgaaaatattgtccagcaaagcaaatcattgatcttttttcaaaattacttatattttggaaagtctatatagaatatccacaaatttcttcagccctcttgttgatttcatattttcatgaaactttttcccctaataatttgtcttcgctctttaatcagtgctttactacattactcagcctgaaaaaatatcttttccttcatctgacaatgtggaaataaagaactccatttctgtcattctggttctcttcagtgtccattgagaaagtttctcaactgtttgtaaaatacggggggaaaaaaacacgcatttctaaacctggtacttaaggttatactggattgtttgctacctaattagaagttattggggaaggggcattgtgtctttttatatgatttttagccaaatccagatgttctgatacacatttctgaatacctgtctgactgtaaatacagcctgtggaggttcaggttgataaacctttcacctgactgctccacagccatgctccttgccagcttctggcacattgtacatagatttgttgaatgtttaaatgatgttgtttttctaaatgctgttctctaaaacaattttttgaatttcttttgctttccattgttttggactttgtgtgttcgttttttaaaaaaaaaaatgtttcctaaatatttaacaccaggaaaaatatttttaaatacactggtgctaattgaaacagaaggaaattttcagatcgaagatgtacaatgttaaatgttcataccagttaaactgcactttcccaaggggacagctggcatctacttgaaatgggcatcaagagaccaccaaatgtttacagtttctgtggcccgtttaagtgtaaaatgcagaagtggctctgtccccccagagttaaggatttgctacactggtcctctggaagcatttaagtagaagaaaaggcttatagtcagaatcactttagtaatcgtcttctggtccttggacttttctgttctgtaatgcttgtaacaatgaatatggtgttgccaatctagtctgatatcattgttgacctgtacttactttgtggatggttctacctggggttgcactggcacaaacagagccagaacactggactttcaaaagaccattttgacttctacagtgtccacacacatgaatttaaatgcacttgtaactggttaattaccatgaagtaagtctaacttccacttaataaaagtttttgtgtatctgcttcta

SEQ ID NO: 203550 - DNA, 712 bp, Homo sapiens
  Payload ID: 20139
  Gene Name: zinc finger protein 704
  ENST ID: ENST00000519936
  CDS Start-End: 144-712
acgaggaggtggtcgtcgaggtggtggacggcgacgaagacgacgaggacggcgaggagcgtttcgtgcccctcggacccggccacgcagtccccaggggcccggcccggggcgcgttgaaggtggggagcattaagcgggaaatgaccttcacatttcagtcagaggacttaaaacgtgactgtggtaaaaaaatgtctcatcaacacgtgttttccttggccatggaggaagatgtgaaaacagcagacaccaaaaaagccagccggatccttgaccatgaaaaagaaaacactcgctccatctgtctccttgagcaaaaaagaaaagttgtttcctccaacattgatgttcctccagcaaggaaatcttcagaggaactagacatggacaaggtgacagcagcaatggtactaaccagcttgtcgactagccctttggttcgaagtcctcccgtgcggccgaacgagagcctcagcggatcctggaaggagggcggctgcgtgccttccagcaccagcagcagcggctactggagctggagcgcccccagcgaccagtccaacccgtccacgccgtcgccgccgctctcggctgacagcttcaagcccttccgcagccccgcgcagccagacgacggcatcgacgaggcggaggccagcaacctgctcttcgacgagcccattcccaggaaaagaaagaattccatgaa

SEQ ID NO: 203551 - DNA, 3455 bp, Homo sapiens
  Payload ID: 20140
  Gene Name: zinc finger protein 705A
  Uniprot ID: Q6ZN79
  ENST ID: ENST00000359286
  CDS Start-End: 90-992
ttctttctccaacctcagcttttcttagtgcctaaagtgtctgcacatggaaatccagaggtagacagagagaaactgagttccggacaatgcattcactaaagaaagtgacttttgaagatgtagctattgacttcacccaggaagagtgggccatgatggacacatccaagagaaagctgtacagagatgtgatgctggaaaatatcagtcacctggtgtccctcgggtaccagataagcaaatcctatataattttgcagctggagcaaggaaaagagctgtggcgggaaggaagagaatttcttcaagaccagaatccagacagggaaagtgcccttaagaaaaaacacatgatatccatgcatcctatcaccagaaaagacgcatccaccagtatgacaatggagaactctctcattctggaggatccttttgaatgtaatgattcgggagaagattgcactcacagttccacaataactcagcgtttgttaactcacagtggaaagaaaccctatgtcagcaaacagtgtggaaaatctcttcgtaatcttttctcccctaaaccacataaacaaattcatactaaaggtaaatcatatcaatgtaatctatgtgaaaaggcctatactaattgctttcgccttagacggcacaagatgactcacactggagagaggccatatgcatgtcatctatgtggaaaagccttcactcagtgttctcaccttagaagacatgagaaaactcacacgggagagagaccatataagtgtcatcaatgtgggaaagcctttattcaatcctttaaccttcgaagacatgagagaactcaccttggaaaaaagtgttatgaatgtgataaaagtgggaaagcctttagtcaaagctctggctttagaggaaacaaaataattcacactggagagaaaccacatgcttgtcttctatgtgggaaggccttcagtctgtcttccgaccttagatgacatgagagaacatgcactggagaaaagccatatgaatgccatttatgtgggaaagccttcagtcaatgtactagtcttaaatagcatcagaaaattcacgctggagagaaaattataaacttcttcagaacatattctgactttagatgacactgtgttaggaatgacgaaggtaaggaatgtggaagagacttcagctgtagttgtagcatctaaacatgccaaaggactcatattttgaagaaatactggaatcaacatggaagatacttcagttacctttattcttcagtccacatcaataaattcatatggaagagaaattgtatgacatgtatgtaccaaagacttgttagtgatctgagcataaatgacatgagagagctgaaactgtcaacatagtcaactaaaagtcttcagcaacagctttaacttaaaacatgtgggactttcaggtagagaatctctaactctgcattcagtgtgaaaatatttttatttgcaatttattgtcaaataacatgagaaaactttacttggatgaaccctttatttgtattttctgtgaataaacattcagccaagcaccaggcttgatgttcacaagaaaacagagtgataaaatgctgctaaaatggaaaataagagaggaaagccttcataagctaaataagaagggaaagtctttccaagggcaatgaattctcttggaataccaaatacttcttactggagaagttatgcaatgaaaaatcatgagaaatcctttcttcatagagcaacacttgtggcacatgtgagatttcacactggacaaaacatggttagcatcctgaaaggagaaaattctttagtggtaattcatttcttagttgacattaagtttctcacattgaggagctatcaaacttgaaaatcactgtggagaaacctgatagatttctcatcagaaaagtgagtcaagaaggtggacctctagaaaaaactcttaacacatactttagcaaaataattcagaaatttgagaaaatatctattcataaaaatgtggcatataaatgcataatagtaaagtgaccagggaataaattgaatgcagaattatataagaaatctcattaaacttttccaaaagatcaatacttacaaatattgaaagaatacaatctgttgttgaaaaaacttagtatgttggcgaagcccttgtttcatttatgcagccctaacaaatcgatttgcatctgcactccttgggtgagattcttggtcgagattctaccccaacttctgagtctccccagtctttaacagctctttcctcacagctcacctccctttacttcaacgtccactaaaaccacttgtttccatccaaccctcgagttgacacaccagggatcttcagccccacttgctagatttctcagtgtgtcattgcatagatttagcagggaaatggaggctgtatcaaagacccctagtatatgcatttgggtgtccgcagcccttgcctctgtctctgagcagttacctgggatcagagaataaggcagctcttctcttctatccctcagaaggctcttgaaattttgtccctggagcctctctaactggaagtagcagttcatctcatgacaccccacattttattcaggtgagtcctgagttattacacagagacagacacagctgtgctccttttactgcagtccagaagataaaacaccagcatgataaaacagccgaacctgtcagccaccttgcaagcctttcctatattcgattcaatgtacttttcccgaagcaaaatgaaagttctcacagaggggccctcctctgccttgtcctcagaattggaaaatgtattgtccgtgaaggagcctcagtactgaacctaaaactcaagagaaaatgtttcctgaatatcaagtgggatgacttgaaattttgccaaacaggcacaatcttaatacgatcggccttactaaggctaaatggccttatccgtggttgaagttgacaaatcaatatattaaaaaatctccacaagtgattgattttactctgcagccagggtttatgtcaagtgtgaggataatgagcaagaaattcaagcccttggcaaactggttggagaggcaaggactgtgtccaggcagagctcatatcattatttattgtttaatctatttaattaaatatgtaatttacccacaaactgtggctgacattatatgtactcctgagccacattgagatgtactatttgtgctatgaaattctatgggatttgacaaatgcatggtggcagatctccagccattattaaagcgtaacacagaatgcttctcttattcaagctcatcttccctccacatagagggaatcaatcgacttttgtatactgatttttgaatttgcttctttatttccatcttcttcaattaaagcacaagatatcgt

SEQ ID NO: 203552 - DNA, 751 bp, Homo sapiens
  Payload ID: 20140
  Gene Name: zinc finger protein 705A
  ENST ID: ENST00000396570
  CDS Start-End: 131-751
taatggaaaattgcaaggggtttttcctgatctactttgaaatgcaattccgcttaaagcttttcttagtgcctaaagtgtctgcacatggaaatccagaggtagacagagagaaactgagttccggacaatgcattcactaaagaaagtgacttttgaagatgtagctattgacttcacccaggaagagtgggccatgatggacacatccaagagaaagctgtacagagatgtgatgctggaaaatatcagtcacctggtgtccctcgggtaccagataagcaaatcctatataattttgcagctggagcaaggaaaagagctgtggcgggaaggaagagaatttcttcaagaccagaatccagacagggaaagtgcccttaagaaaaaacacatgatatccatgcatcctatcaccagaaaagacgcatccaccagtatgacaatggagaactctctcattctggaggatccttttgaatgtaatgattcgggagaagattgcactcacagttccacaataactcagcgtttgttaactcacagtggaaagaaaccctatgtcagcaaacagtgtggaaaatctcttcgtaatcttttctcccctaaaccacataaacaaattcatactaaaggtaaatcatatcaatgtaatctatgtgaaaaggcctatactaattgctttcgccttagacggcacaagatgactcacactggagagaggccatatgcatgtcatctatgtggaaaa

SEQ ID NO: 203553 - DNA, 499 bp, Homo sapiens
  Payload ID: 20140
  Gene Name: zinc finger protein 705A
  ENST ID: ENST00000402465
  CDS Start-End: 268-499
cagattctggcatccacgtgagcccagtgatcccaatgagcgctgcgttgtgctaaattttcgtaaatcacccaaaagatggggctggaatgatgttaattgtcttggtcctcaaagtgactcgtcaaaaatctgcataatggaaaattgcaaggggtttttcctgatctactttgaaatgcaattccgcttaaagcttttcttagtgcctaaagtgtctgcacatggaaatccagaggtagacagagagaaactgagttccggacaatgcattcactaaagaaagtgacttttgaagatgtagctattgacttcacccaggaagagtgggccatgatggacacatccaagagaaagctgtacagagatgtgatgctggaaaatatcagtcacctggtgtccctcgggtaccagataagcaaatcctatataattttgcagctggagcaaggaaaagagctgtggcgggaaggaagagaatttcttcaagaccagaatc

SEQ ID NO: 203554 - DNA, 339 bp, Homo sapiens
  Payload ID: 20140
  Gene Name: zinc finger protein 705A
  ENST ID: ENST00000398526
  CDS Start-End: 1-305
cagacagggaaagtgcccttaagaaaaaacacatgatatccatgcatcctatcaccagaaaagacgcatccaccagtatgacaatggagaactctctcattctggaggatccttttgaatgtaatgattcgggagaagattgcactcacagttccacaataactcagcgtttgttaactcacagtggaaagaaaccctatgtcagcaaacagtgtggaaaatctcttcgtaatcttttctcccctaaaccacataaacaaattcatactaaaggaaatcccacttccagctggatgtctggatgaactcctgaaagctgctgagtgtcctgcagcaggt

SEQ ID NO: 203555 - DNA, 3378 bp, Homo sapiens
  Payload ID: 20140
  Gene Name: zinc finger protein 705A
  Uniprot ID: Q6ZN79
  ENST ID: ENST00000610508
  CDS Start-End: 117-1019
attttctcaagcaatttttaaatttcattcatttaccttattgagcttttcttagtgcctaaagtgtctgcacatggaaatccagaggtagacagagagaaactgagttccggacaatgcattcactaaagaaagtgacttttgaagatgtagctattgacttcacccaggaagagtgggccatgatggacacatccaagagaaagctgtacagagatgtgatgctggaaaatatcagtcacctggtgtccctcgggtaccagataagcaaatcctatataattttgcagctggagcaaggaaaagagctgtggcgggaaggaagagaatttcttcaagaccagaatccagacagggaaagtgcccttaagaaaaaacacatgatatccatgcatcctatcaccagaaaagacgcatccaccagtatgacaatggagaactctctcattctggaggatccttttgaatgtaatgattcgggagaagattgcactcacagttccacaataactcagcgtttgttaactcacagtggaaagaaaccctatgtcagcaaacagtgtggaaaatctcttcgtaatcttttctcccctaaaccacataaacaaattcatactaaaggtaaatcatatcaatgtaatctatgtgaaaaggcctatactaattgctttcgccttagacggcacaagatgactcacactggagagaggccatatgcatgtcatctatgtggaaaagccttcactcagtgttctcaccttagaagacatgagaaaactcacacgggagagagaccatataagtgtcatcaatgtgggaaagcctttattcaatcctttaaccttcgaagacatgagagaactcaccttggaaaaaagtgttatgaatgtgataaaagtgggaaagcctttagtcaaagctctggctttagaggaaacaaaataattcacactggagagaaaccacatgcttgtcttctatgtgggaaggccttcagtctgtcttccgaccttagatgacatgagagaacatgcactggagaaaagccatatgaatgccatttatgtgggaaagccttcagtcaatgtactagtcttaaatagcatcagaaaattcacgctggagagaaaattataaacttcttcagaacatattctgactttagatgacactgtgttaggaatgacgaaggtaaggaatgtggaagagacttcagctgtagttgtagcatctaaacatgccaaaggactcatattttgaagaaatactggaatcaacatggaagatacttcagttacctttattcttcagtccacatcaataaattcatatggaagagaaattgtatgacatgtatgtaccaaagacttgttagtgatctgagcataaatgacatgagagagctgaaactgtcaacatagtcaactaaaagtcttcagcaacagctttaacttaaaacatgtgggactttcaggtagagaatctctaactctgcattcagtgtgaaaatatttttatttgcaatttattgtcaaataacatgagaaaactttacttggatgaaccctttatttgtattttctgtgaataaacattcagccaagcaccaggcttgatgttcacaagaaaacagagtgataaaatgctgctaaaatggaaaataagagaggaaagccttcataagctaaataagaagggaaagtctttccaagggcaatgaattctcttggaataccaaatacttcttactggagaagttatgcaatgaaaaatcatgagaaatcctttcttcatagagcaacacttgtggcacatgtgagatttcacactggacaaaacatggttagcatcctgaaaggagaaaattctttagtggtaattcatttcttagttgacattaagtttctcacattgaggagctatcaaacttgaaaatcactgtggagaaacctgatagatttctcatcagaaaagtgagtcaagaaggtggacctctagaaaaaactcttaacacatactttagcaaaataattcagaaatttgagaaaatatctattcataaaaatgtggcatataaatgcataatagtaaagtgaccagggaataaattgaatgcagaattatataagaaatctcattaaacttttccaaaagatcaatacttacaaatattgaaagaatacaatctgttgttgaaaaaacttagtatgttggcgaagcccttgtttcatttatgcagccctaacaaatcgatttgcatctgcactccttgggtgagattcttggtcgagattctaccccaacttctgagtctccccagtctttaacagctctttcctcacagctcacctccctttacttcaacgtccactaaaaccacttgtttccatccaaccctcgagttgacacaccagggatcttcagccccacttgctagatttctcagtgtgtcattgcatagatttagcagggaaatggaggctgtatcaaagacccctagtatatgcatttgggtgtccgcagcccttgcctctgtctctgagcagttacctgggatcagagaataaggcagctcttctcttctatccctcagaaggctcttgaaattttgtccctggagcctctctaactggaagtagcagttcatctcatgacaccccacattttattcaggtgagtcctgagttattacacagagacagacacagctgtgctccttttactgcagtccagaagataaaacaccagcatgataaaacagccgaacctgtcagccaccttgcaagcctttcctatattcgattcaatgtacttttcccgaagcaaaatgaaagttctcacagaggggccctcctctgccttgtcctcagaattggaaaatgtattgtccgtgaaggagcctcagtactgaacctaaaactcaagagaaaatgtttcctgaatatcaagtgggatgacttgaaattttgccaaacaggcacaatcttaatacgatcggccttactaaggctaaatggccttatccgtggttgaagttgacaaatcaatatattaaaaaatctccacaagtgattgattttactctgcagccagggtttatgtcaagtgtgaggataatgagcaagaaattcaagcccttggcaaactggttggagaggcaaggactgtgtccaggcagagctcatatcattatttattgtttaatctatttaattaaatatgtaatttacccacaaactgtggctgacattatatgtactcctgagccacattgagatgtactatttgtgctatgaaattctatgggatttgacaaatgcatggtggcagatctccagccattattaaagcgtaacacagaatgcttctcttattcaa

SEQ ID NO: 203556 - DNA, 1207 bp, Homo sapiens
  Payload ID: 20141
  Gene Name: zinc finger protein 705B
  Uniprot ID: P0CI00
  ENST ID: ENST00000400120
  CDS Start-End: 283-1185
gtccttgtcccaagggacatacagcacacagcctgtggagggtggaggaaccaactgcaagatcacttgtcctcctcaattgatgtacactgaagaaagagccaccttcaggctgtaaggtcatcgtataatcctgaccactcatttcccatcatgacactgctgttccttctctttctccttcttggatgtctgatacaaacagcctcagcttttcttagtgcctaaagtgtctgcaagtggaaatccagaggaagacagagagaaactgagttcctgacaatgcattcactagagaaagtgacttttgaagatgtagctattgacttcacccaggaagagtgggacatgatggacacatccaaaagaaagctgtacagagatgtgatgctggaaaatatcagtcacctggtgtccctcgggtaccagataagcaaatcctatataattttgcagctggagcaaggaaaagagctgtggtgggaaggaagagtatttcttcaagaccagaatccagacagggaaagtgcccttaagaaaaaacacatgatatccatgcatcctatcatcagaaaagacacatccaccagtatgacaatggagaactctctcattctggaggatccttttgaatataatgattcgggagaagattgcactcacagttccacaataactcagtgtttgttaactcacagtggaaagaaaccctgtgtcagcaaacagtgtggaaaatcccttcgtaatcttttgtcccctaaaccacgtaaacaaattcatactaaaggtaaatcatatcaatgtaatctatgtgaaaaggcctatactaattgcttttaccttagacggcacaagatgactcacactggagagaggccatatgcatgtcatctatgtggaaaagccttcactcagtgttctcaccttagaagacatgagaaaactcacacgggagagagaccatataagtgtcatcaatgtgggaaagcctttattcaatcctttaaccttcgaagacatgagagaactcaccttggacaaaagtgttatgaatgtgataaaagtgggaaagcctttagtcaaagctctggctttagaggaaacaaaataattcacattggagagaaaccacctgcttgtcttctatgtgggaaggccttcagtctgtcctccgaccttagatgacatgagagaacacgcactggag

SEQ ID NO: 203557 - DNA, 3377 bp, Homo sapiens
  Payload ID: 20142
  Gene Name: zinc finger protein 705D
  Uniprot ID: P0CH99
  ENST ID: ENST00000400085
  CDS Start-End: 117-1019
attttctcaagcaatttttaaatttcattcttttaccctattgagcttttcttagtgcctaaagtgtctgcaagtggaaatccagaggaagacagagagaaactgagttcctgacaatgcattcactagagaaagtgacttttgaagatgtagctattgacttcacccaggaagagtgggacatgatggacacatccaagagaaagctgtacagagatgtgatgctggaaaatatcagtcacctggtgtccctcgggtaccagataagcaaatcctatataattttgcagctggagcaaggaaaagagctgtggcgggaaggaagagtatttcttcaagaccagaatccagacagggaaagtgcccttaagaaaaaacacatgatatccatgcatcctatcatcagaaaagacgcatccaccagtatgacaatggagaactctctcattctggaggatccttttgaatataatgattcgggagaagattgcactcacagttccacaataactcagtgtttgttaactcacagtggaaagaaaccctgtgtcagcaaacagtgtggaaaatcccttcgtaatcttttgtcccctaaaccacgtaaacaaattcatactaaaggtaaatcatatcaatgtaatctatgtgaaaaggcctatactaattgcttttaccttagacggcacaagatgactcacactggagagaggccatatgcatgtcatctatgtggaaaagccttcactcagtgttctcaccttagaagacatgagaaaactcacacgggagagagaccatataagtgtcatcaatgtgggaaagcctttattcaatcctttaaccttcgaagacatgagagaactcaccttggacaaaagtgttatgaatgtgataaaagtgggaaagcctttagtcaaagctctggctttagaggaaacaaaataattcacattggagagaaaccacatgcttgtcttctatgtgggaaggccttcagtctgtcctccgaccttagatgacatgagagaacacgcactggagaaaagccatatgaatgccatttatgtgggaaagccttcagtcaatgtactaatcttaaaaagcatcagaaaattcaccctggagagaaaattataaacttcttcagaacatattctgactttagatgacacagtgttaggaatgacgaaggtaaggaatgtggaagagacttcagctgtagttgtagcatctaaacatgccaaaggactcacattttgaagaaatactgtaatcaacatggaagatacttcagttgcctttattcttcagcccacatcaataaattcatatggaagagaaattgtatgacatgtatgtaccaaagacttgttagtgatctgagcataaatgacatgagagagctgaaactgtcagcataatcaactaaaagtcttcagcaacagctttaacttaaaacatgtgggactttcaggtagagaatctctaactctgcattcagtgtgaaaatgtttttatttgcaatttattgtcaaataacatgagaaaactttacttggatgaaccctttatttgtatttttctgtgaatgaacattcagccaagcaccaggcttgatgttcacaagagaagagtgacaaaatgctgctaaaatggaaaataagagaggaaagccttcataagctaaataacaagggaaagtctttccaagggcaatgaattctcttggaataccaaatacttcttactggagaagttatgcaatgaaaaatcatgagaaatcctttcttcatagagcaacacatgtggcacatgtgagatttcacactggacaaaacagggttagcatcttgaaagaagaaaattctttagtggtaattcatttcttagttgacattaagtttctcacgttgaggagctatcaaacttgaaaatcactgtggagaaacctgatagatttctcatcagaaaagtgagtcaagaaggtggacctctagaaaaaactcttaacacatactttagcaaaataattcagaaatttgagaaaatatctattcataaaaatgtggcatgtaaatgcataatagcaaagtgaccaaggaataaattgaatgcagaattatataagaaatctcattaaacttttccaaaagaccaatacttacaaatattgaaagaatacaatctgttgttgaaaaaacttagtatgttggtgaagcccttgtttcatttatgcagccctaacaaactgatttgcatctgaactccttgggtgagattcttggtggagattctaccccaacttctgagtctccccagtcttcaacagctctttcctcacagctcacctccctttacttcaacgtccaccaaaaccacttgtttccatccaaccctcgagttgacacaccagggatcttcagccccacttgctagatttctcagtttgtcattgcatagatttagcagggaaatggaggctgtatcaaagacccctagtatatgcatttgggtgtccccagctcttgcctctgtctctgagcagttacctgggatcagagaataaggcagctcttctcttctatccctcagaaggctcttgaaattttgtccctggagcctctctaactggaagtagcagttcatctcatgacaccccacattttattcaggtgagtcctgagttattacacagagacagacacagctgtgctccttttactgcagtccagaagataaaacaccagcatgataaaacagccgaacctgtcagccaccttgcaagccttttctatatttgattcaatgtacttttcccgaagcaaaatgaaagttctcacagaggggccctcctctgccttgtcctcagaattggaaaatgtattgtccgtgaaggagcctcaccactgaacctaaaactcaagagaaaatgtttcctgaatatcaagtgggatgacttgaaattttgtcaaacaggcagaatcttaatacgatcggccttactaaggctaaatggccttatccatggttgaaattgacacatcatcatattaaaaaatctccacgagtgattgattttactctgcagccagggtttatgtcaagtgtgaggataatgagcaagaaattcaagcccttggcaaactggttggagaggcaaggactgtgtccaggcagagctcatatcattatttattgtttaatctatttaattaaatatgtaatttacccacaaactgtggctgacattatatgtactcctgagccacattaagatgtactatttgtgctgtgaaattctatgggatttgacaaatgcatggtggcagatctccagcgattattaaagcgtaacacagaatgcttctcttattcaa

SEQ ID NO: 203558 - DNA, 925 bp, Homo sapiens
  Payload ID: 20142
  Gene Name: zinc finger protein 705D
  Uniprot ID: P0CH99
  ENST ID: ENST00000400078
  CDS Start-End: 23-925
gagagaaactgagttcctgacaatgcattcactagagaaagtgacttttgaagatgtagctattgacttcacccaggaagagtgggacatgatggacacatccaagagaaagctgtacagagatgtgatgctggaaaatatcagtcacctggtgtccctcgggtaccagataagcaaatcctatataattttgcagctggagcaaggaaaagagctgtggcgggaaggaagagtatttcttcaagaccagaatccagacagggaaagtgcccttaagaaaaaacacatgatatccatgcatcctatcatcagaaaagacgcatccaccagtatgacaatggagaactctctcattctggaggatccttttgaatataatgattcgggagaagattgcactcacagttccacaataactcagtgtttgttaactcacagtggaaagaaaccctgtgtcagcaaacagtgtggaaaatcccttcgtaatcttttgtcccctaaaccacgtaaacaaattcatactaaaggtaaatcatatcaatgtaatctatgtgaaaaggcctatactaattgcttttaccttagacggcacaagatgactcacactggagagaggccatatgcatgtcatctatgtggaaaagccttcactcagtgttctcaccttagaagacatgagaaaactcacacgggagagagaccatataagtgtcatcaatgtgggaaagcctttattcaatcctttaaccttcgaagacatgagagaactcaccttggacaaaagtgttatgaatgtgataaaagtgggaaagcctttagtcaaagctctggctttagaggaaacaaaataattcacattggagagaaaccacatgcttgtcttctatgtgggaaggccttcagtctgtcctccgaccttagatga

SEQ ID NO: 203559 - DNA, 3644 bp, Homo sapiens
  Payload ID: 20143
  Gene Name: zinc finger protein 705G
  Uniprot ID: A8MUZ8
  ENST ID: ENST00000400156
  CDS Start-End: 283-1185
gtccttgtcccaagggacatacagcacacagcctgtggagggtggaggaaccaactgcaagatcacttgtcctcctcaattgatgtacactgaagaaagagccaccttcaggctgtaaggtcatcgtataatcctgaccactcatttcccatcatgacactgctgttccttctctttctccttcttggatgtctgatacaaacagcctcagcttttcttagtgcctaaagtgtctgcaagtggaaatccagaggaagacagagagaaactgagttcctgacaatgcattcactaaagaaactgacttttgaagatgtagctattgacttcacccaggaagagtgggccatgatggacacatccaagagaaagctgtacagagatgtgatgctggaaaatatcagtcacctggtgtccctcgggtaccagataagcaaatcctatataattttgcagctggagcaaggaaaagagctgtggagggaaggaagagtatttcttcaagaccagaatccaaacagggaaagtgcccttaagaaaacacacatgatatccatgcatcctatcaccagaaaagacgcatccaccagtatgacaatggagaactctctcattctggaggatccttttgaatgtaatgattcgggagaagattgcactcgcagttccacaataactcagtgtttgttaactcatagtggaaagaaaccctatgtcagcaaacagtgtggaaaatcccttcgtaatcttttgtccactgaaccacataaacaaattcatactaaaggtaaatcatatcagtgtaatctatgtgaaaaggcctatactaattgctttcaccttagacggcacaagatgactcacactggagagaggccatatgcatgtcatctatgtagaaaagccttcactcagtgttctcaccttagaagacacgagaaaactcacacgggacagagaccatataagtgtcatcaatatgggaaagtctttattcaatcctttaaccttcaaagacatgagagaactcaccttggaaaaaagtgttatgaatgtgataaaagtgggaaagcctttagtcaaagctctggctttagaggaaacaaaataattcacactggagagaaaccacatgcttgtcttctatgtgggaaggccttcagtctgtcttccaaccttagatgacatgagagaacacgcactggagaaaagccatatgaatgccatttatgtgggaaagccttcagacaatgtactaatcttaaagagcatcagaaaattcaccctggagagaaaattataaacttcttcagaacatattctgactttagatgacacggtgttaggaatgacaaaggtaaggaatgtggaagagacttcagctgtagttgtagcatctaaacatgccaaaggactcacattttgaagaaatactgtaatcaacatggaagatacttcagttacctttattcttcagtccacatcaataaattcatatggaagagaaattgtatgacatgtatgtaccaaagacttgttagtgatctgagcataagtgacatgagagagctgaaactgtcaatataatcaactaaaagtcttcagcaacagctataacttaaaacatgtgggactttcaggtagagaatctctaactctgcattcagtgtgaaaatgtttttatttgcaatttattgtcaaataacatgagaaaactttacttggatgaaccctttatttgtattttctgtgaatgaacattcagccaagcaccaggcttgatgttcacaagagaagagtgacaaaatgctgctaaaatggaaaataagagaggaaagccttcatgagctaaataagaagggaaaatctttccaagggcaatgaattctcttggaataccaaatacttcttactggagaagttatgcaatgaaaaatcatgagaaatcctttcttcatagagcaacacatgtggcacatgtgagatttctcactggacaaaacatggttagcatcttgaaaggagaaaattctttagtggtaattcatttcttagttgacattgagtttctcacattgaggagctatcaaacttgaaaatcactgtggagaaacctgatagatttctcatcagaaaagtgagtcaagaagttggacccctagaaaaaactcttaacacatactttagcaaaataattcagaaatttgagaaaatatctattcataaaaatgtggcatgtaaatgcataatagcaaagtgaccagggaataaattgcgtgcagaattatataagaaatctcattaaacttttccaaaagatcaatacttacaaatattgaaagaatacaatctgttgttgaaaaaacttagtatgttggcaaagcccttgtttcatttatgcggccctaacaaatggatttgcacctgcactccttgggtgagattcttggtcgagattctaccccaacttctgagtctccccagtcttcaacagctctttcctcacagctcacctccctttacttcaacgtccactaaaaccacttgtttccatccaaccctcgagttgacacaccagggatcttcagccccacttgctagatttctcagtgtgtcattgcatagatttagcagggaaatggaggctgtatcaaagacaccttgtatatgcatttgggtgtccgcagccctttcctctgtctctaggcagttaactgggatcagagaataaggcagctcttctcttctatccctcagaagactcttgaaattttgtccctggagcctctctaactggaagtagcagttcatctcataacaccccacattttattctggtaagtcctgagttattacacagagacagacacagctgtgctccttttactgcagtccagaagataaaacaccagcatgataaaacagccgaacctgtcagccaccttgcaagcctttcctatatttgattcaatgtacttttcctgaagcaaaatgaaagttctcacagaggggccctcctctgccttgtcctcagaattgaaaaatgtattgtccgtgaaggagcctcaccactgaacctaaaactgaagagaaaatgtttcctgaatattaagtgggatgacttgaaattttgccaaacaggcacaatcttaatacgatcggccttactaaggctaaatggccttatccatggttgaagttgacacatcattatattttaaaatctctacaagtgattgattttactctgcagccagggtttatgtcaagtgtgaggataatgagcaagaaattcaagcccttggcaaactggttggagaggcaaggactgtgtccaggcagagctcatatcattatttattgtttaatctatttaattaaatatgtaatttacccacaaactgtgactgacattatatgtactcctgaaccacattaagatgtactatttgtgctgtgaaattctatgggatttgacaaatgcatggtggcagatctccagccattattaaagcgtaacacagaatgcttctcttattcaagctcgtcttccctccacatagagggaatcaatcggcttttgtatactgatttttgaatttgcttctttatttccatcttctttaattaaagcacaaggtatc

SEQ ID NO: 203560 - DNA, 3647 bp, Homo sapiens
  Payload ID: 20143
  Gene Name: zinc finger protein 705G
  ENST ID: ENST00000612855
  CDS Start-End: 283-1185
gtccttgtcccaagggacatacagcacacagcctgtggagggtggaggaaccaactgcaagatcacttgtcctcctcaattgatgtacactgaagaaagagctaccttcaggctgtaaggtcatcgtataatcctgaccactcatttcccatcatgacactgctgttccttctctttctccttcttggatgtctgatacaaacagcctcagcttttcttagtgcctaaagtgtctgcaagtggaaatccagaggaagacagagagaaactgagttcctgacaatgcattcactagagaaagtgacttttgaagatgtagctattgacttcacccaggaagagtgggacatgatggacacatccaaaagaaagctgtacagagatgtgatgctggaaaatatcagtcacctggtgtccctcgggtaccagataagcaaatcctatataattttgcagctggagcaaggaaaagagctgtggtgggaaggaagagtatttcttcaagaccagaatccagacagggaaagtgcccttaagaaaaaacacatgatatccatgcatcctatcatcagaaaagacacatccaccagtatgacaatggagaactctctcattctggaggatccttttgaatataatgattcgggagaagattgcactcacagttccacaataactcagtgtttgttaactcacagtggaaagaaaccctgtgtcagcaaacagtgtggaaaatcccttcgtaatcttttgtcccctaaaccacgtaaacaaattcatactaaaggtaaatcatatcaatgtaatctatgtgaaaaggcctatactaattgcttttaccttagacggcacaagatgactcacactggagagaggccatatgcatgtcatctatgtggaaaagccttcactcagtgttctcaccttagaagacatgagaaaactcacacgggagagagaccatataagtgtcatcaatgtgggaaagcctttattcaatcctttaaccttcgaagacatgagagaactcaccttggacaaaagtgttatgaatgtgataaaagtgggaaagcctttagtcaaagctctggctttagaggaaacaaaataattcacattggagagaaaccacatgcttgtcttctatgtgggaaggccttcagtctgtcttccgaccttagatgacatgagagaacacgcactggagaaaagccatatgaatgccatttatgtgggaaagccttcagtcaatgtactaatcttaaaaagcatcagaaaattcaccctggagagaaaattataaacttcttcagaacatattctgactttagatgacacagtgttaggaatgacgaaggtaaggaatgtggaagagacttcagctgtagttgtagcatctaaacatgccaaaggactcacattttgaagaattactgtaatcaacatggaagatacttcagttgcctttattcttcagcccacatcaataaattcatatggaagagaaattgtatgacatgtatgtaccaaagacttgttagtgatctgagcataaatgacatgagagagctgaaactgtcagcataatcaactaaaagtcttcagcaacagctttaacttaaaacatgtgggactttcaggtagagaatctctaactctgcattcagtgtgaaaatgtttttatttgcaatttattgtcaaataacatgagaaaactttacttggatgaaccctttatttgtatttttctgtgaatgaacattcagccaagcaccaggcttgatgttcacaagagaagagtgacaaaatgctgctaaaatggaaaataagagaggaaagccttcataagctaaataacaagggaaagtctttccaagggcaatgaattctcttggaataccaaatacttcttactggagaagttatgcaatgaaaaatcatgagaaatcctttcttcatagagcaacacatgtggcacatgtgagatttcacactggacaaaacagggttagcatcttgaaagaagaaaattctttagtggtaattcatttcttagttgacattaagtttctcacgttgaggagctatcaaacttgaaaatcactgtggagaaacctgatagatttctcatcagaaaagtgagtcaagaaggtggacctctagaaaaaactcttaacacatactttagcaaaataattcagaaatttgagaaaatatctattcataaaaatgtggcatgtaaatgcataatagcaaagtgaccaaggaataaattgaatgcagaattatataagaaatctcattaaacttttccaaaagagcaatacttacaaatattgaaagaatacaatctgttgttgaaaaaacttagtatgttggtgaagcccttgtttcatttatgcagccctaacaaactgatttgcatctgaactccttgggtgagattcttggtggagattctaccccaacttctgagtctccccagtcttcaacagctctttcctcacagctcacctccctttacttcaacgtccaccaaaaccacttgtttccatccaaccctcgagttgacacaccagggatcttcagccccacttgctagatttctcagtttgtcattgcatagatttagcagggaaatggaggctgtatcaaagacccctagtatatgcatttgggtgtccccagctcttgcctctgtctctgagcagttacctgggatcagagaataaggcagctcttctcttctatccctcagaaggctcttgaaattttgtccctggagcctctctaactggaagtagcagttcatctcatgacaccccacattttattcaggtgagtcctgagttattacacagagacagacacagctgtgctccttttactgcagtccagaagataaaacaccagcatgataaaacagccgaacctgtcagccaccttgcaagccttttctatatttgattcaatgtacttttcccgaagcaaaatgaaagttctcacagaggggccctcctctgccttgtcctcagaattggaaaatgtattgtccgtgaaggagcctcaccactgaacctaaaactcaagagaaaatgtttcctgaatatcaagtgggatgacttgaaattttgtcaaacaggcagaatcttaatacgatcggccttactaaggctaaatggccttatccatggttgaaattgacacatcatcatattaaaaaatctccacgagtgattgattttactctgcagccagggtttatgtcaagtgtgaggataatgagcaagaaattcaagcccttggcaaactggttggagaggcaaggactgtgtccaggcagagctcatatcattatttattgtttaatctatttaattaaatatgtaatttacccacaaactgtggctgacattatatgtactcctgagccacattaagatgtactatttgtgctgtgaaattctatgggatttgacaaatgcatggtggcagatctccagccattattaaagcgtaacacagaatgcttctcttattcaagctcgtcttccctccacatagagggaatcaatcgacttttgtatactgatttttgaatttgcttctttatttccatcttctttaattaaagcacaagatatcgt

SEQ ID NO: 203561 - DNA, 2615 bp, Homo sapiens
  Payload ID: 20144
  Gene Name: zinc finger protein 706
  Uniprot ID: Q9Y5V0
  ENST ID: ENST00000311212
  CDS Start-End: 185-415
gggcgcgcggcggcggcgggcgtgcgaggctgttgtgctcccggctctcgtgtttcccctcctgagcgggtggaggaggcccaagcggtgctgggcgcgctcccccttcctttccctccggcgtcctctcccggccctctcgcgctgcactgtctctccgacgcaagactgtcccggcccggatatggctcgtggacagcagaaaattcagtctcagcagaaaaatgccaaaaagcaagctggacaaaagaagaaacaaggacatgaccaaaaggctgctgccaaagctgccttaatatatacctgcactgtctgtaggacacaaatgccagaccctaagaccttcaagcagcactttgagagcaagcatcctaagactccacttcctccagaattagctgatgttcaggcataaggttgtttacaggtgaattcatgacacctttgactcttctactgtctcagaccttaggtaacatacctgcagctgcttttctaacaaactgttgatcagcaaaaataaaggggctacagaaacactcatttttatgctgttccctcttgggcttcatgcaaagacaattctgtgtaaatgtacagttgactctgatttggaaatatgaaaatcagtccatccttgttataaaaaatttttttacaattgtaattatattgatgttcatattgtgtaaaataactcatttaataaaatagtactttgatttacgacatcacaggataaatggttttagaaattctgttctaactttccacattatttgccttataaaaatctaatgaattcatcagctagaattgcaagtgcaattcttatatccctttctctgctcagtggcaggttcctcagttaaactagagcagactgattcattaaaattgtgcatacgattttatgggcagctgatgatctaggtgaaaaatgacttatctgctgccttagtatattgcggttatgtgtcattgtacccctctgatcatttcctgtgtttgagttggaatatttaaaattgcagtatgacctggctctaactgccagtcaggtgtaccctgtagataactgatagcttcctaaaagcggttggattgtcagtgagcccttgtgaaaggttaggttctaatgtatatgccgtaatgaaataatcattaagcctattgtttaatgcaaaatatggaacaaatgtgaactggtaaaggtcgatcttgatactatattctttgaaaattcttgaagttctttaatttgaaattgaaacattaatttttgaggtttttggaagttactatttggccatttttacaaatggattttgcattaacaggaagattggaatgacttgtggctggattaattcccagaaccctctccctcctttcttttctaagtgagttgttgattttaggagtttgctttgtgctgttacctaaaatcagagactggtgtacagtatgacttccatctgaacttgaaaagtattaaaatgggtcaatattcacattcttttagatctcaggatgggaaaatgggtttgttcagatggatatggtaaatcttacccaattaaggaaggctaattttagagttcttctaatttgcttgtgtcaactcttaacttgtaaaactgctgttaactcggtttaaatttttaaattaatataatagaaagaacactaaaatacttactggtaactgcttagagccatttatctgatcctgtggattacagaatgcattccctcttctgctgtagcttatcattgctttgttttgtagctctgcatattttgcccaccttgtcttccctgtaagtttaagacgtttccaaggaaaagcttcagggctgatagtttcttagcaattcctattcttatgcccttactttaaaatagtccttttattttgtgtattttatttcctaagtttcagatgtaatatctgttgtttcctaacatgtcgattaccagaacgttagaattttacctaatttcttgtggatattgcagaagttctggttaaatcacaacttaaaagtttttaaaagtgctttgagcatatgtatatgtttagtgacaaatcatataaaaccattcacaagttttggttttttttttttcgtttgttttagtgactaattcaggatgaaagtttttttgttcttgtatttaacccttttttataagcagctgaagacaccatatttaacactatatctcagtgatagggaaatagctgcattgatcttacatgagcataatcatccttatacttcatgaggggattattagtacaatccccattttactgtgtttgagttaaaaaccaaacatccctgtaatttaatttgaagattctttaacagattgcagcaaagttcattataaaactgttatggtgtcttcaaagacttgataaaataacactgagagagaattggtccatttgtatgctgtatttctattacttgccaaaaggaatggggttaagattaaacttgtttccattctcttcacatggatattcatccccatgtttaactgacacactgggggctcagttgtgtgctgtaatgtcttattaaagaagatattaaagaaaa

SEQ ID NO: 203562 - DNA, 782 bp, Homo sapiens
  Payload ID: 20144
  Gene Name: zinc finger protein 706
  Uniprot ID: Q9Y5V0
  ENST ID: ENST00000520984
  CDS Start-End: 30-260
ctccgacgcaagactgtcccggcccggatatggctcgtggacagcagaaaattcagtctcagcagaaaaatgccaaaaagcaagctggacaaaagaagaaacaaggacatgaccaaaaggctgctgccaaagctgccttaatatatacctgcactgtctgtaggacacaaatgccagaccctaagaccttcaagcagcactttgagagcaagcatcctaagactccacttcctccagaattagctgatgttcaggcataaggttgtttacagggtttcccaaactctcgattgcctcttgcaagcagatgacctgggagcaaatgttatggcagaacgatggactcctagcaagggccgaagcgtgccctgtgaagactggaaagaatatatgcttgtcagagatttggtaacctcatcaagaccttaaactgcagtttaagagggtggaaaaattactcaagtgaaactataagccctgttattcgtaagaaaacgtatgacacagagcaattggagaatctcttaatttgcatgcaaaaataacaggaggaaaaagtaaggaatgttatatctgatttcaagtgtgaatatgaagcaaaggaacttgagatgttaacacctgaaagaaatcaagatttcctagatacccctgaaacacagggctcaggactagaatatggaagccctgagagaacagatagcagaggagcattatatgtccaaaatgtctgaaagtgcacagaaagccagaagcctgcacgaagaggtgggatggagaat

SEQ ID NO: 203563 - DNA, 488 bp, Homo sapiens
  Payload ID: 20144
  Gene Name: zinc finger protein 706
  ENST ID: ENST00000519103
  CDS Start-End: 1-156
caaaaggctgctgccaaagctgccttaatatatacctgcactgtctgtaggctctcttttgcacaattttttgttagacacaaatgccagaccctaagaccttcaagcagcactttgagagcaagcatcctaagactccacttcctccagaattagctgatgttcaggcataaggttgtttacaggtgaattcatgacacctttgactcttctactgtctcagaccttaggtaacatacctgcagctgcttttctaacaaactgttgatcagcaaaaataaaggggctacagaaacactcatttttatgctgttccctcttgggcttcatgcaaagacaattctgtgtaaatgtacagttgactctgatttggaaatatgaaaatcagtccatccttgttataaaaaatttttttacaattgtaattatattgatgttcatattgtgtaaaataactcatttaataaaatagtactttgatttacgac

SEQ ID NO: 203564 - DNA, 604 bp, Homo sapiens
  Payload ID: 20144
  Gene Name: zinc finger protein 706
  Uniprot ID: Q9Y5V0
  ENST ID: ENST00000517844
  CDS Start-End: 55-285
ctttgcagccccctcggaaaaccacactgagagttgcattaaaaaccagcatatatggctcgtggacagcagaaaattcagtctcagcagaaaaatgccaaaaagcaagctggacaaaagaagaaacaaggacatgaccaaaaggctgctgccaaagctgccttaatatatacctgcactgtctgtaggacacaaatgccagaccctaagaccttcaagcagcactttgagagcaagcatcctaagactccacttcctccagaattagctgatgttcaggcataaggttgtttacaggtgaattcatgacacctttgactcttctactgtctcagaccttaggtaacatacctgcagctgcttttctaacaaactgttgatcagcaaaaataaaggggctacagaaacactcatttttatgctgttccctcttgggcttcatgcaaagacaattctgtgtaaatgtacagttgactctgatttggaaatatgaaaatcagtccatccttgttataaaaaatttttttacaattgtaattatattgatgttcatattgtgtaaaataactcatttaataaaatagtactttgatttacgacatca

SEQ ID NO: 203565 - DNA, 501 bp, Homo sapiens
  Payload ID: 20144
  Gene Name: zinc finger protein 706
  Uniprot ID: Q9Y5V0
  ENST ID: ENST00000518336
  CDS Start-End: 214-444
agcctgggaggagcgggaaaagggtcgcagcgcctgaggcccggccgccgcccgagtggatgagcgagcgagcgacttgtgaaacacgccgcggcccggtcaccaaccaggaccgggatcacgtggctcccagggctgggtgaagaagccgcccggaccgagcgcgccggagaggaggggcgcctggggacagaaggcgacgtcccctgaaatatggctcgtggacagcagaaaattcagtctcagcagaaaaatgccaaaaagcaagctggacaaaagaagaaacaaggacatgaccaaaaggctgctgccaaagctgccttaatatatacctgcactgtctgtaggacacaaatgccagaccctaagaccttcaagcagcactttgagagcaagcatcctaagactccacttcctccagaattagctgatgttcaggcataaggttgtttacaggtgaattcatgacacctttgactcttctactgtctcagaccttag

SEQ ID NO: 203566 - DNA, 959 bp, Homo sapiens
  Payload ID: 20144
  Gene Name: zinc finger protein 706
  Uniprot ID: Q9Y5V0
  ENST ID: ENST00000519882
  CDS Start-End: 416-646
cagaaaggcacatgggcggggctgcgaggagcaggcggggcgggggcgccgaggagagcggcgcggcgtgcgcgggcacgaggcgtagtggtctcccctaaggctgaggcggcggcgggcgcgcggcggcggcgggcgtgcgaggctgttgtgctcccggctctcgtgtttcccctcctgagcgggtggaggaggcccaagcggtgctgggcgcgctcccccttcctttccctccggcgtcctctcccggccctctcgcgctgcactgtctctccgacgcaagactgtcccggcccggagtctcactgtcgcccaggctgcagtgcagtggtgccatcacgcgtcactgcaacctctgcctcccggattcaagcaattctccacctcagcctcccaagtagctggaattacagatatggctcgtggacagcagaaaattcagtctcagcagaaaaatgccaaaaagcaagctggacaaaagaagaaacaaggacatgaccaaaaggctgctgccaaagctgccttaatatatacctgcactgtctgtaggacacaaatgccagaccctaagaccttcaagcagcactttgagagcaagcatcctaagactccacttcctccagaattagctgatgttcaggcataaggttgtttacaggtgaattcatgacacctttgactcttctactgtctcagaccttaggtaacatacctgcagctgcttttctaacaaactgttgatcagcaaaaataaaggggctacagaaacactcatttttatgctgttccctcttgggcttcatgcaaagacaattctgtgtaaatgtacagttgactctgatttggaaatatgaaaatcagtccatccttgttataaaaaatttttttacaattgtaattatattgatgttcatattgtgtaaaataactcatttaataaaatagtactttgatttacg

SEQ ID NO: 203567 - DNA, 493 bp, Homo sapiens
  Payload ID: 20144
  Gene Name: zinc finger protein 706
  ENST ID: ENST00000523922
  CDS Start-End: 367-493
gaggggtcgcggggggcggcagggcccggcccggggcgggccgcgggaaggggatgagttcgggcgcctgccaggccctgcaggtggccgggtcgcaggccagccgcggaagcggagcggagctttggggcagagcttacttgttgcctcctacgagagcgcctcattttagaactcgtttcttccactacttccctctttgcagccccctcggaaaaccacactgagagttgcattaaaaaccagcatagtctcactgtcgcccaggctgcagtgcagtggtgccatcacgcgtcactgcaacctctgcctcccggattcaagcaattctccacctcagcctcccaagtagctggaattacagatatggctcgtggacagcagaaaattcagtctcagcagaaaaatgccaaaaagcaagctggacaaaagaagaaacaaggacatgaccaaaaggctgctgccaaagctgccttaatatatacctgcactg

SEQ ID NO: 203568 - DNA, 785 bp, Homo sapiens
  Payload ID: 20144
  Gene Name: zinc finger protein 706
  ENST ID: ENST00000519744
  CDS Start-End: 137-283
cgtgtttcccctcctgagcgggtggaggaggcccaagcggtgctgggcgcgctcccccttcctttccctccggcgtcctctcccggccctctcgcgctgcactgtctctccgacgcaagactgtcccggcccggatatggctcgtggacagcagaaaattcagtctcagcagaaaaatgccaaaaagcaagctggacaaaagaagaaacaaggacatgaccaaaaggctgctgccaaagctgccttaatatatacctgcactgtctgtagggtgaattcatgacacctttgactcttctactgtctcagaccttaggtaacatacctgcagctgcttttctaacaaactgttgatcagcaaaaataaaggggctacagaaacactcatttttatgctgttccctcttgggcttcatgcaaagacaattctgtgtaaatgtacagttgactctgatttggaaatatgaaaatcagtccatccttgttataaaaaatttttttacaattgtaattatattgatgttcatattgtgtaaaataactcatttaataaaatagtactttgatttacgacatcacaggataaatggttttagaaattctgttctaactttccacattatttgccttataaaaatctaatgaattcatcagctagaattgcaagtgcaattcttatatccctttctctgctcagtggcaggttcctcagttaaactagagcagactgattcattaaaattgtgcatacgattttatgggcagctgatgatctaggtgaaaaa

SEQ ID NO: 203569 - DNA, 488 bp, Homo sapiens
  Payload ID: 20144
  Gene Name: zinc finger protein 706
  ENST ID: ENST00000520454
  CDS Start-End: 463-488
gggccggggccgcggtgtcctgggtggcggggctccgggaatgtgactcagccaccgcggccccgcgatccgctcccgggccagcgcctcagtcggtgccgaggagggcggcgccgagacgggcgcgtcagcctgggaggagcgggaaaagggtcgcagcgcctgaggcccggccgccgcccgagtggatgagcgagcgagcgacttgtgaaacacgccgcggcccggtcaccaaccaggaccgggatcacgtggctcccagggctgggtgaagaagccgcccggaccgagcgcgccggagaggaggggcgcctggggacagaaggcgacgtcccctgaaaccagagtctcactgtcgcccaggctgcagtgcagtggtgccatcacgcgtcactgcaacctctgcctcccggattcaagcaattctccacctcagcctcccaagtagctggaattacagatatggctcgtggacagcagaaaattca

SEQ ID NO: 203570 - DNA, 732 bp, Homo sapiens
  Payload ID: 20144
  Gene Name: zinc finger protein 706
  Uniprot ID: Q9Y5V0
  ENST ID: ENST00000521272
  CDS Start-End: 410-640
gaggagagcggcgcggcgtgcgcgggcacgaggcgtagtggtctcccctaaggctgaggcggcggcgggcgcgcggcggcggcgggcgtgcgaggctgttgtgctcccggctctcgtgtttcccctcctgagcgggtggaggaggcccaagcggtgctgggcgcgctcccccttcctttccctccggcgtcctctcccggccctctcgcgctgcactgtctctccgacgcaagactgtcccggcccggccccctcggaaaaccacactgagagttgcattaaaaaccagcatagtctcactgtcgcccaggctgcagtgcagtggtgccatcacgcgtcactgcaacctctgcctcccggattcaagcaattctccacctcagcctcccaagtagctggaattacagatatggctcgtggacagcagaaaattcagtctcagcagaaaaatgccaaaaagcaagctggacaaaagaagaaacaaggacatgaccaaaaggctgctgccaaagctgccttaatatatacctgcactgtctgtaggacacaaatgccagaccctaagaccttcaagcagcactttgagagcaagcatcctaagactccacttcctccagaattagctgatgttcaggcataaggttgtttacaggtgaattcatgacacctttgactcttctactgtctcagaccttaggtaacatacctgcagctgcttttctaacaaactgt

SEQ ID NO: 203571 - DNA, 3502 bp, Homo sapiens
  Payload ID: 20144
  Gene Name: zinc finger protein 706
  Uniprot ID: Q9Y5V0
  ENST ID: ENST00000520347
  CDS Start-End: 2958-3188
gcgggaaggggatgagttcgggcgcctgccaggccctgcaggtggccgggtcgcaggccagccgcggaagcggagcggtaaccttacccccggcgacagccgccggtcagctgccagagtgtggcgctcccggtggacgcaggggccgggtttcgggcagtctcggcctccaggaggcgcgtcttggtccagggtccgtgaggactggctagatgggggctgcgtggcctttggtggcagggaggaggagggggtctccgaggcgggagaggcgggtttgggaaggaaggtgcgccaggctgaagctggggtcggagaagtgttgggtggagacctcactgtgggtgcgttcctcctctcctctccccaaaacgatggtgttaaaagctagggtcaggatgtggagcgctgcctgggcctcttcctttccgatggttatggagaatgagcctacttcctggacccaaaatccttttcttctgttactcatttatgttggttttaaaaggagctttggggcagagcttacttgttgcctcctacgagagcgcctcattttagaactcgtttcttccactacttccctctttgcagccccctcggaaaaccacactgagagttgcattaaaaaccagcatgtaggtatttgtaagtgactttttccctccagtttgtcgcatttaatcaaggagcggttgtagctgcctacgattttgtagaaaattgtgttggcttgagagcaagtcctaagttgagctgtccaaaagcaggtggttggttcgtttgaatttctgctttcagaaaggaaatcgatggggcgtgttgtcagaagttaggggcctacctcatgcatttagcttattttattccatttcctttacctggtgttaagttttctgtcttcagaataagaacaagtgactactgtctttattaagtctcttcggtctttttggttgctgtttggtgacaatggaaaatgggttgaatctattgtgtaatgttatattttagggaaagtcctaagtgcaaaagttaaaaataattttgtgtgtctaatgacattgctttgtacgagtcacaacatggaaatatcaaaatagctagtaacttctagaaagcaaaggaacttctgaaattagtggcttaccatttttgaagattttttttaacataaaacaagatttcccacaaaatcagtgtattaagatacataaaatacattgtgtcgaagagttaagatgtgtgagaagactggctattttgttacaaggtcctgatagtaagacattgagacaaaaaaccttgcaaaacattggtatacataaaggctgatcacgtgactactgtcgtccaaataatacataagtatccaaacctgtttccatgggaataggtttgtaagcttgcggtaacatcggacttaaatacacttttaaaaaaaatgtgccatttggcttagaattaataattttttttaaagcaaaaatggaagcttagtcttcaaggactgataacagctggtaatatttaccattgtttggtgggaatggggttctcatattaggctagcacgctaaacattttcaattacgaaaatgtattaggctcgtgtgctaccctaatataaaaaccccatatttcctcagttgaaatagtcagctgactatcctgaaaagcattgaccctcttttatattttatctgactttcagttcatttttttaatgctagtgggaacttctccaatcagtgtatttttttagtttccttttttggggaacaggaggagctcagtaatttttatgaaatgctttgacctcatatccattaactaattatggtcctagtcagaagaagctagcacccttccctggtgaagttgatacaaatccattgtatgttcctgtcctgcaatgatttacattcagttacagtactagtcaaaactatatatatatgaattctacttaggatccaattttgatatatttaaaaagcaattgagactcatgatagactttatgagcaggtttaacttgtgtggtcgaataaaagcctttaatttaaatggaaaagtaaaagtaacttttttcagtgacttgatttttttttttgttttaatccatttgggttcacgtcagatcatcggtaacaaaaagtggtatctttcagctttgtaaaagaaccctcttaaccaagttcattccctcaaatgggaactaacgtctagagagcaaagaaacttctggaattagtggcttgctgataatctcattttataatttgttcagcaatccagcaagaccaactttttaaaaaaattaataacagtagttttatgaaaactaagtaagaaaacagtttccacctatttctgaggtctcctttagaaggagtaacagacagcttttatttctcttaaagttataaaaatcacaatcgcaagtcacaatgaatactgggaagggaaattacttttgcagagtgatcaagtaaatgatagcgggggctaaacttttttagtaaacttgtgaagattacatacagtaaagtgcataaatcttgagtgtacaattcaatgaatttttataagtaaacacacttgattcaagaacattttcaggaccccataagtccccttcatgtcctgtcttcccagtcattacccataacccccaaggtgacccctttcactatagattagctttgcctgttttgaactttaaataatgtatattccccacaactggcttctttcctttaacattgagatacaaccaagttgttacttgtaacaattttttgtttgtgtgtttgtttatttatttttgagaccagagtctcactgtcgcccaggctgcagtgcagtggtgccatcacgcgtcactgcaacctctgcctcccggattcaagcaattctccacctcagcctcccaagtagctggaattacagatatggctcgtggacagcagaaaattcagtctcagcagaaaaatgccaaaaagcaagctggacaaaagaagaaacaaggacatgaccaaaaggctgctgccaaagctgccttaatatatacctgcactgtctgtaggacacaaatgccagaccctaagaccttcaagcagcactttgagagcaagcatcctaagactccacttcctccagaattagctgatgttcaggcataaggttgtttacaggtgaattcatgacacctttgactcttctactgtctcagaccttaggtaacatacctgcagctgcttttctaacaaactgttgatcagcaaaaataaaggggctacagaaacactcatttttatgctgttccctcttgggcttcatgcaaagacaattctgtgtaaatgtacagttgactctgatttggaaatatgaaaatcagtccatccttgttataaaaaatttttttacaattgtaattatattgatgttcatattgtgtaaaataactcatttaataaaatagtactttgatttacga

SEQ ID NO: 203572 - DNA, 476 bp, Homo sapiens
  Payload ID: 20144
  Gene Name: zinc finger protein 706
  ENST ID: ENST00000523146
  CDS Start-End: 43-204
cgctgcactgtctctccgacgcaagactgtcccggcccggatatggctcgtggacagcagaaaattcagtctcagcagaaaaatgccaaaaagcaagctggacaaaagaagaaacaaggacatgaccaaaaggctgctgccaaagctgccttaatatatacctgcactgtctgtaggaagagtaaactgactaatggaaattaaacaatttgtgtggggtctcccagctggttagtagaagagctggaatctgaactcaggcagttcagctccagagtccaccctctggaccactactgtactgcctctcaaagaagtacttctgaaattccaaatcagagcctcttgcctgtttgtttaagctcattacccttgaagttagtgagtggcagtaccaaaggaaaccatagtggaacacaaatgccagaccctaagaccttcaagcagcactttgagagcaagcatcctaagactcc

SEQ ID NO: 203573 - DNA, 540 bp, Homo sapiens
  Payload ID: 20144
  Gene Name: zinc finger protein 706
  ENST ID: ENST00000518071
  CDS Start-End: 1-92
aaatgccagaccctaagaccttcaagcagcactttgagagcaagcatcctaagactccacttcctccagaattagctgatgttcaggcataaggttgtttacaggtgaattcatgacacctttgactcttctactgtctcagaccttagggtttcccaaactctcgattgcctcttgcaagcagatgacctgggagcaaatgttatggcagaacgatggactcctagcaagggccgaagcgtgccctgtgaagactggaaagaatatatgcttgtcagagatttggtaacctcatcaagaccttaaactgcagtttaagagggtggaaaaattactcaagtgaaactataagccctgttattcgtaagaaaacgtatgacacagagcaattggagaatctcttaatttgcatgcaaaaataacaggaggaaaaagtaaggaatgttatatctgatttcaagtgtgaatatgaagcaaaggaacttgagatgttaacacctgaaagaaatcaagatttcctagatacccctgaaacacagg

SEQ ID NO: 203574 - DNA, 2183 bp, Homo sapiens
  Payload ID: 20145
  Gene Name: zinc finger protein 707
  Uniprot ID: Q96C28
  ENST ID: ENST00000358656
  CDS Start-End: 213-1328
aaaagtctgggctaccggcgcggcgtagtggatgcagcatcctagtggaggacgcccctgtgttgctgaacctgtttgcatgagttgctcctgacggccctttaggatacttccatgtctgtagggtctagagtgacatctcctcccctcccctgacgagatctgccctccttggcactgtgcttccccagaggggtggcctcgctgttcccatggacatggcccaggagccagtgaccttcagggacgtggccatctacttctcaagggaggagtgggcgtgtctggaacccagccagagggccctctaccgggacgtgatgctggacaacttcagcagtgtggctgctctgggattttgcagccccagaccagacctcgtctctcgcctggaacagtgggaggagccgtgggttgaagaccgggagagacctgagttccaggcagtgcagaggggaccccggccaggggcaaggaagtctgcagaccccaagagaccttgtgatcatccagcttgggctcacaagaaaacccacgtgcggcgagaaagagccagggaaggaagcagctttaggaagggcttcaggctggacacggatgacgggcagcttcccagagctgctccagaaaggacagacgccaagcccacggctttcccgtgtcaggtgctcacgcagcgttgtgggcggcggccgggccgcagagagcgccggaagcagcgcgcagtagagctgtcattcatctgcggcacgtgcgggaaggcgctcagctgccacagccggctgctcgctcaccagacggtgcacacgggaaccaaggccttcgagtgccccgagtgcggccagaccttccggtgggcttcaaacctgcagcgccaccagaagaaccacacgcgcgagaagcccttctgctgcgaggcctgcgggcaggcgttcagcctgaaggaccgcctggctcagcaccgcaaggtccacaccgagcacaggccctactcgtgtggcgactgtgggaaagccttcaagcagaagtccaaccttctcagacaccagctggtgcacaccggggagcggccgttctactgcgcggactgcggcaaagccttccggaccaaggagaacctcagccaccaccagagggtccacagcggggagaagccctacacctgtgccgagtgcggcaagtccttccggtggcccaagggcttcagcatccaccggaggctgcacctgacgaagaggttctacgagtgcggccactgtgggaaaggcttccgtcacctggggttcttcacgcggcatcagaggactcacaggcacggggaggtgtaggggcgcccgaagagtggggtgctgcgcctctgcgggagtactgggtcctgagggagagctgcagtgagaagttgctcttcagcctggaaaatcaacctgaattcagagaagccttcttagtcctcagagctccccagtcccccgagaagtttactgggaaaactgccaggtgggagaagcagagccatgggtacgccggagatggcgggggctctggagatggcgggggctgcgccccggcgccgggcatcctggggatgtgctgagagtgtgcgcgaccccggagccacgtgccaggccgggctcagaggcggagaagcctgcctggtgcccacagccgtctggctcagggactccaccctggccccgagtcgccgtctgctgggcctttccttcctggctctgcaccccatgctggctgcccggtctggcttcccttcttgtctctgtcttgggcgaggcagctgtgagcattgcacagaggcaaagaccctcctgcagcctctgcgctgggccgtagaaacaagagcctttgtaatactgaacctcattcaaggattaggagtggtggttaggtcagggccacccccagtgctgcaggaacggcctccacccagctctgttggtcagagcctgggtcatgcacctggagttgggagatcaagttgggtctcagggcagtgaggtggccatatccaccacatcgcatttcgtgggggaagaggtgacctctttgttttaaacttaaggtgtctgcttatccagccagaaataaaaatctgccagtggtgttcccaagggaagacccccgtgggaatgggtcgggacactgccgtgtttcaggttagccaatta

SEQ ID NO: 203575 - DNA, 562 bp, Homo sapiens
  Payload ID: 20145
  Gene Name: zinc finger protein 707
  ENST ID: ENST00000442058
  CDS Start-End: 287-454
aaaagtctgggctaccggcgcggcgtagtggatgcagcatcctagtggaggacgcccctgtgatggagtctcactctgttgcccaggctggagtacagtggcgtgatctcggctcactgcaagctctgcctcccggttgctgaacctgtttgcatgagttgctcctgacggccctttaggatacttccatgtctgtagggtctagagtgacatctcctcccctcccctgacgagatctgccctccttggcactgtgcttccccagaggggtggcctcgctgttcccatggacatggcccaggagccagtgaccttcagggacgtggccatctacttctcaagggaggagtgggcgtgtctggaacccagccagagggccctctaccgggacgtgatgctggacaacttcagcagtgtggctgctctgggtgagcacgggctgagcgcagcgtgagcacagggattttgcagccccagaccagacctcgtctctcgcctggaacagtgggaggagccgtgggttgaagaccgggagagacctgagttccaggcagtgcagagg

SEQ ID NO: 203576 - DNA, 2661 bp, Homo sapiens
  Payload ID: 20145
  Gene Name: zinc finger protein 707
  Uniprot ID: Q96C28
  ENST ID: ENST00000418203
  CDS Start-End: 696-1811
cagacagcgtctcagtctaacatccaggctggagtgcactggcatgatctcagctcactgcaacctccgcctcccatattcaagcagtccccccacctcagcctcctgagtagctgggactgcatatgtgcactgccacgccccgctaattattgtattgtttatagagacaggctgggcaactgctgggctcgaacagtcctcctgcctcagcctcctagggtgttaggattacaggcgtgagccactgtgcttggccccttgtaatatctctgtcaggttttcggtttgggttttgctggcctcattaagacagactggatagcgtctgctcttcctctgttcactaaatagcttctaagatcagtactgtgcttccgtaggctttggtggagtttaccagggaatccagctgggtgtggtattttctgtgtgggaagggttccagttacattttcaattgccttatcagatggaaggcttccctttcttttgtcagtttcatgatactgtgtttttcatcgagtttgtctgtttcatctcagttgctgaacctgtttgcatgagttgctcctgacggccctttaggatacttccatgtctgtagggtctagagtgacatctcctcccctcccctgacgagatctgccctccttggcactgtgcttccccagaggggtggcctcgctgttcccatggacatggcccaggagccagtgaccttcagggacgtggccatctacttctcaagggaggagtgggcgtgtctggaacccagccagagggccctctaccgggacgtgatgctggacaacttcagcagtgtggctgctctgggattttgcagccccagaccagacctcgtctctcgcctggaacagtgggaggagccgtgggttgaagaccgggagagacctgagttccaggcagtgcagaggggaccccggccaggggcaaggaagtctgcagaccccaagagaccttgtgatcatccagcttgggctcacaagaaaacccacgtgcggcgagaaagagccagggaaggaagcagctttaggaagggcttcaggctggacacggatgacgggcagcttcccagagctgctccagaaaggacagacgccaagcccacggctttcccgtgtcaggtgctcacgcagcgttgtgggcggcggccgggccgcagagagcgccggaagcagcgcgcagtagagctgtcattcatctgcggcacgtgcgggaaggcgctcagctgccacagccggctgctcgctcaccagacggtgcacacgggaaccaaggccttcgagtgccccgagtgcggccagaccttccggtgggcttcaaacctgcagcgccaccagaagaaccacacgcgcgagaagcccttctgctgcgaggcctgcgggcaggcgttcagcctgaaggaccgcctggctcagcaccgcaaggtccacaccgagcacaggccctactcgtgtggcgactgtgggaaagccttcaagcagaagtccaaccttctcagacaccagctggtgcacaccggggagcggccgttctactgcgcggactgcggcaaagccttccggaccaaggagaacctcagccaccaccagagggtccacagcggggagaagccctacacctgtgccgagtgcggcaagtccttccggtggcccaagggcttcagcatccaccggaggctgcacctgacgaagaggttctacgagtgcggccactgtgggaaaggcttccgtcacctggggttcttcacgcggcatcagaggactcacaggcacggggaggtgtaggggcgcccgaagagtggggtgctgcgcctctgcgggagtactgggtcctgagggagagctgcagtgagaagttgctcttcagcctggaaaatcaacctgaattcagagaagccttcttagtcctcagagctccccagtcccccgagaagtttactgggaaaactgccaggtgggagaagcagagccatgggtacgccggagatggcgggggctctggagatggcgggggctgcgccccggcgccgggcatcctggggatgtgctgagagtgtgcgcgaccccggagccacgtgccaggccgggctcagaggcggagaagcctgcctggtgcccacagccgtctggctcagggactccaccctggccccgagtcgccgtctgctgggcctttccttcctggctctgcaccccatgctggctgcccggtctggcttcccttcttgtctctgtcttgggcgaggcagctgtgagcattgcacagaggcaaagaccctcctgcagcctctgcgctgggccgtagaaacaagagcctttgtaatactgaacctcattcaaggattaggagtggtggttaggtcagggccacccccagtgctgcaggaacggcctccacccagctctgttggtcagagcctgggtcatgcacctggagttgggagatcaagttgggtctcagggcagtgaggtggccatatccaccacatcgcatttcgtgggggaagaggtgacctctttgttttaaacttaaggtgtctgcttatccagccagaaataaaaatctgccagtggtgttcccaagggaagacccccgtgggaatgggtcgggacactgccgtgtttcaggttagcc

SEQ ID NO: 203577 - DNA, 589 bp, Homo sapiens
  Payload ID: 20145
  Gene Name: zinc finger protein 707
  ENST ID: ENST00000527293
  CDS Start-End: 215-382
gtaaaagtctgggctaccggcgcggcgtagtggatgcagcatcctagtggaggacgcccctgtggccggactgcaggggtgcgatcttggctcacagcaacttccacctcccgggttcaagcgattctcctgcctcagcttcccaagtagctgggatgacagatctgccctccttggcactgtgcttccccagaggggtggcctcgctgttcccatggacatggcccaggagccagtgaccttcagggacgtggccatctacttctcaagggaggagtgggcgtgtctggaacccagccagagggccctctaccgggacgtgatgctggacaacttcagcagtgtggctgctctgggtgagcacgggctgagcgcagcgtgagcacagggattttgcagccccagaccagacctcgtctctcgcctggaacagtgggaggagccgtgggttgaagaccgggagagacctgagttccaggcagtgcagaggggaccccggccaggggcaaggaagtctgcagaccccaagagaccttgtgatcatccagcttgggctcacaagaaaacccacgtgcggcgagaaagagcc

SEQ ID NO: 203578 - DNA, 2114 bp, Homo sapiens
  Payload ID: 20145
  Gene Name: zinc finger protein 707
  ENST ID: ENST00000533031
  CDS Start-End: 140-307
aacaacttccgctcgggaagtttgtaaaagtctgggctaccggcgcggcgtagtggatgcagcatcctagtggaggacgcccctgtgatctgccctccttggcactgtgcttccccagaggggtggcctcgctgttcccatggacatggcccaggagccagtgaccttcagggacgtggccatctacttctcaagggaggagtgggcgtgtctggaacccagccagagggccctctaccgggacgtgatgctggacaacttcagcagtgtggctgctctgggtgagcacgggctgagcgcagcgtgagcacagggattttgcagccccagaccagacctcgtctctcgcctggaacagtgggaggagccgtgggttgaagaccgggagagacctgagttccaggcagtgcagaggggaccccggccaggggcaaggaagtctgcagaccccaagagaccttgtgatcatccagcttgggctcacaagaaaacccacgtgcggcgagaaagagccagggaaggaagcagctttaggaagggcttcaggctggacacggatgacgggcagcttcccagagctgctccagaaaggacagacgccaagcccacggctttcccgtgtcaggtgctcacgcagcgttgtgggcggcggccgggccgcagagagcgccggaagcagcgcgcagtagagctgtcattcatctgcggcacgtgcgggaaggcgctcagctgccacagccggctgctcgctcaccagacggtgcacacgggaaccaaggccttcgagtgccccgagtgcggccagaccttccggtgggcttcaaacctgcagcgccaccagaagaaccacacgcgcgagaagcccttctgctgcgaggcctgcgggcaggcgttcagcctgaaggaccgcctggctcagcaccgcaaggtccacaccgagcacaggccctactcgtgtggcgactgtgggaaagccttcaagcagaagtccaaccttctcagacaccagctggtgcacaccggggagcggccgttctactgcgcggactgcggcaaagccttccggaccaaggagaacctcagccaccaccagagggtccacagcggggagaagccctacacctgtgccgagtgcggcaagtccttccggtggcccaagggcttcagcatccaccggaggctgcacctgacgaagaggttctacgagtgcggccactgtgggaaaggcttccgtcacctggggttcttcacgcggcatcagaggactcacaggcacggggaggtgtaggggcgcccgaagagtggggtgctgcgcctctgcgggagtactgggtcctgagggagagctgcagtgagaagttgctcttcagcctggaaaatcaacctgaattcagagaagccttcttagtcctcagagctccccagtcccccgagaagtttactgggaaaactgccaggtgggagaagcagagccatgggtacgccggagatggcgggggctctggagatggcgggggctgcgccccggcgccgggcatcctggggatgtgctgagagtgtgcgcgaccccggagccacgtgccaggccgggctcagaggcggagaagcctgcctggtgcccacagccgtctggctcagggactccaccctggccccgagtcgccgtctgctgggcctttccttcctggctctgcaccccatgctggctgcccggtctggcttcccttcttgtctctgtcttgggcgaggcagctgtgagcattgcacagaggcaaagaccctcctgcagcctctgcgctgggccgtagaaacaagagcctttgtaatactgaacctcattcaaggattaggagtggtggttaggtcagggccacccccagtgctgcaggaacggcctccacccagctctgttggtcagagcctgggtcatgcacctggagttgggagatcaagttgggtctcagggcagtgaggtggccatatccaccacatcgcatttcgtgggggaagaggtgacctctttgttttaaacttaaggtgtctgcttatccagccagaaataaaaatctgccagtggtgttcccaagggaagacccccgtgggaatgggtcggg

SEQ ID NO: 203579 - DNA, 589 bp, Homo sapiens
  Payload ID: 20145
  Gene Name: zinc finger protein 707
  ENST ID: ENST00000529833
  CDS Start-End: 353-589
aagtttgtaaaagtctgggctaccggcgcggcgtagtggatgcagcatcctagtggaggacgcccctgtgggctgtgagacccagcgtcgcggctgctgggacagaccggggaggctgcccgtgccctcggctattcgggggctgttcttcagcttcttccggctcggcctcctcttctctcctcgctccttacacttgcagttgctgaacctgtttgcatgagttgctcctgacggccctttaggatacttccatgtctgtagggtctagagtgacatctcctcccctcccctgacgagatctgccctccttggcactgtgcttccccagaggggtggcctcgctgttcccatggacatggcccaggagccagtgaccttcagggacgtggccatctacttctcaagggaggagtgggcgtgtctggaacccagccagagggccctctaccgggacgtgatgctggacaacttcagcagtgtggctgctctgggattttgcagccccagaccagacctcgtctctcgcctggaacagtgggaggagccgtgggttgaagaccgggagagacctgagttccaggcagtg

SEQ ID NO: 203580 - DNA, 595 bp, Homo sapiens
  Payload ID: 20145
  Gene Name: zinc finger protein 707
  ENST ID: ENST00000525185
  CDS Start-End: 144-311
ggataacaacttccgctcgggaagtttgtaaaagtctgggctaccggcgcggcgtagtggatgcagcatcctagtggaggacgcccctgtgatctgccctccttggcactgtgcttccccagaggggtggcctcgctgttcccatggacatggcccaggagccagtgaccttcagggacgtggccatctacttctcaagggaggagtgggcgtgtctggaacccagccagagggccctctaccgggacgtgatgctggacaacttcagcagtgtggctgctctgggtgagcacgggctgagcgcagcgtgagcacaggaaggattttgcagccccagaccagacctcgtctctcgcctggaacagtgggaggagccgtgggttgaagaccgggagagacctgagttccaggcagtgcagaggggaccccggccaggggcaaggaagtctgcagaccccaagagaccttgtgatcatccagcttgggctcacaagaaaacccacgtgcggcgagaaagagccagggaaggaagcagctttaggaagggcttcaggctggacacggatgacgggcagcttcccagagctgctccaga

SEQ ID NO: 203581 - DNA, 577 bp, Homo sapiens
  Payload ID: 20145
  Gene Name: zinc finger protein 707
  ENST ID: ENST00000528456
  CDS Start-End: 134-412
ttccgctcgggaagtttgtaaaagtctgggctaccggcgcggcgtagtggatgcagcatcctagtggaggacgcccctgtgatctgccctccttggcactgtgcttccccagaggggtggcctcgctgttcccatggacatggcccaggagccagtgaccttcagggacgtggccatctacttctcaagggaggagtgggcgtgtctggaacccagccagagggccctctaccgggacgtgatgctggacaacttcagcagtgtggctgctctgggattttgcagccccagaccagacctcgtctctcgcctggaacagtgggaggagccgtgggttgaagaccgggagagacctgagttccaggcagtgcagaggggaccccggccagagtgggatggagcagctatgtgaacacgagccctgggaggtccccgggtatgtggagtccccgactgtggagtgtcaggttcctaggggcaaggaagtctgcagaccccaagagaccttgtgatcatccagcttgggctcacaagaaaacccacgtgcggcgagaaagagccagggaaggaagcagct

SEQ ID NO: 203582 - DNA, 556 bp, Homo sapiens
  Payload ID: 20145
  Gene Name: zinc finger protein 707
  ENST ID: ENST00000531985
  CDS Start-End: 215-382
gtaaaagtctgggctaccggcgcggcgtagtggatgcagcatcctagtggaggacgcccctgtgttgctgaacctgtttgcatgagttgctcctgacggccctttaggatacttccatgtctgtagggtctagagtgacatctcctcccctcccctgacgagatctgccctccttggcactgtgcttccccagaggggtggcctcgctgttcccatggacatggcccaggagccagtgaccttcagggacgtggccatctacttctcaagggaggagtgggcgtgtctggaacccagccagagggccctctaccgggacgtgatgctggacaacttcagcagtgtggctgctctgggtgagcacgggctgagcgcagcgtgagcacagggattttgcagccccagaccagacctcgtctctcgcctggaacagtgggaggagccgtgggttgaagaccgggagagacctgagttccaggcagtgcagaggggaccccggccaggggcaaggaagtctgcagaccccaagagaccttgtgatcatccagcttgggct

SEQ ID NO: 203583 - DNA, 565 bp, Homo sapiens
  Payload ID: 20145
  Gene Name: zinc finger protein 707
  ENST ID: ENST00000526315
  CDS Start-End: 129-565
gtggatgcagcatcctagtggaggacgcccctgtggagccagtgaccttcagggacgtggccatctacttctcaagggaggagtgggcgtgtctggaacccagccagagggccctctaccgggacgtgatgctggacaacttcagcagtgtggctgctctgggattttgcagccccagaccagacctcgtctctcgcctggaacagtgggaggagccgtgggttgaagaccgggagagacctgagttccaggcagtgcagaggggaccccggccaggggcaaggaagtctgcagaccccaagagaccttgtgatcatccagcttgggctcacaagaaaacccacgtgcggcgagaaagagccagggaaggaagcagctttaggaagggcttcaggctggacacggatgacgggcagcttcccagagctgctccagaaaggacagacgccaagcccacggctttcccgtgtcaggtgctcacgcagcgttgtgggcggcggccgggccgcagagagcgccggaagcagcgcgcagtagagctgtcattcatctgcggcacgtgcgg

SEQ ID NO: 203584 - DNA, 2865 bp, Homo sapiens
  Payload ID: 20145
  Gene Name: zinc finger protein 707
  Uniprot ID: Q96C28
  ENST ID: ENST00000532205
  CDS Start-End: 900-2015
gtggatgcagcatcctagtggaggacgcccctgtggctggagtgcaatggcgcgatatcggctcgccgcaacttctgcctcctgggttcaagtgaatctcctgccccagcctcctgagcagctgggatgacagatggagtctcactctgttgcccaggctggagtacagtggcgtgatctcggctcactgcaagctctgcctcccggacagcgtctcagtctaacatccaggctggagtgcactggcatgatctcagctcactgcaacctccgcctcccatattcaagcagtccccccacctcagcctcctgagtagctgggactgcatatgtgcactgccacgccccgctaattattgtattgtttatagagacaggctgggcaactgctgggctcgaacagtcctcctgcctcagcctcctagggtgttaggattacaggcgtgagccactgtgcttggccccttgtaatatctctgtcaggttttcggtttgggttttgctggcctcattaagacagactggatagcgtctgctcttcctctgttcactaaatagcttctaagatcagtactgtgcttccgtaggctttggtggagtttaccagggaatccagctgggtgtggtattttctgtgtgggaagggttccagttacattttcaattgccttatcagatggaaggcttccctttcttttgtcagtttcatgatactgtgtttttcatcgagtttgtctgtttcatctcagttgctgaacctgtttgcatgagttgctcctgacggccctttaggatacttccatgtctgtagggtctagagtgacatctcctcccctcccctgacgagatctgccctccttggcactgtgcttccccagaggggtggcctcgctgttcccatggacatggcccaggagccagtgaccttcagggacgtggccatctacttctcaagggaggagtgggcgtgtctggaacccagccagagggccctctaccgggacgtgatgctggacaacttcagcagtgtggctgctctgggattttgcagccccagaccagacctcgtctctcgcctggaacagtgggaggagccgtgggttgaagaccgggagagacctgagttccaggcagtgcagaggggaccccggccaggggcaaggaagtctgcagaccccaagagaccttgtgatcatccagcttgggctcacaagaaaacccacgtgcggcgagaaagagccagggaaggaagcagctttaggaagggcttcaggctggacacggatgacgggcagcttcccagagctgctccagaaaggacagacgccaagcccacggctttcccgtgtcaggtgctcacgcagcgttgtgggcggcggccgggccgcagagagcgccggaagcagcgcgcagtagagctgtcattcatctgcggcacgtgcgggaaggcgctcagctgccacagccggctgctcgctcaccagacggtgcacacgggaaccaaggccttcgagtgccccgagtgcggccagaccttccggtgggcttcaaacctgcagcgccaccagaagaaccacacgcgcgagaagcccttctgctgcgaggcctgcgggcaggcgttcagcctgaaggaccgcctggctcagcaccgcaaggtccacaccgagcacaggccctactcgtgtggcgactgtgggaaagccttcaagcagaagtccaaccttctcagacaccagctggtgcacaccggggagcggccgttctactgcgcggactgcggcaaagccttccggaccaaggagaacctcagccaccaccagagggtccacagcggggagaagccctacacctgtgccgagtgcggcaagtccttccggtggcccaagggcttcagcatccaccggaggctgcacctgacgaagaggttctacgagtgcggccactgtgggaaaggcttccgtcacctggggttcttcacgcggcatcagaggactcacaggcacggggaggtgtaggggcgcccgaagagtggggtgctgcgcctctgcgggagtactgggtcctgagggagagctgcagtgagaagttgctcttcagcctggaaaatcaacctgaattcagagaagccttcttagtcctcagagctccccagtcccccgagaagtttactgggaaaactgccaggtgggagaagcagagccatgggtacgccggagatggcgggggctctggagatggcgggggctgcgccccggcgccgggcatcctggggatgtgctgagagtgtgcgcgaccccggagccacgtgccaggccgggctcagaggcggagaagcctgcctggtgcccacagccgtctggctcagggactccaccctggccccgagtcgccgtctgctgggcctttccttcctggctctgcaccccatgctggctgcccggtctggcttcccttcttgtctctgtcttgggcgaggcagctgtgagcattgcacagaggcaaagaccctcctgcagcctctgcgctgggccgtagaaacaagagcctttgtaatactgaacctcattcaaggattaggagtggtggttaggtcagggccacccccagtgctgcaggaacggcctccacccagctctgttggtcagagcctgggtcatgcacctggagttgggagatcaagttgggtctcagggcagtgaggtggccatatccaccacatcgcatttcgtgggggaagaggtgacctctttgttttaaacttaaggtgtctgcttatccagccagaaataaaaatctgccagtggtgttcccaagggaagacccccgtgggaatgggtcgggacactgccgtgtttcaggttagcc

SEQ ID NO: 203585 - DNA, 2218 bp, Homo sapiens
  Payload ID: 20145
  Gene Name: zinc finger protein 707
  Uniprot ID: Q96C28
  ENST ID: ENST00000532158
  CDS Start-End: 276-1391
ctaccggcgcggcgtagtggatgcagcatcctagtggaggacgcccctgtgatggagtctcactctgttgcccaggctggagtacagtggcgtgatctcggctcactgcaagctctgcctcccggttgctgaacctgtttgcatgagttgctcctgacggccctttaggatacttccatgtctgtagggtctagagtgacatctcctcccctcccctgacgagatctgccctccttggcactgtgcttccccagaggggtggcctcgctgttcccatggacatggcccaggagccagtgaccttcagggacgtggccatctacttctcaagggaggagtgggcgtgtctggaacccagccagagggccctctaccgggacgtgatgctggacaacttcagcagtgtggctgctctgggattttgcagccccagaccagacctcgtctctcgcctggaacagtgggaggagccgtgggttgaagaccgggagagacctgagttccaggcagtgcagaggggaccccggccaggggcaaggaagtctgcagaccccaagagaccttgtgatcatccagcttgggctcacaagaaaacccacgtgcggcgagaaagagccagggaaggaagcagctttaggaagggcttcaggctggacacggatgacgggcagcttcccagagctgctccagaaaggacagacgccaagcccacggctttcccgtgtcaggtgctcacgcagcgttgtgggcggcggccgggccgcagagagcgccggaagcagcgcgcagtagagctgtcattcatctgcggcacgtgcgggaaggcgctcagctgccacagccggctgctcgctcaccagacggtgcacacgggaaccaaggccttcgagtgccccgagtgcggccagaccttccggtgggcttcaaacctgcagcgccaccagaagaaccacacgcgcgagaagcccttctgctgcgaggcctgcgggcaggcgttcagcctgaaggaccgcctggctcagcaccgcaaggtccacaccgagcacaggccctactcgtgtggcgactgtgggaaagccttcaagcagaagtccaaccttctcagacaccagctggtgcacaccggggagcggccgttctactgcgcggactgcggcaaagccttccggaccaaggagaacctcagccaccaccagagggtccacagcggggagaagccctacacctgtgccgagtgcggcaagtccttccggtggcccaagggcttcagcatccaccggaggctgcacctgacgaagaggttctacgagtgcggccactgtgggaaaggcttccgtcacctggggttcttcacgcggcatcagaggactcacaggcacggggaggtgtaggggcgcccgaagagtggggtgctgcgcctctgcgggagtactgggtcctgagggagagctgcagtgagaagttgctcttcagcctggaaaatcaacctgaattcagagaagccttcttagtcctcagagctccccagtcccccgagaagtttactgggaaaactgccaggtgggagaagcagagccatgggtacgccggagatggcgggggctctggagatggcgggggctgcgccccggcgccgggcatcctggggatgtgctgagagtgtgcgcgaccccggagccacgtgccaggccgggctcagaggcggagaagcctgcctggtgcccacagccgtctggctcagggactccaccctggccccgagtcgccgtctgctgggcctttccttcctggctctgcaccccatgctggctgcccggtctggcttcccttcttgtctctgtcttgggcgaggcagctgtgagcattgcacagaggcaaagaccctcctgcagcctctgcgctgggccgtagaaacaagagcctttgtaatactgaacctcattcaaggattaggagtggtggttaggtcagggccacccccagtgctgcaggaacggcctccacccagctctgttggtcagagcctgggtcatgcacctggagttgggagatcaagttgggtctcagggcagtgaggtggccatatccaccacatcgcatttcgtgggggaagaggtgacctctttgttttaaacttaaggtgtctgcttatccagccagaaataaaaatctgccagtggtgttcccaagggaagacccccgtgggaatgggtcggga

SEQ ID NO: 203586 - DNA, 525 bp, Homo sapiens
  Payload ID: 20145
  Gene Name: zinc finger protein 707
  ENST ID: ENST00000530574
  CDS Start-End: 123-525
aagtttgtaaaagtctgggctaccggcgcggcgtagtggatgcagcatcctagtggaggacgcccctgtgatctgccctccttggcactgtgcttccccagaggggtggcctcgctgttcccatggacatggcccaggagccagtgaccttcagggacgtggccatctacttctcaagggaggagtgggcgtgtctggaacccagccagagggccctctaccgggacgtgatgctggacaacttcagcagtgtggctgctctggccccagaccagacctcgtctctcgcctggaacagtgggaggagccgtgggttgaagaccgggagagacctgagttccaggcagtgcagaggggaccccggccaggggcaaggaagtctgcagaccccaagagaccttgtgatcatccagcttgggctcacaagaaaacccacgtgcggcgagaaagagccagggaaggaagcagctttaggaagggcttcaggctggacacggatgacgggcagcttcccagagctgctcc

SEQ ID NO: 203587 - DNA, 570 bp, Homo sapiens
  Payload ID: 20145
  Gene Name: zinc finger protein 707
  ENST ID: ENST00000525862
  CDS Start-End: 89-400
agtggatgcagcatcctagtggaggacgcccctgtgatctgccctccttggcactgtgcttccccagaggggtggcctcgctgttcccatggacatggcccaggagccagtgaccttcagggacgtggccatctacttctcaagggaggagtgggcgtgtctggaacccagccagagggccctctaccgggacgtgatgctggacaacttcagcagtgtggctgctctgggattttgcagccccagaccagacctcgtctctcgcctggaacagtgggaggagccgtgggttgaagaccgggagagacctgagttccaggcagtgcagaggggaccccggccagccacccaggtgctgtccggcggaggccattggtgtgggtgtctgacctccctgtgatggccatgtggggtcccaggcctggtactgactgcacgtgagggtctccagagtgggatggagcagctatgtgaacacgagccctgggaggtccccgggtatgtggagtccccgactgtggagtgtcaggttcctaggggcaaggaagtctgcagaccccaagagacctt

SEQ ID NO: 203588 - DNA, 562 bp, Homo sapiens
  Payload ID: 20145
  Gene Name: zinc finger protein 707
  ENST ID: ENST00000526970
  CDS Start-End: 421-562
ctgggctaccggcgcggcgtagtggatgcagcatcctagtggaggacgcccctgtggtttgtcaggacccggttgcgtatcctcttgaagctggtttcttcctggccgaccccgtccgcgatcgtgaccttagttatccctcatagacactttccacacctgtgtctccagccctatcgctccgatgagacccgagcgcttagacttgattcataacacccaaagctccccggccccaggctgagctcctgcaacctccacaccccaccctctggtcctcccaggcattccaccgcgaaggggaggaggcagaaacccgagattcgcttcttctcctttcctgcccacgcccagccacacagtcactgatctgccctccttggcactgtgcttccccagaggggtggcctcgctgttcccatggacatggcccaggagccagtgaccttcagggacgtggccatctacttctcaagggaggagtgggcgtgtctggaacccagccagagggccctctaccgggacgtgatgctggacaacttcagcagtgtggctgctctgg

SEQ ID NO: 203589 - DNA, 567 bp, Homo sapiens
  Payload ID: 20145
  Gene Name: zinc finger protein 707
  ENST ID: ENST00000534303
  CDS Start-End: 143-567
gataacaacttccgctcgggaagtttgtaaaagtctgggctaccggcgcggcgtagtggatgcagcatcctagtggaggacgcccctgtgatctgccctccttggcactgtgcttccccagaggggtggcctcgctgttcccatggacatggcccaggagccagtgaccttcagggacgtggccatctacttctcaagggaggagtgggcgtgtctggaacccagccagagggccctctaccgggacgtgatgctggacaacttcagcagtgtggctgctctgggattttgcagccccagaccagacctcgtctctcgcctggaacagtgggaggagccgtgggttgaagaccgggagagacctgagttccaggcagtgcagaggggaccccggccaggggcaaggaagtctgcagaccccaagagaccttgtgatcatccagcttgggctcacaagaaaacccacgtgcggcgagaaagagccagggaaggaagcagctttaggaagggcttcaggctggacacggatgacgggcagcttcccagagctgctccagaaaggacaga

SEQ ID NO: 203590 - DNA, 2661 bp, Homo sapiens; identical to SEQ ID NO: 203576
  Payload ID: 20145
  Gene Name: zinc finger protein 707
  Uniprot ID: Q96C28
  ENST ID: ENST00000622212
  CDS Start-End: 696-1811

SEQ ID NO: 203591 - DNA, 2183 bp, Homo sapiens; identical to SEQ ID NO: 203574
  Payload ID: 20145
  Gene Name: zinc finger protein 707
  Uniprot ID: Q96C28
  ENST ID: ENST00000611844
  CDS Start-End: 213-1328

SEQ ID NO: 203592 - DNA, 2865 bp, Homo sapiens; identical to SEQ ID NO: 203584
  Payload ID: 20145
  Gene Name: zinc finger protein 707
  Uniprot ID: Q96C28
  ENST ID: ENST00000611146
  CDS Start-End: 900-2015

SEQ ID NO: 203593 - DNA, 2218 bp, Homo sapiens; identical to SEQ ID NO: 203585
  Payload ID: 20145
  Gene Name: zinc finger protein 707
  Uniprot ID: Q96C28
  ENST ID: ENST00000617261
  CDS Start-End: 276-1391

SEQ ID NO: 203594 - DNA, 565 bp, Homo sapiens; identical to SEQ ID NO: 203583
  Payload ID: 20145
  Gene Name: zinc finger protein 707
  ENST ID: ENST00000632754
  CDS Start-End: 129-565

SEQ ID NO: 203595 - DNA, 577 bp, Homo sapiens; identical to SEQ ID NO: 203581
  Payload ID: 20145
  Gene Name: zinc finger protein 707
  ENST ID: ENST00000633449
  CDS Start-End: 134-412

SEQ ID NO: 203596 - DNA, 589 bp, Homo sapiens; identical to SEQ ID NO: 203577
  Payload ID: 20145
  Gene Name: zinc finger protein 707
  ENST ID: ENST00000633041
  CDS Start-End: 215-382

SEQ ID NO: 203597 - DNA, 567 bp, Homo sapiens; identical to SEQ ID NO: 203589
  Payload ID: 20145
  Gene Name: zinc finger protein 707
  ENST ID: ENST00000631634
  CDS Start-End: 143-567

SEQ ID NO: 203598 - DNA, 2114 bp, Homo sapiens; identical to SEQ ID NO: 203578
  Payload ID: 20145
  Gene Name: zinc finger protein 707
  ENST ID: ENST00000632874
  CDS Start-End: 140-307

SEQ ID NO: 203599 - DNA, 562 bp, Homo sapiens; identical to SEQ ID NO: 203575
  Payload ID: 20145
  Gene Name: zinc finger protein 707
  ENST ID: ENST00000633543
  CDS Start-End: 287-454

SEQ ID NO: 203600 - DNA, 556 bp, Homo sapiens; identical to SEQ ID NO: 203582
  Payload ID: 20145
  Gene Name: zinc finger protein 707
  ENST ID: ENST00000634047
  CDS Start-End: 215-382

SEQ ID NO: 203601 - DNA, 595 bp, Homo sapiens; identical to SEQ ID NO: 203580
  Payload ID: 20145
  Gene Name: zinc finger protein 707
  ENST ID: ENST00000633413
  CDS Start-End: 144-311

SEQ ID NO: 203602 - DNA, 570 bp, Homo sapiens; identical to SEQ ID NO: 203587
  Payload ID: 20145
  Gene Name: zinc finger protein 707
  ENST ID: ENST00000633973
  CDS Start-End: 89-400

SEQ ID NO: 203603 - DNA, 525 bp, Homo sapiens; identical to SEQ ID NO: 203586
  Payload ID: 20145
  Gene Name: zinc finger protein 707
  ENST ID: ENST00000632986
  CDS Start-End: 123-525

SEQ ID NO: 203604 - DNA, 589 bp, Homo sapiens; identical to SEQ ID NO: 203579
  Payload ID: 20145
  Gene Name: zinc finger protein 707
  ENST ID: ENST00000631732
  CDS Start-End: 353-589

SEQ ID NO: 203605 - DNA, 562 bp, Homo sapiens; identical to SEQ ID NO: 203588
  Payload ID: 20145
  Gene Name: zinc finger protein 707
  ENST ID: ENST00000633668
  CDS Start-End: 421-562

SEQ ID NO: 203606 - DNA, 4004 bp, Homo sapiens
  Payload ID: 20146
  Gene Name: zinc finger protein 708
  Uniprot ID: P17019
  ENST ID: ENST00000356929
  CDS Start-End: 199-1890
actcagacacgcagctggaccggacagggcggcttccgggtttggcgcggcctttgtctcttgctgcagccggagctccggtctcgtcttcactgctgtttgtcctctgctcctagaggcccagactctgtggctctgtgacctgcaggtattgggagatccacagctaagactccaggaccctctggaagcctagaaatgggaccattgacatttatggatgtggccatagaattctctctggaggagtggcagtgcctggacacagcacagcagaatttatataggaatgtcatgttagagaattatagaaacctggtattcctgggtattgctgtgtctaatttagacctgatcacctgtctggagcaaggaaaagagccctggaatatgaagagacacgagatggcagccaaacccccagctatgtgttctcattttgccaaagaccttaggccagagcaatatataaaaaattctttccaacaagtgatactgagaagatatggaaaatgtggatatcagaaaggctgtaaaagtgtggatgagcataagttgcacaaaggaggtcacaagggacttaaccggtgtgtgacaactacccagagcaaaatagttcagtgtgacaaatacgtgaaagtctttcataaatattcaaatgcaaagagacataagataagacatactggaaaaaatcctttcaaatgtaaagaatgtggcaaatcattttgcatgctttcacaactaactcaacatgagataattcatactggagaaaaaccctacaaatgtgaagaatgtggcaaagcttttaaaaagtcctcaaaccttacgaatcataagataattcatactggagagaaaccctacaaatgtgaagaatgtggaaaagcttttaaccagtcctcaactcttactagacataagataattcatactggagagaaactctacaaatgtgaagaatgtggcaaagcttttaaccggtcctcaaaccttactaaacataagatagttcatactggagagaaaccctacaaatgtgaagaatgtggcaaagcttttaaacagtcctcaaaccttactaatcacaagaaaattcatactggagagaaaccctacaaatgtggagaatgtggcaaagcctttaccctatcttcacaccttactacacataagaggattcatactggtgagaaaccctacaaatgtgaagaatgtggcaaagcttttagtgtattttcaacccttactaaacataagataattcatactgaagagaaaccctacaaatgtgaagaatgtggcaaagcttttaaccggtcctcacaccttactaatcataaggtaattcatactggagagaaaccctacaaatgtgaagaatgtggtaaagcctttaccaagtcctcaactcttacttatcataaggtaattcatactggaaagaaaccctacaaatgtgaagaatgtggtaaagcctttagtatattctcaatccttactaaacataaagtaattcatactgaagacaaaccctacaaatgtgaagaatgtggcaaaacttttaactactcctcaaattttactaatcataaaaaaattcatactggagagaaaccctataagtgtgaagaatgtggcaaaagctttattctgtcctctcatcttactacacataagataattcatactggagagaaaccctacaaatgtaaagaatgtggcaaagcttttaaccagtcctcaacccttatgaaacataagataattcatactggagagaaaccctacaaatgtgaagaatgtggcaaagcctttaaccagtccccaaaccttactaaacataagagaattcataccaaagagaaaccctacaaatgtaaataatgtgtcaaatcctttagtgtattttcaacttttattaaaacacaagataattcatactggagagaaatcctacaaatgtgataaatgtggcaaagcctttaactggctcttaatccttatgaaacaaaagataattcatactagagagaaaccctacaaatgtaaagaatgtggcaaagcatttaactggtccctaaatcttactaaacataaaaaaacttaaactggagagaaactacaaagctggaagacatcacagtaattctgacaacacctcaaacttttctaaacataaaataaatcatactggtgaggaactttaaaaatgcgaaaaatgtgacaaaatctttaaatgattgtcacacttgattgtaggtaagataattcttactagaaaaactcttacaagtgtgaagaatgtggcaaaatttttaatgaatactcacaccttattgccaggaaagcatttatacttgagaaaaattgtaccaatataaagactgtgaaaaagccattaatgtctgctcacatcttactcaacatcagagagtacttaaaaaaagtattataaatttaattactgtcaaaaagtatttcagaaaatataagcttttaaagtatttattttgaagacaaacattacaaataaaagaggattgtaatacctttatttgtatcacagatcttattgtacacattttgtactagagaaaaccctgaagcagttacttaaactttgttcaacatcagggaattcagattggagaaaaaccctgcaaatgtaataaatttgaaaaaaaagttttccaaaactacaacttagacaacaccagagggttcatactgagatatatttttgcagatgcagtatatatttaaaacatttaatccaaaataagtctatgtaaatatcagagaattcacagtggaaatatctaaggtagggccgggcatggtggctcacgcctgtaatgccagcactttgggaggctgaggtgggcagatcatgaggtcaacagattgagaccatcctggtcaacatggtaaaaccctgtctctactaaaaatacaaaaattagctgggcgtggcggcacgtgcctgtagtctcagctacttgggacgctgaggcaggaaaatccgttgaacccaggaggcagaggttgtagtgagccgagattgcaccactgcactccagccgggtgacagagtgagactccatctcaaaaacaaacaaactaaggtatggatgcttcagacattacactatatcaaagtgctgactgttaaaaatgatcccaaactaacggtagataaatttatttgtacataactttaaaaggagtagaagattttttggaagtttgtaattacattcaaagtatactttttttgtttgtttgttttccttgagacagagtctctctctgtcgtccaggctggagtgcagtggcacaatctcagctcgctgcaacctctgcctcctgggttcaagcaattctcctgcctcagcctactgagtagctgagattacaggtgcacaccaccacgtccggctgacttttgtatttttagtagggacggggtttcaccatattggtcagggtagtcttgaactcctgacctcatgctctgcccagcttggcttcccaaagtgctgtgattacaggcttaagccacagcgcccggcccaaagtgttcttttttccttgaaaagaagtacagattttttaaaaagctaatattgctgtgattcaactctctagttacttgatgctatttcttcatttctattgtattcacatgtgaaagcatgtgatcagttgtcacggcatcaaagataggagagtttctttttttttaggtgggcattatttatgaccttttctttggaagagtaaggacattaaaatgtaacatgcatgatgaaaatctaagtggagatggtatttgtggttaattatgatattgagtggtgcatgaggtaggtgtttagagtaatattcttttgcattatagtaagaacatttaagttttgttaaaattaaaaaattagtacgttattttactatttgtacttttatgtaataaaatgcagtacatttttaaattttca

SEQ ID NO: 203607 - DNA, 567 bp, Homo sapiens
  Payload ID: 20146
  Gene Name: zinc finger protein 708
  ENST ID: ENST00000601295
  CDS Start-End: 190-567
gctccggtctcgtcttcactgctgtttgtcctctgctcctagaggcccagactctgtggctctgtgacctgcaggtattgggagatccacagctaagactccaggaccctctggaagcctagaaatggtattgctgtgtctaatttagacctgatcacctgtctggagcaaggaaaagagccctggaatatgaagagacacgagatggcagccaaacccccagctatgtgttctcattttgccaaagaccttaggccagagcaatatataaaaaattctttccaacaagtgatactgagaagatatggaaaatgtggatatcagaaaggctgtaaaagtgtggatgagcataagttgcacaaaggaggtcacaagggacttaaccggtgtgtgacaactacccagagcaaaatagttcagtgtgacaaatacgtgaaagtctttcataaatattcaaatgcaaagagacataagataagacatactggaaaaaatcctttcaaatgtaaagaatgtggcaaatcattttgcatgctttcacaactaactcaacatgagataattcat

SEQ ID NO: 203608 - DNA, 590 bp, Homo sapiens
  Payload ID: 20146
  Gene Name: zinc finger protein 708
  ENST ID: ENST00000602023
  CDS Start-End: 396-590
gcggcttccgggtttggcgcggcctttgtctcttgctgcagccggagctccggtctcgtcttcactgctgtttgtcctctgctcctagaggcccagactctgtggctctgtgacctgcaggtattgggagatccacagctaagactccaggaccctctggaagcctagaaatggtattgctgtgtctaatttagacctgatcacctgtctggagcaaggaaaagagccctggaatatgaagagacacgagatggcagccaaacccccagatggagttttgctgttattgcccagactggagtgcagtggcctgatctcagctaactgaaacctccgcctcccgggttcaagcgatttctcctgcctcagccttccgagtaactgggattacagctatgtgttctcattttgccaaagaccttaggccagagcaatatataaaaaattctttccaacaagtgatactgagaagatatggaaaatgtggatatcagaaaggctgtaaaagtgtggatgagcataagttgcacaaaggaggtcacaagggacttaaccggtgtgtgacaactacccagagcaaaatagttcag

SEQ ID NO: 203609 - DNA, 2630 bp, Homo sapiens
  Payload ID: 20146
  Gene Name: zinc finger protein 708
  ENST ID: ENST00000598046
  CDS Start-End: 214-330
agctggggacagttcactcagacacgcagctggaccggacagggcggcttccgggtttggcgcggcctttgtctcttgctgcagccggagctccggtctcgtcttcactgctgtttgtcctctgctcctagaggcccagactctgtggctctgtgacctgcaggtattgggagatccacagctaagactccaggaccctctggaagcctagaaatggtgaaggtttttctttggaaactttacggagtgatgtgtcttcagccacccttcagttttttcctggtcctgggtttcagtactgtctggagtaaaccaagatacacatcatgactttttctgctagagtgtctagtgaatatcagctcctgggtcatttttctccctgaggacaacctgaggtattgctgtgtctaatttagacctgatcacctgtctggagcaaggaaaagagccctggaatatgaagagacacgagatggcagccaaacccccagctatgtgttctcattttgccaaagaccttaggccagagcaatatataaaaaattctttccaacaagtgatactgagaagatatggaaaatgtggatatcagaaaggctgtaaaagtgtggatgagcataagttgcacaaaggaggtcacaagggacttaaccggtgtgtgacaactacccagagcaaaatagttcagtgtgacaaatacgtgaaagtctttcataaatattcaaatgcaaagagacataagataagacatactggaaaaaatcctttcaaatgtaaagaatgtggcaaatcattttgcatgctttcacaactaactcaacatgagataattcatactggagaaaaaccctacaaatgtgaagaatgtggcaaagcttttaaaaagtcctcaaaccttacgaatcataagataattcatactggagagaaaccctacaaatgtgaagaatgtggaaaagcttttaaccagtcctcaactcttactagacataagataattcatactggagagaaactctacaaatgtgaagaatgtggcaaagcttttaaccggtcctcaaaccttactaaacataagatagttcatactggagagaaaccctacaaatgtgaagaatgtggcaaagcttttaaacagtcctcaaaccttactaatcacaagaaaattcatactggagagaaaccctacaaatgtggagaatgtggcaaagcctttaccctatcttcacaccttactacacataagaggattcatactggtgagaaaccctacaaatgtgaagaatgtggcaaagcttttagtgtattttcaacccttactaaacataagataattcatactgaagagaaaccctacaaatgtgaagaatgtggcaaagcttttaaccggtcctcacaccttactaatcataaggtaattcatactggagagaaaccctacaaatgtgaagaatgtggtaaagcctttaccaagtcctcaactcttacttatcataaggtaattcatactggaaagaaaccctacaaatgtgaagaatgtggtaaagcctttagtatattctcaatccttactaaacataaagtaattcatactgaagacaaaccctacaaatgtgaagaatgtggcaaaacttttaactactcctcaaattttactaatcataaaaaaattcatactggagagaaaccctataagtgtgaagaatgtggcaaaagctttattctgtcctctcatcttactacacataagataattcatactggagagaaaccctacaaatgtaaagaatgtggcaaagcttttaaccagtcctcaacccttatgaaacataagataattcatactggagagaaaccctacaaatgtgaagaatgtggcaaagcctttaaccagtccccaaaccttactaaacataagagaattcataccaaagagaaaccctacaaatgtaaataatgtgtcaaatcctttagtgtattttcaacttttattaaaacacaagataattcatactggagagaaatcctacaaatgtgataaatgtggcaaagcctttaactggctcttaatccttatgaaacaaaagataattcatactagagagaaaccctacaaatgtaaagaatgtggcaaagcatttaactggtccctaaatcttactaaacataaaaaaacttaaactggagagaaactacaaagctggaagacatcacagtaattctgacaacacctcaaacttttctaaacataaaataaatcatactggtgaggaactttaaaaatgcgaaaaatgtgacaaaatctttaaatgattgtcacacttgattgtaggtaagataattcttactagaaaaactcttacaagtgtgaagaatgtggcaaaatttttaatgaatactcacaccttattgccaggaaagcatttatacttgagaaaaattgtaccaatataaagactgtgaaaaagccattaatgtctgctcacatcttactcaacatcagagagtacttaaaaaaagtattataaatttaattactgtcaaaaagtatttcagaaaatataagcttttaaagtatttattttgaagacaaacattacaaataaaagaggattgtaataccttta

SEQ ID NO: 203610 - DNA, 2164 bp, Homo sapiens
  Payload ID: 20146
  Gene Name: zinc finger protein 708
  ENST ID: ENST00000611392
  CDS Start-End: 87-1673
ctagaggcccagactctgtggctctgtgacctgcaggtattgggagatccacagctaagactccaggaccctctggaagcctagaaatgggaccattgacatttatggatgtggccatagaattctctctggaggagtggcagtgcctggacacagcacagcagaatttatataggaatgtcatgttagagaattatagaaacctggtattcctgggtattgctgtgtctaatttagacctgatcacctgtctggagcaaggaaaagagccctggaatatgaagagacacgagatggcagccaaacccccagctatgtgttctcattttgccaaagaccttaggccagagcaatatataaaaaattctttccaacaagtgatactgagaagatatggaaaatgtggatatcagaaagtaaaagtgtggatgagctgtgacaaatacgtgaaagtctttcataaatattcaaatgcaaagagacataagataacatactggaaaaaatcctttcaatgtaaagaatgtggcaaatcattttgcatgctttcacaactaactcaacatgagataattcatactggagaaaaaccctacaaatgtgaagaatgtggcaaagcttttaaaaagtcctcaaaccttacgaatcataagataattcatactggagagaaaccctacaaatgtgaagaatgtggaaaagcttttaaccagtcctcaactcttactagacataagataattcatactggagagaaactctacaaatgtgaagaatgtggcaaagcttttaaccggtcctcaaaccttactaaacataagatagttcatactggagagaaaccctacaaatgtgaagaatgtggcaaagcttttaaacagtcctcaaaccttactaatcacaagaaaattcatactggagagaaaccctacaaatgtggagaatgtggcaaagcctttaccctatcttcacaccttactacacataagaggattcatactggtgagaaaccctacaaatgtgaagaatgtggcaaagcttttagtgtattttcaacccttactaaacataagataattcatactgaagagaaaccctacaaatgtgaagaatgtggcaaagcttttaaccggtcctcacaccttactaatcataaggtaattcatactggagagaaaccctacaaatgtgaagaatgtggtaaagcctttaccaagtcctcaactcttacttttactaatcataaaaaaattcatactggagagaaaccctataagtgtgaagaatgtggcaaaagctttattctgtcctctcatcttactacacataagataattcatactggagagaaaccctacaaatgtaaagaatgtggcaaagcttttaaccagtcctcaacccttatgaaacataagataattcatactggagagaaaccctacaaatgtgaagaatgtggcaaagcctttaaccagtccccaaaccttactaaacataagataattcatactggagagaaatcctacaaatgtgaagaatgtggaaaagcttttaaacggtacttaaaccttactacacataagataattcctgctggagagaaaccctacaaatgtgaagaatgtggcaaagcttttaaccacttttcaaaccttactaaacataattcataatggagagaagccctacaaatgtgaaaaatgtggcaaacattttaaccaatcatcaacccttactacacatatgttaattcatgctggagagaaaccctacaaatatgaagaatgtggcaaagcttttaaccaatcctcaaaacttactaagcataactcatactggagaaaaatcttacaaatgtgaagaatgtggtaaagcctttatccagtcctcaactcctactaaacataacataagctgcttacaactgtgaaagagaaaccctacaaatgtgaagaatgtgacaaagcctttaaccagtcctcaattcttaataaacataagaaaattcatattggagagaaaccccatgagtgtgaaaaatatggcaaaggctttagctagtcctcagttcttaacacacataagataattcatactggagagaaactctacaaatcagaaagatgtgataatgcttttgacaatacctcaaacttttctaacc

SEQ ID NO: 203611 - DNA, 4910 bp, Homo sapiens
  Payload ID: 20147
  Gene Name: zinc finger protein 709
  Uniprot ID: Q8N972
  ENST ID: ENST00000397732
  CDS Start-End: 173-2098
ggaggggcgctgcgcaaacggcgagggcgtggctaccagccgctgcgctccgctctggggtctcctcaccccagaaggccctcaggtggaggaagggcctcaggtggaggtaggacctgtgctggccgcgggagaggtaaacagaacaccaggacatcccagagtctgggaaatggactcagtggtctttgaggatgtggctgtgaacttcacccaggaggagtgggctttgctgggtccctctcagaagaaactctacagagatgtgatgcaagaaacctttgttaacttggcctctataggggaaaactgggaggagaagaacattgaagatcacaaaaatcaggggagaaagctaagaagtcatatggtagagaggctctgtgaaaggaaagaaggtagtcagtttggagaaaccatcagtcagactccaaatcctaaaccaaacaagaaaacttttactagagtaaaaccatatgaatgtagtgtgtgtggaaaggactatatgtgtcattcatctcttaataggcacatgagatctcatactgaacatagatcatatgaatatcacaaatatggagagaaatcatatgaatgtaaggaatgtgggaaaagattcagctttcgaagttcatttcgaatacatgaaagaactcacactggagagaaaccctataaatgtaaacagtgtggtaaggctttcagttggcccagttcctttcaaatacatgaaagaactcatactggagagaaaccttatgaatgtaaggaatgtgggaaggccttcatttatcacacaacctttcgaggacacatgagaatgcacacaggggagaaaccctataaatgtaaagaatgcgggaaaacgttcagtcatcccagttcttttcgaaatcatgaaagaactcactctggagagaaaccctatgaatgtaaacaatgtggaaaagctttcagatattaccaaacttttcaaatacatgaaaggactcacactggggaaaaaccctatcagtgtaagcaatgtggtaaagctcttagttgtcccacatcctttcgaagtcatgaaaggattcacactggagaaaaaccctataaatgtaaaaaatgtgggaaagccttcagttttcctagttcctttagaaaacatgaaagaattcatacaggagagaaaccctatgattgtaaggaatgtgggaaagcattcatttctcttccaagctatcgaagacatatgataatgcacactggaaatggaccttataaatgcaaggaatgtgggaaagcctttgattgtcctagttcttttcaaatccatgaacgaactcacactggagagaaaccctatgaatgtaaacagtgtggtaaagccttcagttgttccagttcctttcgaatgcatgaaagaactcacactggagagaaaccccatgaatgtaaacaatgtggtaaagccttcagttgttccagttctgttcgaatacatgaaaggactcacactggagagaaaccctatgaatgtaaacagtgtggtaaagccttcagttgttccagttcctttcgaatgcatgaaagaattcacactggagagaaaccctatgaatgtaaacagtgtggtaaagcctttagtttttctagttcctttcggatgcatgaaaggactcacactggagagaaaccctatgaatgtaaacaatgtggtaaagccttcagttgttccagttcctttcgaatgcatgaaaggactcacactggggagaaaccctatgaatgtaaacagtgtggtaaggcgtttagttgttccagttccattcgaatacatgaaaggactcacactggagagaaaccttatgagtgtaaacaatgtggtaaggccttcagttgttctagttctgttcgaatgcatgaaaggactcacactggagtgaaaccctatgaatgtaaacaatgtgacaaagccttcagttgctcacgttcctttcgaatccatgaacgaactcacactggagagaaaccctatgcatgtcaacaatgtggtaaagccttcaagtgttcccgttcctttcgaatacatgaaagagttcatagtggagagtaaccctatgtatataagcaatatggcaaagttttcagttgtcctatttcctttttttttttttttttttttgagttgaattctcactctgttgccctggctggagtgcagtagagtgatctcagctcactgcaacctctgtctcctgggttcaagcgattctcctgcctcagcttcctgagtagctgggacaacaggtgtgaacgaccatgcccacttaatttttgtatttttagtagagatggggtttcgccatgttggccaggctggtctcgaactcctgacctcagacgatccacctgccttggcctcccaaagtgttggattacaggtgtgagccaccacacccggcccccatttccttttgaagacatgaaattattcatatttcagagaaaccctataagacatgggaataccttcagttatttacatgtgaatatgaggaagcattcatactggacaggaaaccctgcgaatgtaggcagtgtgggaaaaccttcaatggtcatatgaccttttaaggaccatgagaaggcatatgaagtgtaaagaattttcatatgccctataaatgtaaagaatttataaccttaaaaatgtaaagaatgtggaaaaccctataaatgtaaaaaatgtagaaaaacctttatttgtcttagtttacttggaaaccatgaacaaactcacactggaaagcgacttcttaaatatagacattgtgagaaagccttcagttggcccacatactaatatgtgagaatgcagactggatagaaatcctataaaagtgagatatagcaatgttttccattttaacaaatgctcatgtgatactcccttatgtgtgaaacttcaatctcatgttgaaactcccactagggaggtactgtataaatgtagataatatgggaaagcctgatgcaaattaattcatgtatattgttctagaaaattcacaacatgtcagaaatgtgataaaacatattatcagttactgattcttaaaatggatctctgaattatggatttctattactttcacaaaagaacactgagatgagataattctgtaagctcttatacagttgtacacaagttgaattgatagtattttttcattaaatcagtttctgaaattttgtctttccatattgaagtctgttagattcatgagtgaattgaagtgtatttataataagctagcagttttgatttttatgtattttttagttgtgctgtaatgggccatcaaaaaatgacaatttggtaatttttaggatttcctactggccttatgtggcaggtactagatatcattatatgtatttcatctttctgaccaaaagaggcttttttagaggaagacagagtacccttttttctattttttatgctaaaaaataatcataataaatttttgagtctgcaaagtttatcatacagtatactctctcattggaattattattttcatcttctgtttgctgtttgtaattccttctggctgtgatttgaataatagactttgtattaataagagagatctgagatagaaccatataacctatagctggaaatggctgtcctggattgtgttaacatgggttatgttgtgacctatgttttctataatctaaccttttatggctccacggtataattcaccaatagcctacttgcaggagatatggaaggcagaagtgaagaaagcattagtcaggttttatagccaccatatgtggagacagatggatgcataggagcttcagggacacctgcttccaccacattgtcctgatcctttgctctgccaattgagagtattcttagaaccaccactaactgcttgactgccatattttccttccttccttccttctttctttccctttccctttcttttctttctttactttctttttccgagatggagtcttgctctgtcgcccaggctggagtgcagtggtacgatcttggctcactgcaacctctgccttctgggttcaagcaattgtcctgccccagcctcccaagtagctgggattataggtgcccaccaccaagcccagctaaattttttttgtatttttagtagagacagggtttcatcattgttggccaggctggtctcaaactcctgacctcatgatctgcccaccttggccttccaaagtgctgagattacaggcgtgagccactgtgcatggccccagctgccatattttcaaagatgtagttttccacaaattgtcttcaaaagttctactcaaagatgcactgcagtttggattttcctagaaactctaatgtgtccaccaggcaaccatttagactcttaaggttgggaatattctctgatgctctgactcacctcatctctaggttgaatttatccaaggtattatttatgtaataaacaccatgttttgttaacagtaccagtgactatgtgtttctgattccaccgtgacaactacagtggtgcagtcaaaaagaactacatgggtgtctgcttctccactgcactgtgcagggaatgcacttacccagtcctacagtgtaagaataagcaccttcctaatatcaagcagattgtcggtgtttcctattacagttgaatgtcatctctcagtacattttcaattttgtttcattatatgtgattaaaaaccatgtgtatgtttttgttgaacaaaagcttctgtagatgtttcttagaaatattttattaacttttcaaataacttgtatgctatcacttgtctatttaattttctgcaaggatatattaaaatattccattgcaattata

SEQ ID NO: 203612 - DNA, 400 bp, Homo sapiens
  Payload ID: 20147
  Gene Name: zinc finger protein 709
  ENST ID: ENST00000455490
  CDS Start-End: 1-400
gtggcgccgctgcagtccctgtctgctgtgaccagctctgaccaaaggaggcgtagtaaggaagccaggacacctggaacccgggatacggactcagtggtctttgaggatgtggctgtgaacttcacccaggaggagtgggctttgctgggtccctctcagaagaaactctacagagatgtgatgcaagaaacctttgttaacttggcctctataggggaaaactgggaggagaagaacattgaagatcacaaaaatcaggggagaaagctaagaagtcatatggtagagaggctctgtgaaaggaaagaaggtagtcagtttggagaaaccatcagtcagactccaaatcctaaaccaaacaagaaaacttttactagagtaaaaccatatgaatgta

SEQ ID NO: 203613 - DNA, 5428 bp, Homo sapiens
  Payload ID: 20148
  Gene Name: zinc finger protein 71
  Uniprot ID: Q9NQZ8
  ENST ID: ENST00000328070
  CDS Start-End: 235-1704
tcattgtcctggcagagcggcgagccggtgagtgtggctgcggggtcgcgcccaccctctacctgtgccgggggccggaacctggccccggggagggcgcggcctcggggagacggcgtgcaggcccagcactgttggtcaccgcaggcctgtcttcctattcaccgtgggcagcagagggatggctgctcagctgctgactgatgaggcactgactgggagactagacctgaaatgaaagagttggatccaaagaatgacatttcggaagacaagctctccgttgttggggaggccacggggggacccacgaggaatggtgccaggggtcctggctcagaaggagtgtgggaaccaggcagctggccagagaggccgcggggagatgcaggtgcagagtgggagccattgggaattccccaggggaacaaactcttagggggctcagtacccgcatgtcatgaactgaaggcatttgccaaccaaggctgtgtcctggtcccaccacggctggacgaccccacagaaaagggggcctgtccacccgtaaggcgtggcaagaacttctccagcacttcagacctcagtaagccccccatgccctgcgaggagaagaaaacctacgactgcagcgagtgtggcaaggcctttagccgaagctcgtccctgataaagcaccaaaggatccacacgggagaaaagccgtttgagtgtgacacctgtgggaagcacttcatcgagcgctcgtccctcaccatccaccagcgggtgcacacgggcgagaagccctatgcctgcggggactgcggcaaggccttcagccagcgcatgaacctcactgtgcaccagcgcacgcacacgggcgagaagccgtatgtgtgcgacgtgtgtggcaaggccttccggaagacttcctctctcacccagcacgagcggatccacacgggggagaagccctacgcgtgcggggactgcggcaaggccttcagccagaacatgcacctcatcgtgcaccagcgcacgcacaccggggagaagccgtacgtgtgccccgagtgcgggcgagccttcagccagaacatgcacctgaccgagcaccagcgcacgcacaccggggagaagccgtacgcctgcaaggagtgcggcaaggccttcaacaagagctcctcgctcaccctgcaccagaggaaccacaccggcgagaagccctacgtgtgcggcgagtgcggcaaggccttcagccagagctcctacctcatccagcaccagcgcttccacatcggcgtgaagccgttcgagtgcagcgagtgcggcaaggccttcagcaagaactcctcgctcacgcagcaccagcgcatccacaccggcgagaagccctacgagtgctacatctgcaagaagcacttcacggggcgctcgtccctcatcgtgcaccagatcgtgcacaccggggagaagccctacgtgtgcggcgagtgcggcaaggccttcagccagagcgcctacctcatcgagcaccagcggatccacaccggcgagaagccgtacaggtgcggccagtgcgggaagtccttcatcaagaactcctccctcactgtgcaccagcggatccacacgggcgagaagccctaccgatgcggcgagtgcgggaagaccttcagccgcaacacgaacctgacgcgccacctgcggattcacacctgagcgcctctgtgcagggctctcactggcggtgcccaggacggacgccagatggctgcgcgctttgtcagcagtgctgtgagaagttctcccctggggtggggactcggggtcaggggagctcaggaatgtggggttgtggaggggctggctgatcacacatgccccctccttactgagcctcagaaagcaagcccctcggtgtctgacgtatctggggacacttcaaggttcactgtagctgagccatggccgctggtaacagacatcagggttccagactagccctcttgagtaactgtcctagagctgggacaggtcacgcctgcctccacatctctgtttcttcagcgggaaagtggagctggtggaggggagggaggagacatctccctctttgtcagatacatcctggagtccagatgcagcttgtcaccatctgcattttctccgtgggttgggagcgtgagggccttcctatccctccacccaccgtttccctgcagtgcacgctggcagccaccaagctaggaagtggcaggagtttgccggttgtttgtgaggggaaaaatttttttttcagagttagcaaataacagtaactactgctttgaatgccaaagtttcttagagtggtctgttacgttttttaaaaataaaacttttaattaagggagactatgttattttaaacagtcttctgttttggccagttgtctggtcaaaatcggcttcagtgattgtgggaggggcaagaaggaaaagaaacagcagcaggtttgatattcagaaagaaatatgcatggattcaataagtatatacatctgagcacagattatttttatagtgatttttgcagctaaatgtgaaggcaactgtcttaagtcccttcctgctgctgtaacaaaagaccttagactgggtaatttataaacaatagaaatttgtcactcatggttctggatgctgggaagtccaagatcaaggctctggcagatttggtgtctgatggggtatgttcttcataggtagtgcttgtgtcttgatgtgtgtcttcacgtggttgtaaacggcagacttcctcaggccccttataagggtgctaatcccagtcacaagggccctgacctcatgacctcccaaaggtcctccctcttcatactgttacattggggatcaagtttccaatatgtgaatacagggaagcaccaacagaccatatcagtaacttcgagtgagtttcctaaggccgactgaagctctgtttacacataagagtgttccccaaagtgcactttctctggggccttttaggccatacttttaattttgttatttgatactactggttgctaatgttctggcatttccagttgttccacactccctgacactggtgtacacaaataaataatacagaaaaaaaattatatcagcaagcacattctgcaaataagaaaaacagccactcgggcacgtataaacaaggtggaccgtttttcaaattctggcagtcaagtgggcctcagggtgggtttgattcaggctctcatcattggagccatagctgtggttctctgtgatgctctggctctcccttcatacttcttaacatcatcctcaggctggcttcccacgtgggattgtggtggtttccagcagcgagtcttgatcagacattgctttagttgcatctgttgtgggaataaatgagaatatgtatgcactgcagagaatggagtgttaaaacagtcaacaaatgttagctaatatgtacacaagattttactactctttagcagcaaaatggaggggaagaccttctaaggccctttggagagatgaaatggctcatttaaccctcacaagatcctcgaggtagggattcatgtgcatgtcgtatagataaggaatctgaggttcagtgaggcaaggtaagcttcctgagggcacacaacatggaagtggaggggacagggtgtgagctggggtccacctgggctccgaggtccgtgctccttgcctacactggactacttctagagatggacatattgaatttctcaggacttgactcctggccttggtttcctggactccccagtgtgtgaagcagagatgggatcgaggctgcaccaccaccatccccctctcccatccagagaaccagccgggccacctctcaggtccctcctgtttcttttctctgcaacccaagctgatgtggagggcattgaggctcctctggggggatgctgtggtaccaggtgggtctcacatccctggtctcccgcctcctgggcaagctccccactcagggctccacgtttccccaagaggaaccctgaggtggctggaataatggccacattgacggagtcacttgtccaactctgagggggcgctctcatcacccccactctacagatggggaaacaggctcgcagaggttcaggcacctgcccaaggtcacacagctgctggattcaaacccattctgactccagaagctggactgcagtccacggcaccactccacccaccagttcctcagtcaggtacttactgaagccaaattaaatttacccccctgaaaatgtgggtttggcagggatcaagcaggtcaggaacctgctttttaacaagtcttctatcccatacatctgtccaaggcactatttggggttatgtgctggccttcgagttcaccctcactgggccctgtgtccctgtgtccctgtgtccccaggcctgacccaagcctggccttgaggtagaggtcatgggtgctgggtggggtctgaatgacccctttatcacttggagtaaatgccaaactcctcacaaacccctgtgtgacgcagcctctcccagctcccgtcccgctccccctgctcactctgcttcagccacactgtgctttcgttcagtcccagcgctggcccagcccactcccaccgcaggggcctctcccttcctggcccagcacccacgctgagcttcctcaggtccctgatgctcagtttcacgtgtcggcctggctgggctccagtgcccagcaggcccatcgcagtgagtcccggtggtgctgagaagacactttatagatgtggatgtcacccatgtcagctgactttaagtaaacgattattatctgcaatgtgtgtgggcctcatctaatcagttgaaggccttaagagcaaaaccagtttcttggagagtaaaaaactctgcctcaggattacagtgccaactccggcctgagtttccagcctaccagcctaccttatggatttgggacttgccagctcccacagtagcatgacccggttatttaaattaaatctatttatatataaaagtatacatatgccatatgtataacaagaaatatgaggtatataaaaggatatgtataagatatatatagggtagggcatggtgacccacacctgtaatcccagcactttgggaggccaaggtgggaggattacttgagaccaggagtttgagaccagcctaggcaacatagcaagacctcatctttacaaaacgttagaaaaattagccaggtgtggtggcgtgtgcctgtggtcccagctactcaagagacggaggtgggaggattgcccgagtccaggaattagaggttgcagtgaggtatgatcatgccattgcactccagcctgggtgacaagggaagactctctcttaaaaaaaaaaaaa

SEQ ID NO: 203614 - DNA, 783 bp, Homo sapiens
  Payload ID: 20148
  Gene Name: zinc finger protein 71
  ENST ID: ENST00000599599
  CDS Start-End: 398-783
aggcgcactgccgtcgggcgggcctagcgggcgcggtcattgtcctggcagagcggcgagccggtgagtgtggctgcggggtcgcgcccaccctctacctgtgccgggggccggaacctggccccggggagggcgcggcctcggggagacggcgtgcaggcccagcactgttggtcaccgcaggcctgtcttcctattcaccgtgggcagcagagggatggctgctcagctgctgactgatgaggcactggaatcagtgacgttcagggatgtgactgtggacttcacccaggaggagtggcagcagctggagcctgcccagaaggacctgtacagggatgtcatgctggagaactacaggaacctggtctcactggactgggagactagacctgaaatgaaagagttggatccaaagaatgacatttcggaagacaagctctccgttgttggggaggccacggggggacccacgaggaatggtgccaggggtcctggctcagaaggagtgtgggaaccaggcagctggccagagaggccgcggggagatgcaggtgcagagtgggagccattgggaattccccaggggaacaaactcttagggggctcagtacccgcatgtcatgaactgaaggcatttgccaaccaaggctgtgtcctggtcccaccacggctggacgaccccacagaaaagggggcctgtccacccgtaaggcgtggcaagaacttctccagcacttcagacctcagtaagccccccatgccctgcgaggagaagaaaac

SEQ ID NO: 203615 - DNA, 4617 bp, Homo sapiens
  Payload ID: 20149
  Gene Name: zinc finger protein 710
  Uniprot ID: Q8N1W2
  ENST ID: ENST00000268154
  CDS Start-End: 252-2246
tccagggagggagagagcgcgagcgagagagcgagcgagaggaggggggagagagagaaagagaggagccggagggagggcggcaggagcaggcggcgggcgcgcgtggaggcgggcggcgggcgcacagcagcagcccgggcggtgggcagccaggagcccccggcccggcccggcccggcccgccgagggccccagcgcaggagccgcgcccggacccaggcgatgccctcctagctagccgtcacgggatggagggcttcatggactcagggacacagacggacgccgtggtggtgctgtccttggctcaggccgccgtgcttggcctggtctccgaaaatgagctctttggagctaccataagcgccgaggccttctacccggacctggggcccgagctttcaggggcagccatgggagagcccgagccaccaggccccgacgtctaccagctggcctgcaacgggagggccttggaggagccggcggaggaggaggtgctggaggtggaggcagcctgtgagaagcacacccggcggaagacgcggccacctgtgcggttggtgcccaaggtcaagttcgagaaggtggaggaggaggaacaggaggtctatgaggtttctgtgccaggtgacgacaaggacgcagggccagcagaagcccccgccgaggcggccagtggcggctgcgacgccctggtgcagagcagcgccgtcaagatgatcgacctcagcgccttcagccgcaagccccggacgctccggcatctgccccgaaccccgaggccggagctgaacgtggccccatatgaccctcacttcccggccccggcccgggatggcttccccgagcccagcatggcgctgcctgggccagaggccttgcccacagagtgtgggttcgagccaccccacctggcccccctgagtgaccccgaggcccccagcatggagtccccggagcctgtcaagccggaacagggcttcgtgtggcaggaggccagtgagttcgaggctgacacggcgggttcgaccgtggaacgccacaagaaggcccagctggatcggctggacatcaacgtgcagattgacgactcctatctggtggaggcgggcgaccgccagaagcgctggcagtgccgcatgtgcgagaagtcctacacgtccaagtacaacctggtgacgcacatcctgggccacaacggcatcaagccacactcgtgcccacactgcagcaagctcttcaagcagcccagccacctgcagacgcacctgctgacgcaccagggcacccggccccacaagtgccaggtatgccacaaggccttcacgcagaccagccacctcaagcgccacatgctgctgcactcggaggtcaagccctacagctgccacttctgcggccgcggcttcgcctaccccagcgagctcaaggcccacgaagtgaagcatgagagtggccgctgccatgtctgcgtcgagtgcggcctggacttctccaccctgacccagctcaagcgccacctggcctcccaccagggccccaccctctaccagtgcctcgagtgtgacaagtccttccactaccgcagccagttgcagaaccacatgctcaagcaccagaacgtgcgacccttcgtgtgcactgaatgcggcatggagttcagccagattcaccacctcaagcagcactccctcacccacaagggcgtgaaggagttcaagtgcgaggtgtgtggccgggagttcaccctacaggcgaacatgaagcggcacatgctgatccacaccagcgtccggccctaccagtgccacatctgcttcaagacctttgtacagaagcagactctcaagacccacatgattgtacactcgcccgtgaagccattcaaatgcaaggtgtgcgggaagtccttcaaccgcatgtacaacctgctgggccacatgcacctgcacgccggcagcaagcccttcaagtgcccctactgctccagcaagtttaatctcaagggcaacctgagccggcacatgaaggtcaagcatggcgtcatggacatcggcctggacagccaagaccccatgatggagctgacaggcactgacccttcagagctcgacggccagcaggagatggaggacttcgaggagaacgcctacagctatgcgagcgtggacagcagcgccgaggccagtgtcctcactgaacaggccatgaaagagatggcctactacaatgtgctatagcgcaagctgggccacccctaacgggggccgggggcgagggcatgggggtgagacccatgggctgcaggctgcacctcctgcagccgagaaacaagctactgccccactgttctgagccctccctccccgagtcatttgcaccactagggacctttagaccaaatggagactgtactactggccccggctgtgagccagcacaggcccaggcatcccagcaagggaaggagaacacgcgaggcccagatctgggtctccctggcctgcttccgtggggagtgggagaagtggggccactggggacaggtcacaagggcaccggccctcggggtctctccaggcccagcagagctcttcaggggtcctgacactggaagaagagaccacttgagccatgtctttttcacggccaactcctgcctctaaggatgtctgagctcccctctggccagtactgcccacctctaccttgtccaggcccccttccccgccctgtcgacggaccgccaggcagggcactctgccttctacctcccggggtctcccatgcgctcctcaagccaggtgtgcacgtggccctggccctggcctgcaggacagctggggggcacccagcccccagaagacccctgtcctacatccctttctggaagtgagtgtccctacagtggattgcaacacatgtcgtccacttcgaccctagctggagtgcctcaccagggggccccactaggaacaaagccaggacaggccccgcgtcaggcacacactaacaaaaccagaagcatggggcagggcagggcggagtgagggcatcacaggggaccaagaagggctgtccttgggggaggcccaggaccacctgtcggggagggggaccgcagtcatttctcattcctcagtgtccaccttgcgacggggatagccacgagtcagcagcttcccggaaagagcaacgtattttaaaaaggaaagtaaagcccacagagggaaatcaagggtttttttgagcaaagggggtcttctgaaggtaacttattatttttttctttccaactgtgtgtcacctatgaccttttctgatggagatgcattttctttttccaagcgtaagcttcctaatgtgctgtgcgtgcttcctacccacccaccccgagcagcctggccgggcaggactggggctccatggggactgtcaccctggccctggaggtgcagccgctggcagcagcctcagcaggctggggtgggaggcaggagaaggcagagctgggaagccctccacccctgcctggctcctgcagtcgctgacttgctctgtcccatgtcccatcctcggctgtcagggctgctgactctgctcagccaacagctagctccctcgctcgcctgctctcttcccctctgttcccacgccagctcctgcccctggaaccagagatgacaggcccagggcagtgaaatagcacattcaggaactctagggcacccggacccccccacccacttgcctcctgaggcctcagtggggaggggcaagcaggggtcttccccaaaggcacagatgaagccactagcttcagcctagaaacccggagaagggaacagcctgcggtgggaggaaccaatctgcagcgcagccacccccaaggctggatccttaagtgaaggaccaagccaggcctcagggtgactgtgatcaggactgaggggtggacaaggtggcccaagtatggcttccagaccccgaagccccacgacctcccaggtgcccgccatgatgaccctcaggtggcagtgaccccgtcactgtataagacattttctcctgctgagcagaaggcatcatcccctgcaactacctcttcccacgtctttctcccctggtaccaaaaagaaccctgtacctctcctcctcctcctccctcctgccagtgcagtggccttggtcttggaaactgaagggagaaggtctggcccccagggtggggctctcctttccctcccccagccccgccgtcagcactggccctctgtgaggttcgatacttgaacgccccctgccctgtgccttggacctgggcaaagctaggaggaggaaacagcacaactcacagtttgagctggggggtggtcttggcaaggctcctgtctgtacccctccctaaccttctcaaaagaggtgcacagcctctcgggtgacttggaaactcctggacaaattccattctaacttattttgacatgtatacaaaccaactgtttagagattccacttgtgcaaagccctactgtgtttttatgttcctgtttaaaagagaagtttacttagcaataattataaataaatgaatattctttagtgaggtga

SEQ ID NO: 203616 - DNA, 332 bp, Homo sapiens
  Payload ID: 20149
  Gene Name: zinc finger protein 710
  ENST ID: ENST00000559419
  CDS Start-End: 96-332
ttttcctaattggatggagctgtggggcgtgagcaccagcgtcagatcggggccctcaggctaccagcgatgccctcctagctagccgtcacgggatggagggcttcatggactcagggacacagacggacgccgtggtggtgctgtccttggctcaggccgccgtgcttggcctggtctccgaaaatgagctctttggagctaccataagcgccgaggccttctacccggacctggggcccgagctttcaggggcagccatgggagagcccgagccaccaggccccgacgtctaccagctggcctgcaacgggagggccttggaggagccg

SEQ ID NO: 203617 - DNA, 513 bp, Homo sapiens
  Payload ID: 20149
  Gene Name: zinc finger protein 710
  ENST ID: ENST00000559360
  CDS Start-End: 1-482
accccagcgagctcaaggcccacgaagtgaagcatgagagtggccgctgccatgtctgcgtcgagtgcggcctggacttctccaccctgacccagctcaagcgccacctggcctcccaccagggccccaccctctaccagtgcctcgagtgtgacaagtccttccactaccgcagccagttgcagaaccacatgctcaagcaccagaacgtgcgacccttcgtgtgcactgaatgcggcatggagttcagccagattcaccacctcaagcagcactccctcacccacaagggcgtgaaggagttcaagtgcgaggtgtgtggccgggagttcaccctacaggcgaacatgaagcggctggccaaggctgagacttcgttggggtgggctcaggtctggaaggggggtaccctggaaggccatgatgacaataacgatgggatatttatgtcttcttcaaaggacttaaatgagatcacgtaaacaatataataaaaatcataactaacattta

SEQ ID NO: 203618 - DNA, 1191 bp, Homo sapiens
  Payload ID: 20149
  Gene Name: zinc finger protein 710
  ENST ID: ENST00000558883
  CDS Start-End: 1-1164
aagcgctggcagtgccgcatgtgcgagaagtcctacacgtccaagtacaacctggtgacgcacatcctgggccacaacggcatcaagccacactcgtgcccacactgcagcaagctcttcaagcagcccagccacctgcagacgcacctgctgacgcaccagggcacccggccccacaagtgccaggtatgccacaaggccttcacgcagaccagccacctcaagcgccacatgctgctgcactcggaggtcaagccctacagctgccacttctgcggccgcggcttcgcctaccccagcgagctcaaggcccacgaagtgaagcatgagagtggccgctgccatgtctgcgtcgagtgcggcctggacttctccaccctgacccagctcaagcgccacctggcctcccaccagggccccaccctctaccagtgcctcgagtgtgacaagtccttccactaccgcagccagttgcagaaccacatgctcaagcaccagaacgtgcgacccttcgtgtgcactgaatgcggcatggagttcagccagattcaccacctcaagcagcactccctcacccacaagggcgtgaaggagttcaagtgcgaggtgtgtggccgggagttcaccctacaggcgaacatgaagcggcacatgctgatccacaccagcgtccggccctaccagtgccacatctgcttcaagacctttgtacagaagcagactctcaagacccacatgattgtacactcgcccgtgaagccattcaaatgcaaggtgtgcgggaagtccttcaaccgcatgtacaacctgctgggccacatgcacctgcacgccggcagcaagcccttcaagtgcccctactgctccagcaagtttaatctcaagggcaacctgagccggcacatgaaggtcaagcatggcgtcatggacatcggcctggacagccaaggtgggtgggccaagcgcaatggacagagcaggaatgataccaacatgacgcactcaggagcctcctgcccagttagaggagtggggaggctggccaaggctgagacttcgttggggtgggctcaggtctggaaggggggtaccctggaaggccatgatgacaataacgatgggatatttatgtcttcttcaaaggacttaaatgagatcacgtaaacaatataataaaaatcataactaaca

SEQ ID NO: 203619 - DNA, 2887 bp, Homo sapiens
  Payload ID: 20150
  Gene Name: zinc finger protein 711
  Uniprot ID: Q9Y462
  ENST ID: ENST00000276123
  CDS Start-End: 509-2794
gccatccagagcgcggtcacagtccgactggcggcacggaggcggcggcggcggcggcggcggcagcggcggcggcagcggcggcggcagctgtagctgcagcagcaggtaaagagagcgttttcccaaagaaaataacatagcacagaaggaaaaataaaaagaaattgctgcagattttactttatgtgagaaaatctacaatttcttcgagacactcatataaaggaagcagtcatgtttcatgagtcctcaaaactgagacaagagaatgtagtagagtgaggccagaagtccttactggttcaaagaactccggggaaactgggatagaacattttacattataagtagaaccctgggagccagaggtgaatacaagtttatctgcagagctccgctgcagggctgatctgggtctggaagaaatggatgagagccagtggatgaaattcactaatactagacatctgagtcctctaatattggtgaatgaactttgctaagtatggattcaggcggtggaagtcttggattgcacacgccagactctagaatggcccataccatgattatgcaagattttgtggctggaatggctggtactgcacatatcgatggagaccatattgttgtttcagttcctgaagctgttttagtttctgatgttgtcacagatgatgggataactcttgatcatggccttgcagctgaagttgtccatggacctgatatcatcacagagactgatgtagtaacagaaggtgtgattgttcctgaagcggtacttgaagctgatgttgccattgaagaggatttagaggaagatgatggtgatcacatcttgacttctgaactaattacagaaaccgttagggtaccagagcaggttttcgtggctgaccttgttactggtcctaatggacacttagaacatgtggtccaagattgtgtttcaggagtcgactctcccacaatggtatcagaggaggttcttgtaactaattcagatacagaaactgtgattcaagcagctggaggtgttcctggttctacagttactataaaaaccgaagatgatgatgatgatgatgtcaagagcacttctgaagactacttaatgatatctttggatgatgttggagaaaaattagagcatatggggaatacaccattaaaaattggcagtgatggttcacaagaagatgctaaagaagatgggtttggttctgaagttataaaagtgtatatatttaaagcggaggctgaagatgatgttgaaataggtggaacagaaattgtcacagagagtgagtacaccagtggacattcagtagctggagtgcttgaccagagccgaatgcagcgggagaagatggtttacatggcagttaaagattcttctcaagaagaagatgatatcagagatgaaagaagagtttcccgaaggtatgaagattgtcaagcatcaggaaatactttggactcagcattagaaagcagaagtagtacagcagcacagtaccttcaaatttgtgacggcattaatacaaataaagtacttaaacaaaaagccaaaaagaggagaaggggagaaaccaggcagtggcaaacagctgttataataggtcctgatggacagcccctcacagtgtacccttgccatatttgcacaaaaaagtttaaatccaggggattcttaaaaagacacatgaagaatcatcctgatcatttaatgagaaaaaaatatcagtgtacagattgtgactttacaactaacaagaaagtgagtttccataaccacttagaaagccataagctcataaacaaagtcgacaaaacccatgaatttacagaatacacacgaagatacagagaggctagtccactgagttccaataaacttattttaagagacaaggagccgaagatgcacaagtgcaaatactgtgactatgaaactgcagaacaaggactgttaaacaggcatttgttggccgttcacagcaagaattttcctcatgtttgtgttgagtgtgggaagggttttcgacatccttctgaactcaagaaacatatgagaacccatactggtgagaagccatatcagtgtcagtattgtattttcaggtgtgcagatcaatcaaatctgaaaactcacattaagtctaaacatggtaacaatttgccatataaatgtgagcattgtccccaagcatttggtgatgagagggagcttcaacgccatctggatttgtttcaaggacataagacacaccagtgtcctcattgtgaccataagagcaccaattcaagtgaccttaagcggcacatcatatctgtccatactaaggattttcctcacaaatgtgaggtctgtgataaaggttttcatcgtccttctgagctcaaaaagcatagtgatatccataagggtaggaagattcatcagtgcaggcactgtgactttaaaacatccgatccatttattcttagtggccatatcctttcagttcatactaaagatcagccattgaaatgtaaaaggtgcaagagaggattcagacaacaaaatgagctaaaaaaacatatgaagacccatactggaaggaagatttaccaatgtgagtattgtgaatacagcactacagatgcatctggctttaaacgacatgtgatatcaatacatacaaaagactatccacacaggtgtgaattctgcaagaagggattccgaagaccatcagaaaaaaatcagcatattatgaggcaccacaaagaggctcttatgtaataagatcaatataaagaaagaagctatttaggagatatgatatgctacttgggagaaaactctcactaactgtctcaccgggtttcaaagctt

SEQ ID NO: 203620 - DNA, 4844 bp, Homo sapiens
  Payload ID: 20150
  Gene Name: zinc finger protein 711
  Uniprot ID: Q9Y462
  ENST ID: ENST00000360700
  CDS Start-End: 887-3310
acactaaaacaccaccattttggttcccaaccgtctcccacgtagcggggcagaggaagctggaggaggctgaggggctgggcagcacggcgtgggtagcagcggtggcgaccgctgcaccaagtaaagagagcgttttcccaaagaaaataacatagcacagaaggaaaaataaaaagaaattgctgcagattttactttatgtgagaaaatctacaatttcttcgagacactcatataaaggaagcagtcatgtttcatgagtcctcaaaactgagacaagagaatgtagtagagtgaggccagaagtccttactggttcaaagaactccggggaaactgggatagaacattttacattataagtagaaccctgggagccagaggtgaatacaagtttatctgcagagctccgctgcagggctgatctgggtctggaagaaatggatgagagccagtggatgaaattcactaatactagacatctgagtcctctagtaatgtataaatatcctaactattgtttgttgtcatctcgttcttcttttataacctatgttttaactggaacttttagcactgcagttttgttgttttgctttcttctaccacttccctatggctcatcagcttgactgtgcctttgtctccattatttttggtttacttccacttggcacttcttttatttatggttgtcacataaagcatctaaccatggtttttctttgttttgctttcttttgtaataagctttccacacttggttgaaaggcatattgtcaattgcatttttttctcaaaacaactaactttggactaaatatattaaactattttaaaagccatttcttttgcagatattggtgaatgaactttgctaagtatggattcaggcggtggaagtcttggattgcacacgccagactctagaatggcccataccatgattatgcaagattttgtggctggaatggctggtactgcacatatcgatggagaccatattgttgtttcagttcctgaagctgttttagtttctgatgttgtcacagatgatgggataactcttgatcatggccttgcagctgaagttgtccatggacctgatatcatcacagagactgatgtagtaacagaaggtgtgattgttcctgaagcggtacttgaagctgatgttgccattgaagaggatttagaggaagatgatggtgatcacatcttgacttctgaactaattacagaaaccgttagggtaccagagcaggttttcgtggctgaccttgttactggtcctaatggacacttagaacatgtggtccaagattgtgtttcaggagtcgactctcccacaatggtatcagaggaggttcttgtaactaattcagatacagaaactgtgattcaagcagctggaggtgttcctggttctacagttactataaaaaccgaagatgatgatgatgatgatgtcaagagcacttctgaagactacttaatgatatctttggatgatgttggagaaaaattagagcatatggggaatacaccattaaaaattggcagtgatggttcacaagaagatgctaaagaagatgggtttggttctgaagttataaaagtgtatatatttaaagcggaggctgaagatgatgttgaaataggtggaacagaaattgtcacagagagtgagtacaccagtggacattcagtagctggagtgcttgaccagagccgaatgcagcgggagaagatggtttacatggcagttaaagattcttctcaagaagaagatgatatcagttgcgctgaaatagcagatgaagtttacatggaagtcattgtaggggaagaggaaggaacttctctccctgagattcagcttgaggactctgatgttaataaaacagttgtccctgttgtctgggctgcggcatatggagatgaaagaagagtttcccgaaggtatgaagattgtcaagcatcaggaaatactttggactcagcattagaaagcagaagtagtacagcagcacagtaccttcaaatttgtgacggcattaatacaaataaagtacttaaacaaaaagccaaaaagaggagaaggggagaaaccaggcagtggcaaacagctgttataataggtcctgatggacagcccctcacagtgtacccttgccatatttgcacaaaaaagtttaaatccaggggattcttaaaaagacacatgaagaatcatcctgatcatttaatgagaaaaaaatatcagtgtacagattgtgactttacaactaacaagaaagtgagtttccataaccacttagaaagccataagctcataaacaaagtcgacaaaacccatgaatttacagaatacacacgaagatacagagaggctagtccactgagttccaataaacttattttaagagacaaggagccgaagatgcacaagtgcaaatactgtgactatgaaactgcagaacaaggactgttaaacaggcatttgttggccgttcacagcaagaattttcctcatgtttgtgttgagtgtgggaagggttttcgacatccttctgaactcaagaaacatatgagaacccatactggtgagaagccatatcagtgtcagtattgtattttcaggtgtgcagatcaatcaaatctgaaaactcacattaagtctaaacatggtaacaatttgccatataaatgtgagcattgtccccaagcatttggtgatgagagggagcttcaacgccatctggatttgtttcaaggacataagacacaccagtgtcctcattgtgaccataagagcaccaattcaagtgaccttaagcggcacatcatatctgtccatactaaggattttcctcacaaatgtgaggtctgtgataaaggttttcatcgtccttctgagctcaaaaagcatagtgatatccataagggtaggaagattcatcagtgcaggcactgtgactttaaaacatccgatccatttattcttagtggccatatcctttcagttcatactaaagatcagccattgaaatgtaaaaggtgcaagagaggattcagacaacaaaatgagctaaaaaaacatatgaagacccatactggaaggaagatttaccaatgtgagtattgtgaatacagcactacagatgcatctggctttaaacgacatgtgatatcaatacatacaaaagactatccacacaggtgtgaattctgcaagaagggattccgaagaccatcagaaaaaaatcagcatattatgaggcaccacaaagaggctcttatgtaataagatcaatataaagaaagaagctatttaggagatatgatatgctacttgggagaaaactctcactaactgtctcaccgggtttcaaagcttgatactaaaccatgactttacattctttgtattaaagatcttaaaatatttgaattcacaggggatcccatagccctttgaaaattacttaaagaatttaagaagcactatagaatggttacagaaaaacttcttaagtatctgtgtaatagtattatatgcatacttaaactacagaggggaaaagcaaagacaaatactttatttggctgattatgttagatacaaatgtttctgagaagagaatacataattgagtttagtgatgctttgctatagcaagcaaacccacttttatgcaattttagaaatggggcagggaaacaaaatgtggtcattcatcagtcacttagtcattgagccttttatattgtacctggaaattaaattccagcaatgacaaaagttttgtgtattcattaaaagaaaactaactggaaaacaggttagattaattcagtactattaaaaaagaattcagagctgttaatattttatcacaggataggatacttaaaatatagcattctgtgctgagatctaaggtgaagtctataaagattaaagttcccttttttctgatgttcaagttgattgttgttcagtatggcatatatgacaaaagtatatttgagtcaaatgtggctttctaaaatggatgcaacattagcgttgcaaacaaaatcagcactatatttcttaatgatctaaagattaatttgagagaacacagttttcttaaatattataatgtctagagtttttttaggacagtcttagcaagtatgattgttctagtcttacttgctctaatgtttaaaggtgcaattttatgccattattgaaattgatttttaaaatctatataccatatgattaacatgcattttcaatatgaggcagtgtttatgcagtatttaacagagcaatctgctgccaatagagtttggaggtggatatttagtttacagtgtataaacttaaaatatgcatccctttaacaacgctttgtgttagcatgctgcaaatcaaaatggcacttaatattaaaagctggtttagggaaattttatgaaaatcctgttcataaatgtaatgcatatgatatgtacttttaagttttagttgcttcatgtttacattcagctgttcaacataattaaaatgtaattttacttcatgctatattgtggctttgtgtttcaaataatgttcacctttctgtttttgcaccagataagaatcagttccttgagaataaattttttatctttcttaacttcagaatattaaatttggaatatctactaaaattgtgtgttatgtggctgtaaatgatgtacacgctgtaaaataagatcgctactgttatgtgggattattatttctaaatgttactcattgaaatgagcatacaataaaaagcatttattgcacttaa

SEQ ID NO: 203621 - DNA, 4124 bp, Homo sapiens
  Payload ID: 20150
  Gene Name: zinc finger protein 711
  Uniprot ID: Q9Y462
  ENST ID: ENST00000373165
  CDS Start-End: 307-2592
cggaaacccgaatgtgaggaccttaagggatccacagctgccgccccccgcagccatccagagcgcggtcacagtccgactggcggcacggaggcggcggcggcggcggcggcggcagcggcggcggcagcggcggcggcagctgtagctgcagcagcaggtaaagagagcgttttcccaaagaaaataacatagcacagaaggaaaaataaaaagaaattgctgcagattttactttatgtgagaaaatctacaatttcttcgagacactcatataaagatattggtgaatgaactttgctaagtatggattcaggcggtggaagtcttggattgcacacgccagactctagaatggcccataccatgattatgcaagattttgtggctggaatggctggtactgcacatatcgatggagaccatattgttgtttcagttcctgaagctgttttagtttctgatgttgtcacagatgatgggataactcttgatcatggccttgcagctgaagttgtccatggacctgatatcatcacagagactgatgtagtaacagaaggtgtgattgttcctgaagcggtacttgaagctgatgttgccattgaagaggatttagaggaagatgatggtgatcacatcttgacttctgaactaattacagaaaccgttagggtaccagagcaggttttcgtggctgaccttgttactggtcctaatggacacttagaacatgtggtccaagattgtgtttcaggagtcgactctcccacaatggtatcagaggaggttcttgtaactaattcagatacagaaactgtgattcaagcagctggaggtgttcctggttctacagttactataaaaaccgaagatgatgatgatgatgatgtcaagagcacttctgaagactacttaatgatatctttggatgatgttggagaaaaattagagcatatggggaatacaccattaaaaattggcagtgatggttcacaagaagatgctaaagaagatgggtttggttctgaagttataaaagtgtatatatttaaagcggaggctgaagatgatgttgaaataggtggaacagaaattgtcacagagagtgagtacaccagtggacattcagtagctggagtgcttgaccagagccgaatgcagcgggagaagatggtttacatggcagttaaagattcttctcaagaagaagatgatatcagagatgaaagaagagtttcccgaaggtatgaagattgtcaagcatcaggaaatactttggactcagcattagaaagcagaagtagtacagcagcacagtaccttcaaatttgtgacggcattaatacaaataaagtacttaaacaaaaagccaaaaagaggagaaggggagaaaccaggcagtggcaaacagctgttataataggtcctgatggacagcccctcacagtgtacccttgccatatttgcacaaaaaagtttaaatccaggggattcttaaaaagacacatgaagaatcatcctgatcatttaatgagaaaaaaatatcagtgtacagattgtgactttacaactaacaagaaagtgagtttccataaccacttagaaagccataagctcataaacaaagtcgacaaaacccatgaatttacagaatacacacgaagatacagagaggctagtccactgagttccaataaacttattttaagagacaaggagccgaagatgcacaagtgcaaatactgtgactatgaaactgcagaacaaggactgttaaacaggcatttgttggccgttcacagcaagaattttcctcatgtttgtgttgagtgtgggaagggttttcgacatccttctgaactcaagaaacatatgagaacccatactggtgagaagccatatcagtgtcagtattgtattttcaggtgtgcagatcaatcaaatctgaaaactcacattaagtctaaacatggtaacaatttgccatataaatgtgagcattgtccccaagcatttggtgatgagagggagcttcaacgccatctggatttgtttcaaggacataagacacaccagtgtcctcattgtgaccataagagcaccaattcaagtgaccttaagcggcacatcatatctgtccatactaaggattttcctcacaaatgtgaggtctgtgataaaggttttcatcgtccttctgagctcaaaaagcatagtgatatccataagggtaggaagattcatcagtgcaggcactgtgactttaaaacatccgatccatttattcttagtggccatatcctttcagttcatactaaagatcagccattgaaatgtaaaaggtgcaagagaggattcagacaacaaaatgagctaaaaaaacatatgaagacccatactggaaggaagatttaccaatgtgagtattgtgaatacagcactacagatgcatctggctttaaacgacatgtgatatcaatacatacaaaagactatccacacaggtgtgaattctgcaagaagggattccgaagaccatcagaaaaaaatcagcatattatgaggcaccacaaagaggctcttatgtaataagatcaatataaagaaagaagctatttaggagatatgatatgctacttgggagaaaactctcactaactgtctcaccgggtttcaaagcttgatactaaaccatgactttacattctttgtattaaagatcttaaaatatttgaattcacaggggatcccatagccctttgaaaattacttaaagaatttaagaagcactatagaatggttacagaaaaacttcttaagtatctgtgtaatagtattatatgcatacttaaactacagaggggaaaagcaaagacaaatactttatttggctgattatgttagatacaaatgtttctgagaagagaatacataattgagtttagtgatgctttgctatagcaagcaaacccacttttatgcaattttagaaatggggcagggaaacaaaatgtggtcattcatcagtcacttagtcattgagccttttatattgtacctggaaattaaattccagcaatgacaaaagttttgtgtattcattaaaagaaaactaactggaaaacaggttagattaattcagtactattaaaaaagaattcagagctgttaatattttatcacaggataggatacttaaaatatagcattctgtgctgagatctaaggtgaagtctataaagattaaagttcccttttttctgatgttcaagttgattgttgttcagtatggcatatatgacaaaagtatatttgagtcaaatgtggctttctaaaatggatgcaacattagcgttgcaaacaaaatcagcactatatttcttaatgatctaaagattaatttgagagaacacagttttcttaaatattataatgtctagagtttttttaggacagtcttagcaagtatgattgttctagtcttacttgctctaatgtttaaaggtgcaattttatgccattattgaaattgatttttaaaatctatataccatatgattaacatgcattttcaatatgaggcagtgtttatgcagtatttaacagagcaatctgctgccaatagagtttggaggtggatatttagtttacagtgtataaacttaaaatatgcatccctttaacaacgctttgtgttagcatgctgcaaatcaaaatggcacttaatattaaaagctggtttagggaaattttatgaaaatcctgttcataaatgtaatgcatatgatatgtacttttaagttttagttgcttcatgtttacattcagctgttcaacataattaaaatgtaattttacttcatgctatattgtggctttgtgtttcaaataatgttcacctttctgtttttgcaccagataagaatcagttccttgagaataaattttttatctttcttaacttcagaatattaaatttggaatatctactaaaattgtgtgttatgtggctgtaaatgatgtacacgctgtaaaataagatcgctactgttatgtgggattattatttctaaatgttactcattgaaatgagcatacaataaaaagcatttattgcactt

SEQ ID NO: 203622 - DNA, 4339 bp, Homo sapiens
  Payload ID: 20151
  Gene Name: zinc finger protein 713
  ENST ID: ENST00000429591
  CDS Start-End: 789-2120
gcggggaggctgtcctcagagcaggtctggcgcgccggtggctggaccggccccaggagcccagtcaccgggcgtcattggctcaggctgcggggccctcggcaccttctccctcccgggtccaccgcggcggcggcggcggcggcggcggcggcggcggcggcgtcagggggcggagcctgccgaagcgccctttgtctgcggaggtcaacatacctggcctaaggaggcaggattgagtgactctcactcaccactggtgttgctctttgaaagtggcgcttggcaccagcatgaactccccatcctcagcaatcccatcaggtgttttgggtcttcaacctaaaattctatcttacaagatccttgccaggatgcagatttgaatactatagtgaagtctgtacatgaagaaatgatgcttttagggaggaaaaaaaaaggtaataacaaccttcaagagccccttcatctcaactcggcataaacaaggcaagattctgagagtggccgcccctggaagcagaaattattcttgtggctatccattggctcctgaggctctaatcagagatggggcacctttagtaccaggggagtgactgttgcccataaggtactggacatcaactttcaagagcagccccagctccttaagctgctggtcctggtgcatctgctgactttcatgtagaagatagcagagctttggcgacattacaacataagaactgcagagaggtgtaatcccagtggaagactgaatcgagagactcaaaaaggaagttatgccttctcagaatgctgttttttctcaggaggggaacatggaggaggaagaaatgaatgatggctcacagatggtgagatctcaggaatcactgacgtttcaggatgtggccgtggacttcaccagagaggagtgggaccagctgtaccctgcccaaaagaacctctatcgagacgtgatgctggagaactacaggaatctagttgcactggggtatcagctttgtaagccagaggtaatcgcgcagttggagctagaggaagaatgggtgatagaaagagacagcctgctggatactcatccagatggagaaaacagacccgaaatcaaaaagtcaaccacaagccagaatatttctgatgaaaatcaaacccatgagatgataatggagagactcgcaggagacagcttctggtactccatcctaggaggactctgggattttgattaccatccagagtttaaccaagaaaaccacaagagatatttaggacaagtaactttgacccacaaaaagatcacacaggagagaagccttgagtgtaataaatttgcagaaaactgtaatctgaactcaaaccttatgcagcagagaattccttccattaaaatacccctgaattctgacacacagggaaacagcatcaaacataattcagacttgatttactatcagggaaattatgtaagagagactccctatgaatatagtgagtgtggaaaaatcttcaatcaacatattcttcttactgatcatattcatactgcagagaaacccagtgagtgtgggaaggccttcagccacacctcatctcttagccagcctcagatgttgcttacaggagagaagccctataagtgtgatgaatgtggaaaaagattcagccagaggatacatctcattcaacatcagagaattcacacaggagaaaagccttttatatgcaatggatgtgggaaagccttccgtcagcattcatcctttactcaacatctgaggattcatactggagaaaagccctataaatgtaatcaatgtggtaaagcttttagccgcatcacatcccttactgaacatcatagacttcataccggagagaaaccttacgaatgtggtttctgtggcaaagccttcagtcagaggacacatctgaatcaacatgaaagaactcatacaggagagaaaccctataaatgtaatgaatgcgggaaagcctttagccagagtgcacaccttaatcaacacaggaaaatccatactcgggagaaattatgtgaatataaatgtgagcaaactgttcgccacagtccttcatttagcagcacataacttatggtgggggaaatcagataaatatataaatgtaggagattttttggtcagacctttttatcccattcaatatcaaattattcatagtggagagaaagcttatacataaatttttgttttgttttgtttttgagactgagtctcactctgtcacccaggctgaagtgcagtggtacaatcttggctcactgcaacctctgccacctgggttcaagcgattctcctgcctcagcctcctgagtagctgggaccacaggtatgcaccaccacgcccagctaattttttgtatttttagtagagacggggtttcaccatgttggccaggctggtctcgaactcctaacctcaggtgatccgcccacctcggcctcccaaagtgctgggattacaggcgtgggccactgcgcctggccataaactttcaatgcgtagaaaccaaattaatttagaccttaaactagcagcatattacattcccaggaggggttataaaaagaaaaaataatttattttacaaatgagattatatttggagtcatgttccaaatctgatataaaactttttaaaaaatcagaagtccttatccaggcatggtggtgcacacctgcaatcccagctactctggagactgaggcatgagaatgacttgaacatgggaggtggaggttgctgtgagctgagatcatgccactgtactccagcctgggcaacagagcaagactctgtctcaaaaaaaaaaaagaaagaaagcctataggcaacaacttgtaattactcacctgtaagttttatggtataaaacttttttttttttttttttttgaggcagagtctcgctctgccacccaggctggagtgcaatggcgcgatctcggctcacagcaacctccacctcctgggttccagcgattcttctgcttcagcctcccgagtagctgggactacaggtgcgtaccaccacgcctggctaactttttttttgtattttttagtagagacacggtttcaccatattgactaggctggtctcgaactcctgaccttgtgatctgcccgcctcggcctcccaaagtgctgggattataggcgtgagcaactgcacctggcaggttatggtataaaacttttaaatcagaaattttgattaattaaagacaatgctggctgggggcggtggttcacgcctataatcccagcactttgggaggccgaggtggggtgatcatctgaggccaggagtttgagaccagcctggccaacatggtaaaaccccatctctactaaaaatacaaaaattagctgggtatggtggtgcacgcctgtagtctcagcagcttgggaggctgaggcagaagaattgcttgaacccggtaggtggaggttgcagtgagccaagatcacgccactgtactccagcctgggcaacagagtgagactgtctcaaaaaaaaaaaaaagtaaaatttaaaaataaaggcgatgctgtagtgcagccagtcacattaacttgaaataaacataaaagaggaatatttcacgaacgtcagttatttgtatgctttctttacagtttttaccatatctagtatttacttaatattctttataaagggatgcaagatttttagccttctcctaggaaatactatttagcatataaaataagttatatgctagttttatatgctaattaaatttattctactcttcatcaaaatagatacataaccttgaaattaaaaatattcgttgatgtccccccaaaaatcttgtgtgccgttgtttgagaaacagtgtgatagtttgtggcaatatcctgtgatgattctttttgcaatcttgacattattttcatcaaatgaatcctaggatcactttgagaagagccttgaagaagacttgagggtcctattgatgaactttgaaatattgattcagagaagtctgcttttctattttgttttagctttaaatttccctgtggcaagtctagattttttttcagttaaaattatttctgctgtatttgtagaacagaagttttgggattttgtaaaataatgaccagagactaagaattcccatgccaccccgtatcactgtggaagatggagaagtgaggaactgtacctgcgggtgagccctggtgccatgttgagggtgggaatcaggagagctgcagtggcttatataaacacctgacgaagtagtctaa

SEQ ID NO: 203623 - DNA, 1286 bp, Homo sapiens
  Payload ID: 20151
  Gene Name: zinc finger protein 713
  ENST ID: ENST00000411863
  CDS Start-End: 752-907
gtggctggaccggccccaggagcccagtcaccgggcgtcattggctcaggctgcggggccctcggcaccttctccctcccgggtccaccgcggcggcggcggcggcggcggcggcggcggcggcggcgtcagggggcggagcctgccgaagcgccctttgtctgcggaggtcaacatacctggcctaaggaggcaggattgagtgactctcactcaccactggtgttgctctttgaaagtggcgcttggcaccagcatgaactccccatcctcagcaatcccatcaggtgttttgggtcttcaacctaaaattctatcttacaagatccttgccaggatgcagatttgaatactatagtgaagtctgtacatgaagaaatgatgcttttagggaggaaaaaaaaaggtaataacaaccttcaagagccccttcatctcaactcggcataaacaaggcaagattctgagagtggccgcccctggaagcagaaattattcttgtggctatccattggctcctgaggctctaatcagagatggggcacctttagtaccaggggagtgactgttgcccataaggtactggacatcaactttcaagagcagccccagctccttaagctgctggtcctggtgcatctgctgactttcatgtagaagatagcagagctttggcgacattacaacataagaactgcagagaggtgtaatcccagtggaagactgaatcgagagactcaaaaaggaagttatgccttctcagaatgctgttttttctcaggaggggaacatggaggaggaagaaatgaatgatggctcacagatggtgagatctcagatgtggagatctgtgtgctctccattggatctcggcaaggctgtgactggaggatgcaaagctttgtgactttcaaggcagatcataaatggcagtaagacttctacctcattctgttgggatgcttactctaaacccgaccaccttgtcaggaggaaacccagacagcccatggagaagcccatatggagaggagccaaggcccacagccctagccgagctcccagctgaaagccagtaccaatttgccagccttgaatcactgacgtttcaggatgtggccgtggacttcaccagagaggagtgggaccagctgtaccctgcccaaaagaacctctatcgagacgtgatgctggagaactacaggaatctagttgcactgggtgaggatggcatccctgtgaaaccggaagccgttcacgtgggtttatttcctgaactagtagaa

SEQ ID NO: 203624 - DNA, 2065 bp, Homo sapiens
  Payload ID: 20151
  Gene Name: zinc finger protein 713
  Uniprot ID: Q8N859
  ENST ID: ENST00000633730
  CDS Start-End: 39-1331
tgccttctcagaatgctgttttttctcaggaggggaacatggaggaggaagaaatgaatgatggctcacagatggtgagatctcaggaatcactgacgtttcaggatgtggccgtggacttcaccagagaggagtgggaccagctgtaccctgcccaaaagaacctctatcgagacgtgatgctggagaactacaggaatctagttgcactggggtatcagctttgtaagccagaggtaatcgcgcagttggagctagaggaagaatgggtgatagaaagagacagcctgctggatactcatccagatggagaaaacagacccgaaatcaaaaagtcaaccacaagccagaatatttctgatgaaaatcaaacccatgagatgataatggagagactcgcaggagacagcttctggtactccatcctaggaggactctgggattttgattaccatccagagtttaaccaagaaaaccacaagagatatttaggacaagtaactttgacccacaaaaagatcacacaggagagaagccttgagtgtaataaatttgcagaaaactgtaatctgaactcaaaccttatgcagcagagaattccttccattaaaatacccctgaattctgacacacagggaaacagcatcaaacataattcagacttgatttactatcagggaaattatgtaagagagactccctatgaatatagtgagtgtggaaaaatcttcaatcaacatattcttcttactgatcatattcatactgcagagaaacccagtgagtgtgggaaggccttcagccacacctcatctcttagccagcctcagatgttgcttacaggagagaagccctataagtgtgatgaatgtggaaaaagattcagccagaggatacatctcattcaacatcagagaattcacacaggagaaaagccttttatatgcaatggatgtgggaaagccttccgtcagcattcatcctttactcaacatctgaggattcatactggagaaaagccctataaatgtaatcaatgtggtaaagcttttagccgcatcacatcccttactgaacatcatagacttcataccggagagaaaccttacgaatgtggtttctgtggcaaagccttcagtcagaggacacatctgaatcaacatgaaagaactcatacaggagagaaaccctataaatgtaatgaatgcgggaaagcctttagccagagtgcacaccttaatcaacacaggaaaatccatactcgggagaaattatgtgaatataaatgtgagcaaactgttcgccacagtccttcatttagcagcacataacttatggtgggggaaatcagataaatatataaatgtaggagattttttggtcagacctttttatcccattcaatatcaaattattcatagtggagagaaagcttatacataaatttttgttttgttttgtttttgagactgagtctcactctgtcacccaggctgaagtgcagtggtacaatcttggctcactgcaacctctgccacctgggttcaagcgattctcctgcctcagcctcctgagtagctgggaccacaggtatgcaccaccacgcccagctaattttttgtatttttagtagagacggggtttcaccatgttggccaggctggtctcgaactcctaacctcaggtgatccgcccacctcggcctcccaaagtgctgggattacaggcgtgggccactgcgcctggccataaactttcaatgcgtagaaaccaaattaatttagaccttaaactagcagcatattacattcccaggaggggttataaaaagaaaaaataatttattttacaaatgagattatatttggagtcatgttccaaatctgatataaaactttttaaaaaatcagaagtccttatccaggcatggtggtgcacacctgcaatcccagctactctggagactgaggcatgagaatgacttgaacatgggaggtggaggttgctgtgagctgagatcatgccactgtactccagcctgggcaacagagcaagactctgtctc

SEQ ID NO: 203625 - DNA, 2562 bp, Homo sapiens
  Payload ID: 20152
  Gene Name: zinc finger protein 714
  ENST ID: ENST00000425625
  CDS Start-End: 323-577
gtctctcgctgcagctggagctgcaggtctcgccttcactgccctgtgtcctctgctcgcagaggcccagcctctgtggccctgtgacctgcaggtattgagagatccacagctaagacgccaggtaccccggaagcctagaaatgggcgacctgaggtctggagtgtatcctctcaagggagcaagtggatccctggggcagagaggaagcttctagtgtactcttactttgaaaaggagacgttgacatttagggatgtggccatagaattctctctggaggagtgggaatgcctgaaccctgctcagcagaatttatatatgaatgtgatgttagagaactacaaaaacctggtcttcttgggtattgctgtctctaagcaagacccgatcaccagtctagagcaagaaaaagagccctggaatatgaagatatgtgagatggtggatgaatccccaggatacatgtgcaggatgtgcagctatgtgttcttcttttaccagagacctttggccagagcaagacataaaagattcttttcaacaagtgatactgagaagacatggcaaatgtgaacatgagaatttacagttaagaaaaggctccgcaaatgtggttgagtgtaaggtgtacaaaaaaggttataatgaactaaaccagtgtttgacaactacccagagcaaaatatttccatgtgataaatatataaaagtctttcataaaattttcaattcaaatagacacaagacaagacatactggagagaaacctttcaaatgtaaaaaatgtgatgaatcattttgcatgcttttacacctacatcaacataaaagaattcatattagagagaattcttaccaatgtgaagaatgtgacaaagtgtttaagcggttctcaacccttactagacacaagagagttcatactggagagaaacccttcaaatgtgaagaatgtggcaaagcttttaagcactcctcaacccttactacacataagatgattcatactggagagaaaccctacagatgtgaagaatgtggcaaagccttctaccattcttcacaccttactacacataaggtaattcatactggagagaagcccttcaaatgtgaagaatgtggtaaagcttttaaccacccttcagcccttactacacataagttcattcatgttaaagaaaaaccctacaaatgtgaagaatgtgacaaagcttttaaccgattctcataccttactaaacataagataattcattctggagagaaatcttacaaatgtgaacaatgtggcaaaggctttaactggtcttcaacccttacaaaacataaaagaattcatactggagagaaaccctacaaatgtgaagaatgtggcaaagcctttaatgtgtcttcacaccttactacacataagatgattcatactggagagaaaccctacaaatgtgaagaatgtggcaaagcctttaaccactcctcaaaacttactatacataagataattcatactggagagaaaccttacaaatgtgaagaatgtggcaaagcttttaaccaatcctcaaaccttaccaaacataagataattcatactggagagaaactctacaaatgtgaagaatgtggcaaagcttttaaccgatcctcaaaccttactacacataagagaattcacactggagagaaaccctacaaatgtgaagaatgtggcaaagctttcaaccgatcctcaaaccttactaaacataacataattcatactggagagaaatcttacaaatgtgaagaatgtggtaaagcctttaaccaatcctcaactcttactaaacataggaaaattcagcagggcatggtggctcatgcctgtaatcccaacactttgagaggactaggtgagcagatcgcgaggtcaggagttcaagaccagcctggccaacatggtaaaaccccatctctactaaaaatacaaaaatttgctgggtgtggtggcaggcgcctgtaatcccagctacttgggaggcagaggcaggagaatcatttgaacctgggaggcagaggttgcagtgagccaagatcgcgccattctactccagcctgggccacaaggcaagactctgtctcaaaaaaaaaaaaaaaaagaaaagaaaattcatactggaacgaaaccctacaattgtgaagaatgtgccagtgctttcaaccagtcctcgaacctttttaagaaaataatttatactggagagaaattctacaaatgtgaagaatatggcaaagcctttaaccagtcttcaactcttactaggcattaaaaattcatactgtacagaaaccctacgagggtgaaaaacatggcaaagcctttaacaagccctcaattcttaacagacataacataattcatactggaaagaaactctgcaaaccagaaagatctggcaatgcttttgacaacacctcaaacttttctaaccataaaagaaattatactggtgagaaatcttagaaatctgaagaatgagacaaagcctttaaatggttgtcacacttgattgtag

SEQ ID NO: 203626 - DNA, 800 bp, Homo sapiens
  Payload ID: 20152
  Gene Name: zinc finger protein 714
  ENST ID: ENST00000596053
  CDS Start-End: 352-684
gacggcttcggggatgtggcggggcctttgtctctcgctgcagctggagctgcaggtctcgccttcactgccctgtgtcctctgctcgcagaggcccagcctctgtggccctgtgacctgcaggtattgagagatccacagctaagacgccaggtaccccggaagcctagaaatgggcgacctgaggtctggagtgtatcctctcaagggagcaagtggatccctggggcagagaggaagcttctagtgtactcttactttgaaaaggagacgttgacatttagggatgtggccatagaattctctctggaggagtgggaatgcctgaaccctgctcagcagaatttatatatgaatgtgatgttagagaactacaaaaacctggtcttcttgggtattgctgtctctaagcaagacccgatcaccagtctagagcaagaaaaagagccctggaatatgaagatatgtgagatggtggatgaatccccaggccaggtgtggtgtcttacacctgtaatcccagcactgtgggaagccagggcaggtggattgcttgagcccaggagtttgagaccagcctggtcaacatggaaaatccccgtctctacaaaaaaaaaaaaaaaatctcagctgggcatgggcatggtagtgcatgcctgtaatcccagctactccagaggctgaggcatgagaatcccttgagccagggatgcagaggttgcagtgaactgagattgtgccactgcatccagcctgggtaacagagtgagactccgtctcaagagaaaaggaattttctt

SEQ ID NO: 203627 - DNA, 2671 bp, Homo sapiens
  Payload ID: 20152
  Gene Name: zinc finger protein 714
  ENST ID: ENST00000610902
  CDS Start-End: 317-1984
cgctgcagctggagctgcaggtctcgccttcactgccctgtgtcctctgctcgcagaggcccagcctctgtggccctgtgacctgcaggtattgagagatccacagctaagacgccaggtaccccggaagcctagaaatgggcgacctgaggtctggagtgtatcctctcaagggagcaagtggatccctggggcagagaggaagcttctagtgtactcttactttgaaaaggagacgttgacatttagggatgtggccatagaattctctctggaggagtgggaatgcctgaaccctgctcagcagaatttatatatgaatgtgatgttagagaactacaaaaacctggtcttcttggcaggtattgctgtctctaagcaagacccgatcaccagtctagagcaagaaaaagagccctggaatatgaagatatgtgagatggtggatgaatccccagctatgtgttcttcttttaccagagacctttggccagagcaagacataaaagattcttttcaacaagtgatactgagaagacatggcaaatgtgaacatgagaatttacagttaagaaaaggctccgcaaatgtggttgagtgtaaggtgtacaaaaaaggttataatgaactaaaccagtgtttgacaactacccagagcaaaatatttccatgtgataaatatataaaagtctttcataaaattttcaattcaaatagacacaagacaagacatactggagagaaacctttcaaatgtaaaaaatgtgatgaatcattttgcatgcttttacacctacatcaacataaaagaattcatattagagagaattcttaccaatgtgaagaatgtgacaaagtgtttaagcggttctcaacccttactagacacaagagagttcatactggagagaaacccttcaaatgtgaagaatgtggcaaagcttttaagcactcctcaacccttactacacataagatgattcatactggagagaaaccctacagatgtgaagaatgtggcaaagccttctaccattcttcacaccttactacacataaggtaattcatactggagagaagcccttcaaatgtgaagaatgtggtaaagcttttaaccacccttcagcccttactacacataagttcattcatgttaaagaaaaaccctacaaatgtgaagaatgtgacaaagcttttaaccgattctcataccttactaaacataagataattcattctggagagaaatcttacaaatgtgaacaatgtggcaaaggctttaactggtcttcaacccttacaaaacataaaagaattcatactggagagaaaccctacaaatgtgaagaatgtggcaaagcctttaatgtgtcttcacaccttactacacataagatgattcatactggagagaaaccctacaaatgtgaagaatgtggcaaagcctttaaccactcctcaaaacttactatacataagataattcatactggagagaaaccttacaaatgtgaagaatgtggcaaagcttttaaccaatcctcaaaccttaccaaacataagataattcatactggagagaaactctacaaatgtgaagaatgtggcaaagcttttaaccgatcctcaaaccttactacacataagagaattcacactggagagaaaccctacaaatgtgaagaatgtggcaaagctttcaaccgatcctcaaaccttactaaacataacataattcatactggagagaaatcttacaaatgtgaagaatgtggtaaagcctttaaccaatcctcaactcttactaaacataggaaaattcagcagggcatggtggctcatgcctgtaatcccaacactttgagaggactaggtgagcagatcgcgaggtcaggagttcaagaccagcctggccaacatggtaaaaccccatctctactaaaaatacaaaaatttgctgggtgtggtggcaggcgcctgtaatcccagctacttgggaggcagaggcaggagaatcatttgaacctgggaggcagaggttgcagtgagccaagatcgcgccattctactccagcctgggccacaaggcaagactctgtctcaaaaaaaaaaaaaaaaagaaaagaaaattcatactggaacgaaaccctacaattgtgaagaatgtgccagtgctttcaaccagtcctcgaacctttttaagaaaataatttatactggagagaaattctacaaatgtgaagaatatggcaaagcctttaaccagtcttcaactcttactaggcattaaaaattcatactgtacagaaaccctacgagggtgaaaaacatggcaaagcctttaacaagccctcaattcttaacagacataacataattcatactggaaagaaactctgcaaaccagaaagatctggcaatgcttttgacaacacctcaaacttttctaaccataaaagaaattatactggtgagaaatcttagaaatctgaagaatgagacaaagcctttaaatggttgtcacacttgattgtaggccaggtgtggtgtcttacacctgtaatcccagcactgtgggaagccagggcaggtggattgcttgagcccaggagtttgagaccagcctggtcaacatggaaaatccccgtctctacaaaaaaaaaaaaaaaa

SEQ ID NO: 203628 - DNA, 6812 bp, Homo sapiens
  Payload ID: 20152
  Gene Name: zinc finger protein 714
  ENST ID: ENST00000456283
  CDS Start-End: 326-1993
tttgtctctcgctgcagctggagctgcaggtctcgccttcactgccctgtgtcctctgctcgcagaggcccagcctctgtggccctgtgacctgcaggtattgagagatccacagctaagacgccaggtaccccggaagcctagaaatgggcgacctgaggtctggagtgtatcctctcaagggagcaagtggatccctggggcagagaggaagcttctagtgtactcttactttgaaaaggagacgttgacatttagggatgtggccatagaattctctctggaggagtgggaatgcctgaaccctgctcagcagaatttatatatgaatgtgatgttagagaactacaaaaacctggtcttcttggcaggtattgctgtctctaagcaagacccgatcaccagtctagagcaagaaaaagagccctggaatatgaagatatgtgagatggtggatgaatccccagctatgtgttcttcttttaccagagacctttggccagagcaagacataaaagattcttttcaacaagtgatactgagaagacatggcaaatgtgaacatgagaatttacagttaagaaaaggctccgcaaatgtggttgagtgtaaggtgtacaaaaaaggttataatgaactaaaccagtgtttgacaactacccagagcaaaatatttccatgtgataaatatataaaagtctttcataaaattttcaattcaaatagacacaagacaagacatactggagagaaacctttcaaatgtaaaaaatgtgatgaatcattttgcatgcttttacacctacatcaacataaaagaattcatattagagagaattcttaccaatgtgaagaatgtgacaaagtgtttaagcggttctcaacccttactagacacaagagagttcatactggagagaaacccttcaaatgtgaagaatgtggcaaagcttttaagcactcctcaacccttactacacataagatgattcatactggagagaaaccctacagatgtgaagaatgtggcaaagccttctaccattcttcacaccttactacacataaggtaattcatactggagagaagcccttcaaatgtgaagaatgtggtaaagcttttaaccacccttcagcccttactacacataagttcattcatgttaaagaaaaaccctacaaatgtgaagaatgtgacaaagcttttaaccgattctcataccttactaaacataagataattcattctggagagaaatcttacaaatgtgaacaatgtggcaaaggctttaactggtcttcaacccttacaaaacataaaagaattcatactggagagaaaccctacaaatgtgaagaatgtggcaaagcctttaatgtgtcttcacaccttactacacataagatgattcatactggagagaaaccctacaaatgtgaagaatgtggcaaagcctttaaccactcctcaaaacttactatacataagataattcatactggagagaaaccttacaaatgtgaagaatgtggcaaagcttttaaccaatcctcaaaccttaccaaacataagataattcatactggagagaaactctacaaatgtgaagaatgtggcaaagcttttaaccgatcctcaaaccttactacacataagagaattcacactggagagaaaccctacaaatgtgaagaatgtggcaaagctttcaaccgatcctcaaaccttactaaacataacataattcatactggagagaaatcttacaaatgtgaagaatgtggtaaagcctttaaccaatcctcaactcttactaaacataggaaaattcagcagggcatggtggctcatgcctgtaatcccaacactttgagaggactaggtgagcagatcgcgaggtcaggagttcaagaccagcctggccaacatggtaaaaccccatctctactaaaaatacaaaaatttgctgggtgtggtggcaggcgcctgtaatcccagctacttgggaggcagaggcaggagaatcatttgaacctgggaggcagaggttgcagtgagccaagatcgcgccattctactccagcctgggccacaaggcaagactctgtctcaaaaaaaaaaaaaaaaagaaaagaaaattcatactggaacgaaaccctacaattgtgaagaatgtgccagtgctttcaaccagtcctcgaacctttttaagaaaataatttatactggagagaaattctacaaatgtgaagaatatggcaaagcctttaaccagtcttcaactcttactaggcattaaaaattcatactgtacagaaaccctacgagggtgaaaaacatggcaaagcctttaacaagccctcaattcttaacagacataacataattcatactggaaagaaactctgcaaaccagaaagatctggcaatgcttttgacaacacctcaaacttttctaaccataaaagaaattatactggtgagaaatcttagaaatctgaagaatgagacaaagcctttaaatggttgtcacacttgattgtaggtaagataattcatactggagaaaacacctacatgtgtgaacaatgtggcaaaacttaaccagtgctcacaccttattgcacaggaaagcatttgtacttgagataaattatacaaatataaagactgaaaaagccattaatatatgttcatatctcaacaccagatagttcatacttaataaaagcattataagtacaattactgtcaaaagacctttcagaaaatacaagcttttgaccaggcgtggtggctcaggcctataatcccagcactttggtaggccaaggcaggtggatcatgaggtcaggagtttgagaccagcctatccaagatggtgaaaccccatctctactaaaaatacaacaattagccggttgcggtggtggtgcctgtaatcccagctactcaagaggctgaggcaggagaatcacttgaacttggggagggagaggttgcagtgagctgagattgcactctagcctgggccacagagcaagactccatctaaaaagtaaaaaaaaaagaaaatatgaactttacagtgaagaatatttattttgaagatgaatgttacaaatataaagtgggtagtagtgcctttacttgtatcacagatcttattgtagacattttttgtagaggaaaaactctgaagcactttcacactttgttcaatatcagggaatttatattgaagaaaaatcatgcaaatgtagtaaatttggaaaaacactttttcaaaaactacagcttagaaaacagagttcatactagaatatatttttgcagatgcagtaaaagttaaaaaaaatttaatccataagtaagtctgtgtaaatatcagaatttatggtagaaatacataaggcactgacaacatcagatatactaaatcagagggctgagtatagaaaattaaagttggtagaaaaattatttgtatataactttaagaggatcagaaggttttttgcagttataattacattcaaagtatactttatttcttgaaaaatattacagattttttgaaaagtgaataatgatgtcattcaactctgaaattcctgccgtttcttcattcctattggattcacatgtgaaagcatgggatcaattattgctgtatcaaagatatgaaagattctttctttgttttgttctgtttttttgagatggagttttgctctttcgtccaggctggagcacagtggcatgatctcggctcactgcaaccttcaatttccagtttcaagcgattctcctccctcagcctcctgagtagctgggattacaggcgcatatcaccacgcccagctaatttttatgtttctagtacagacaggatttcatcatgttggccaggctggtctcaaactcctcaccttgtgatccacccaccttggcctccaaaggtgctgggattacacaggcatgagccactgctcctggcaagagattcttttttattaggtgggcattatttgtgatcttttctattgaaaagtaaaaacattagaatgtaagatgcataatgaaaatgtaagtggagaggttctttggggttaacttataatattgagtggtgcatgaggttggtgttcagagtaatattctgcattatgaaaaaacatttaattttatttaaaatttagtttatcatactaattgtacttttatataagatgcagtacatttttaaaattttagattgtgtgaagttaatagtttaacatttttaacatgttaaatactattgtgcattcaatgaagcattattataccacaaactttaccctgttccaccttactgaagggtataggtaaaagatggtaacgatatactatttagtaacataatggattaacatctctagtaattttttttgccagtggctttaaaccgcaaataagttaaagaatattgtttctgtaggttaaatttttattttgtttttaatcatttaaatttaattttggtgggtacataatatgagtatatatttatgcacttatatggcatattttagtacaggaatacaatatataatagtagcatcagggttaagtgaggcatccttcacccatagcatttctcctttgttttacaaacaatccaaacctacactttttaaaaattttttgttgttgttgttcttgttgttgttgagacggagtctcgctctgtcgcccaggctggagtgtgcaatctcggctcactgcaagctccacttcccgggttcacgccattttcctgcctcagcctcccaagcagctaggactacaggcgcccaccaccatgcccggctaattttttgtatttttagtagagatggggtttcaccatgttagccaggatggtctcaatctcctgacctcgtgatctggtctcgatctcctgacctcatgatctgcctgccttgacctcccaaagtgctgggattacaggcatgagccaccgtgcccggccactttttataaattttaaaatgtacaattgttatttactatagagttatttttatggtcataatacaaattatatatgagtataaataaaattcatttctaaactattaatattttttccaaattgttatatatttttctttgaacatgtggcctgtctgcctgcaaacatgcagactttttgattcacatagagttaaatatgtattagtctaaagacaaactttaggtgtaagaaaattatggaataagtgtgtgtgtgtgagtatgagtttgtacctattttcagaaaagaacaatatgggaataaaaatcattttaataaggtggctactataaaactaaaaaccttaaaaaatgctgaaagcaaatgtatactttgtgctttgtattgaatttattactgtacaatccatgacttacagttctgaaccttttcatgcaaattctctgtatatacttgcctggtactcatgctagacccatactttttttgtttcttacattttttttgttttatggtttaggaagtattcattatatgagctggtctgtgattataagaatttttatgaaatttagtgcacacaaaataatttttagatgtaattccaaaagtagtgtattaagttacattttatttagtgagagcactccattttgttcttttaaggggagaacaatatataagttttcttttctttagtgattgttcctttcactttttataattgacataagtatatttatttattgagtcaatttgttcaggtaagtactggggggcttcataagtcatgaggatgtttttatatataaatgtagcaaacatacattacagttcttactgtgtaatcgatgctccataataattcacaaatattcctgctggagttagtttgtaatttcaagtcagaaatgaaagatatcagtggtgaagaaataagattgattcttcatatggagtggacattttttccagactataaaactgaatcttgctgaatttaaagagaaattctggccgaggcagatggatcacctgaggttaggagtttcagaccagcctggtgaaacccggtctctactaataaactacaaaaattagctgattgtggtggcatccacctgtagcccagctactcaggaggctgaggcagaagaattgcttgaacccaggaggcgaagattgtggtgagccgagattgtgccattgcactacagcctgggtgacagaatgagactcataaaaaaaaaaataaattctgcttcttttattttctacttctcttcagatttgtttctcgtatgtattttccaactatgtatgcatcacagcccttctttttctgagttatagctacagttttctgactgttctcttcacgccatttcatttcgcctggtattttgtagattttgatgacaaaattctatttttagtgcacttaaaaatggattttaactggtgagttcgcttatcaatataacattcagattagttaattaagataaaagccaggtgtggtggctcacgcctctaatcccagcactttgagaggccgaggcaagtggatcacttgagctcaggagttcgagaccagcctgaccaacatggtgaaaccccgtgtctactacaaatacaaaattagccacatgttgtggcgcatgcctgtaatcccagctactcgggaggctgatgcaggagaatcgcttgaacccaggaggcagaggttgcagtgagccgaaattgcgccattgcactccagcctggacaagagcaaaactctgtctc

SEQ ID NO: 203629 - DNA, 577 bp, Homo sapiens
  Payload ID: 20152
  Gene Name: zinc finger protein 714
  ENST ID: ENST00000616183
  CDS Start-End: 492-577
agctggagcggacaggacggcttcggggatgtggcggggcctttgtctctcgctgcagctggagctgcaggtctcgccttcactgccctgtgtcctctgctcgcagaggcccagcctctgtggccctgtgacctgcaggtattgagagatccacagctaagacgccaggtaccccggaagcctagaaatgagacctttggccagagcaagacataaaagattcttttcaacaagtgatactgagaagacatggcaaatgtgaacatgagaatttacagttaagaaaaggctccgcaaatgtggttgagtgtaaggtgtacaaaaaaggttataatgaactaaaccagtgtttgacaactacccagagcaaaatatttccatgtgataaatatataaaagtctttcataaaattttcaattcaaatagacacaagacaagacatactggagagaaacctttcaaatgtaaaaaatgtgatgaatcattttgcatgcttttacacctacatcaacataaaagaattcatattagagagaattcttaccaatgtgaagaatgtgacaaagtgtttaagcg

SEQ ID NO: 203630 - DNA, 2066 bp, Homo sapiens
  Payload ID: 20152
  Gene Name: zinc finger protein 714
  ENST ID: ENST00000620627
  CDS Start-End: 276-443
gtcctctgctcgcagaggcccagcctctgtggccctgtgacctgcaggtattgagagatccacagctaagacgccaggtaccccggaagcctagaaatgggcgacctgaggtctggagtgtatcctctcaagggagcaagtggatccctggggcagagaggaagcttctagtgtactcttactttgaaaaggagacgttgacatttagggatgtggccatagaattctctctggaggagtgggaatgcctgaaccctgctcagcagaatttatatatgaatgtgatgttagagaactacaaaaacctggtcttcttggcaggtattgctgtctctaagcaagacccgatcaccagtctagagcaagaaaaagagccctggaatatgaagatatgtgagatggtggatgaatccccagagacctttggccagagcaagacataaaagattcttttcaacaagtgatactgagaagacatggcaaatgtgaacatgagaatttacagttaagaaaaggctccgcaaatgtggttgagtgtaaggtgtacaaaaaaggttataatgaactaaaccagtgtttgacaactacccagagcaaaatatttccatgtgataaatatataaaagtctttcataaaattttcaattcaaatagacacaagacaagacatactggagagaaacctttcaaatgtaaaaaatgtgatgaatcattttgcatgcttttacacctacatcaacataaaagaattcatattagagagaattcttaccaatgtgaagaatgtgacaaagtgtttaagcggttctcaacccttactagacacaagagagttcatactggagagaaacccttcaaatgtgaagaatgtggcaaagcttttaagcactcctcaacccttactacacataagatgattcatactggagagaaaccctacagatgtgaagaatgtggcaaagccttctaccattcttcacaccttactacacataaggtaattcatactggagagaagcccttcaaatgtgaagaatgtggtaaagcttttaaccacccttcagcccttactacacataagttcattcatgttaaagaaaaaccctacaaatgtgaagaatgtgacaaagcttttaaccgattctcataccttactaaacataagataattcattctggagagaaatcttacaaatgtgaacaatgtggcaaaggctttaactggtcttcaacccttacaaaacataaaagaattcatactggagagaaaccctacaaatgtgaagaatgtggcaaagcctttaatgtgtcttcacaccttactacacataagatgattcatactggagagaaaccctacaaatgtgaagaatgtggcaaagcctttaaccactcctcaaaacttactatacataagataattcatactggagagaaaccttacaaatgtgaagaatgtggcaaagcttttaaccaatcctcaaaccttaccaaacataagataattcatactggagagaaactctacaaatgtgaagaatgtggcaaagcttttaaccgatcctcaaaccttactacacataagagaattcacactggagagaaaccctacaaatgtgaagaatgtggcaaagctttcaaccgatcctcaaaccttactaaacataacataattcatactggagagaaatcttacaaatgtgaagaatgtggtaaagcctttaaccaatcctcaactcttactaaacataggaaaattcagcagggcatggtggctcatgcctgtaatcccaacactttgagaggactaggtgagcagatcgcgaggtcaggagttcaagaccagcctggccaacatggtaaaaccccatctctactaaaaatacaaaaatttgctgggtgtggtggcaggcgcctgtaatcccagctacttgggaggcagaggcaggagaatcatttgaacctgggaggcagaggttgcagtgagccaagatcgcgccattctactccagcctgggccacaaggcaagactctgtctcaaaaaaaaaaaaaaaaagaaaagaaa

SEQ ID NO: 203631 - DNA, 2696 bp, Homo sapiens
  Payload ID: 20152
  Gene Name: zinc finger protein 714
  ENST ID: ENST00000613286
  CDS Start-End: 323-577
gtctctcgctgcagctggagctgcaggtctcgccttcactgccctgtgtcctctgctcgcagaggcccagcctctgtggccctgtgacctgcaggtattgagagatccacagctaagacgccaggtaccccggaagcctagaaatgggcgacctgaggtctggagtgtatcctctcaagggagcaagtggatccctggggcagagaggaagcttctagtgtactcttactttgaaaaggagacgttgacatttagggatgtggccatagaattctctctggaggagtgggaatgcctgaaccctgctcagcagaatttatatatgaatgtgatgttagagaactacaaaaacctggtcttcttgggtattgctgtctctaagcaagacccgatcaccagtctagagcaagaaaaagagccctggaatatgaagatatgtgagatggtggatgaatccccaggatacatgtgcaggatgtgcagctatgtgttcttcttttaccagagacctttggccagagcaagacataaaagattcttttcaacaagtgatactgagaagacatggcaaatgtgaacatgagaatttacagttaagaaaaggctccgcaaatgtggttgagtgtaaggtgtacaaaaaaggttataatgaactaaaccagtgtttgacaactacccagagcaaaatatttccatgtgataaatatataaaagtctttcataaaattttcaattcaaatagacacaagacaagacatactggagagaaacctttcaaatgtaaaaaatgtgatgaatcattttgcatgcttttacacctacatcaacataaaagaattcatattagagagaattcttaccaatgtgaagaatgtgacaaagtgtttaagcggttctcaacccttactagacacaagagagttcatactggagagaaacccttcaaatgtgaagaatgtggcaaagcttttaagcactcctcaacccttactacacataagatgattcatactggagagaaaccctacagatgtgaagaatgtggcaaagccttctaccattcttcacaccttactacacataaggtaattcatactggagagaagcccttcaaatgtgaagaatgtggtaaagcttttaaccacccttcagcccttactacacataagttcattcatgttaaagaaaaaccctacaaatgtgaagaatgtgacaaagcttttaaccgattctcataccttactaaacataagataattcattctggagagaaatcttacaaatgtgaacaatgtggcaaaggctttaactggtcttcaacccttacaaaacataaaagaattcatactggagagaaaccctacaaatgtgaagaatgtggcaaagcctttaatgtgtcttcacaccttactacacataagatgattcatactggagagaaaccctacaaatgtgaagaatgtggcaaagcctttaaccactcctcaaaacttactatacataagataattcatactggagagaaaccttacaaatgtgaagaatgtggcaaagcttttaaccaatcctcaaaccttaccaaacataagataattcatactggagagaaactctacaaatgtgaagaatgtggcaaagcttttaaccgatcctcaaaccttactacacataagagaattcacactggagagaaaccctacaaatgtgaagaatgtggcaaagctttcaaccgatcctcaaaccttactaaacataacataattcatactggagagaaatcttacaaatgtgaagaatgtggtaaagcctttaaccaatcctcaactcttactaaacataggaaaattcagcagggcatggtggctcatgcctgtaatcccaacactttgagaggactaggtgagcagatcgcgaggtcaggagttcaagaccagcctggccaacatggtaaaaccccatctctactaaaaatacaaaaatttgctgggtgtggtggcaggcgcctgtaatcccagctacttgggaggcagaggcaggagaatcatttgaacctgggaggcagaggttgcagtgagccaagatcgcgccattctactccagcctgggccacaaggcaagactctgtctcaaaaaaaaaaaaaaaaagaaaagaaaattcatactggaacgaaaccctacaattgtgaagaatgtgccagtgctttcaaccagtcctcgaacctttttaagaaaataatttatactggagagaaattctacaaatgtgaagaatatggcaaagcctttaaccagtcttcaactcttactaggcattaaaaattcatactgtacagaaaccctacgagggtgaaaaacatggcaaagcctttaacaagccctcaattcttaacagacataacataattcatactggaaagaaactctgcaaaccagaaagatctggcaatgcttttgacaacacctcaaacttttctaaccataaaagaaattatactggtgagaaatcttagaaatctgaagaatgagacaaagcctttaaatggttgtcacacttgattgtaggccaggtgtggtgtcttacacctgtaatcccagcactgtgggaagccagggcaggtggattgcttgagcccaggagtttgagaccagcctggtcaacatggaaaatccccgtctctacaaaaaaaaaaaaaaaa

SEQ ID NO: 203632 - DNA, 649 bp, Homo sapiens
  Payload ID: 20152
  Gene Name: zinc finger protein 714
  ENST ID: ENST00000618422
  CDS Start-End: 204-649
ctttgtctctcgctgcagctggagctgcaggtctcgccttcactgccctgtgtcctctgctcgcagaggcccagcctctgtggccctgtgacctgcaggtattgagagatccacagctaagacgccaggtaccccggaagcctagaaatggagacgttgacatttagggatgtggccatagaattctctctggaggagtgggaatgcctgaaccctgctcagcagaatttatatatgaatgtgatgttagagaactacaaaaacctggtcttcttggagacctttggccagagcaagacataaaagattcttttcaacaagtgatactgagaagacatggcaaatgtgaacatgagaatttacagttaagaaaaggctccgcaaatgtggttgagtgtaaggtgtacaaaaaaggttataatgaactaaaccagtgtttgacaactacccagagcaaaatatttccatgtgataaatatataaaagtctttcataaaattttcaattcaaatagacacaagacaagacatactggagagaaacctttcaaatgtaaaaaatgtgatgaatcattttgcatgcttttacacctacatcaacataaaagaattcatattagagagaattcttaccaatgtgaagaatgtga

SEQ ID NO: 203633 - DNA, 647 bp, Homo sapiens
  Payload ID: 20152
  Gene Name: zinc finger protein 714
  ENST ID: ENST00000618008
  CDS Start-End: 231-647
gtctctcgctgcagctggagctgcaggtctcgccttcactgccctgtgtcctctgctcgcagaggcccagcctctgtggccctgtgacctgcaggtattgagagatccacagctaagacgccaggtaccccggaagcctagaaatggagacgttgacatttagggatgtggccatagaattctctctggaggagtgggaatgcctgaaccctgctcagcagaatttatatatgaatgtgatgttagagaactacaaaaacctggtcttcttgggtattgctgtctctaagcaagacccgatcaccagtctagagcaagaaaaagagccctggaatatgaagatatgtgagatggtggatgaatccccagctatgtgttcttcttttaccagagacctttggccagagcaagacataaaagattcttttcaacaagtgatactgagaagacatggcaaatgtgaacatgagaatttacagttaagaaaaggctccgcaaatgtggttgagtgtaaggtgtacaaaaaaggttataatgaactaaaccagtgtttgacaactacccagagcaaaatatttccatgtgataaatatataaaagtctttcataaaattttcaattcaaatagacacaagacaagacatact

SEQ ID NO: 203634 - DNA, 5197 bp, Homo sapiens
  Payload ID: 20153
  Gene Name: zinc finger protein 716
  Uniprot ID: A6NP11
  ENST ID: ENST00000420713
  CDS Start-End: 113-1600
ctttttgcttctctgcgcccagagctccagtccttctcttcactgctctgcgtcctctgctcctggaggccaagcctctgtggccttgtgtcctgcaagtattcgcagatttatggctaaaagaccgggaccccctggaagccgagaaatgggactgttgacattcagagacatagctatagaattttctctggcggaatggcaatgcctggatcatgctcagcagaatttatatagagatgtgatgttagagaactacagaaacctggtctccctgggtattgctgtctctaagccagacttgatcacctgtctggagcaaaataaagagccccagaatataaagagaaatgagatggtagccaaacacccagttacatgttctcatttcacccaagaccttcagtcagagcagggcataaaagattcactccaaaaagtgatactgagaagatatggaaaatgtggacaggaggatttacaagtaaaaaaatgctgtaaaagtgtaggtgagtgtgaggtgcacaaaggaggttataattatgttaaccaatgtttgtcagctacccaaaacaaaacatttcagactcataaatgcgtcaaagtctttggtaaattttcaaattccaatagacacaagacaagacatactggaaagaaacatttcaaatgtaaaaacgatggcaaatcattttgcatgctttcacgcctaaatcaacatcagataattcatactagggagaagtcttacaaatgtgaagaatgtggcaaatcctttaactgctcttcaacccttactagacataaaagaattcatactggagagaaaccctacagatgtgaggaatgtggcaaagcttttagctggtctgcatcccttactaaacataagagaattcatactggagagaaaccttacacatgtgaagaacgtggcaaagtctttagccgctcaacacttactaactacaagagaattcatactggagagaaaccctacacatgtgaagaatgtggcaaagcctttagccgctcttcaacacttactaaccacaagagaattcatactggagagagaccctacaaatgtgaagaatgtggcaaagcctttagcttatcctcaacccttaagaaacataagatagttcatactggggagaaactctacacatgtgaagaatgtgggaaagcctttaccttctcctcaactctaaatactcataagaggattcatactggagagaaaccctacacttgtgaagaatgtggcaaagcctttagcttaccctcaaccttcacttaccacaagagaactcatactggagagaaaccctacaaatgtgaagaatgtggcaaagcctttaactgctcctcaacccttaagaaacataagataattcatactggagagaaactctacaaatgtaaagaatgtgggaaagcctttaccttctcctcaactctaaatactcataagaggattcatactggagagaaaccctacaaatgtgaagaatgtgaccaaacttttaagtggcattcaagtcttgctaatcataagaatatgcatactggagagaaaccctacaaatatgaataatgtggtaaagtccagccctcaggccttataatacataaaataatttatactggaaaaaatcactacaagtgtggagaatgtggccaattctttaaccagttccaaaccactgctgtccataagataattcatattggacaaaagtcttataaatgtaaaaaaaaaagtaacagcctttaaccacccctcaaaccttaatgaacccaagagaatttatttaaaaaaatttttttgagacagagtctcactttgtcacccaggctggagtgcagtggcacgatgtcagctcactgcaacctctgcctcctgggttcaagcgattctcctgcctcagcctcctgagtagctggaattacaggcacgtgcaaccacactggctgagttttgtatttttagtagagatggggtttcaccattttgaccaggctggtctcaaactcctgacttcaggtgaaccacctgcctcagcctcccaaagcctaagagaatttatattagagagactctacaaaggtcaaaaatgtgacaaaacatttaagcacatctcaggccttacacaatatcagataattcattctagagacaaaccctacaaaaacaatgtggtaaagcttttacctagtcttgaacccttattatacactaaaagaattgatactgaagaaaaaccctacaataaggaatatggaaatgtcttttaaaagtcctcaaactttttgtttgaataaatgtaaaataattgatactggagagaacccctgcaattgtaaaaaaaaaaaaaaatgtggcaaagcttttaactggttctccatctttattaattaaaatattttatactggagagaaactctacatacataaaaaatgtgacagcatttaaccacacctgacatttttctaaaatagagaaatcatactggtgaaaaactctagaaatgtgttaaatgaggtaagtcctttaaatggtagttgcatgttatggtaggtaagataatttatactgaagaaaactcaggcaaatatgaaaaatgtggcaaaacttttaacaaattttcccatcttattgcacaggaagccttttatactagagaaaaattgtaaaaatataaagaatgtgaaaagccattaatgtctgttcacatcttactcaatatcagaaagtttatacttaacaaaagcattataggctagatgtggtggctcatgcctgtaatcccagcactttgggagctcatggcaggtggatcatgaggtcaggagttcaagaccagcctggctaacatggtgaatccccatctctactaaaaacacaaaaattagacaggcatggtggtgtgcacctgtaatcccagctactcaggaggctgaagcaggagaattgcttgaacccaggtggtggaggttgcagtgagtcaagatcaccccaccatactccagcctgggtgacagagcaagaatccatcttaaaaaaaaaaaaaaagcgtaaatgtgattactgtaaaaagacctttcagaaaacataggcctttaaagcaaagactatttattctaaagacaaacattaaaacataaagaggattgtgtagtacctttatttgtattacggattttattgtacacattttatatcaaaggaaaaccctgaaacagatgctcaaactttgttgaacatcggagaatttatattggagagaaagtgtaaatgaatgtcaaaaaatatttgttcaaaaactacagtttagaaaacactagtttatactaaaaaaatatttttgcagatgcagtaaatggggaaaatatgtttaatcaaaaattaagtctacataaacatttgaggattcacagtagaaagaatgaaggtgctgaaacttcagacattacactaaatcagagtgttgagtgtaaaaaagatataaatctaacaatataaatttaaagaagtagatttatttggagatttataattacattcgaggtatgcttctttctttgtaaaaaaaaatatagattttctgaaaagcaaatagtaatgtaactcacatttcaaattacttcatgttgatcctttcttcccattgtttctgtgaaagtattggaccaattgttgaatcagagatatgagattgttttttataggtgtccattattcatgaactttcctatggatgagtaaggacattaagttgtaagatgcataatgaaaatctaaatggagaggttctttgtggttgacttataacattgttttagtgatgtataaggcgagcgttcagagtaatattctaaattctagtgaggaaaacctttgaacgtcagtagtaaattattttatcaattgtacctttatgtaaacaaagttgtttttaatgagctaaaactattgtgctttgaaagaagtattaagctgccattgactctatcgtgtctcatcttaaggttctgcgtaaaagatggtgacaatatactatttgttaatgtaggggaatgacatcactagtagtctcttttttgccagtgtttttgtttgtttgttttgagactaagtcttactctgtcacccagactggggtgcagtggtgcgatctcagctcactgcaacctccacctcctgggtccaagtgattctcctgcttcagcctcacaagtagctggaactagaggcaggcaccaccactcctggctaatttttgtatttttagtagagatgaggtttccccatgttggccaggctggtctcaaactcctgacctcaggtgatacacccacctcggtgtaccgaagtgctgggattacaggcatgagccaccatgcctggcctactagaggttttacacagcaaacaagttgaagaattttgttcccataggacaaatttgtacttttttaccttatttaatttttttttaatttttgtgggtagtgtgcatacacacttatggcatatatgagatatgttaacacatgcacataatatttaatgatcacaacagagtaaatgaggcattcatcaccttgagcatgtatttatcctttgtattacaaacaatcccattatacagttttagttatttcaatatgtgcaattgaattactattaaccacagggtcattttatgatcataaaaattacatgagtataattaatacccatacatttctgagtcttgattaaatatttttaaaattttgttttataaattttttgcacatgtggcatctctgctgacaaacaaaaacagacttttagtttcaatttacatagagttacatatacaaatatattactctaaagatataccagccgagcacagtggctcccagcattttgggagcctgaggtgggaggatcatttgaggttaggagttcaagaccagcctggccaacatggtgaaaccccatctctactaaaaatacaaaaaattagctgggcatggtggtgcatgcccatggtcccagttactcaggaggctgaggcaggagaattgcttgaacctcggaggtggaggtagcagtgagctgagatggtgctactgcactccagcctgggtgaaagagcgagaaaccatctcaaaaaaaaaaataaataaataaaagat

SEQ ID NO: 203635 - DNA, 1169 bp, Homo sapiens
  Payload ID: 20154
  Gene Name: zinc finger protein 717
  ENST ID: ENST00000477374
  CDS Start-End: 173-517
cggtcttgtagctgggccagcctggggcttggttctatgtccctgcgggtcggtgcgagggcgaagaggaacccgtgggcccgggggatcccggggggccggaccagtgttccccagttgtgggagcagacgcgtgggcgcatcgcgggcgggcagggcctgaagtgcagctatgtttccagtgttctctggctgtttccaagagctacaagaaaagaataaatctctggagttggtgtcctttgaggaggtagctgtgcacttcacctgggaggagtggcaggacctggatgatgctcagaggaccctgtacagggacgtgatgctggagacctacagcagcctggtatcattggggcattacattaccaaacctgagatgatcttcaagctagagcaaggagcagagccatggatagtagaagaaaccccaaacctgagactttcaggtggaagcaagaagcaagttttctcaggtatttgccacaggagcctggtggagctccaggaggtttgatctctcttgtgaactctggaactgtattcccaattgtcaattggacatccctacgtatgggacctcagatatttcaaacatgatgtgtccaagtctgtatcacttctggccatcatattgttcttttatttttccaaatttcacatcaccagtaacaaactagctgtgatcatggcagatagcctggaaataaaactcccctttttaccctttgcacagcaaattgacatcaaatcctgtttctactttttttttttttaactattgcttccctattctgtattctcactgctccatctcctgatgtaggaggtcatctgttttcctcttttcctctcctctgactcttaagccctttcccattctctttctcaggaatggctgttaaaatgccaatatggtcttgtaactttcctgtacttagtgaacctccttatttacaccctgtttgtgaagtggctgtgttcaccctgggtggacacggaatgtttttgtcatgtacaaagagaattttatgctgcctgtgtacagttattaatttgtaagtacactcagctttttgtatctgtaggtttaatatctgtgtatgtaagcaaacttggatgcaaaatatttgaaataaaatcagatgcttgcatctgtagtgaacata

SEQ ID NO: 203636 - DNA, 608 bp, Homo sapiens
  Payload ID: 20154
  Gene Name: zinc finger protein 717
  ENST ID: ENST00000468296
  CDS Start-End: 278-608
tctggttccctccttcactgtgtgacctgcctagtcctcctgggttgcgtttacagaagtttatacgagacctagtttccagggaagaactcactgatgccgcgagggagatggggtactggatgatggtcttcagccttaagggtacttcagtcttaaccgtgtgttataaggtttgaaagggagggttccctatgaataagaagcgcacttgaaagaacagccctctggtctaacctcccactggtgcttcagaggaggataaaaggtcacagctatgtttccagtgttctctggctgtttccaagagctacaagaaaagaataaatctctggagttggtgtcctttgaggaggtagctgtgcacttcacctgggaggagtggcaggacctggatgatgctcagaggaccctgtacagggacgtgatgctggagacctacagcagcctggtatcattggggcattacattaccaaacctgagatgatcttcaagctagagcaaggagcagagccatggatagtagaagaaaccccaaacctgagactttcagctgtccagatcattgatgaccttattgaaaggagccatgaaagtcatgatagat

SEQ ID NO: 203637 - DNA, 3875 bp, Homo sapiens
  Payload ID: 20154
  Gene Name: zinc finger protein 717
  ENST ID: ENST00000478296
  CDS Start-End: 278-2872
gcggcacccagaggcggtcttgtagctgggccagcctggggcttggttctatgtccctgcgggtcggtgcgagggcgaagaggaacccgtgggcccgggggatcccggggggccggaccagtgttccccagttgtgggagcagacgcgtgggcgcatcgcgggcgggcagggcctgaagtgcaggagttggtgtcctttgaggaggtagctgtgcacttcacctgggaggagtggcaggacctggatgatgctcagaggaccctgtacagggacgtgatgctggagacctacagcagcctggtatcattggggcattacattaccaaacctgagatgatcttcaagctagagcaaggagcagagccatggatagtagaagaaaccccaaacctgagactttcagctgtccagatcattgatgaccttattgaaaggagccatgaaagtcatgatagatttttctggcaaattgtaatcaccaacagcaacacatcaactcaggagagagttgaattaggaaaaacatttaatttgaactcaaaccatgttttaaatctgattataaataatggaaacagttcaggaatgaagcctgggcagtttaatgattgccagaacatgcttttccctattaagcctggggagacacagtctggagagaaacctcatgtctgtgatataaccaggagatcccacagacatcatgaacatcttactcagcatcacaagattcaaactctgctgcagacttttcaatgtaatgaacaagggaaaaccttcaacacggaggcaatgttctttatacataagagggttcatatagtacagacctttggtaaatataatgaatatgagaaagcctgtaataactcagctgttattgtccaagtgataactcaggtaggacagccaacttgctgtagaaagtctgacttcactaaacatcagcagacacacacaggagagaaaccctatgaatgtgttgaatgtgagaaaccctccattagcaaatcagaccttatgctacagtgcaagatgcctactgaggaaaaaccttatgcctgtaactggtgtgaaaaattgttcagctataagtccagcctcattatccatcagagaattcacacaggggaaaagccctatggatgcaatgaatgtggtaaaacctttcgccgtaagtcattcctcactttacatgagagaactcacacaggggataaaccctacaaatgtattgaatgtggaaaaacttttcactgtaagtcacttctcactttacatcacagaactcactcaggggaaaagccctatcagtgtagtgaatgtggaaaaacctttagccagaagtcatacctcacaatacatcatagaactcacacaggggaaaagccctatgcatgtgaccattgtgaagaagcatttagccataagtcaaggcttactgtccatcagagaacacacacaggggaaaaaccgtatgaatgtaatgagtgtggaaaaccctttatcaataagtcaaacctcaggttacatcagagaactcacacaggggaaaaaccctatgaatgcaatgaatgtgggaaaacgtttcaccgtaagtcattcctcactatccatcaatggactcacacaggggaaaaaccctacgaatgcaatgaatgtgggaaaacctttcgctgtaagtcattcctcactgtccatcagagaactcatgctggggaaaaaccatacgcatgtaacgaatgtggaaaaacatatagccacaagtcataccttacagtacatcacagaactcacacaggggaaaaaccctatgaatgtaatgaatgtggaaaatcctttcactgtaagtcattcctaactatacatcagagaactcatgctggcaaaaaaccctatgaatgtaatgaatgtgagaaaacctttatcaataagttaaaccttgggatacacaagagaactcacacaggggaaagaccctatgaatgtaatgaatgtggaaaaacctttcgtcagaagtcaaatctcagcacccatcagggaactcacacaggagagaaaccttacgtatgtaatgaatgtggaaaaacctttcatcgcaagtcattcctcaccatacaccagagaactcacacggggaaaaaccgtatggatgtaatgaatgtggaaaaactttttgtcagaaatcataccttattatacatcagagaactcacaccggggaaaagccctatgaatgtaatgaatgtggaaaatcctttcatcagaaggcaaatcttcagaagcatcaaggtattcacacgggggagaaaccctatgaatgtagcaaatgtggaaaaaccttgtcagaagtcagtcctcactgtacatcatagaacccataccggagaaaaaccttatgaatgtaatgagtgtgggaaaaccttttgtcacaagtcaaacctcagtacgcatcaggggactcactcaggagagaaaccctatgaatgtgatgaatgtaggaaaactttttacgataagacagttctcaccatacatcagagaactcacacaggtgagaagccatttgaatgtaaagaatgtaggaaaaccttctcccagaagtcaaaactctttgtacatcacagaactcacacaggggaaaaaccctttagatgtaatgaatgtaggaaaactttctcccagaagtcaggcctcagtatacatcagagaacacacacaggagaaaaaccttatgaatgtaaggaatgtgggaaaaccttttgccagaagtcacacctcagcaggcatcaacaaacccatataggagagaaatctgacgtagctgaggcaggctatgtgttccctcaaaatcactcttttttcccttgaacacacaacctacacctctctggctactattacagatttctccatgctcagtctaggagaatatggacacaaatggtgaccattacctcctggcctaccaacaagaaggtcttaaccatgctgtaacagaagtcctatcatgcaggctttgttgttcccatttttacagcacactttgcactttaatgtcacagatatggctgttttcctagaagctcatataccaacctctgccagcttcaaacatttcttctgcaacttcctcacctctcttctcctccatagaattgaagagagttagggcctttctcaggattaggctttgtctcaagggaatgttggggctggtttgatcttctatgtggaccactcagactttctctgtgtcagtaaaaagcctgttttgttttttaaaaatcattcatgtgttctctggagtagcacctataacatccttcaagaactttttctttgcattcacaacttgagtagctgatgcaagaagcttagctttggcctgtcttagcttccaacatgctttcttcactaagctcgatgatttctaccttttgatttgaagtgacaggtgtgcacacttcttttcaattgaacacatggtggccactgcagagtgaagtggcctaatttcattgttgtatcttggggaatggggagctagaagagagaaacagagacagggaaatgactagtcaatgaagcagtcaaacacaacatttttccatcacgtttgctatcttccatagagttccagcacgctgagacaattccattagtaacatcagaaatcactgatcacagatcataacagatgtgataactaaaatctttgaaagattgggattgccaaaagatgtgacagagatgtgaagtgagcccatggtgttggaaaaatggtgctggtcaggcttgctgagcacttcgtggccacaaatctttaatttgttaaaaaggtgatgttgccaagcaaaataaagtgaagctc

SEQ ID NO: 203638 - DNA, 562 bp, Homo sapiens
  Payload ID: 20154
  Gene Name: zinc finger protein 717
  ENST ID: ENST00000471541
  CDS Start-End: 382-562
attttcctccggaagtgcggcacccagaggcggtcttgtagctgggccagcctggggcttggttctatgtccctgcgggtcggtgcgagggcgaagaggaacccgtgggcccgggggatcccggggggccggaccagtgttccccagttgtgggagcagacgcgtgggcgcatcgcgggcgggcagggcctgaagtgcagaagtttatacgagacctagtttccagggaagaactcactgatgccgcgagggagatggggtactggatgatggtcttcagccttaagggagttggtgtcctttgaggaggtagctgtgcacttcacctgggaggagtggcaggacctggatgatgctcagaggaccctgtacagggacgtgatgctggagacctacagcagcctggtatcattggggcattacattaccaaacctgagatgatcttcaagctagagcaaggagcagagccatggatagtagaagaaaccccaaacctgagactttcagctgtccagatcattgatgaccttattgaaaggagccatgaaagtcatgatagat

SEQ ID NO: 203639 - DNA, 2772 bp, Homo sapiens
  Payload ID: 20155
  Gene Name: zinc finger protein 718
  ENST ID: ENST00000609714
  CDS Start-End: 853-2193
gcctcatcgctctgctcccgctccttagggaagcctcggtgattctgccacagcctcagcctctgtggctctgtgacctgccggtattggatgattcgtatctaagactctgggacactcctgaagtcgggaaatggtgagtgtgcagggcagggcgtcccaaggctgtggaggcctcatcggaaccggcgggaaatggcggcggtgggaggagtctgtgaatggagttcccgctcagccctctgtcctcagtcccctccggtgagggacccgcgctcttgtcagtccccgtacagcggctctggcccagcctgcagccctccttgtgcagctctgcgccggtagccctgcactttccccgggctgtggagtgagtaggagctcatccggaagacaccgcggcggcctgcgcggtgccggcgtgggaggagctgtggtccggaatcccgtccctactttaccctgttcagaatgagattgaggccccatcaaaacatggagttcatgtgagcaaacaggacttattaatgggaaagctctgccgtggctcgtggtttggggactgccagcgggtcttgaaggaaaggcttttgtgaggtgtgtgaggaagcgaagcaaatcacctgcctgcgccaactttgccgccagtccccttgccctgtgcgcctcctccgcgtggctgttcctgaatacgctggtgtctgttcgcatcttttagaatacgctggtgtcggtgcgcacagcgcttctcttagttctgaactcttaacattcaaggatgtggccatagaattctctccagaagagtggaaatgtctggacacttcccagcagaatttatatagagatgtgatgttggagaactacagaaacctggtctccctgggtgttagtatctctaacccagacctggtcaccagtctggagcaaagaaaagagccctacaatttgaagatacatgaaacagcagccagacccccagctgtgtgttctcatttcacccaaaacctttggacagtgcagggcatagaagattcattccacaaacttataccaaaaggacatgagaaacgtggacatgagaatttaagaaaaacttgtaaaagtataaatgagtgtaaggtgcagaaaggtggttataatagaattaaccaatgcttattaactacccagaaaaaaacaattcaatctaatatatgtgtcaaagtttttcataaattttcaaattcaaacaaagataagataagatatactggagataaaacctttaaatgtaaagaatgtggcaaatcatttcacgtgctctcacgcctaactcaacacaaaagaattcatactggagagaacccctacacatgtgaagaatgtggcaaagcctttaattggtcctcaattcttactaaacataagagaattcatgccagagagaaattctacaagtgtgaagaatgtggtaaaggctttactcggtcctcacaccttactaaacataagagaattcatactggagagaaaccctacatatgtgaaaaatgtggtaaagcttttaaccaatcctcaacccttaatttacataagagaattcattctgcacaaaaatactacaaatgtgaagaatgtggtaaagcctttaagtggtcctcatcccttaatgaacataagagaattcatgctggagagaaacccttctcatgcgaagaatgtggcaatgtctttaccacatcctcagactttgctaaacataagagaattcatacaggagagaaaccctacaaatgtgaagaatgtggaaaatcctttaataggtccacaactcttacgacacataagagaatccatactggagagaaaccctacacatgtgaagaatgtggaaaagcctttaattggtcctcaacccttaatgtacacaagagaattcactctggaaaaaatccctacaaatgtgaagattgtggcaaagcctttaaagtgtttgcaaacctgcataatcataagaaaattcatactggagagaaaccctacatatgtaaacaatgtggcaaagcctttaaacagtcctcacacttgaataaacataagaaaattcacactgtagataaaccctacaaatgtaaagaatgcgggaaagcttttaagcagtactccaaccttcctcaacataagagaactcatactggaggaaaattttagaaatgtgaagaatgtgggagcctttaagtcttcctcagtcttttctaatcataattcatactggagagaaactctacacatgaaaaaattgacaaagcttttaaccgcaactcaatctgttctaaacataagagaaatggtattggtgagaagccataaaaatatgaaaaatgtggaaaagccttcaaatgcttgtcacatattactgaatataattcttactgcagaaaacccctaggaatattaaaagtgtggcaaaacctttaaccaatgctcatatctctttgcacatgatagcatttatacttgagaaaaattgtacaaatatagaaaatgtagaaaagccattaatgcctactcatgtgttactaaatatcagagagtttgtacttaataaaaggattataaatgtagtatttgttgaaagacctattagaaaatacaggtcttaaaagtgaagaagagtattctgaagatagacaatagaaatagtaagagggttgtagtacctgtacttgcatcatgggtcttattgtgcatatttcatactagaagaaaaccctgaagcagttgcccaaa

SEQ ID NO: 203640 - DNA, 3495 bp, Homo sapiens
  Payload ID: 20155
  Gene Name: zinc finger protein 718
  ENST ID: ENST00000510175
  CDS Start-End: 192-1628
gcggcatccgggatctggcgcggcttttgcttgtagctccagccagagctcggttagggcctcatcgctctgctcccgctccttagggaagcctcggtgattctgccacagcctcagcctctgtggctctgtgacctgccggtattggatgattcgtatctaagactctgggacactcctgaagtcgggaaatggaactcttaacattcaaggatgtggccatagaattctctccagaagagtggaaatgtctggacacttcccagcagaatttatatagagatgtgatgttggagaactacagaaacctggtctccctgggtgttagtatctctaacccagacctggtcaccagtctggagcaaagaaaagagccctacaatttgaagatacatgaaacagcagccagacccccagctgtgtgttctcatttcacccaaaacctttggacagtgcagggcatagaagattcattccacaaacttataccaaaaggacatgagaaacgtggacatgagaatttaagaaaaacttgtaaaagtataaatgagtgtaaggtgcagaaaggtggttataatagaattaaccaatgcttattaactacccagaaaaaaacaattcaatctaatatatgtgtcaaagtttttcataaattttcaaattcaaacaaagataagataagatatactggagataaaacctttaaatgtaaagaatgtggcaaatcatttcacgtgctctcacgcctaactcaacacaaaagaattcatactggagagaacccctacacatgtgaagaatgtggcaaagcctttaattggtcctcaattcttactaaacataagagaattcatgccagagagaaattctacaagtgtgaagaatgtggtaaaggctttactcggtcctcacaccttactaaacataagagaattcatactggagagaaaccctacatatgtgaaaaatgtggtaaagcttttaaccaatcctcaacccttaatttacataagagaattcattctgcacaaaaatactacaaatgtgaagaatgtggtaaagcctttaagtggtcctcatcccttaatgaacataagagaattcatgctggagagaaacccttctcatgcgaagaatgtggcaatgtctttaccacatcctcagactttgctaaacataagagaattcatacaggagagaaaccctacaaatgtgaagaatgtggaaaatcctttaataggtccacaactcttacgacacataagagaatccatactggagagaaaccctacacatgtgaagaatgtggaaaagcctttaattggtcctcaacccttaatgtacacaagagaattcactctggaaaaaatccctacaaatgtgaagattgtggcaaagcctttaaagtgtttgcaaacctgcataatcataagaaaattcatactggagagaaaccctacatatgtaaacaatgtggcaaagcctttaaacagtcctcacacttgaataaacataagaaaattcacactgtagataaaccctacaaatgtaaagaatgcgggaaagcttttaagcagtactccaaccttcctcaacataagagaactcatactggaggaaaattttagaaatgtgaagaatgtgggagcctttaagtcttcctcagtcttttctaatcataattcatactggagagaaactctacacatgaaaaaattgacaaagcttttaaccgcaactcaatctgttctaaacataagagaaatggtattggtgagaagccataaaaatatgaaaaatgtggaaaagccttcaaatgcttgtcacatattactgaatataattcttactgcagaaaacccctaggaatattaaaagtgtggcaaaacctttaaccaatgctcatatctctttgcacatgatagcatttatacttgagaaaaattgtacaaatatagaaaatgtagaaaagccattaatgcctactcatgtgttactaaatatcagagagtttgtacttaataaaaggattataaatgtagtatttgttgaaagacctattagaaaatacaggtcttaaaagtgaagaagagtattctgaagatagacaatagaaatagtaagagggttgtagtacctgtacttgcatcatgggtcttattgtgcatatttcatactagaagaaaaccctgaagcagttgcccaaactttctttgacattagagaatttatattggaaagaaattttacaaatgtaataaatttggaaaagcatttgttcaaaaactatagcttaaaaaaaaccagtttatactagaagatattttgtagatgcggtaagtatgaaaagatagtctgaaattaagactaaatgtcagaatatttacagtagaaagaaaaaggcattaacacttgaaacattacagtatatcagagtgtaaagtataaaaaaattccaaagctgaaactgttagataatttctttctatataagttgaaaaggagtagctttttgaaattattccattgaaattatactttttttacctgaaaaaattatagattttttgaaaagcaaattcaactctaaaattacttcatactgattcaacttattgtttatatgaaagcatgtgatgaattgttgcatcagaggtatgagtgattctttttaggtgggcatcattcatgaactttttttttttttttgagacggagtctcgctctgtcgcccaggctggagtgcagtggcgggatctcggctcactgcaagctctgcctccccctgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtattcatgaacttttacatgaatgagtaaggacattgaaagatgcatgagatgatgcatacatctttgtggttgacttatcattgcatgatgcatgacgtacatgttcagagtaatattcttctgcattatagtgagagaaaaatcttgaattttagtaataaattgcttttaccagttgcacatttatgtaataaaatacagtaaattttaaaattctcttttaagattgtgtgtgaaccttactcaagggtgtaggtaaaaaatggtaacagtatacttttagtaacatagtttaatgacatttctagtaatttctttttccagtggctttaaacagcaaataagttgaagaatattgttctcatgttaaatttttattattttttatatttaaatttatttttaaaaatttatgtgggtacatggtatgtgtatacattcatggcatagatgggttactttgatacagacatgcaacatgtaatcacatcagagtaaatgagttattcatcacctcaa

SEQ ID NO: 203641 - DNA, 2769 bp, Homo sapiens
  Payload ID: 20156
  Gene Name: zinc finger protein 720
  Uniprot ID: Q7Z2F6
  ENST ID: ENST00000316491
  CDS Start-End: 200-580
ggcggcttccgggatttggcggtggcctttgttggctgcagtaagagctcagtctcttcaccaggggctcccagtccttccatctgggaggccaaggcggcttcgcgttctgagaatagacagaacctctgttactctgtgaccggcaggcaccgggagatccgtagctcagacgccaggacatcccggaagctgggaaatgggactgttgacattcagggatgtggccatagaattctctcgggaggagtgggaacacctggactcagatcagaagcttttatatggggatgtgatgttagagaactacggaaacctggtctctctgggtctcgctgtctctaagccggacctgatcacctttttggagcaaaggaaagagccctggaatgtgaagagtgcagagacagtagccatccagccagatatcttttctcatgatactcaaggcctcttaagaaagaagcttatagaagcatcattccaaaaagtgatattggatggatatgggagctgtggccctcagaatttaaacttaaggaaagagtgggaaagtgagggcaaaataatcctatggtgaaaaaaatcaacaagataatctctgcttgagaaaaaggaccaaagacaagtgaattttctgagggtgatgaaagtgttgcttcgaaaaggggtgaagtttatatgggtctatttatttgtctaacatgtacagttaaggtttatgccttgcaatgtatgtacatcttcacaaaaaaaatcttaaaaaaattaaatgggtgggggtagggaaagggttgaagtatagatgaagcagaagtggtacatgattagtagttgaagctgggggcaggtctatatattttatttttatgtctttaatagcatttgtataaatgtacaatattcgtttacaatgttagctcaggatcttgtttacctttggacagggagggagggagaaatttattttctgggtaggagtaaagctggttctattcctcagttatgtaaattatctgttataatccaaaaagctttacatgaatgtttctgtatgtaatgtggtatatcaataaaaaattaaatattacatatttgcaccagaatcctaactcactatctcagaatgttagcagcattttcttttgttgtaaagtggaacacaatctcatggcattagcagatgggtttgaatattctaaagtatcaacgtcctaatctcatgggcacctcttgggtctttccatttttgccttcatttgctaagtggcatgcttttgattttttgagatgaaactttttcccagcaaagtcttttccccacagtgatgctctgaaagccaggacacctagcacaggaccctgggcatagtatgcactcagtacatgtggagcatgttgatcaggaacaaaaggagtagcaaaggtcagttcctgcaaaggtgagtagataatacaggtatgactgaaaggctgcaactcaggagtaaacattttacattcattcaagagacaatttgcaactagtacaccaaaaaattttggcttgaagcagtactttggggacttggctaaactctgtaatcacttggagaactttaaacaatactgacgtctgggccctactccagggattttgattttattggtctgttgcaatttaggttttgggaattgtagggcctccgcatgtgactgtaatgtggagccaggggtgagacccactgtttcagggtgagggatgcattagctgtgtgtgatttccatgtgtgctgcaagtatttaacctatgaccactcctgcatttggagtcttggaaattgcagcaggaggaaatgtctctctacagatctattttttatgtcacttgcttttagagtaagaggttatttcaggcacagtaatttgatttaatctgttttcaaatactaaatctgaaaatactaaaatgaaaagaatttgcaaatgtgagaatttgcaaacatgtggagtgtgttcttatgtgctttccagtttctctgatgataagaaatgagtaatgttgggccttgatttcctaaactcagccctcagtcactttctcaaattatttgaagaccttccaagttgcttcagaagcattgtccaaaggagattattcccagtagtgaagaataatagatggatgagaatgtctaaggaatcctacttctgtcgcagaagtggcactctccagaacctcaagggcccatggagttcatgggctttggagtcaggcagagttgaccctgagtcccatcccagcctcttaatagactagttacttgacttggaacagttatgcaagacaaagcacaatgatactgattgcagtaatgggaacaattcattcctctctgtatccatgccctttgcaatgcatgtttttagctactcccatggagggaaagattctgtttttccagtccttggatctgactggccttatttgctgtggccaattcatacttactgttctagtgaaacaattaggcatgttttgctcctcattctagactttaattaaaattaaaattttatgatattttatttctactgtattttgctgtattcattctgctcagtattctagttcaccggtcctcttatctctgtttaatttagtggtgaacctatacattgtctggtaacttaattttgtattttcgtattctattgggctgtcgttcaaatgtggcttttaaacttcagttacttgttctttctacaaaaataaacattgattttcta

SEQ ID NO: 203642 - DNA, 2282 bp, Homo sapiens
  Payload ID: 20156
  Gene Name: zinc finger protein 720
  ENST ID: ENST00000398707
  CDS Start-End: 165-413
ctgcagtaagagctcagtctcttcaccaggggctcccagtccttccatctgggaggccaaggcggcttcgcgttctgagaatagacagaacctctgttactctgtgaccggcaggcaccgggagatccgtagctcagacgccaggacatcccggaagctgggaaatgggactgttgacattcagggatgtggccatagaattctctcgggaggagtgggaacacctggactcagatcagaagcttttatatggggatgtgatgttagagaactacggaaacctggtctctctgggtctcgctgtctctaagccggacctgatcacctttttggagcaaaggaaagagccctggaatgtgaagagtgcagagacagtagccatccagccagaagtcaaagtgaatacccattaaacaacaaattgtcctttccacacttctctccagctcctgaagagcaccattctgcctaatgtttctatgagtttggctactgtagatactttatatatcttttctcatgatactcaaggcctcttaagaaagaagcttatagaagcatcattccaaaaagtgatattggatggatatgggagctgtggccctcagaatttaaacttaaggaaagagtgggaaagtgaggagaaaaatcagtacaataaatctgatacaacattaagccaaggcataagccccagaagacatcagaaaactcattttctacataaccattgcaaacgtaaaaaatgtgagaaagcctttcatgaatgcaccaaccatgtccatcagagtatctttattcaagagaagtctgccaaatgtaataagtgtatagaaacttttatccagtcatcaaaacatactcagcctcagagaatccatattggagaaaagtcacacagatgtaataatggtgagaaaatccttagtaaattgtcaagtctaagaaaacataagataatccataatgaagagaaaccttacaaatgtaaagaatgtgacaaagcctttaaccatcgttcacaccttactcaacatcaaataattcatactggagagaaaccatacaaatgtaaagaatgtggcaaagccttcaattctagttcatattttactagacatcagagaattcacactggagaaaaactttacaaatgtaaagcgtgtagcaaatgttttactcattcttcaaatcttcttgtgcatcagagaattcatactggagagaaaccttacaaatgtaaagaatgtggtaaatcatttaaagtgtcttcagcccttactcagcatgagagaattcatactggagagaaaccctataaatgtaaggaatgcagcaaagcctttaactgtaggtcgtacctaactaaacatcagagaattcataccggagaaaaactttacaaatgtaaatcatgtagcaaatctttttctcgttcctcaagtcttattgtccaccagagaattcatactggagaaaaaccctataaatgcaaagaatgtggcaaagcctttaattgtagttcacgccttactcaacatcaaagaattcataccggagagaaaccctacatatgtaaagaatgtggcaaagcctttaactgtagttcatcccttactaaacatcagagaattcatactggagtaaaactttacaaatgtaaagcatgtagcaaatctttctctcattcctcatgtctttctgtgcatcagataactcatactggaatgaaaccatatatatgtaaggattgtggcatctcctttaaccggtcttcaaaccttagacgacatcagatgattcatactggagagaaaccctacaaatgtaaagaatgtggcaaattatttaatcgatgctcaacccttactcgacataaaagtattcatactagagaatttctatagttgtagtaaatgtgaaaagagttttatccaaaatttagaacttaaaaatcaccatagagtttatagggaaaccgactttacagattgaataaatgggaggaagtatttaatcagaactcaaatctgaatgtgtcaggacttacacaaaaaaggactaaagcacagatccccactttaaaattaaataagagtatttgttatggaggattactctaaagccaaagcagttacttattttgttatgtgtttcaaatgagcaaaagcattgatgtttggacaagtaattattcagtgagcatgttatttgtattgaaaacatttgaaatttgtataaagcaaatcataatttaattctcagattagttgttatacctt

SEQ ID NO: 203643 - DNA, 791 bp, Homo sapiens
  Payload ID: 20156
  Gene Name: zinc finger protein 720
  ENST ID: ENST00000534369
  CDS Start-End: 157-513
agagctcagtctcttcaccaggggctcccagtccttccatctgggaggccaaggcggcttcgcgttctgagaatagacagaacctctgttactctgtgaccggcaggcaccgggagatccgtagctcagacgccaggacatcccggaagctgggaaatggtctcctttacagaaaggggcttggataaggaggaaagaccatcagaagaaaagataagacactctcttctcattccagtaagagccacatgcaaggcaagaatcagagtccagctcagatgggggaactctaggaagagagaaatccattccatggacagctgccaagatagagcaggacagcatcaaggacatgagccaaaagtgcaaaaggactgcttgactttggaaaagaaaccaaaggcctctgacactgtacacatcagtgaaatgaggagacccatgatgcctgctgtgggggacccccagaggcccacaccgggcacagcgagcggcccagatctcagtctctaggagaccacccactaccacttcagaaaagcctggtgacctctctgcacactccatctgaagccatttatcacaacacagcccaggtgtgggaacagtaggcctattctctgctgacctgggagcagctgtctgagctcacctggctccaggggcctctgtgctgtggtacaaacctgtgccatggccacccaggtggcctatgtctttcgcactgagggctggctcatcccagccatactccctggtccctagggtggagaagctcagaactcctccta

SEQ ID NO: 203644 - DNA, 5994 bp, Homo sapiens
  Payload ID: 20156
  Gene Name: zinc finger protein 720
  ENST ID: ENST00000534277
  CDS Start-End: 189-347
ggatttggcggtggcctttgttggctgcagtaagagctcagtctcttcaccaggggctcccagtccttccatctgggaggccaaggcggcttcgcgttctgagaatagacagaacctctgttactctgtgaccggcaggcaccgggagatccgtagctcagacgccaggacatcccggaagctgggaaatggtgaatgtgccagggactgttgacattcagggatgtggccatagaattctctcgggaggagtgggaacacctggactcagatcagaagcttttatatggggatgtgatgttagagaactacggaaacctggtctctctgggtctcgctgtctctaagccggacctgatcacctttttggagcaaaggaaagagccctggaatgtgaagagtgcagagacagtagccatccagccagatatcttttctcatgatactcaaggcctcttaagaaagaagcttatagaagcatcattccaaaaagtgatattggatggatatgggagctgtggccctcagaatttaaacttaaggaaagagtgggaaagtgaggagaaaaatcagtacaataaatctgatacaacattaagccaaggcataagccccagaagacatcagaaaactcattttctacataaccattgcaaacgtaaaaaatgtgagaaagcctttcatgaatgcaccaaccatgtccatcagagtatctttattcaagagaagtctgccaaatgtaataagtgtatagaaacttttatccagtcatcaaaacatactcagcctcagagaatccatattggagaaaagtcacacagatgtaataatggtgagaaaatccttagtaaattgtcaagtctaagaaaacataagataatccataatgaagagaaaccttacaaatgtaaagaatgtgacaaagcctttaaccatcgttcacaccttactcaacatcaaataattcatactggagagaaaccatacaaatgtaaagaatgtggcaaagccttcaattctagttcatattttactagacatcagagaattcacactggagaaaaactttacaaatgtaaagcgtgtagcaaatgttttactcattcttcaaatcttcttgtgcatcagagaattcatactggagagaaaccttacaaatgtaaagaatgtggtaaatcatttaaagtgtcttcagcccttactcagcatgagagaattcatactggagagaaaccctataaatgtaaggaatgcagcaaagcctttaactgtaggtcgtacctaactaaacatcagagaattcataccggagaaaaactttacaaatgtaaatcatgtagcaaatctttttctcgttcctcaagtcttattgtccaccagagaattcatactggagaaaaaccctataaatgcaaagaatgtggcaaagcctttaattgtagttcacgccttactcaacatcaaagaattcataccggagagaaaccctacatatgtaaagaatgtggcaaagcctttaactgtagttcatcccttactaaacatcagagaattcatactggagtaaaactttacaaatgtaaagcatgtagcaaatctttctctcattcctcatgtctttctgtgcatcagataactcatactggaatgaaaccatatatatgtaaggattgtggcatctcctttaaccggtcttcaaaccttagacgacatcagatgattcatactggagagaaaccctacaaatgtaaagaatgtggcaaattatttaatcgatgctcaacccttactcgacataaaagtattcatactagagaatttctatagttgtagtaaatgtgaaaagagttttatccaaaatttagaacttaaaaatcaccatagagtttatagggaaaccgactttacagattgaataaatgggaggaagtatttaatcagaactcaaatctgaatgtgtcaggacttacacaaaaaaggactaaagcacagatccccactttaaaattaaataagagtatttgttatggaggattactctaaagccaaagcagttacttattttgttatgtgtttcaaatgagcaaaagcattgatgtttggacaagtaattattcagtgagcatgttatttgtattgaaaacatttgaaatttgtataaagcaaatcataatttaattctcagattagttgttataccttaatgcctagtgtttatataaaaacatatagtctattttttctgcatcagagctgtaagaggtcgttctatagtaggtgaacatcattaatatcaacttattttcttggaaatttaatggcaaatgtaaaatacatgaagaaaatctaaaagaggctctttgtgtttgaatcattaaacagtaatatgtgtaaacatatagtacatatttagggcattagtattctatactaaagtaaaagaggaatattctgaatttatttattacatcaattgctccttaagtagaaaaacactggtcagttatttaaaatactggcatacctttatagtacaatgaagtagtaatcttgaatattatttgatgtgttaaaaataaaaacatcttcacagatatcagagaaaagtgaaaactcatatctgaaagattataaatatactttatatcaattttccagagaacttaaacttctaataatattggtaatattctcatggttactattttatattctttcctgctttttgtagctactggtgtactatgacagttataataaagattatatgggggtatacttaaatgccatacttttaaaatcctgaatcattgtttataaagttttattcaatatttttctttgcacatgccctttttcagtccaattgaacacttagagatttttctttgctttcacttgcattaaatggaatatacagatgtactaagatagaaagaaaaaggtgaaagagaactatacaggcagaaatgcatgtgtgtgtacctgtcttcaaatggaaaagaaaatgatggatcacaacaggaaactggagaactgttgatttattacagttctcaaattagaaacctcccaaattcttaaagctaaattagcttttcattgcacactgaatttttctctgataaatctaatgtcttctgggttcagactttatcccgtacaaatccttttttcttgcctgtgattcatgtgagaagaattatataattttcttatttcaaagcttataaactattacttataagttctcatggattttaagaatgtttttgtaaaatttaatggtgctgtccaggtgtggtggctcacgccggtaatcccagcatttcgggaggctgaggcaggaggatcatttgaggtcaggagtttgagaccagcctggccaacatggtgatatctcgtctctactgaaaatacaaaaattagctggatgtggtggcacacacctgtaatcccagttactcaggaggcaaaggcaggagagttgcttgaactgaggagatgaaggttacagtgagccaagtttgtgcctcacactccagcctgggtaacagagtgagactctgtctataaacaaacaaattatctgtcatctacctatagacataaccctactgaggaggatggggataaaaggtctgcatctaagtcactttgaaaaacagtattttgattgaatgctgtaagactacacaaatgctgtattctactgagtaatattttattttcctacaaggatatgcattagcaattctgaaacagttttacatgttattatataatatatggaggctgtttctcagtgtagttcacaaaagttaaatggtgaatgctagcatgaatcttgtggtcctagcccaaagttggaaatatcaggatgaacccatgactaatacatctggatggatggatggatgaatagatataaagataggtaggtaggtaggtaggtaggtagatagatagatagatagatagatagatagatagatagatagatgaagcgatgtctaagatatctggaaggatggatggatggatggatggatagttagatagatagatagatagatagatacatagatagacgattcagagatagataatgttccaaactcttgagggccaagaactggtgacatcttgtatcaacacatctaggtctacaatcttggtttctaaacaacattcattaaaaggacccaagggttgaagttagaaaatacaagttgagctagagtatcttgtaaagccacaaagaaaaaagtgcttaataaaaatgatggggacttttcaaagggagccaacctgaaagacctcccaatggtccaagctccaacaatatgagcaataagttatgatagctttggattatggcccacagaataaagtaatactcatctctactgtgtgaataaaagagattaaataaggaaagaaggaatgaaatctacaatatttaaaatacagatcaatgtagttggataatgcaaaataaatcaacactagaacatcacagtaataattaccatagggaagattccccgaggaattcaaaaatttcaggaaaaacttaaacactaaagagtgtatttgggccagtctcggtggcacatgcctgtaatcctagcactttgggaggcctctgcgggtggatcacctgaggtcaggagttcaagaccagcctagccaacatggtgaaaccccgtctctattaaaaatgaaaaaattagtcgggcatggtggtgggtacctataatcccagctacttgggaggctgaagcaggagagtcacttgaacctgggaagcagaagttgttttgagccaagatcatgccattgcactccagcctgggcgacaagagcagaactctgtctcaaaaaaaaaaaaagaaaagaaaagtgtatttgcatattttaagtatctaccatctaatatttattaatacaattttttcttaatttcttagacttgtgactatttgaaacaaattataacactgtattgtaggatttataatttgtagttgtaaaatttataacacatggaataagaagataaatggaactgttctgtagcaaatttttcatgttttatatttaagacagtatagtattaactctaaaagtatggtggatatgttaaagattcatattgtattccctgcagcaaccactaaaaaatgcaaagaagtgtaatgtaaatgctaaaaaaggagataattataaaatatttatttgcacaatatttatgtatcttttagtcataatagcccaaaacaggaaacaaccaaaatgtccattaataagaaaatgaactaattgtatagcttttagaacaaaatacagctcaggaatatgaaaaaccaagcacacatcctggataaaattcataaacctgctcaatgagagaaaagttggacacaaaattgtactttatgtattttgtattttattccaggcaaaataatcctatggtgaaaaaaatcaacaagataatctctgcttgagaaaaaggaccaaagacaagtgaattttctgagggtgatgaaagtgttgcttcgaaaaggggtgaagtttatatgggtctatttatttgtctaacatgtacagttaaggtttatgccttgcaatgtatgtacatcttcacaaaaaaaatcttaaaaaaattaaatgggtgggggtagggaaagggttgaagtatagatgaagcagaagtggtacatgattagtagttgaagctgggggcaggtctatatattttatttttatgtctttaatagcatttgtataaatgtacaatattcgtttacaatgttagctcaggatcttgtttacctttggacagggagggagggagaaatttattttctgggtaggagtaaagctggttctattcctcagttatgtaaattatctgttataatccaaaaagctttacatgaatgtttctgtatgtaatgtggtatatcaataaaaaattaaatatta

SEQ ID NO: 203645 - DNA, 570 bp, Homo sapiens
  Payload ID: 20156
  Gene Name: zinc finger protein 720
  ENST ID: ENST00000530881
  CDS Start-End: 131-570
cccagtccttccatctgggaggccaaggcggcttcgcgttctgagaatagacagaacctctgttactctgtgaccggcaggcaccgggagatccgtagctcagacgccaggacatcccggaagctgggaaatggtgaatgtgccaggtcgggggtccccagaagagggagaggggcggtcggaagcggcgggaaccctctttgaggtcactgaacatctgactggctgggcacctgctcctgtcccttcagttgagggactgttgacattcagggatgtggccatagaattctctcgggaggagtgggaacacctggactcagatcagaagcttttatatggggatgtgatgttagagaactacggaaacctggtctctctgggtctcgctgtctctaagccggacctgatcacctttttggagcaaaggaaagagccctggaatgtgaagagtgcagagacagtagccatccagccagatatcttttctcatgatactcaaggcctcttaagaaagaagcttatagaagcatcattccaaaaagtgatattggatggatatgggagctg

SEQ ID NO: 203646 - DNA, 518 bp, Homo sapiens
  Payload ID: 20156
  Gene Name: zinc finger protein 720
  ENST ID: ENST00000529515
  CDS Start-End: 128-518
agtccttccatctgggaggccaaggcggcttcgcgttctgagaatagacagaacctctgttactctgtgaccggcaggcaccgggagatccgtagctcagacgccaggacatcccggaagctgggaaatgggactgttgacattcagggatgtggccatagaattctctcgggaggagtgggaacacctggactcagatcagaagcttttatatggggatgtgatgttagagaactacggaaacctggtctctctgggtctcgctgtctctaagccggacctgatcacctttttggagcaaaggaaagagccctggaatgtgaagagtgcagagacagtagccatccagccagatatcttttctcatgatactcaaggcctcttaagaaagaagcttatagaagcatcattccaaaaagtgatattggatggatatgggagctgtggccctcagaatttaaacttaaggaaagagtgggaaagtgaggagaaaaatcagtacaataaatctgatacaa

SEQ ID NO: 203647 - DNA, 837 bp, Homo sapiens
  Payload ID: 20156
  Gene Name: zinc finger protein 720
  ENST ID: ENST00000539915
  CDS Start-End: 202-372
ggggcggcttccgggatttggcggtggcctttgttggctgcagtaagagctcagtctcttcaccaggggctcccagtccttccatctgggaggccaaggcggcttcgcgttctgagaatagacagaacctctgttactctgtgaccggcaggcaccgggagatccgtagctcagacgccaggacatcccggaagctgggaaatggtgaatgtgccagatatcttttctcatgatactcaaggcctcttaagaaagaagcttatagaagcatcattccaaaaagtgatattggatggatatgggagctgtggccctcagaatttaaacttaaggaaagagtgggaaagtgagggcaaaataatcctatggtgaaaaaaatcaacaagataatctctgcttgagaaaaaggaccaaagacaagtgaattttctgagggtgatgaaagtgttgcttcgaaaaggggtgaagtttatatgggtctatttatttgtctaacatgtacagttaaggtttatgccttgcaatgtatgtacatcttcacaaaaaaaatcttaaaaaaattaaatgggtgggggtagggaaagggttgaagtatagatgaagcagaagtggtacatgattagtagttgaagctgggggcaggtctatatattttatttttatgtctttaatagcatttgtataaatgtacaatattcgtttacaatgttagctcaggatcttgtttacctttggacagggagggagggagaaatttattttctgggtaggagtaaagctggttctattcctcagttatgtaaattatctgttataatccaaaaagctttacatgaa

SEQ ID NO: 203648 - DNA, 1339 bp, Homo sapiens
  Payload ID: 20156
  Gene Name: zinc finger protein 720
  Uniprot ID: Q7Z2F6
  ENST ID: ENST00000398696
  CDS Start-End: 161-697
agtaagagctcagtctcttcaccaggggctcccagtccttccatctgggaggccaaggcggcttcgcgttctgagaatagacagaacctctgttactctgtgaccggcaggcaccgggagatccgtagctcagacgccaggacatcccggaagctgggaaatggtgaatgtgccagatatcttttctcatgatactcaaggcctcttaagaaagaagcttatagaagcatcattccaaaaagtgatattggatggatatgggagctgtggccctcagaatttaaacttaaggaaagagtgggaaagtgagggtaagtgtgaaggtcacaatggatattatgatggacatacaaaatgtaagacaactacctataacaaaaacctcactgttacaggaggtcaaaaacatgaaaaaactcaatttatgtcagttgctttttctaaaccatgtgtttctgtaagtaagtgtcaacatcaatttttgaaacttaccttttcttttaaaggaaatttggataatccgaatagtgacttagtccatgtttcaaataatcatttaaaccaattaaaatatagaactggagtaaatgttcagtcaaatatttctgaaaaggagagatttaaaaacgaggaggtgatttctaaatatgatcaatttgatggatctttgttaaaagtttgtttcaccaacaaataacacctcgttctgcctgtgatcaatatagaaaggtcttcattcattcatcattgcttaatcaatgtcaaggaatagataatttgggaaaatatcacacacataataaaactttgacagcctttaggcaggactataccctaaataattaccagtatatttgtgttgcagagaaaaatcagtacaataaatctgatacaacattaagccaaggcataagccccagaagacatcagaaaactcattttctacataaccattgcaaacgtaaaaaatgtgagaaagcctttcatgaatgcaccaaccatgtccatcagagtatctttattcaagagaagtctgccaaatgtaataagtgtatagaaacttttatccagtcatcaaaacatactcagcctcagagaatccatattggagaaaagtcacacagatgtaataatggtgagaaaatccttagtaaattgtcaagtctaagaaaacataagataatccataatgaagagaaaccttacaaatgtaaagaatgtgacaaagcctttaaccatcgttcacaccttactcaacatcaaataattcatactggagagaaaccatacaaatgtaaagaatgtggcaaagccttcaattctagttcatattttacta

SEQ ID NO: 203649 - DNA, 1214 bp, Homo sapiens
  Payload ID: 20156
  Gene Name: zinc finger protein 720
  ENST ID: ENST00000529943
  CDS Start-End: 205-363
gcaggggcggcttccgggatttggcggtggcctttgttggctgcagtaagagctcagtctcttcaccaggggctcccagtccttccatctgggaggccaaggcggcttcgcgttctgagaatagacagaacctctgttactctgtgaccggcaggcaccgggagatccgtagctcagacgccaggacatcccggaagctgggaaatggtgaatgtgccagggactgttgacattcagggatgtggccatagaattctctcgggaggagtgggaacacctggactcagatcagaagcttttatatggggatgtgatgttagagaactacggaaacctggtctctctgggtctcgctgtctctaagccggacctgatcacctttttggagcaaaggaaagagccctggaatgtgaagagtgcagagacagtagccatccagccagatatcttttctcatgatactcaaggcctcttaagaaagaagcttatagaagcatcattccaaaaagtgatattggatggatatgggagctgtggccctcagaatttaaacttaaggaaagagtgggaaagtgagggtaagtgtgaaggtcacaatggatattatgatggacatacaaaatgtaagacaactacctataacaaaaacctcactgttacaggaggtcaaaaacatgaaaaaactcaatttatgtcagttgctttttctaaaccatgtgtttctgtaagtaagtgtcaacatcaatttttgaaacttaccttttcttttaaaggaaatttggataatccgaatagtgacttagtccatgtttcaaataatcatttaaaccaattaaaatatagaactggagtaaatgttcagtcaaatatttctgaaaaggagagatttaaaaacgaggaggtgatttctaaatatgatcaatttgatggatctttgttaaaagtttgtttcaccaacaaataacacctcgttctgcctgtgatcaatatagaaaggtcttcattcattcatcattgcttaatcaatgtcaaggaatagataatttgggaaaatatcacacacataataaaactttgacagcctttaggcaggactataccctaaataattaccagtatatttgtgttgcagagaaaaatcagtacaataaatctgatacaacattaagccaaggcataagccccagaagacatcagaaaactcattttctaca

SEQ ID NO: 203650 - DNA, 4492 bp, Homo sapiens
  Payload ID: 20157
  Gene Name: zinc finger protein 721
  Uniprot ID: Q8TF20
  ENST ID: ENST00000338977
  CDS Start-End: 50-2785
ggggccgtcttcccggcgagtccgcgacggtcgccgcccacggcgagctatgtgttctcatttcacccaagactttttgccagtgcaggggatagaagattcattccacaaacttatactgagaagatatgagaaatgtgggcatgataatttacaattaaggaaaggctgtaaaagtatgaacgtgtgtaaagtgcagaagggagtttataatggaattaataaatgcttgtcaaatactcagagcaaaatatttcaatgtaatgcacgtgtcaaagtttttagtaaatttgcaaattcaaacaaagataagacaagacatactggagagaaacactttaaatgtaacgaatgtggcaagtcatttcagaagttctcagacctaactcaacataaaggaattcatgctggagagaaaccctacacttgtgaagaacgtggcaaagactttggatggtacacagacctgaatcaacacaagaaaattcatactggagagaaaccttacaaatgtgaagaatgtggcaaagcctttaataggtcaacaaaccttactgcacataagagaattcacaacagagagaaagcttacacaggtgaagatcgtgacagagcctttggatggtccacaaacctgaatgaatataagaaaattcatactggagataaaccctacaaatgtaaagaatgtgggaaagcctttatgcattcctcacacctgaataaacatgagaaaattcatactggagagaaaccctacaaatgtaaggaatgtggcaaagtcatttcctcatcctcaagctttgctaaacataagaggattcatactggcgagaaaccctttaaatgtttagaatgtggtaaagcctttaatatttccacaacccttactaaacataggagaattcatactggagagaaaccctacacatgtgaagtatgtggcaaagcctttagacagtccgcaaacctttatgtacataggagaattcatactggagagaaaccctacacatgtggagaatgtggcaaaacctttagacagtccgcaaacctttacgtacataggagaattcatactggagagaaaccttacaaatgcgaagactgtggcaaagcctttggacggtacacagccctgaatcaacacaagaaaattcatactggagagaaaccttacaaatgtgaagagtgtggcaaagcctttaatagttcaacaaaccttactgcacataagagaattcacaccagagagaaaccctacacatgtgaagatcgtggcagagcctttggattgtccacaaacctgaatgaatataagaaaattcatactggagataaaccctacaaatgtaaagaatgtgggaaagcctttatacattccttgcacctgaataaacatgagaaaattcatactggaaagaaaccctacaaatgtaagcaatgtggcaaagtcattacctcatcctcaagctttgctaaacataagaggattcatactggcgagaaaccctttgaatgtttagaatgtggtaaagcgtttactagttccacaacccttactaaacataggagaattcatactggagagaaaccctacacatgtgaagtatgtggcaaagcctttagacagtccgcaatcctttatgtacataggagaattcatactggagagaaaccctacacatgtgaagaatgtggcaaaacctttagacagtccgcaaacctttatgtacataggagaattcatactggagagaaaccttacaaatgtgaagagtgtggcaaagcctttggacggtacacagacctgaatcaacacaagaaaattcatactggagagaaactttacaaatgtgaagagtgtggcaaagactttgtatggtacacggacctgaatcaacagaagaaaatttacactggggagaaaccttacaaatgtgaagagtgtggcaaagcctttgccccatcaacagacctgaatcaacacacgaaaattcttactggagagcaaagttacaaatgtgaagagtgtggcaaagcctttggatggtccatagccctgaatcaacacaagaaaattcatactggagaaaaaccttacaaatgtgaagagtgtggcaaagcctttagtaggtcaagaaaccttactacacataggagagttcacactagggagaaaccctacaaatgtgaagatcgtggcagatcctttggatggtccacaaacctgaacgaatataagaaaattcatactggagataaactctacaaatgtaaagaatgtgggaaagtgtttaaacagtcctcacacctgaatagacatgagaaaattcatactggaaagaaaccctacaaatgtaaggaatgtggcaaagtcattacgtcatcctcaagctttgctaaacataagaggattcatacaggtgagaaaccctttaaatgtttagaatgtggtaaagcgtttactagttccacaacccttactaaacataggagaattcatactggagagaaaccctacacatgtgaagaatgtggcaaagcctttagacagtcagcaatcctttatgtacataggagaattcatactggagagaaaccctacacatgtggagaatgtggcaaaacctttagacagtctgcaaatctttatgcgcataagaaaattcatactggagagaaaccctacacgtgtggagactgtggcaaaacctttagacagtctgcaaatctttatgcacataagaaaattcatactggagataaaaccatacaagtgtaaagaatgtggcaaagcctttaagtcatactacagcattcttaaacataagagaactcataccaggggaatgtcttacgaaggtgacgaatgtcgcggtctttaaatgctcctcaatcctttctaatcataagataattcataatgaagagaaactctaaaatgtgaaaaatgtgagaaggcttttaatcacacctcaatctgttgtagacataagagtaattatattgatgagaagccaaattaaaattaaaaatgtggcaaagacttccaattctagtcagttcttaatgtaattcctactgaagaaaacacctggaaatacaaaaaatgtggcaaaacttgtaaccaatgcttagcatttttgcacatgatagtatttatatgtgagactacttgtacaaacataaaaatatacaaaagctattgtctacttgaaatttatagttaataaaagcattataaatgtaatttctgttgaaagaccttttagaaaatataggccattaaagtgaagaatagtcttaagacagagaatacaaagataaagagggctctagtacctgtacttgtatcccagaacttactatatgcattttgtactagaggaaaactctgaagcagttgcttaaactttgttcaacatcagagaatttatattggagagaaatcctacaaatgtaataaatgtggaaaaacctctgttcagaaactgcaggttaagaaaccagaggccaggcgcggtggctcacgcctgtaatcccaacactttgggaggccaaggagggtggatcacctgaggtcgggagttcaaggacagcctgaccaatatggagaaacctcgtctgtactaaaaatacaaaaattagcaggacatggtggtgcatggctgtaatcccagctactcaggaggctgagacaggagaatggcttgaacccaggaggtggaggttgcggtgagctgagatcgtgccattgcactccagcctgggtaacaagagtgaaactctgtctcaaaacaagataaaaagaaaagaaacaccagagaatttttactagaatataatttgtaggtgcagtaaatgtgaagaaatatttaggctaaaattaagactatgtaaacatcagaggatttacagtagaaagaactaaggaactaacacttcagactttaaaataaatcagagtattaagtataacaaaagttgaacctgttagaaaatttccttgtatataagttgaaaagtaggtttttgaagagatatattcgaaatatattttttcacttgaaaaaagtaaaaatttttttcaaaagcaaataattcaactctaaaattatactatttcaacattctcatttatgtgaaagcatgtgataaattgttgctgcgtcagagatatgagaaactcctttgcattaggtgggcattattcatagacttctacatgaaagagaagagaaataaaagatgcaccaggaaaatctgagcagagaggcttttagtggttgacttactgagtgatgcctgaagtaggtgttcagagtaatactttgcgttatactgagagagaatctgaattttagtagtaaattgttttgccaactgtatatttatgtaataagtgcaataaaatgcagtaaattttaaaattctcttaagataatgtgtgaacttaatttttgaaataaaaattgttattgtgttaaaa

SEQ ID NO: 203651 - DNA, 664 bp, Homo sapiens
  Payload ID: 20157
  Gene Name: zinc finger protein 721
  ENST ID: ENST00000505900
  CDS Start-End: 185-664
ccgggatcttcggcggccttggcctgttgcttcagcctgagctcggttagggcctcacttccctgcttccacacctcagggaggcctcggtgattttgccagagcctcagcctccatcgctctgtaacctgcgggtattggatgattcgtagctaagacttcgcgacacccttgaagctgagaaatggaacccttaacattcagggatgtggccatagaattctctccagaagagtggaaatgcctggaccctgcccagcagaatttgtatagagatgtgatgttggagaactacagaaacctggtctccctagctatgtgttctcatttcacccaagactttttgccagtgcaggggatagaagattcattccacaaacttatactgagaagatatgagaaatgtgggcatgataatttacaattaaggaaaggctgtaaaagtatgaacgtgtgtaaagtgcagaagggagtttataatggaattaataaatgcttgtcaaatactcagagcaaaatatttcaatgtaatgcacgtgtcaaagtttttagtaaatttgcaaattcaaacaaagataagacaagacatactggagagaaacactttaaatgtaacgaatgtggcaagtcatttcagaagttctcagacctaactcaacataaa

SEQ ID NO: 203652 - DNA, 935 bp, Homo sapiens
  Payload ID: 20157
  Gene Name: zinc finger protein 721
  ENST ID: ENST00000506646
  CDS Start-End: 160-558
gttgcttcagcctgagctcggttagggcctcacttccctgcttccacacctcagggaggcctcggtgattttgccagagcctcagcctccatcgctctgtaacctgcgggtattggatgattcgtagctaagacttcgcgacacccttgaagctgagaaatggaacccttaacattcagggatgtggccatagaattctctccagaagagtggaaatgcctggaccctgcccagcagaatttgtatagagatgtgatgttggagaactacagaaacctggtctccctagctatgtgttctcatttcacccaagactttttgccagtgcaggggatagaagattcattccacaaacttatactgagaagatatgagaaattttcctcgctgatctcttcatgccgtgtaatttcacatggactttcaagaggaaggaacagagccacagagaaaaatgacttgctcacaacagaagagccagtagtaaaacacaggtttgacttgcagtatccagaggaaatgtggagaaacacagttgtacagaagggaagaaaataggttgatactcctgttgcaggaccatttgaagtctgagagtttccaggatatgtcgttattgatccagctcaactttatgtatatgagaaacttggacagtctggacaatagaataaatgaagtcaataaaaccattcttttaacaaacttaataccataccttcagagtgttattttcctttttgtcataaggtgtctggaaatgaagtatggaaatgaaatcatgaataaagacccagttttcagaatctctccacgaagtagaggaactcataccaatccagaagagcctgaagaagatgttcaagctgaaagagtccaagcagcaaatgcactcactactccaaacttggaggaggaaccagtcataactgcaa

SEQ ID NO: 203653 - DNA, 2966 bp, Homo sapiens
  Payload ID: 20157
  Gene Name: zinc finger protein 721
  Uniprot ID: Q8TF20
  ENST ID: ENST00000511833
  CDS Start-End: 195-2966
acagcggggcgtcacctcggacatacgaacagcgggcggtgttcccggctccgtggggccgtcttcccggcgagtccgcgacggtcgccgcccacggcgaggaacccttaacattcagggatgtggccatagaattctctccagaagagtggaaatgcctggaccctgcccagcagaatttgtatagagatgtgatgttggagaactacagaaacctggtctccctagctatgtgttctcatttcacccaagactttttgccagtgcaggggatagaagattcattccacaaacttatactgagaagatatgagaaatgtgggcatgataatttacaattaaggaaaggctgtaaaagtatgaacgtgtgtaaagtgcagaagggagtttataatggaattaataaatgcttgtcaaatactcagagcaaaatatttcaatgtaatgcacgtgtcaaagtttttagtaaatttgcaaattcaaacaaagataagacaagacatactggagagaaacactttaaatgtaacgaatgtggcaagtcatttcagaagttctcagacctaactcaacataaaggaattcatgctggagagaaaccctacacttgtgaagaacgtggcaaagactttggatggtacacagacctgaatcaacacaagaaaattcatactggagagaaaccttacaaatgtgaagaatgtggcaaagcctttaataggtcaacaaaccttactgcacataagagaattcacaacagagagaaagcttacacaggtgaagatcgtgacagagcctttggatggtccacaaacctgaatgaatataagaaaattcatactggagataaaccctacaaatgtaaagaatgtgggaaagcctttatgcattcctcacacctgaataaacatgagaaaattcatactggagagaaaccctacaaatgtaaggaatgtggcaaagtcatttcctcatcctcaagctttgctaaacataagaggattcatactggcgagaaaccctttaaatgtttagaatgtggtaaagcctttaatatttccacaacccttactaaacataggagaattcatactggagagaaaccctacacatgtgaagtatgtggcaaagcctttagacagtccgcaaacctttatgtacataggagaattcatactggagagaaaccctacacatgtggagaatgtggcaaaacctttagacagtccgcaaacctttacgtacataggagaattcatactggagagaaaccttacaaatgcgaagactgtggcaaagcctttggacggtacacagccctgaatcaacacaagaaaattcatactggagagaaaccttacaaatgtgaagagtgtggcaaagcctttaatagttcaacaaaccttactgcacataagagaattcacaccagagagaaaccctacacatgtgaagatcgtggcagagcctttggattgtccacaaacctgaatgaatataagaaaattcatactggagataaaccctacaaatgtaaagaatgtgggaaagcctttatacattccttgcacctgaataaacatgagaaaattcatactggaaagaaaccctacaaatgtaagcaatgtggcaaagtcattacctcatcctcaagctttgctaaacataagaggattcatactggcgagaaaccctttgaatgtttagaatgtggtaaagcgtttactagttccacaacccttactaaacataggagaattcatactggagagaaaccctacacatgtgaagtatgtggcaaagcctttagacagtccgcaatcctttatgtacataggagaattcatactggagagaaaccctacacatgtgaagaatgtggcaaaacctttagacagtccgcaaacctttatgtacataggagaattcatactggagagaaaccttacaaatgtgaagagtgtggcaaagcctttggacggtacacagacctgaatcaacacaagaaaattcatactggagagaaactttacaaatgtgaagagtgtggcaaagactttgtatggtacacggacctgaatcaacagaagaaaatttacactggggagaaaccttacaaatgtgaagagtgtggcaaagcctttgccccatcaacagacctgaatcaacacacgaaaattcttactggagagcaaagttacaaatgtgaagagtgtggcaaagcctttggatggtccatagccctgaatcaacacaagaaaattcatactggagaaaaaccttacaaatgtgaagagtgtggcaaagcctttagtaggtcaagaaaccttactacacataggagagttcacactagggagaaaccctacaaatgtgaagatcgtggcagatcctttggatggtccacaaacctgaacgaatataagaaaattcatactggagataaactctacaaatgtaaagaatgtgggaaagtgtttaaacagtcctcacacctgaatagacatgagaaaattcatactggaaagaaaccctacaaatgtaaggaatgtggcaaagtcattacgtcatcctcaagctttgctaaacataagaggattcatacaggtgagaaaccctttaaatgtttagaatgtggtaaagcgtttactagttccacaacccttactaaacataggagaattcatactggagagaaaccctacacatgtgaagaatgtggcaaagcctttagacagtcagcaatcctttatgtacataggagaattcatactggagagaaaccctacacatgtggagaatgtggcaaaacctttagacagtctgcaaatctttatgcgcataagaaaattcatactggagagaaaccctacacgtgtggagactgtggcaaaacctttagacagtctgcaaatctttatgcacataagaaaattcatactggagataaaaccatacaagtgtaa

SEQ ID NO: 203654 - DNA, 1679 bp, Homo sapiens
  Payload ID: 20157
  Gene Name: zinc finger protein 721
  ENST ID: ENST00000515578
  CDS Start-End: 69-254
tcgctctgtaacctgcgggtattggatgattcgtagctaagacttcgcgacacccttgaagctgagaaatggaacccttaacattcagggatgtggccatagaattctctccagaagagtggaaatgcctggaccctgcccagcagaatttgtatagagatgtgatgttggagaactacagaaacctggtctccctagaggaaggaacagagccacagagaaaaatgacttgctcacaacagaagagccagtagtaaaacacaggtttgacttgcagtatccagaggaaatgtggagaaacacagttgtacagaagggaagaaaataggttgatactcctgttgcaggaccatttgaagtctgagagtttccaggatatgtcgttattgatccagctcaactttatgtatatgagaaacttggacagtctggacaatagaataaatgaagtcaataaaaccattcttttaacaaacttaataccataccttcagagtgttattttcctttttgtcataaggtgtctggaaatgaagtatggaaatgaaatcatgaataaagacccagttttcagaatctctccacgaagtagaggaactcataccaatccagaagagcctgaagaagatgttcaagctgaaagagtccaagcagcaaatgcactcactactccaaacttggaggaggaaccagtcataactgcaagctgtttacacaaggaatattatgagacaaagaaagttgcttttcaacaacaaagaagaaagcagccatcagaaatgtttcgttttgtgttaaaaagtgaagttttgggattactaggacacaatggagctggcaaaagtacttccattaaaatgataactgggtgcacagtgccaactgcaggagtggtggtgttacaaggcaacagagcatcagtaaggcaacagcgtgacaacagcctcaagttcttgggtactgccctcaggagaactcactgtgtcccaaacttacaatgaaagagcatttggagttgtatgcagccgtgaaaggactgggcaaagatgctgctcttagtatttcatgattggtggaagctctcaagctccaggagcaacttaaggctcccgtgaaaactctatcagagggaataaagagaaagctatgcttcgtgctgagcatactggggaacccatcagtggtgcttctagacgagctgttcaccgggatggaccctgaggggcagcagcaaatgtggcagatacttcaggctaccattaaaaaccaggagaggggcgccctcttgaccacccattacatgtcagaggctaagtctctgtgtgaccgtgtggccatcatggtgtcaggaacgctaaggtgtattggttccattcaacagctgaaaagtttggtaaagattatttactagaaataaaaatgaaagaacctactcaggtggaagctctccacacagagattttgaagcttttcccacaggctgcttggcaggaaagatattcctctttaatggcatgtaagttacctgtggaggatgtccaccctctgtctcaggcctttttcaaattaaaggcagtgaaacagaccttcaacctggaggaatacagcctctctcaggctaccttggagcaggtgttcttagaactctgtaaagagcaggcgctgggaaatgttgatga

SEQ ID NO: 203655 - DNA, 2764 bp, Homo sapiens
  Payload ID: 20158
  Gene Name: zinc finger protein 724, pseudogene
  Uniprot ID: A8MTY0
  ENST ID: ENST00000418100
  CDS Start-End: 119-1978
ctcgtcttccctgctttgtgtcccctgctcttagaggcccagcctctgtggccctctgacctgcaagcattgggagatccacagctaagacgccagggcctcccctggaagcctagaaatgggaccattgacatttatggatgtggccatagaattctctgtggaggagtggcaatgcctggacactgcacagcagaatttatataggaacgtgatgttagagaactacagaaacctggtcttcctgggtattgctgtctctaagccagacctgatcacctgtctggagcaaggcaaagagccctggaatatggagagacatgagatggtggccaaacccccaggtatgtgttgttattttgcccaagaccttcggccagagcagagcataaaagcttctttgcaaagaataatactgagaaaatatgaaaaatgtggacatcacaatttacagttaaaaaaaggctataaaagtgtggatgagtacaaggtgcacaaaggaagttataatggatttaaccagtgtttgacaactacccagagcaaaatatttcagtgtgataaatatgtgaaagactttcataaattttcaaattcaaatagacataagactgaaaagaatcctttcaaatgtaaagaatgtggcaagtcattttgtgttctttcacacctaactcaacataaaagaattcacactactgtcaattcctacaaacttgaagaatgtggcaaggcctttaatgtgtcctcaaccctttctcaacataagagaattcatacaggacaaaaacactacaaatgtgaagaatgtggcatagcctttaacaagtcctcacaccttaacacacataagataattcatactggagagaaatcctacaaacgtgaagaatgtggaaaagcttttaacatatcctcacaccttactacacataagataattcatactggagagaatgcctacaaatgtaaagaatgtggcaaagcttttaaccaatcatcaacccttactagacataagataattcatgctggagagaagccctacatatgtgaacattgtggcagagcttttaaccaatcctcgaaccttactaaacataagagaattcatactggtgataaaccttataaatgtgaagaatgtggcaaagcctttaatgtgtcctcaacccttactcaacataagagaattcatactggagagaaaccttacaaatgtgaagagtgtggcaaagcctttaacgtgtcctcaactcttactcaacataagagaattcatactggagaaaaaccatacaaatgtgaagaatgtggcaaagcctttaacacatcctcacacctcaccacacataaaagaattcataccggagagaaaccctacaaatgtgaagaatgtggcaaagcctttaaccagttctcacaacttactacacataagataattcatactggagagaaaccctacaaatgtaaagaatgtggcaaagcttttaagcggtcctcaaaccttactgaacataggataattcatactggagagaaaccctacaaatgtgaagaatgtggcaaagcttttaacctatcctcacaccttacaacacataagaaaattcatactggagagaaaccctacaaatgtaaagaatgtggcaaagcttttaaccaatcctcgacacttgctagacataagataattcatgctggagagaaaccctacaaatgtgaagaatgtggcaaagctttttaccaatactcaaaccttactcaacataagataattcatactggagagaaaccctacaaatgtgaagaatgtggcaaagcctttaattggtcctcaactctgactaaacataaggtaattcatactggagagaaaccctacaaatgtaaagaatgtggcaaagcttttaaccaatgctcaaaccttactacacacaagaaaattcatgctgtagaaaaatctgacaaataagaaaaatggaccaggcgtggtggctcacacctgtaatcccagcactttgggaggccaaggcgggtggatcacaagatcaagagattgagaccatcctggccaacgaagagaattactggagagaaaccgtacaaacctgaaagatataacagtgcagttgacaacacctcaatatttctaaacacctttaaatggttgtcatacttgattgtaggtaaaatatagtagaggaaacctctacaagtgtgaagaatgtggcaaaacttttaaccaatgctgacactttattggacaggaaatgatgtatacttgagaaaaattatgcaaatgtaaagaatgtgaagaagccattaatatctgttcacatcttattcaatatcagagagttcatacttaatagaagcattaaagatgaaattactgtcaatagatttttcagaaaatataagcctttaaagtgaagaagagtatttattttgaagacaagcattaaaatatcaagagtgtaagctgggcatggtggctcaggcctgtaatttcagcactttggaggccaaggcaggtggtttacttgaggtcagaagttcaagaccagcctggccaacatggtgaaactccatctctacccaaaatacaaaaattaggtgggtgtggtagtgcatgactaatcccagctactcggtggttgagacaggagaatcgcttgaacctgggaggcagaggttgcagtgagctgagtttgtgccaccacactccagcctgggcactccagctgcactccatctc

SEQ ID NO: 203656 - DNA, 780 bp, Homo sapiens
  Payload ID: 20158
  Gene Name: zinc finger protein 724, pseudogene
  ENST ID: ENST00000597037
  CDS Start-End: 149-382
ttgtctctcgctgcagctggagcgcttggtctcgtcttccctgctttgtgtcccctgctcttagaggcccagcctctgtggccctctgacctgcaagcattgggagatccacagctaagacgccagggcctcccctggaagcctagaaatgggaccattgacatttatggatgtggccatagaattctctgtggaggagtggcaatgcctggacactgcacagcagaatttatataggaacgtgatgttagagaactacagaaacctggtcttcctgggtattgctgtctctaagccagacctgatcacctgtctggagcaaggcaaagagccctggaatatggagagacatgagatggtggccaaacccccaggtaggtgagagtgaatatgacagatgacacagatgagaggtccaaatgtcaaggagaaagtcagtttttgaaatacgatttggggccaggtgtggtggctcatgcctgtaatcccagcacttggagaggctaaggcgggcagatgacctaaggtcgggtgttcgagaccagcctgaccaacatggagaaaccccgtctttactaaaaatacaaaattagctgggtgtggtggcgcatgcctgtagtcccagctacttgggaggctgaggcaggagaatcgcttgaacctgggaggcagaggttgtggtgagctgagatcgcgccattgcactgcagcctgggcaacaagagcgaaactccgtctcagataaataaataaataaacgaataaaaataagaaatacaa

SEQ ID NO: 203657 - DNA, 583 bp, Homo sapiens
  Payload ID: 20158
  Gene Name: zinc finger protein 724, pseudogene
  ENST ID: ENST00000597537
  CDS Start-End: 287-583
gtctctcgctgcagctggagcgcttggtctcgtcttccctgctttgtgtcccctgctcttagaggcccagcctctgtggccctctgacctgcaagcattgggagatccacagctaagacgccagggcctcccctggaagcctagaaatgacggagtctcgctctgtcacccaggctggagtgcaatggcgtgatcttggctcactgcaacctctgccttctgggttcaagtgattctcctgcctcagcctcccaagtagctgggattacagggaccattgacatttatggatgtggccatagaattctctgtggaggagtggcaatgcctggacactgcacagcagaatttatataggaacgtgatgttagagaactacagaaacctggtcttcctgggtattgctgtctctaagccagacctgatcacctgtctggagcaaggcaaagagccctggaatatggagagacatgagatggtggccaaacccccaggtatgtgttgttattttgcccaagaccttcggccagagcagagcataaaagcttctttgcaaagaataatactgagaaaatatgaaaaa

SEQ ID NO: 203658 - DNA, 2330 bp, Homo sapiens
  Payload ID: 20159
  Gene Name: zinc finger protein 726
  ENST ID: ENST00000322487
  CDS Start-End: 114-2330
ctttgtctctatctgcggccggagctccaggtctcgtcctcactactctgtgtcttctgcttttaggggcgcagcctctgtggccctgtgacctgccccctggaagcctagaaatgggactgttgacatttagggatgtggccatagaattctctctggaggagtggcagtgcctggacactgcacagaagaatttatataggaatgtgatgttagagaactacagaaacctggccttcctgggtattgctgtctctaagccagacctcatcatctgtctggagaaagaaaaagagccctggaatatgaagcgagatgagatggtggatgaacccccaggtatatgtcctcattttgctcaagacatttggccagagcagggcgtggaagattcttttcaaaaagtaatactaagaagatttgaaaaatgtggacatgagaatttacagttaagaaaaggttgtaaaagtgtggatgagtgtaaggtacacaaagaaggttataatggacttaaccagtgtttcacaactacccagggcaaagcttctcaatgtggtaaatatttgaaagtcttttataaatttataaatttaaacagatataagataagacatactagaaagaaacctttcaaatgtaaaaattgtgtcaaatcattttgcatgttttcacacaaaacccagcataaaagcatatatactacagagaagtcctacaaatgtaaagaatgtggaaaaacctttaattggtcctcaacccttactaatcataagaaaactcatactgaagaaaagccctacaaatgtgaagaatatggcaaagcttttaatcaatcctcaaattatactacacataaggtaactcatactggagagaagccttacaagtgtgaagaatgtggcaaagcatttagccaatcctcaacactaaccatacataagaggatacatactggagagaaaccctgcaaatgtgaagaatgtggcaaagcatttagccaaccctcagcactaaccatacataagaggatgcacattggagagaaaccctacaaatgtgaagaatgtggcaaagcatttgtttggtcctcaaccctaactagacataagaggctgcacagtggagagaaaccctacaaatgtgaagaatgtgccaaagcttttagccaattcggacaccttactacacataggataattcatactggagagaaaccctacaaatgtgaagaatgtggcaaagcatttatatggccctcaaccctaactaaacataagaggattcacactggagagaaaccctacaaatgtgaagaatgtggcaaagcttttcatcgatcctcaaatcttactaaacataagataattcatactggagagaaaccttacaagtgtgaagaatgcggcaaagcgtttatatggtcctcaaaccttactgaacataagaaaattcatactagagagaaaccctacaaatgtgaagaatgtagtaaagcatttagccgatcctcagccctaactacacataagaggatgcacactggagagaaaccctacaaatgtgaagaatgtggcaaagcttttagccagtcctcaacccttactgcacataagataattcatactggagagaaaccctacaaatgtgaagaatgtggcaaagcatttatattgtcctcgaccctatctaaacataagaggattcacactggagagaaaccctacaaatgtgaagaatgtggcaaaacttttaatcaatcctcaaatcttagtacacataagataattcatactggagagaaaccttacaagtgtgaagaatgtggaaaagcgtttaatcgatcctcaaatcttagtacgcataagataattcatactggagagaaaccttacaagtgtgacgaatgtggcaaatcatttatctggtcctcaaccctttttaagcataagataattcacactggagagaaaccttacaagtgtgaagaatgtgggaaagcttttaatcattctcaaatcttactacacataagacataagaggatgcacactggagagaaaccttacaaatgtgaggaatgtgggaaatcttttaacctgtcttcaacttttattaaacataaggtaattcatactggagtaaaactctacaaatgtgaagaatgtggcaaagtgtttttctggtcctcagccctaactagacataagaaaattcatgctggacagcaaccctacaaatgggaaaaaattggcaaagcctttaaccagtcctcacatcttactacagataagataactcatattggagagaaatcttacaagtgtgaataa

SEQ ID NO: 203659 - DNA, 847 bp, Homo sapiens
  Payload ID: 20159
  Gene Name: zinc finger protein 726
  ENST ID: ENST00000334589
  CDS Start-End: 119-445
ggggcctttgtctctatctgcggccggagctccaggtctcgtcctcactactctgtgtcttctgcttttaggggcgcagcctctgtggccctgtgacctgccccctggaagcctagaaatgggactgttgacatttagggatgtggccatagaattctctctggaggagtggcagtgcctggacactgcacagaagaatttatataggaatgtgatgttagagaactacagaaacctggccttcctgggtattgctgtctctaagccagacctcatcatctgtctggagaaagaaaaagagccctggaatatgaagcgagatgagatggtggatgaacccccaggccttgctgtctctaaccctgatctgatctcctgccttgagcaaataaaagagccctggaatgtgaagagacatgagacagtagtcaaatactcagggtgaaactgacctcagagtgacttaggaagaatttcatttttgggaagagtttcaagaggattgttattcaaatacatttggtagaatttggctgtgcatttttctagtcctaagcttttctttgtcaagacatttttaattactgactcaatcatgctactcattattggtttgttcaggtactctatttctttctggctctatcttgggaggttgtatgtttccataaatttatttactctaagttttcaggtttgtgagtgtctagttgtttataatcatttctagtgatcttttgtattactgttgtatccattgtaatgtctattctttcatttctgattttgtttatttagatctctcttctgtttgtgatgaatctagctagcaatttatcaattttgt

SEQ ID NO: 203660 - DNA, 1798 bp, Homo sapiens
  Payload ID: 20159
  Gene Name: zinc finger protein 726
  Uniprot ID: A6NNF4
  ENST ID: ENST00000531821
  CDS Start-End: 114-347
ctttgtctctatctgcggccggagctccaggtctcgtcctcactactctgtgtcttctgcttttaggggcgcagcctctgtggccctgtgacctgccccctggaagcctagaaatgggactgttgacatttagggatgtggccatagaattctctctggaggagtggcagtgcctggacactgcacagaagaatttatataggaatgtgatgttagagaactacagaaacctggccttcctgggtattgctgtctctaagccagacctcatcatctgtctggagaaagaaaaagagccctggaatatgaagcgagatgagatggtggatgaacccccaggtaggtgagagtgaatacaacagatgacctggatgagaggtccaacgtcaagaagaaagccagtctttaaagtgatttggaaagctgcattccaaaggaaaccgtttctggaaagcctgaaatttaaaaaaaaatatactctcagataggggcatcttctgcttatgcttataaaatctctaagaattctactctcccttcaatgatcttccttaacgtttacagtgacagccaaagtactgttcatggcatataaaagagtgtacaatctgactttttttttcttgtttttgtggacagatagatatctgcatagttttgagacactctatgttaaaatttttttttgttttagaaggagtttcgcttttgtggcccatgctggagtgcaatggtgcgatctcggctcactgcaacctctgcctcccaggttgaagtgattgtcctgcctcaggctcctgagtagctggggttacaggtgcacaccaccacaactggctaattttttgtatttctcgtagagacggagtttcatcatgttggccaggctggtctcctgacctcaggtgatccacccacctcagactcccaaagtgctgggattacaggtgtgagccaccgtgcctggcctctctttttgcacaagagtagtggtttctgtttcattaggggtttttttttgtttgtttgtttttctgctcatttcatcctgttttttttcttgctttcttttttttttttgtttatttaatatggccgtttttacttcctgcagaaagggtatactcgccagcagttttgccatgagagtacactgagcaaaggagacagggtcatttataacctgatgtgtccactctactgctgtgtccagtttccactggctggaacgggcatcctgttttcattactatagccttgaaatatagtttgggccatgcgtggtggctcacgcctgtaatcccagcattttgggaggccaaggtgggtgaatcacgaggtcacgaatttgagaccagcctggccaacatggtgaaaccccatctatactaaaaataaaaaaattagctgggctcagtggtgggcacctgtaatcccagctactcaggtggctgaggcaggagaattgcttgaacccaggagccagaggttgcaatgagctgagatcatgccactgtactttagcctgggcggcagagcaagactctctctcgatgtatatatatatagtttgaaattataaagtataatgtccttctgctttgttctttttcctcaagattgctttggctattcaaaatttattgtggtttcgtgtacattttaggattgtaattttcattactgtgaaaaactggaattttgacagggagtttattgagtctagagatcaccttagataatatggcagtttcacaatacttattctttcaatagaaataaaatatttttaaattta

SEQ ID NO: 203661 - DNA, 806 bp, Homo sapiens
  Payload ID: 20159
  Gene Name: zinc finger protein 726
  ENST ID: ENST00000525354
  CDS Start-End: 120-389
cggggcctttgtctctatctgcggccggagctccaggtctcgtcctcactactctgtgtcttctgcttttaggggcgcagcctctgtggccctgtgacctgccccctggaagcctagaaatgggactgttgacatttagggatgtggccatagaattctctctggaggagtggcagtgcctggacactgcacagaagaatttatataggaatgtgatgttagagaactacagaaacctggccttcctgggtattgctgtctctaagccagacctcatcatctgtctggagaaagaaaaagagccctggaatatgaagcgagatgagatggtggatgaacccccagatggagtctcgctctgtcacccaggctggagtgcagtggcgtgatcttggctcactgcaacctccgcctcccaggttcaagccattctcctgcctcagcctcctgagtagctgggactataggtgccgacaccgcgcttggctaattttttgtatttttagtagaaacggggtttcaccgtgctctcgatctcctgatctcgtgatctgcccgcctcggcctcccaaagtgctgggattacagatgccagtaatttaaaatgcctgccttccatgaatgcacagttacagtcaaacattgcagttatctagacaaattatttgttaatgtacataaatgttgccaactagttgtaatgagtaaacatttctgttattgtgttgcagttttatattagtgttttttgtagtgtaagtttcctaacatcagtttattgtgcctattggttttttcttatatat

SEQ ID NO: 203662 - DNA, 1522 bp, Homo sapiens
  Payload ID: 20159
  Gene Name: zinc finger protein 726
  ENST ID: ENST00000575986
  CDS Start-End: 77-406
cctcactactctgtgtcttctgcttttaggggcgcagcctctgtggccctgtgacctgccccctggaagcctagaaatgggactgttgacatttagggatgtggccatagaattctctctggaggagtggcagtgcctggacactgcacagaagaatttatataggaatgtgatgttagagaactacagaaacctggccttcctgggtattgctgtctctaagccagacctcatcatctgtctggagaaagaaaaagagccctggaatatgaagcgagatgagatggtggatgaacccccaggccttgctgtctctaaccctgatctgatctcctgccttgagcaaataaaagagccctggaatgtgaagagacatgagacagtagtcaaatactcaggtaggtaagcatgaatgaagccgataacacagatgacaggttcaaaggtcaaaaagaatgccagactttaaaatgtgatatgggatgctctgcttcagtggaaagatttcctaaaaagcctttttttttcctctagctctgaagtaggagcatttttgtcccatacccttaaattatttctaaggactctacttcctatttagtgattttcctttgagggtaccatgagaactaaactcctctttatggcttataaggtactgcatgatatacctgctcttccattgcttcgggggaatataaaaatatctcgagtatttttgaggaactgcatgttagattatttctcaaattttcccatcatgtctgaaatgtatgagagcagtggtgatattaagatttgtttcagaaatctcaggaacatcaatgacagaggttacttatttctctattttctgtttttaatattagcaatcctaactcaagtgatagctcattattgttttcatttgcagttgcctgttgttaggtgatattgaccactttttttatatacctattggtcatgtgtatatatttgctggcaaaatattttttgaatcttttgaccatttttctgttgggtttttattgttatacttgcctttgctttgaatttcctgtatattttgaatattaagcttttcttgtatatatggtttgctattgtgagcatgcaataaacattcaagtataggtatcattttcttataataaactatttttctttgagtagatacccaatgatgagacttttaaatcaaatggtagttctatttatagttgagactgagcatttttgtcatatgtgtgttggctatttgcatgtctttattgaaaaatgtttactaatgttatttgcccatttttcaatgggattctttattattatgatatttttgagttgtttgagttacttgtaaattctgaatgttagtttcattttggcacatagtttgcaaatatgttcatttattctgtaggttgcctatttaccctgttgattattttttttgctgtgccaaagctttttagtcccgtttgtctatttttaataataatataataaataataatacaataat

SEQ ID NO: 203663 - DNA, 2473 bp, Homo sapiens
  Payload ID: 20159
  Gene Name: zinc finger protein 726
  Uniprot ID: A6NNF4
  ENST ID: ENST00000594466
  CDS Start-End: 106-1956
ctatctgcggccggagctccaggtctcgtcctcactactctgtgtcttctgcttttaggggcgcagcctctgtggccctgtgacctgccccctggaagcctagaaatgggactgttgacatttagggatgtggccatagaattctctctggaggagtggcagtgcctggacactgcacagaagaatttatataggaatgtgatgttagagaactacagaaacctggccttcctgggtattgctgtctctaagccagacctcatcatctgtctggagaaagaaaaagagccctggaatatgaagcgagatgagatggtggatgaacccccaggtatatgtcctcattttgctcaagacatttggccagagcagggcgtggaagattcttttcaaaaagtaatactaagaagatttgaaaaatgtggacatgagaatttacagttaagaaaaggttgtaaaagtgtggatgagtgtaaggtacacaaagaaggttataatggacttaaccagtgtttcacaactacccagggcaaagcttctcaatgtggtaaatatttgaaagtcttttataaatttataaatttaaacagatataagataagacatactagaaagaaacctttcaaatgtaaaaattgtgtcaaatcattttgcatgttttcacacaaaacccagcataaaagcatatatactacagagaagtcctacaaatgtaaagaatgtggaaaaacctttaattggtcctcaacccttactaatcataagaaaactcatactgaagaaaagccctacaaatgtgaagaatatggcaaagcttttaatcaatcctcaaattatactacacataaggtaactcatactggagagaagccttacaagtgtgaagaatgtggcaaagcatttagccaatcctcaacactaaccatacataagaggatacatactggagagaaaccctgcaaatgtgaagaatgtggcaaagcatttagccaaccctcagcactaaccatacataagaggatgcacattggagagaaaccctacaaatgtgaagaatgtggcaaagcatttgtttggtcctcaaccctaactagacataagaggctgcacagtggagagaaaccctacaaatgtgaagaatgtgccaaagcttttagccaattcggacaccttactacacataggataattcatactggagagaaaccctacaaatgtgaagaatgtggcaaagcatttatatggccctcaaccctaactaaacataagaggattcacactggagagaaaccctacaaatgtgaagaatgtggcaaagcttttcatcgatcctcaaatcttactaaacataagataattcatactggagagaaaccttacaagtgtgaagaatgcggcaaagcgtttatatggtcctcaaaccttactgaacataagaaaattcatactagagagaaaccctacaaatgtgaagaatgtagtaaagcatttagccgatcctcagccctaactacacataagaggatgcacactggagagaaaccctacaaatgtgaagaatgtggcaaagcttttagccagtcctcaacccttactgcacataagataattcatactggagagaaaccctacaaatgtgaagaatgtggcaaagcatttatattgtcctcgaccctatctaaacataagaggattcacactggagagaaaccctacaaatgtgaagaatgtggcaaaacttttaatcaatcctcaaatcttagtacacataagataattcatactggagagaaaccttacaagtgtgaagaatgtggaaaagcgtttaatcgatcctcaaatcttagtacgcataagataattcatactggagagaaaccttacaagtgtgacgaatgtggcaaatcatttatctggtcctcaaccctttttaagcataagaggattcatacttgagagaaaccttaaaaagggtaaagaatgtggcaaagcatttatatggtcctcaacgctaaacataagaggatgcacactggagagaaaccctacaaatgtgaagaatgtgaaaaagcttttaatcctcaaatcttactaaacattagataattcacactggagagaaaccttacaagtgtgaagaatgtgggaaagcttttaatcattctcaaatcttactacacataagataattcatactggaaataaaccctacaaatgtgaaaaatgtggcaaagcatatggtccacacccctaagtagacataagaggatgcacactggagagaaaccttacaaatgtgaggaatgtggcaaagcctttaaatgttcctcaactgttactgaacataaagtaattcatactgaagagaaaccctacaaatgtgaaaaatgtgtcaaagcctttaagcagtcttcaatcctgagtaaccataagataattcaaactggaaagaaaccctgcaagtctgaagaat

SEQ ID NO: 203664 - DNA, 1679 bp, Homo sapiens
  Payload ID: 20160
  Gene Name: zinc finger protein 727
  Uniprot ID: A8MUV8
  ENST ID: ENST00000456806
  CDS Start-End: 180-1679
aatatggcaaggccttcgtctcctagcttctaggctctgagtccagtacccgtctgtactattccatctcttccgctccattagctcctcggtgactccaccatagcccctgttatcctgtgacctgcaggtactgggagatccatagggaagaaggcggaacatccggaggctgggaaatgcgagtgctaacattcagggatgtggctgtagaattctccccagaagagtgggaatgcctggactctgctcagcagcgtttgtatagggatgtgatgttagagaactacggaaacctgttctccttgggtcttgctatctttaagccagacttgattacctatctggagcaaagaaaagagccttggaatgcgaggagacagaagacagtagccaaacacccagctggctctttgcattttactgcagagatattgctggagcacgacataaacgattcatttcaaaaagtgatcctgagaaaatctggaagctgtgaccttaatactttacgtttaaagaaagactaccaacgtgtgggtaattgcaaggggcagaaaagcagttataatggcattcatcaatgtttgtcagctacccgtagcaaaacctgtcaatataataaatgtggcaaagcttttgggttgtgctcaatcttcactgaacataagaaaatttttagcagagagaaatgctacaaatgtgaagaatgtggcaaagactgtaggttgtcagattttaccatacagaagagaattcatactgcagatagaagttacaaatgtgaagaatgtggcaaagcctgtaaaaagttctcaaaccttactgaacataatagagttcatactggaaagaaaccctacaaatgtgaagaatgtggcaaaacatttacctgttcctcagcccttactaaacacaagagaaatcatactggagacagaccctacaaatgcgaagaatgtcacaaagcctttaggtgttgctcagaccttactaaacataagagaattcatactggagagaaaccctacaaatgtaaagaatgtcacaaagcctttaggtgttgctcagaccttactaaacataagagaattcatactggagagaaaccctacaaatgtaatgaatgtggaaaagcttttatgtggatctcggcccttagtcaacataacagaattcatactggagagaaaccctacatttgtgaagaatgtggcaaagcctttacctactcctcaacccttattagccacaagagaattcatatggaattgagaccttacaaatgtgaagaatgtggcaaaacctttaagtggttctcagacctgactaatcataagagaattcacactggagagaaaccctacaaatgtgaagaatgtggcaaaagctttacctgctcctcaaaccttattaaacacaagagaattcatatggaagtgagaccttacaaatgtgaagaatgtggcaaaacctttaagtggttcccagacctgactaatcataagagaattcacactggagagaagccctacaaatgtgaagaatgtggcaaaacctttacctgctcctcaagccttattaaacacaagagaagtcatactggagacagacctacaagtgcaaagaatgtggcaaagcctttaggtggttctcagaccttactaaacataaggtaa

SEQ ID NO: 203665 - DNA, 714 bp, Homo sapiens
  Payload ID: 20161
  Gene Name: zinc finger protein 728
  ENST ID: ENST00000599851
  CDS Start-End: 1-230
tggagcaaggaaaagagccctggaatatgaagagacatgagctggtgaaagaaccgccaggcagaactggccatgaactgtggcttaggaagctggaactgagtcttggaactgctattgggaccaaggtctgcaggcctgccagcattgctctaaatgggtatcactctccaggcctctggaagacccaagacctctcacagactgtggctgggaggagtttgggatgattacagattatatgttctcattttgctcaagacctttggccagagcagggcagagaagattctttccaaaaagtgatattgagaagatatgaaaaatgtggacatgagaatttacagttaaaaattggttgtaccaatgtggatgagtgtaaggtgcacaaaaaaggttataataagcttaaccagagtttgacaactacacaaagcaaagtatttcaatgtggcaaatatgcaaacatctttcataaatgttcaaattcaaaaagacataagataaggcatactggaaagaaacttttgaaatgtaaagaatatgtcagatcattttgcatgctttcacacctatctcaacataaaagaatttatactagagagaattcctacaaaagtgaagaacatggcaaagcctttaactggtcctcagcccttacttataagagaattcatactggagagaaaccctgcaaatgtgaagaatgtggca

SEQ ID NO: 203666 - DNA, 2015 bp, Homo sapiens
  Payload ID: 20161
  Gene Name: zinc finger protein 728
  Uniprot ID: P0DKX0
  ENST ID: ENST00000594710
  CDS Start-End: 147-2015
gttggctctcgctgcacgcggaggtcaaggtgtcgtccttactgctgtgtgtcgtccgctcctaaaggcccagcttctatggccctgtgacctgcaggtattgggagattcacaactaagtcgccaggacccccggaagcctagaaatgggatcgttgacatttcgggatgtggccatacaattctctctggaggagtggcaatgcctggacactgcacagcagaatttatataggaatgtgatgttagagaactacagaaacctggtcttcctgggtattgctgcccctaagccagacctgatcatttttctggagcaaggaaaagagccctggaatatgaagagacatgagctggtgaaagaaccgccagttatatgttctcattttgctcaagacctttggccagagcagggcagagaagattctttccaaaaagtgatattgagaagatatgaaaaatgtggacatgagaatttacagttaaaaattggttgtaccaatgtggatgagtgtaaggtgcacaaaaaaggttataataagcttaaccagagtttgacaactacacaaagcaaagtatttcaatgtggcaaatatgcaaacatctttcataaatgttcaaattcaaaaagacataagataaggcatactggaaagaaacttttgaaatgtaaagaatatgtcagatcattttgcatgctttcacacctatctcaacataaaagaatttatactagagagaattcctacaaaagtgaagaacatggcaaagcctttaactggtcctcagcccttacttataagagaattcatactggagagaaaccctgcaaatgtgaagaatgtggcaaagcctttagtaagttctcaatccttactaagcataaggtaattcatactggagagaaacattacaaatgtgaagaatgtggcaaagccttcacccggtcctcaagccttattgaacataagagaagtcatgctggagagaaaccctacaaatgtgaagaatgtggcaaagcctttagtaaggcctcaacccttactgcacataagacaattcatgctggagagaaaccctacaaatgtgaagaatgtggcaaagctttcaaccggtcctcaaaccttatggaacataagagaattcatactggagagaagccctgcaaatgtgaagaatgtggcaaagcctttggtaacttctcaacccttactaaacataaggtaattcatactggagagaaaccctacaaatgtgaagaatgtggcaaagccttcagctggccctcaagccttactgaacacaagagaattcatgctggagacaaaccttacaaatgtgaagaatgtggcaaaacctttaagtggtcctcaacacttactaaacataagataattcatactggagagaaaccctacaaatgtgaagaatgtggcaaagcctttactacattttcgagccttactaaacataaagtaattcatactggagagaaacactacaaatgtgaagaatgtggcaaagtcttcagctggtcctcaagccttactacacataaggcaattcatgctggagagaaactctacaaatgtgaagaatgtggcaaagcctttaagtggtcctcaaaccttatggaacataagagaattcatactggagagaaaccctacaaatgtgaagaatgtggcaaagccttcagtaaggttgcaaaccttactaaacataaggtaattcatactggagagaaacaatacaaatgtgaagaatgtggcaaagccttcatctggtcctcaagacttagtgaacataagagaattcatactggagagaaaccctacaaatgtgaagaatgtggcaaagcctttagctgggtctcagtccttaacaaacataagaaaattcatgctggaaagaaattctacaaatgtgaagaatgtggtaaagacttcaaccaatcctcacaccttactactcataagagaattcatactggaggaaaaaccctacaaatgtga

SEQ ID NO: 203667 - DNA, 3877 bp, Homo sapiens
  Payload ID: 20162
  Gene Name: zinc finger protein 729
  Uniprot ID: A6NN14
  ENST ID: ENST00000601693
  CDS Start-End: 119-3877
gatgtggcggggccgttgtttctggttgcagccgcagttcccggtctcgccttcactgctgtgtgtcctcagcctctgtggccctgtaacctgcggcattggaagatccacagctaacatgccaggtgcccctggcagcctagaaatgggaccattgacatttagagatgtgaccatagaattctctctggaggagtggcaatgcctggacacggttcagcagaatttatatagggatgtgatgttagagaactacagaaacctggtcttcctgggtatggctgtctttaagccagacttgataacttgtctgaagcaagggaaagagccttggaatatgaagagacatgagatggtaactaaacccccagttatgcgttctcattttacacaagacctttggccagatcagagcacaaaagattctttccaagaagtaatactgagaacatatgcaagatgtggacataagaatttacgattaagaaaagattgtaaaagtgccaatgagggtaagatgcacaaagaaggttataataaacttaaccaatgcaggacagctacccagagaaaaatatttcagtgtaacaaacatatgaaagtctttcataaatattcaaatagaaataaggttagacacactaaaaagaaaactttcaaatgtataaaatgtagcaaatcatttttcatgctttcatgcttaattcgacataagagaattcatattagacagaatatctacaaatgtgaagaacgtggcaaagcctttaaatcgttctcaacccttactaaacataagataattcatactgaagacaaaccttacaaatataagaaatgtggcaatgcctttaaattttcttcaacgttcactaaacataagagaattcatactggagagacacctttcagatgtgaagaatgtggcaaagcttttaaccagtcctcaaatcttactgaccataagagaattcatactggagagaaaacctacaaatgtgaagaatgtggcaaagcttttaaggggtcctcaaattttaatgcacataaggtaattcatactgcagagaaaccctacaaatgtgaagattgtggcaaaacttttaaccatttctcagcccttagaaaacataagataattcatactggaaagaaaccctacaagcgtgaagaatgtggcaaagcttttagccagtcctcaacccttagaaaacatgagataattcatactggagagaaaccctacaaatgtgaagaatgtggtaaagcttttaagtggtcttcaaaacttactgtacataaggtagttcatactggagagaaaccctacaaatgtgaagaatgtggcaaagcttttagccagttctcaacccttaaaaaacataagataattcatactggaaagaaaccctacaaatgtgaagaatgtggcaaagcttttaacagttcctcaacccttatgaaacataagataattcatactggggagaaaccatacaaatgtgaagaatgtggcaaagcttttaggcaatcctcacaccttactagacataaagcaattcatactggagagaaaccctacaaatgtgaagaatgtggcaaagcttttaaccatttctcagaccttagaagacataagataattcatactggaaagaaaccctacaaatgtgaagaatgtgggaaagcttttagccagtcctcaacccttagaaaccatcagataattcatactggagagaaaccctacaaatgtgaagaatgtggtaaagcttttaagtggtcatcaaaacttactgtacataaggtaattcatactggagagaaaccctgcaaatgtgaagaatgtggcaaagcttttaagcatttctcagccctcagaaaacataaggtaattcatactagggagaaattgtacaaatgtgaagaatgtggcaaagcttttaacaattcctcaatccttgctaaacataagataattcatactgggaagaaaccgtacaaatgtgaagaatgtggcaaagcttttaggcaatcctcacaccttactagacataaagcaattcatactggagagaaaccttacaaatgtgaagaatgtggcaaagcttttagccatttctcagcccttagaagacataagataattcatactggaaagaaaccgtacaaatgtgaagaatgtggcaaagcttttagccatttctcagcccttagaagacataagataattcatactggagagaaaccctacaaatgtgaagaatgtggtaaagcttttaagtggtcatcaaaacttactgtacataaggtaattcatactgcagagaaaccctgcaaatgtgaagaatgtggcaaatcttttaagcatttctcagcccttagaaaacataaggtaattcatactagggagaaattgtacaaatgtgaagaatgtgtcaaagcttttaacagtttctcagcccttatgaaacataaggtaattcatactggagagaaaccctacaagtgtgaagaatgtggtaaagcttttaagtggtcctcaaagcttactgtacataaggtaattcatactggagagaaaccctgcaaatgtgaagaatgtggcaaagcttttaagcatttctcagcccttagaaaacataaggtaattcatactggaaagaaaccctacaaatgtgaagaatgtggcaaagcttttagccaatcctcatcccttagaaaacatgagataattcatagtggagagaaaccatacaaatgtgaagaatgtggtaaagcttttaagtggttgtcaaaacttactgtacataaggtaattcatactgcagagaaaccctgtaaatgtgaagaatgtggcaaagcttttaagcatttctcagcccttagaaaacataagataattcatactggaaagaaaccctacaaatgtgaagaatgtggcaaagcttttaatgattcctcaacccttatgaagcataagataattcatactgggaagaaaccatacaaatgtgcagaatgtggcaaagcttttaagcaatcctcacatcttactagacataaagcaattcatactggggagaaaccctacaaatgcgaagaatgtggcaaagattttaacaattcctcaacccttaagaaacataagctaattcatactagggagaaattgtacaaatgtgaagaatgtgtcaaagcttttaacaatttctcagcccttatgaaacataagataattcatactggggagaaaccctacaaatgtgaagaatgtggtaaagcttttaagtggtcctcaaaacttactgaacataaggtaattcatactggagagaaaccctgcaaatgtgaagaatgtgacaaagcttttaagcatttctcagcccttagaaaacataaggtaattcatactggaaagaaaccctaccaatgtgacgaatgtggcaaagcttttaacaattcctcaacccttacgaaacataagataattcatactggggagaaaccctacaaatgtgaagaatgtggcaaagcctttagtcagtcctcaatccttactaaacataagataattcattctgtagagaaaccctacaaatgtgaagaatgtggcaaagcctttaaccagtcctcacaccttactagacacaaaacaattcatactggagagaaaccctacaaatgtgaagaatgtggcaaagcttttattcagtgctcataccttattagacataaaacaattcataccagagagaaacctacaaatgtgaagaaagtaccaaagcttttaagcaatcctcacaccttactagacaaaacaattcatactggagagaaaccctacaaatgtgaagaatgtgccaaagctttttaa

SEQ ID NO: 203668 - DNA, 148 bp, Homo sapiens
  Payload ID: 20162
  Gene Name: zinc finger protein 729
  ENST ID: ENST00000624059
  CDS Start-End: 119-148
gatgtggcggggccgttgtttctggttgcagccgcagttcccggtctcgccttcactgctgtgtgtcctcagcctctgtggccctgtaacctgcggcattggaagatccacagctaacatgccaggtgcccctggcagcctagaaatg

SEQ ID NO: 203669 - DNA, 792 bp, Homo sapiens
  Payload ID: 20163
  Gene Name: zinc finger protein 730
  ENST ID: ENST00000599195
  CDS Start-End: 1-241
cagaaacctggtcttcctgggtattgctgtctcaaagccagacctgatcacctgtctggagcaagaaaaagagccttggaatttgaagacacatgatatggtagccaaacccccaggaactgctttcagcatcttttatatgtttgtgaagttttataagtatatgcagtgccaatatactttttcagaatttggctattttggaacatcattttttcatttttcaggacagatttgctgatggtgttactctcacttgaaagctattttttttcccaggactttgactgcatcacacagtttctttccggcctacaaaatttttgttgacaattcactggttatatcgtaagactatgtttgtatatgacacatcacttttatcttgtagctcccaagatgctctgtgacttttgaaattgtgcttatatatgtatttgttataaatattttgtatgtattctagtttgtttgttaagcttcttcatgtttacattatttttcttactgagggatttttcaggtattatttcttcttgtattttttacccccataatttctattttttaattttttcaatatttttgttcttatcttcatttctgattttctgtagtctgtgttcctgtttcactcattgaatattcaattttttatcaatttttaaaattaatgtgtacatcttttctatggtttccttctgaaaattttataatatttttgatggaattatattgccctgttttgtatatattgtaatctttaattgagatttggacattaaaaaaatc

SEQ ID NO: 203670 - DNA, 464 bp, Homo sapiens
  Payload ID: 20163
  Gene Name: zinc finger protein 730
  ENST ID: ENST00000593635
  CDS Start-End: 272-409
ggtctttgtctctcgctcccgccagagcttgggatcggtcttcactgttccgcgtcctctacctgggaaccaccgacccccgcccggcgactttgtcacagactctgttgccctgtgatctgcaggtcctgggagacgcacagccaagatgccagggcaccctggaagctgtgaagtgggagcgttgacatttagagatgtggccatagaattctctctggaggagtggcaatgtctggacaccgaacaacagaatttatatagaaatgtaatgttagataactacagaaacctggtcttcctgggtattgctgtctcaaagccagacctgatcacctgtctggagcaagaaaaagagccttggaatttgaagacacatgatatggtagccaaacccccaggtaggtgacagtaaatacaatacacaaaactgataagagatctatagtttaaaaaaagaaaaa

SEQ ID NO: 203671 - DNA, 2374 bp, Homo sapiens
  Payload ID: 20163
  Gene Name: zinc finger protein 730
  Uniprot ID: Q6ZMV8
  ENST ID: ENST00000597761
  CDS Start-End: 200-1711
aatcaggcccgcagctggagcagacagggcggcttccgggatttggcgcggcctttgtttctcgctgccgccgaagctccaattttcgtctgtctgctttgtgtcctctgcacgtagaagcccagcctgtgtggccctgcgacctgcgggtattgggagatccacagctaagacgccagggccccctggaagcctagaaatgggagcgttgacatttagagatgtggccatagaattctctctggaggagtggcaatgtctggacaccgaacaacagaatttatatagaaatgtaatgttagataactacagaaacctggtcttcctgggtattgctgtctcaaagccagacctgatcacctgtctggagcaagaaaaagagccttggaatttgaagacacatgatatggtagccaaacccccagttatatgttctcatattgcccaagacctttggccagagcaaggcataaaagattatttccaagaagtcatactgagacaatataaaaaatgtagacatgagaatttactgttaagaaaaggctgtaaaaatgtggatgagtttaagatgcacaaaaaaggttataatagacataaccagtgtttgacaacttcccatagcaaaatatttcagtgtgacaaatatgtgaaagtctttcataaattttcaaattcaaacagacataagataagacatacttcgaagaaacctttcaaatgtaaagaatgtggaaaattattttgcattctttcacacttagctcaacataaaaaaattcatactggagagaaatcctacaaatgtgaagaatatggcaaagcctttaatgagtcctcaaactgtactacacataaaagaattactgagaaaaaaccttacaaatgtaaagaatgtggcaaagcctttaactggttttcacattttactacacataagagaattcatactggagaaaaaccctaccaatgtgagaaatgtggcaaattttttaaccaatccacaaaccttactacacataaaagaattcatactggagagaaaccctataaatgtgaagaatgtggcaaagcctttaaccagtcctcaaaccttactgaacataagaaaattcatactaaagagcaaccatacaaatgcgaaaaatgtggcaaagcttttaagtggtcctcaacccttacaaaacataaaagaattcataatggagaaaaaccctacaaatgtgaagaatgtggcaaagcttttaaccgatcctcaacccttaatagacataagataactcatactggagggaaaccctacaaatataaagaatgtggtaaagcttttaaccaatcctcaactcttactatacataagataattcatactgtagagaaattttacaaatgtgaagaatgtggcaaagcctttagccgtatctcacaccttactacacataagagaattcatactggagagaaaccctacaaatgtgaagaatgtggcagagctttcaaccagtcctcaacccttactacacataaaagaattcatactggagagaaaccctatgaatgtgaagaatgtggcaaagcttttaaccggtcctcaaccctcactacacataagataattcattctggggaaaaaatctacaaatgtaaagaatgtggtaaagcctttaggcggttctcacaccttactaggcataagacaattcatacataaaattgtaaagactgtggcaaagcttttaaacaatctttataccttactacacataagataattcatactgaagagaaaccctacaaatgtgaagaatgtggcaaagcttttaaccagtcctcaaatcttactaaacataaggtaattcatactggagaaaaacctacaaatgtgaagaatgtggcaaagtcttcaaccaatcttcacaccttactacacataagataattcatactggagagaaaccctacaagtgtgaagaatgtgacaaagcctttaacaaatccttaattcttaacagacatgattcataccagagagaaactctacaaacctgaaagttttaacagtgcttttgacaacacctcaaacttttccagatgtcaaagaaatgctggtgagaaattctagaaatatgaagaatgtgacaaagccattaaattgttgtcacatttaattgtaggtaaggtgattcatactggagaaaacttctacaagtgtaaacaaagtggcaaaacttttaaccaatgctcacactttattgcacaggacatttatacttgagaataaatatacaagtgtaaagaaagtgaaaaccctattaatatctgctcacatcaactcaacatcagagttcatacttaataaaatcattaaaagtgc

SEQ ID NO: 203672 - DNA, 2193 bp, Homo sapiens
  Payload ID: 20164
  Gene Name: zinc finger protein 732
  Uniprot ID: B4DXR9
  ENST ID: ENST00000419098
  CDS Start-End: 12-1769
gaagtggggaaatggaactcttaacattcagggatgtggccatagaattctctccagaagagtggaaatgcctggaccctgcccagcagaatttgtatagagatgtgatgttggagaactacaggaacctgatctccctgggtgttgctatctctaacccagacctggtcatctatctggagcaaagaaaggagccctacaaagtgaagatacatgagacagtagccaaacacccagctgtgtgttctcatttcacccaagactttttgccagtgcaggggatagaagattcgttccacaaacttatattaagaagatatgagaaatgtggacatgagaatttagaattaagaaaaagctgtaaaaggaaggtgcagaaaggaggttataatgaatttaatcaatgcttgtcaactatccagagcaaaatatttcagtgtaatgtacatgtcaaagtatttagtacattttcaaattcaaaccaacgtaggataagacatactggagagaaacactttaaagaatgtggcaagtcatttcagaagttctcagacctaactcaacatcaaggaattcatgctggagagaaaccctacacatgtgaagaatgtggcaaagactttaaatggtatttaatctttaatgaatatgagataattcatactggagagaaacccttcacatgtgaagaatgtggcaacatctttaccacatcctcaaactttgctaaacataaagttcatactggagagaaatcttacaaatatgaagaatgtggcaaagcctttaataggtcctcaacccttactaagcataagagaattcatgctgaagagaaacccttcacatgtgaagaatgtggcaaaatcattacctcatcctcaaatgttgccaaacataagaaaattcataccggagagaaactctacaaatgtcaggaatgtggcaaagtctttaataggtccacaacccttactaaacataacagaattcatactggagagaaaccctacacatgtgaagaatgtggcaaagcctttagtaggtcctcagttctgaatgaacataagagaattcatactggagagaagccctacaaatgtgaacaatgtggcaaagcctttagacaatccgcaacccttaataaacataagagtattcatactggagagaaaccctacacatgtgaagaatgtggaaaagcctttagtcggttcacaacccttaatgaacataagagaattcatactggagagaggccccacaaatgtgaagagtgtggcaaagcctttggatggtccacagacctgaataaacataagataattcatactggagagaaaccttacaaatgtgaagagtgtggcaaagcctttggatggtctgcatacctgagtaaacataagaaaattcatactggagagaaaccttatagatgtgaagagtgtggcaaagcctttttatgttccagagccctgaataaacataagacaattcatactggagagaaaccttacgaatgtgaagagtgtggcaaagcctttggatggtccacatacctgagtaaacataagaaaattcatactggagagaaaccttatagatgtgaagagtgtggcaaagcatttagacgttccagagtcctgaataaatataagacaattcatactggagataaaacccccaaatgtaaaggatgtggcaaagcctttaagtggtcctcataccttaatcaacataataaaatttatactggagagaaactctagaaatatgaagaatgtggcaaagcctttggatgatccacaaacctgaatgaacataagaaaatttatactggaaataaactatacaaatgtgaagaatgtggcaaagcttttggatggtccacaaccctgaatgaaagtaagaattcatactggagaaaaaccctacaaatgtaaagaatgtgggaaagccttcaaacagtccgcatacctgaatcaacataagaaaattgatgctggagagcaaccctacaaatgtgaagaatgtggcaaagcttttagatggtccacaaccctgagtgaacataagaaaattcatatgggagatgaatcctacaaatgtaaagaatgtgggaaagcctataaacggtcctcacccataaataaacatgagaaaattcataatggagagaacacctacaaatgt

SEQ ID NO: 203673 - DNA, 2179 bp, Homo sapiens
  Payload ID: 20164
  Gene Name: zinc finger protein 732
  ENST ID: ENST00000619749
  CDS Start-End: 1-1755
gaactcttaacattcagggatgtggccatagaattctctccagaagagtggaaatgcctggaccctgcccagcagaatttgtatagagatgtgatgttggagaactacaggaacctgatctccctgggtgttgctatctctaacccagacctggtcatctatctggagcaaagaaaggagccctacaaagtgaagatacatgagacagtagccaaacacccagctgtgtgttctcatttcacccaagactttttgccagtgcaggggatagaagattcgttccacaaacttatattaagaagatatgagaaatgtggacatgagaatttagaattaagaaaaagctgtaaaaggaaggtgcagaaaggaggttataatgaatttaatcaatgcttgtcaactatccagagcaaaatatttcagtgtaatgtacatgtcaaagtatttagtacattttcaaattcaaaccaacgtaggataagacatactggagagaaacactttaaagaatgtggcaagtcatttcagaagttctcagacctaactcaacatcaaggaattcatgctggagagaaaccctacacatgtgaagaatgtggcaaagactttaaatggtatttaatctttaatgaatatgagataattcatactggagagaaacccttcacatgtgaagaatgtggcaacatctttaccacatcctcaaactttgctaaacataaagttcatactggagagaaatcttacaaatatgaagaatgtggcaaagcctttaataggtcctcaacccttactaagcataagagaattcatgctgaagagaaacccttcacatgtgaagaatgtggcaaaatcattacctcatcctcaaatgttgccaaacataagaaaattcataccggagagaaactctacaaatgtcaggaatgtggcaaagtctttaataggtccacaacccttactaaacataacagaattcatactggagagaaaccctacacatgtgaagaatgtggcaaagcctttagtaggtcctcagttctgaatgaacataagagaattcatactggagagaagccctacaaatgtgaacaatgtggcaaagcctttagacaatccgcaacccttaataaacataagagtattcatactggagagaaaccctacacatgtgaagaatgtggaaaagcctttagtcggttcacaacccttaatgaacataagagaattcatactggagagaggccccacaaatgtgaagagtgtggcaaagcctttggatggtccacagacctgaataaacataagataattcatactggagagaaaccttacaaatgtgaagagtgtggcaaagcctttggatggtctgcatacctgagtaaacataagaaaattcatactggagagaaaccttatagatgtgaagagtgtggcaaagcctttttatgttccagagccctgaataaacataagacaattcatactggagagaaaccttacgaatgtgaagagtgtggcaaagcctttggatggtccacatacctgagtaaacataagaaaattcatactggagagaaaccttatagatgtgaagagtgtggcaaagcatttagacgttccagagtcctgaataaatataagacaattcatactggagataaaacccccaaatgtaaaggatgtggcaaagcctttaagtggtcctcataccttaatcaacataataaaatttatactggagagaaactctagaaatatgaagaatgtggcaaagcctttggatgatccacaaacctgaatgaacataagaaaatttatactggaaataaactatacaaatgtgaagaatgtggcaaagcttttggatggtccacaaccctgaatgaaagtaagaattcatactggagaaaaaccctacaaatgtaaagaatgtgggaaagccttcaaacagtccgcatacctgaatcaacataagaaaattgatgctggagagcaaccctacaaatgtgaagaatgtggcaaagcttttagatggtccacaaccctgagtgaacataagaaaattcatatgggagatgaatcctacaaatgtaaagaatgtgggaaagcctataaacggtcctcacccataaataaacatgagaaaattcataatggagagaacacctacaaatgt

SEQ ID NO: 203674 - DNA, 1570 bp, Homo sapiens
  Payload ID: 20165
  Gene Name: zinc finger protein 735
  Uniprot ID: P0CB33
  ENST ID: ENST00000429565
  CDS Start-End: 114-1352
cttttgtgtttctctgcgtccagagctccagttcttctcttcactgctctgcgtcctctgctcttagaggtcaagccactgtggccttgtgtcctgcaggtatccgcagatttatggctaaaagaccgggaccccctggaagccgagaaatgggactgttgacattcagagacatagctatagaattctctctggcggagtggcaatgcctggatcatgctcagcagaatttatatagagatgtgatgttagagaactacagaaacctgttctccctgggtatgactgtctctaagccagacttgatcgcctgtctggagcaaaataaagagccccagaatataaagagaaatgagatggcagccaaacacccagttacatgttctcatttcaaccaagaccttcagccagagcagagcataaaagattcactccaaaaagtaataccaagaacatatggaaaatgtggacatgagaatttacaattaaaaaaatgttgtaaaagagtagatgagtgtgaggtgcacaaaggaggttataatgaccttaaccaatgtttgtcaaatacccaaaacaaaatatttcagactcataaatgtgtcaaagtcttcagtaaattttcaaattccaatagacacaatgcaagatatactggaaagaaacatttgaaatgtaaaaaatatggcaaatcattttgcatgttttcacacctaaatcaacatcagataattcatactaaggagaagtcctacaaatgtgaagaatgtggcaaatcctttaaccactcctcaagcggtactacacataaaagaattcttactggagagaaaccctacagatgtgaggaatgtggcaaagcctttaggtggccctcaaaccttactagacataagagaattcacactggagagaaaccctacgcatgtgaagaatgtggccaagcctttaggcgctcctcaacacttactaaccacaagagaattcatactggagagagaccctacaaatgtgaagaatgtggcaaagcctttagcgtatcctcagccctcatttaccacaagagaattcatactggagagaaaccctacacatgtgaagaatgtggcaaagcctttaactgctcctcgactcttaagacacataagataattcatactggagagaaaccctacacatgtgaagaatgtggcagaacctttaactgctcctcaactgtaaaggcacataagagaattcatactggagagaaaccatacaaatgtgaagaatgtgacaaagcttttaagtggcattcaagtcttgctaaacataagataattcacactggagagaaaccctacaaatgtaaataatgtggcaaagtccagccctcagaccttataatacataaaataatttatactggaaagaaagcattacaagtgtagagaatgtggccaagcctttatctagttccataccttaattgtacataagagaattcatattggacaaaaatcttataaatgtaaaaaaatgtaacaaagcctttaaccaaccctcaaagcataatgaacctaagagaatttat

SEQ ID NO: 203675 - DNA, 2098 bp, Homo sapiens
  Payload ID: 20166
  Gene Name: zinc finger protein 736
  Uniprot ID: B4DX44
  ENST ID: ENST00000355095
  CDS Start-End: 323-1606
ggtggccaacttgggtgtcttcctctgccagggtcaaggacaaggattgaaacgggtggggcctggagccctagccaatcagtggcgccagcgtgaaactgtccaatcaagtgcgcagctacagaggaagaggcggcctcttcaatatggcggggcctttgtctcctagcttccgggctctgatcctagttcgcgtctccactgttccatctcctccgttcctggagttcctcggtgactctactatagcttctgttatcctgtgacctgcaggtactgggagatccatagggaggacggcggaacatctggaggctgggaaatgggagtgttgacattcagggatgtggctgtagaattctccccagaagagtgggaatgcctggactctgctcagcagcgtttgtatagggatgtgatgttagagaactatggaaacctggtctccttgggtcttgctatctttaagccagacttgatgacctgtctggagcaaagaaaagagccttggaaagtgaagagacaggaggcagtagccaaacacccagctggttcttttcattttactgcagagatattgccggatcatgacataaaagattcatttcaaaaagtgattctgagaaaatatggaagctgtgaccttaataatttacatttaaagaaagactaccaaagtgtgggtaattgcaaggggcagaaaagcagttataatggccttcatcaatgtttgtcagctacccatagcaaaacctgtcaatgtaataaatgtggcagaggttttcagttgtgctcaatcttcactgaacataaagacatttttagcagagagaaatgccacaaatgtgaagaatgtggcaaagactgtaggttgttctcagattttactagacataagaaaattcatactgtagagagatgctacaaatgtgaagaatgtggcaaagcgtttaaaaagttttcaaaccttactgaacataagagagttcatactggagagaaaccttacaaatgtgaaggatgtggcaaaacttttacctgctcctcaacccttgttaaacacaagagaaatcatactggagacagaccctacaaatgtgaagaatgtggcaaagcctttaagtgcttctcagaccttactaatcataagagaattcatactggagagaaaccctacaaatgtgaagaatgtaacaaagcctataggtggttctcagaccttgctaaacataagataattcatactggagacaaaccctacacatgtaatgaatgtggaaaagcttttaagtggttctcggcccttagtaaacataagagaattcatactggagagaaaccctacatctgtgaagaatgtggcaaagcctttacccgctcctcaaccctttttaaccacaagagaattcatatggaagagagaccttacaaatgtgaagaatgcagcaaaacctttaagtgcttctcagacctgactaatcataagagaattcacactggagagaaaccctacaaatgtgaagaatgtggcaaagcatcgagctggttctcacacctcatcagacataagagaattcatactagagagaagctccacaagtgttaaaaatgtggaaaagcctttaccaagtcctcatactgtgttcaacatctgaaatttaatactgaacaaatgcagtataaatgtaatgacagtggaagaacatttatcatcttagagggtctctaagaacttactttataatctggttgcttatatgttgggtacatatatagccctttgctattatgtaatgccctttttttttaaatctatgttaatttcaagtctgttttgtcagaaactaggattgcaacccctgcttcttttcctgttttctatttgcttggtaggcttttctttttccctttattttgagcttatttgagatgggtgtcttgattaaagcataccattagatcttgattcttttttcagcttgccatctgtgctttaatttgggtatttagcccatttacatttaaggttagtattcatatgtgtggattggattctgttattaggatcttagctggctattttgcacatttgtttctg

SEQ ID NO: 203676 - DNA, 562 bp, Homo sapiens
  Payload ID: 20166
  Gene Name: zinc finger protein 736
  ENST ID: ENST00000438373
  CDS Start-End: 533-562
gtgcctgcccagctggagtgctgggcccccggggtcaccatgcagcagggcctgacactgaccagggagccatggccacaggctcttggcagctggcccaaaataaatattctccataacctctgccgatctgctggaccctcacctctcagtctcactgagccactccgttaactggaggcagacccaaaattgctccacaggctgaagggtggccaacttgggtgtcttcctctgccagggtcaaggacaaggattgaaacgggtggggcctggagccctagccaatcagtggcgccagcgtgaaactgtccaatcaagtgcgcagctacagaggaagaggcggcctcttcaatatggcggggcctttgtctcctagcttccgggctctgatcctagttcgcgtctccactgttccatctcctccgttcctggagttcctcggtgactctactatagcttctgttatcctgtgacctgcaggtactgggagatccatagggaggacggcggaacatctggaggctgggaaatgggagtgttgacattcagggatgtggct

SEQ ID NO: 203677 - DNA, 7119 bp, Homo sapiens
  Payload ID: 20166
  Gene Name: zinc finger protein 736
  Uniprot ID: B4DX44
  ENST ID: ENST00000423484
  CDS Start-End: 123-1406
actgttccatctcctccgttcctggagttcctcggtgactctactatagcttctgttatcctgtgacctgcaggtactgggagatccatagggaggacggcggaacatctggaggctgggaaatgggagtgttgacattcagggatgtggctgtagaattctccccagaagagtgggaatgcctggactctgctcagcagcgtttgtatagggatgtgatgttagagaactatggaaacctggtctccttgggtcttgctatctttaagccagacttgatgacctgtctggagcaaagaaaagagccttggaaagtgaagagacaggaggcagtagccaaacacccagctggttcttttcattttactgcagagatattgccggatcatgacataaaagattcatttcaaaaagtgattctgagaaaatatggaagctgtgaccttaataatttacatttaaagaaagactaccaaagtgtgggtaattgcaaggggcagaaaagcagttataatggccttcatcaatgtttgtcagctacccatagcaaaacctgtcaatgtaataaatgtggcagaggttttcagttgtgctcaatcttcactgaacataaagacatttttagcagagagaaatgccacaaatgtgaagaatgtggcaaagactgtaggttgttctcagattttactagacataagaaaattcatactgtagagagatgctacaaatgtgaagaatgtggcaaagcgtttaaaaagttttcaaaccttactgaacataagagagttcatactggagagaaaccttacaaatgtgaaggatgtggcaaaacttttacctgctcctcaacccttgttaaacacaagagaaatcatactggagacagaccctacaaatgtgaagaatgtggcaaagcctttaagtgcttctcagaccttactaatcataagagaattcatactggagagaaaccctacaaatgtgaagaatgtaacaaagcctataggtggttctcagaccttgctaaacataagataattcatactggagacaaaccctacacatgtaatgaatgtggaaaagcttttaagtggttctcggcccttagtaaacataagagaattcatactggagagaaaccctacatctgtgaagaatgtggcaaagcctttacccgctcctcaaccctttttaaccacaagagaattcatatggaagagagaccttacaaatgtgaagaatgcagcaaaacctttaagtgcttctcagacctgactaatcataagagaattcacactggagagaaaccctacaaatgtgaagaatgtggcaaagcatcgagctggttctcacacctcatcagacataagagaattcatactagagagaagctccacaagtgttaaaaatgtggaaaagcctttaccaagtcctcatactgtgttcaacatctgaaatttaatactgaacaaatgcagtataaatgtaatgacagtggaagaacatttatcatcttagagggtctctaagaacttactttataatctggttgcttatatgttgggtacatatatagccctttgctattatgtaatgccctttttttttaaatctatgttaatttcaagtctgttttgtcagaaactaggattgcaacccctgcttcttttcctgttttctatttgcttggtaggcttttctttttccctttattttgagcttatttgagatgggtgtcttgattaaagcataccattagatcttgattcttttttcagcttgccatctgtgctttaatttgggtatttagcccatttacatttaaggttagtattcatatgtgtggattggattctgttattaggatcttagctggctattttgcacatttgtttctgtggttgctttatagtgtccacagtttgtatactttagtgtgcttttgtagtgactggtaatagtctttttcttatttaatgctttcttcagaagctcttttaagacagatcctgtggtaacattttctcagcatttgcttgtctgaataggatcatatatattttttacttctgaagcttaccttggtcagatatgaaattctgtgttggaattctttttttaagaatgttgaatattggcccctataatctcttttgacttgtaggatttcagctgaaagatttgttgttttcctgatgagcttctttttagaggtgacctggcctttctctctagctgcctttaacatattttttctttcattttgaccctggagaatctcatgattatgtgtcttgaggatgaccttctcctggggtatcttactggggttctccacatttcctgcatttgaatgttggcctctctaggttggggaagttctcatggatgttatcctgaaatacgtatttcaagttgttttcattctccccatcactttcaggcaatctcttgcatcatagatttggtttctttacataatcccatatttcttagaggttttgttcattcctctttattcttttttcactgttcttgtctgtctgatttcagaaagccagtcttgaggccctgagattctttcctctgcttggcctattctgctgttaatatatgtgattacattataaaggttttgtattgtgtttttcagttctatcaggttggccacattttttctccagactggctgttttttccgtcagttcctgcaattttttttcctcccttgcattgggttgcaaattacttttgtaactcagtgaagtttgtttctacccatattctgaattctacttctgtcatcttaggccttgctggaaatgtaatttggtcatttggatgaaagaagtcactctggctttttgtgtttttatctttgcactgattgtgtcttatctttgtgggcatatctttgaggttgctgacctttgggcttttttttttttaatcctatttgatggtcttgagtatttgattgtggtataagatggatgcagccaacaggctttgttcctgggaggttttttttgttttgttttgttttgttttgttttgtttggtggtggtggtgggtgggcaatgctcagctcacaactcagaggctgcatactctaactccgggggacttgttttgagccccaactgtgttctctggctccttgagatttggagtttgcgagtttgtgggatgaaggtgccatagctggagcagagtgctagtggatatgggatttctgcctgtctttgggtactcacctcagtggcaggagcaaagcagctgggaagggagtgggggatacctgctggaggctgtgtgctgttgcactaaaggtggtgttggcttggggcaggatactggccagtaaaggttttgatgccttctctgtgccccccaagaaagagtgattgttcagagtgtgggaggttaccctgttctctgcacagtgttagcacaaaggcaggggtggagttttctggctctctgcccaccaaagtttcatctacaatggcagttgctgggggtggcggggcatattgcattcccatttgctggtggggcaagcaaagccaaacctgcctttgcagacatgtgccagcaaagaaatatcaggagttgccatggtgtcacgggaagctgcagtatggggaagaaatgtgggctggtgcagtcataggggctgctttgctggagctcttcatgagtcaggcatgtccctccagtgcagatgctctggtatgagcttccagggtacctgagactgccctgtaagcagctgtggccagactgggtccctgggagaggccagcagaccaaggagtgctcagttggaccagcttcttctgatttgcaagaccatcctgcagaaattaggcccaacagttcccgtagggctaaagtctcttatgggagacagttgagcctagagaaatggccatcactggccacactttactacagatgctcttgcaccaaaccctctggccaccacatgagctggcttgctgcattatctctttgcttgtcttctgggggctgcatctcagagagatgtaggtcagcaattactcagtgcagccagcccaggatggaagatctttacttttggccaagttaggggtttactgtctgctgaggagcagtgggtagtttgtgggacccatggaggatgggctggcttcctctccttgggtaaactgcagtttgaggtgtgaataaggcacttagggtttgggattttttattagtctgagggtagcaaggacagttgtactgcagaggcccctggaggctctgtccagggagttgctaagctgctactggctcaatagctctggcaatgattggctagtggcccgggcctggagaacctgcctcgtgagaatatatgagaacaggcactcacgtaacagtccgaccacttctgaagggctgctgcagtatgctgggtgtccactacagtttctagtcacctcagattttccagtactggaagttatcaccactgaatgctgcaaaacagcaacaatggcagcatgcccttttctctgggagcgccatcccagggaggtatagacctgttgccagcccaaaagcacctgtaggaggtagctggaagcccctgttgaaggtcctacccagtgaggaaaacatgattggggacccacttaagaaagcagtctagccatatttttgcaggacagctctgctattcagaggtaccacttccacccccagtttatttggattctccaaagccagaaggctggaacagctaactcacacaaacagcaaaaatggcagctcactcctccctctaggaactgtatcccaaagaggtttcaaaactccatcaaccaaagagcgctggtggtggtagctggagaccctcattgggaagtactttccagtgagaaggaatgaaacgggggacctgctttaacaggcagtctggccatgtctttttagagcacctgtactgtgctaggagatcctttccgccccccggtcagcttgggctcttcaaagcctgaaggctggaatggctaagttgctcaagcagcaaagatggtggcccactcctctttctggtagctccatcccagggaggtgcagtgctgctaccaatggttggctggaatctaagccagtaggtcttaccacgtgaggcattgttgaagtgggtcctacagaccatcactatcagccccctggattctgcctctttcctatgggtatgttcaggggtgtaacctgctttgctcgagttgcagctactttttctgggaagcctggaaagccagtatctaaggctcttgaatctgcgcaggcctaagtggcttatctgctgagactccatgtagctctgtgtgttaaactgaaggccttggtgaagtgggttcatgagggtatctcctcacctgaaggttgcagagatctgtgggagaatcatgggtttctagggtcacacatgcactcactgctttactgggtggggaggttcccttggctccatgttgttcccaggtggcccattgtcctgccttgctttactccattctccatagattgtttctttgattattcccaatgcaagtacctggatgtttcagttgcaggtgctgtatttatgtataccttgcattcctgtctatgagaactgcacagtctagctgcttctagtcagcaatctcgatcacttttctctaaagggaacctacttttttatattaaaaggattcaatatttttcaaaagcaaatttcaatataatttaactcttacatttgatgctgtgtcttcatttctagaatttatgtgaaagaacatggtcagtggttgcaccagagttgtgagaggttcttctatattagatggacagatttatatacttttccatggaggattaagtaaactgaaacctaagacacacgaagaaattctaagtggaaaggccacttattagtttacagcagtatcgtaagtgacaggatgataggagtgtggtaagtgatcaggataataatctgcttagtaagagaaacaatttgaattttagaaggaaattgccttaccatttgcaaattaaggtaattaaaatacagtgaatttcaaaatgcctttttaatgacaatgtgtgaacttaatttgttttaataaaccaaaattattgttattgtgttaaggctattttacattgaatgtgtatcttgccactgatgttaacttatcccatcttacccaaggttgtaggtaacaatatactattgggtgacagtggactaacatctctagtgatccctttgtcagtggtctttaacttaaaataatttagagaatatggtttctacaacttacatttttgtttacttgtaactacagattattatgatggttgtaatgaagattatgagtataattggagctatatgtttctgaattctgaacaactatttataaaattttatcctacttttttctgttgaacatatgacttctctggtctgctaaacacatacagacctttagttttggtttacatggatttaaatatatagatatatcactgtaaaataaacttcaggtgtaacagatttatagagaaagtaatcatatttgtttatggttgtgtacctactttgagaagaaaagaaaaatattagaatgaacagataattttacaagtgttgatcacttaccagcaaaccagaaacttcagagattttgaaagcaaatctattttctctgctgtgtattaaattcatttatctaaaatgttattgctcctggcttagaatcatcttgtgcaaattctttttttgttgtttgtctgtttgcctgttgctcaccatagacataattttcttttcataaaacattctttgtataatcacctcagagattatgaaagtgactttgataaaatttaatggtgttcacaaaataattttcacgtgagtaatttcacagtgcgtgtattgtatgttatttagtgtattttatattttgtttcaattagagaatgctattgaatccagtttttgtttagttactgttcattttactttataaaattgacataattgagtttattaaatttattgggccaatttaagtaaa

SEQ ID NO: 203678 - DNA, 2867 bp, Homo sapiens
  Payload ID: 20167
  Gene Name: zinc finger protein 737
  Uniprot ID: O75373
  ENST ID: ENST00000427401
  CDS Start-End: 96-1706
ctctgctcctagaggcccagcctctgtggccctgtgtcctgcaggtattgggagatccacagctaagacgcccgggagcccctggaagcctagaaatggggccattgcaatttagagacgtggccatagaattctctctggaggagtggcattgcctggacactgcacagcggaatttatataggaatgtgatgttagagaactacagaaacctggtcttccttggtattgttgtctctaagccagacctcatcacctgtctggagcaaggaaaaaaacctttgaccatgaagaaacatgagatggtagccaacccctcagttacgtgttctcattttgcccgagatctttggccagagcagagcataaaagattctttccaaaaagtgacactgagaagatatgaaaactatggacatgacaatttacagtttaaaaagggctgtgaaagtgtagatgagtgtaaggtgcacaaaagaggttataatggacttaaccaatatttgacaactactcaaagcaaaatatttcagtgtgataaatatgtgaaagtcattcataaattttcaaattcaaacagacataagataagacatactggaaaaaaacctttcaaatgtatagaatgtggcaaagcttttaaccagtcttcaacccttactacacataagaaaattcatactggggagaaacccttcaaatgtgaagaatgtggcaaagccttcaactggtcctcacaccttactacacataagagaattcatactggagagaaacggtacaaatgtgaagactgtggcaaagcctttagccggttttcataccttactgcacataagataattcatagtggagagaaaccctacaaatgtgaagaatgtggcaaggcctttaagcgctcctctaaccttactacacataagataattcatactggagagaaaccctacaaatgtgaagaatgtggcaaggcctttaagcgctcctctatccttactgcgcataagataattcatagcggagagaaaccctacaaatgtgaagaatgtggcaaagcctttaagcacccctctgtccttactacacataaaagaattcatactggagagaaaccctacaaatgtgaagaatgtggcagagcctttaagtacttctcatcccttactacacacaagataattcatagtggagagaaaccctacaaatgtgaagaatgtggcaaagccttcaactggtcctcacaccttactacacataagagaattcatactggagagaaaccctacaaatgtgaagaatgtggcgaagcctttaagtactcctcttcccttactacacataagataatccatactggacagcaacccttcaagtgtgaagaatgtggcaaggcctttaagtgcttctctatccttactacacataagagaattcatactggagagaaaccctacaaatgtgaagaatgtggcaaagccttcaactcgtcctcacaccttactgcacataagagaattcatactggagagaaaccctacaaatgtgaacgatgtggcaaggcttttaagcgctcctttatccttactagacataagagaattcatactggagagaaaccctacaaatgtgaagaatgtggcaaaggctttaagtgcccctctacccttactacacataaggtaattcatactggagagaaactataaatgtgaggaatgtggcaaagctttaagctatcccactatgcttttttcacataagaaaattcatattggagggaaactgtacaagtgtgataaatgtggcaaagcctttatttcatcctcaaaccttagtagacattagataattcatgcgggaaagaaacccaacaaataagaaaatgcagcaaagcctttaaggacacctctgcccttactagacataagataattcgtactggagagaaaccctgtgagtttgatgaatgtcggaaagcctttaaccagctatcaacttttactaaatatgagaatttatatggaacataaaccctacaaatataaagaatgtgacaacgcttttaggaagttctgaacccttcttacacataattcatgctggacaaaaatcctacaagtttgaggaatgtggcaaatcctataacaagttttcaatatttttttttttgagatgaagtttcatgcttgtcatccaagctggagtacagtgccatgatctcggctcactgcaacctctgcctcctgggtttaagccattctcctacctcagcttcctgagtagctgggattacaggtgtcctccaacatgcccagctaatttttttatttttagtagagatgcgacttcgccatgtttgccaggctggtctcgaactcctgacctcaggtgatccacccaccttggcctcctaaagtgctgggattacaggcgtgagccacgacgcccagccacaagttctcaattcttaagaggcatggcaataattcatgttgaagaggaaatccgcaaagctaaaaaatgtgacattgcttttacgaacacctccaacttctctacacataacaataattatactagtgtgaaaccctagaaatatataaaatgtgacaaagcctttatatggttgccactcttgattgtaggttggataattcatactggcaaaactcctacaagtgtgaagaatgtggcaaaacttttaatcagttcttacaccttatctcacagaaaagctagtatccttgagaaaaattgtacaaatagaaggaatatggaaaacctattaattcctactcacatctaactcaacataaaaatcttccttttaataaaagcattaaaatggcaattactgtcaaaacttt

SEQ ID NO: 203679 - DNA, 544 bp, Homo sapiens
  Payload ID: 20167
  Gene Name: zinc finger protein 737
  ENST ID: ENST00000597940
  CDS Start-End: 140-271
ctctgcagccggagctccaggtcttgtcttcactgctgtgtgtcctctgctcctagaggcccagcctctgtggccctgtgtcctgcaggtattgggagatccacagctaagacgcccgggagcccctggaagcctagaaatggttggagtgcagtggcgtgatctcggcttactgcagcctccacctcctgggttcaagcaattctcctgcctcagcctcctgagtagctgggattacaggggccattgcaatttagagacgtggccatagaattctctctggaggagtggcattgcctggacactgcacagcggaatttatataggaatgtgatgttagagaactacagaaacctggtcttccttggtattgttgtctctaagccagacctcatcacctgtctggagcaaggaaaaaaacctttgaccatgaagaaacatgagatggtagccaacccctcagttacgtgttctcattttgcccgagatctttggccagagcagagcataaaagattctttccaaaaagtgacactgagaagat

SEQ ID NO: 203680 - DNA, 872 bp, Homo sapiens
  Payload ID: 20167
  Gene Name: zinc finger protein 737
  ENST ID: ENST00000594419
  CDS Start-End: 172-872
tgctgtgtgtcctctgctcctagaggcccagcctctgtggccctgtgtcctgcaggtattgggagatccacagctaagacgcccgggagcccctggaagcctagaaatggtattgttgtctctaagccagacctcatcacctgtctggagcaaggaaaaaaacctttgaccatgaagaaacatgagatggtagccaacccctcagttacgtgttctcattttgcccgagatctttggccagagcagagcataaaagattctttccaaaaagtgacactgagaagatatgaaaactatggacatgacaatttacagtttaaaaagggctgtgaaagtgtagatgagtgtaaggtgcacaaaagaggttataatggacttaaccaatatttgacaactactcaaagcaaaatatttcagtgtgataaatatgtgaaagtcattcataaattttcaaattcaaacagacataagataagacatactggaaaaaaacctttcaaatgtatagaatgtggcaaagcttttaaccagtcttcaacccttactacacataagaaaattcatactggggagaaacccttcaaatgtgaagaatgtggcaaagccttcaactggtcctcacaccttactacacataagagaattcatactggagagaaacggtacaaatgtgaagactgtggcaaagcctttagccggttttcataccttactgcacataagataattcatagtggagagaaaccctacaaatgtgaagaatgtggcaaggcctttaagcgctcctctaaccttactacacataagataattcatactggagagaaaccctacaaatgtgaagaatgtggcaaggcctttaagcgctcctc

SEQ ID NO: 203681 - DNA, 569 bp, Homo sapiens
  Payload ID: 20167
  Gene Name: zinc finger protein 737
  ENST ID: ENST00000596797
  CDS Start-End: 170-565
gaaggcttccgggttttgcggggcctttgtctctgcagccggagctccaggtcttgtcttcactgctgtgtgtcctctgctcctagaggcccagcctctgtggccctgtgtcctgcaggtattgggagatccacagctaagacgcccgggagcccctggaagcctagaaatggggccattgcaatttagagacgtggccatagaattctctctggaggagtggcattgcctggacactgcacagcggaatttatataggaatgtgatgttagagaactacagaaacctggtcttccttggtattgttgtctctaagccagacctcatcacctgtctggagcaaggaaaaaaacctttgaccatgaagaaacatgagatggtagccaacccctcagagactgggtttcaccatgttggcaagggtggtctcaaactcctgacctcagatgatctgcctgcctcggcctcccaaagtactggaattacaggcatgaggcaccccgcccggcccaattgtgtgggcttctatgtaggcagaactgaccataaactgtggctcaggtaaccga

SEQ ID NO: 203682 - DNA, 417 bp, Homo sapiens
  Payload ID: 20167
  Gene Name: zinc finger protein 737
  ENST ID: ENST00000596530
  CDS Start-End: 1-160
acataagagaattcatactggagagaaaccctacaaatgtgaagaatgtggcaaaggctttaagtgcccctctacccttactacacataagttttttgtttattgcagagaagtggctgtcctactagaaaactgctactctcatctgtatccacattgaataatagtgaatggaagtgaagcggataaaaggtaaatgtgtcttctctgtatcttttttcatccattggctgaagaacaggaaaatgtggaaaataaaagaaaatataacccctgaaaaatcctgaagaagctctcttaaccagacaaaaaaccttataggggattttttgtttgttttattattgtaccatctgcttctatgagtttaattttttttttttttttacactttacatagaaataggattatgtggg

SEQ ID NO: 203683 - DNA, 2442 bp, Homo sapiens
  Payload ID: 20168
  Gene Name: zinc finger protein 738
  Uniprot ID: Q8NE65
  ENST ID: ENST00000311015
  CDS Start-End: 212-625
gtccaatcaggcacgcagcttgagcggagaggacggcttccgggatgtggcgggatttgtccgcttctttgtctttggctgccgctggaactccgggtctcgtcttcactgctctgtgtcctctgctcctagaggcccagcctctggtcctgtgacctgcaggtattgggaatccacagctaagacgccgggacaccctggaagcctagaaatggacgacctgaggtatggagtgtatcctgtcaagggggcaagtggataccctggggctgagaggaatcttctggagtactcttattttgaaaaggggccgttgacatttagggatgtggtcatagaattctctcaggaggagtggcaatgcctggacactgctcagcaagatttgtataggaaagtgatgttagagaacttcagaaacctggtgttcttgggtattgatgtctctaagccagatctgatcacctgtctggagcaaggaaaagatccctggaatatgaagagacacagtatggtagccacacccccagaaagtggggtattgaaatttcctactataattatattgctgtctaggtgtttcttccagtctgtcaatatttgctttatatatttggaaccttagtgtgacatacacacagacacacagacgtgcacacacacacacacacacacaaaatttgtcataggttcccagttaataaatctattattgtttaatgtctttctttgtctctttgcagttttgacttaaagtactttatgtaagatatgacagtttttgacttaagatgtggcttttgtaatactattttgacctcttctgctctcatttggttaatatttgcatgcaatgtctaaatctatcttgccaccttcagtatgtttttaatcattagatgtcagctgacccttgtagaaaggcaaattggatcttggtttttaataattttaaataaatttctttattgaaagtatgtctcttgattggaaagttttctgaaacaaagagacttactaattttttttgttgttctatttgattcttgcatctttgtcccacattttctctctttgtttctctctgtggctgttttatttttactttgatatgcttttacttctttcttatgttgttttctgtgtctatacaggcatattctttgtggtacgtgggggattacataaaacctttaagagatacaatgtatttcagtctagttaaaaatgaacttttgttgcatgcaaaaattttttctcattacatatgttctcagatttgttcttgatgttgctaattatatttttatatgtatatttattaacatgtttataatgatttctatgcctttatctttcaaattttggggaataattaaaaatttcttctgtgccattatgataatgctaagaaatgtatttttgtgtatgtgcgtatctttcccagaaaataatgtgttttaatatgattttgtgttgctttgttaaatcatcttattttcattggaagcaactgttttcagcaccttttatatgtaaggaagtaccaatatactttttaaaatttggttatttttgaagtttgttttctttttatttagcaggacagatttggtgatggtattatactcacttgataactattttcttcagatttcactatatcacacagttttcttctgtcctgaaaaatttttgttgagaatccactggctatctcataagagtattcttgcaaataatatcactttttttttttttttttttgagatggagtttcactgttgttccccaggccggagtgaaatggcgcgatttcacctcgctgtgtcccaggttcaagcagttctcctacctcagcctcccgagtagctgggattacgggcatatgccaccacacccagctaagtttgtatttttagtagagacagggtttctccatgttggtcaggctagtctcgatctcctgacctcaggtgattcacccacctcagcttcccaaagtgccgggattacaagcttgagctaccgcgcccagccaacacatcacttttatcttgcagctcccgagattctcttttctgtgacttttaaaattgtgcttacatatgtgtttgatataaatatctttgtattctagtttgtttgttcagcttcttcatttttacatcactttttaaaagatttctgttattttttatatttttttacctccataatttctgtttttccaatattttaaatatttctgttcttatttccagttttctgattttctgtagttctctgtgttcatattttactcattgagtattcaatttattttgtttttaaaattaatgtatacattttttatttctttctgaaaaatttataataattttgttggtactacattgccctgttttgtatatattctaatcttttattaaaatttgcaca

SEQ ID NO: 203684 - DNA, 1142 bp, Homo sapiens
  Payload ID: 20168
  Gene Name: zinc finger protein 738
  ENST ID: ENST00000380870
  CDS Start-End: 150-503
gcttctttgtctttggctgccgctggaactccgggtctcgtcttcactgctctgtgtcctctgctcctagaggcccagcctctggtcctgtgacctgcaggtattgggaatccacagctaagacgccgggacaccctggaagcctagaaatggacgacctgaggtatggagtgtatcctgtcaagggggcaagtggataccctggggctgagaggaatcttctggagtactcttattttgaaaaggggccgttgacatttagggatgtggtcatagaattctctcaggaggagtggcaatgcctggacactgctcagcaagatttgtataggaaagtgatgttagagaacttcagaaacctggtgttcttgggtattgatgtctctaagccagatctgatcacctgtctggagcaaggaaaagatccctggaatatgaagagacacagtatggtagccacacccccagatggagtttcactgttgttccccaggccggagtgaaatggcgcgatttcacctcgctgtgtcccaggttcaagcagttctcctacctcagcctcccgagtagctgggattacgggcatatgccaccacacccagctaagtttgtatttttagtagagacagggtttctccatgttggtcaggctagtctcgatctcctgacctcaggtgattcacccacctcagcttcccaaagtgccgggattacaagcttgagctaccgcgcccagccaacacatcacttttatcttgcagctcccgagattctcttttctgtgacttttaaaattgtgcttacatatgtgtttgatataaatatctttgtattctagtttgtttgttcagcttcttcatttttacatcactttttaaaagatttctgttattttttatatttttttacctccataatttctgtttttccaatattttaaatatttctgttcttatttccagttttctgattttctgtagttctctgtgttcatattttactcattgagtattcaatttattttgtttttaaaattaatgtatacattttttatttctttctgaaaaatttataataattttgttggtactacattgccctgttttgtatatattctaatcttttattaaaatttgcacatt

SEQ ID NO: 203685 - DNA, 1086 bp, Homo sapiens
  Payload ID: 20168
  Gene Name: zinc finger protein 738
  ENST ID: ENST00000594245
  CDS Start-End: 112-318
cgtcttcactgctctgtgtcctctgctcctagaggcccagcctctggtcctgtgacctgcaggtattgggaatccacagctaagacgccgggacaccctggaagcctagaaatggacgacctgaggtatggagtgtatcctgtcaagggggcaagtggataccctggggctgagaggaatcttctggagtactcttattttgaaaagacggagtttcgctcttgttgcccaggctggagtgcaatggcgcgatctcagctcacctcaacctccgcctcccgggttcaagcgattctcctgcctcagccttccgagtagctgggattacaggcatgcaccaccaccctggctaattttgtatttttagtagagatggggtttctccatgttggtcaggctggtcttgaactcccgacctcaggtgacctacctacctcgacctcccaaaatgctgggattacaggcatgagccaccgtgccaggctgggatttaagtttttcttaggtaaacttaggaaaaacagaactggaaatactccagtgacatagaaaacaaattctacctaggttcttttccctgccccagttctgatcagattcaccatttttggaggccttatttaggtctggcctcactctggagtgttcccttacaaaactgatttataaagattcaagtttttgggggtaaatcctgctgactttctagagctgctgctcacagtatcctgaaacccaaaagcagatacataagaaaaataaactatacattttaagatcttaatttttaaattttgtagtaaaaccagtgcttacagaaacgttccatttagcagattttctgttcctgcagatccagtagctgctctacaagtcataaacaagtaaacataaacacaaaaaaatttctctaaactacattctaaatcctgagaattattgaacacttagtatgaactttcaaggtgttagtaggacataataacaaataataacacataatgtgttattcccagcacagtgctctgcaacatactattgagcacatagtacctgcttaataaacattgcattagttcatgtgta

SEQ ID NO: 203686 - DNA, 747 bp, Homo sapiens
  Payload ID: 20168
  Gene Name: zinc finger protein 738
  ENST ID: ENST00000597810
  CDS Start-End: 131-520
ccgctggaactccgggtctcgtcttcactgctctgtgtcctctgctcctagaggcccagcctctggtcctgtgacctgcaggtattgggaatccacagctaagacgccgggacaccctggaagcctagaaatggacgacctgaggtatggagtgtatcctgtcaagggggcaagtggataccctggggctgagaggaatcttctggagtactcttattttgaaaaggggccgttgacatttagggatgtggtcatagaattctctcaggaggagtggcaatgcctggacactgctcagcaagatttgtataggaaagtgatgttagagaacttcagaaacctggtgttcttgggtattgatgtctctaagccagatctgatcacctgtctggagcaaggaaaagatccctggaatatgaagagacacagtatggtagccacacccccaggcatattctttgtggtacgtgggggattacataaaacctttaagagatacaatgtatttcagtctagttaaaaatgaacttttgttgcatgcaaaaattttttctcattacatatgttctcagatttgttcttgatgttgctaattatatttttatatgtatatttattaacatgtttataatgatttctatgcctttatctttcaaattttggggaataattaaaaatttcttctgtgccattatgataatgctaagaaatgtatttttgtgtatgtgcgtatctttcccagaaaat

SEQ ID NO: 203687 - DNA, 1021 bp, Homo sapiens
  Payload ID: 20168
  Gene Name: zinc finger protein 738
  ENST ID: ENST00000597492
  CDS Start-End: 121-255
tccgggtctcgtcttcactgctctgtgtcctctgctcctagaggcccagcctctggtcctgtgacctgcaggtattgggaatccacagctaagacgccgggacaccctggaagcctagaaatgatggagtctcgctctgtctcccaggctggagtgcaatggcgcgatctcggctcacctcaacctccgcctcccggttttaaacaattctcccacttcagcctccttagtagctgggattacaggacgacctgaggtatggagtgtatcctgtcaagggggcaagtggataccctggggctgagaggaatcttctggagtactcttattttgaaaaggggccgttgacatttagggatgtggtcatagaattctctcaggaggagtggcaatgcctggacactgctcagcaagatttgtataggaaagtgatgttagagaacttcagaaacctggtgttcttgggtattgatgtctctaagccagatctgatcacctgtctggagcaaggaaaagatccctggaatatgaagagacacagtatggtagccacacccccaggtaggtgagagtgaataaaacagttgacatagatgaaaggttggaagattacaaaaaaaaaaaagcagtccctataatgtgatttgggaagctgtgttccaaagcaaatagattctgggaagcctgaggtgtgtggtttttttgtttgttttctttttgttgttgttactgtcacatagggccatcttctgtcttaggcttttaaattctctaaggattctactttcccttcattgattttccttcaagttcacagtgagagccagagtcctcttcatggcatataaaagactgcacaatctgactgcatttccattgttttgggggacacacaaatatctgcatgattttgagaaactttatgttaaactatttttttagttctcttttgcatcatgtctaaaatgtgtgagagtagtggtcactgttctattggtttttatgttaattttctgcacat

SEQ ID NO: 203688 - DNA, 2416 bp, Homo sapiens
  Payload ID: 20169
  Gene Name: zinc finger protein 74
  ENST ID: ENST00000356671
  CDS Start-End: 163-1881
cctgctctttccctgaaagagaatctcgaggatatatcgggttggggtcttcccgaagccaggtccaaggaatcggtgagtttcaaggatgtggctgtggacttcacccaggaggagtggggtcaactagactcccctcagagggccttgtaccgggatgtgatgttggagaactaccagaaccttcttgccctaggacctccactgcacaagccagatgtgatctctcatctggaacgaggcgaggagccatggagcatgcagagggaagtccccagagggccctgtccagaatgggagctgaaggcggtgccctctcaacagcagggcatttgcaaagaagaaccggcccaggagcccatcatggagcggcccctcggcggggcgcaggcgtgggggcgccaggcaggtgctctgcagaggagtcaggctgcgcctgggcgccgcacctgccatggtctgggacgtcctgtagaggaattccccctcaggtgtcccctcttcgcccagcaacgcgttcccgaggggggacccttgctggacacacgcaagaacgtccaggccactgagggcagaaccaaggcccccgcgagactgtgtgcaggggaaaacgcctccacgccaagtgagccagaaaagttcccccaggtgcgccggcagcgcggggcgggcgccggggagggcgagttcgtgtgcggcgagtgcgggaaggcgttccgccagagctcctccctcacgctgcaccggcgctggcacagccgggagaaggcttacaagtgcgatgaatgcggcaaggccttcacctggagcaccaaccttctggagcaccggcgcatccacaccggcgagaagcccttcttctgcggcgagtgcgggaaggccttcagctgccactcgtccctcaacgtgcaccagcgcatccacacgggcgagcggccctacaagtgcagcgcctgcgagaaggccttcagctgcagctcgctgctcagcatgcacctgcgggtgcacaccggcgagaagccctaccggtgcggcgagtgcggcaaggccttcaaccagcgtacacacctcacacgccaccaccgcatccacacgggcgagaagccctaccagtgcggctcctgcggcaaggccttcacctgccactcatccctcaccgtgcatgagaagatccacagcggggacaagccgttcaagtgcagcgactgcgagaaggccttcaacagccgctcgcgcctcaccctccaccagaggacgcacacgggcgagaagcccttcaagtgcgccgactgcgggaagggcttcagctgccacgcgtacctgctcgtgcaccggcgcatccacagcggcgagaagcccttcaagtgcaacgagtgcggcaaagccttcagctcccacgcctacctcatcgtgcaccggcgcatccacacaggcgagaagcccttcgactgcagccagtgttggaaggccttcagctgccactcgtccctcatcgtgcaccagcgcatccacaccggtgagaagccctacaagtgcagcgagtgcggcagagccttcagccagaaccactgtctcattaaacatcagaaaatccactccggggagaagtcgtttaagtgtgagaaatgtggggagatgttcaactggagctcgcacctcactgagcaccagaggctgcacagcgaggggaagcccttggccatccagttcaacaaacacctgctcagcacatactacgtgcctggcagcctgctgggtgcaggggatgctggactgagggacgtggatcccatcgacgcgctggatgtggcaaagctcttgtgcgtggttccccccagagctggcaggaatttctccctggggagcaaacctcgaaactaacatgatgtgctttggtgtcagtagctgctttctgagctactcaacaaggaaagcaccctggtcctccctggctcctagatccagaccaccttcctccaggtgtgggagccttgccttatcacccccatcaggtctgcatgccagggtgcctcctctagttaaagtcagtcacctccccagaagggccacactccaggaggagtgttgagagtcatttgaggtagtcttgccacctgttttccttgatgggcctggaagttgttgacaaggggaaagatctttcttgccaataaaaagaagggatatcgttgggtgccatggctcacacctgtaatcttaacactgtgggaggccaaggcaaggggatcacttgagcccaggagtctaggaccagcctggacaacatggtgagacctcgtctctacaaaaaatgcaaaaattagccagatgtggcggcatgtccctgtggtcccagctactcaggaggctgaggtgggaggatcatttgagcctaggaggtcaaggctgcagtgag

SEQ ID NO: 203689 - DNA, 2788 bp, Homo sapiens
  Payload ID: 20169
  Gene Name: zinc finger protein 74
  ENST ID: ENST00000357502
  CDS Start-End: 125-763
cctgctgctctttgtggcagtcgcagtccttttgtgggagtccggtctgtccacttgccggtccctcagaccgtcggcggtctctgtccgcttcgggacctgtccgctggtcgctccgcgtccgatggctcctggccgcggaaccttaggcctggccctggtctccgagcgcggctctttcctctcaggatcctgctctttccctgaaagagaatctcgaggatatatcgggttggggtcttcccgaagccaggtccaaggaatcggtgagtttcaaggatgtggctgtggacttcacccaggaggagtggggtcaactagactcccctcagagggccttgtaccgggatgtgatgttggagaactaccagaaccttcttgccctaggacctccactgcacaagccagatgtgatctctcatctggaacgaggcgaggagccatggagcatgcagagggaagtccccagagggccctgtccagaatgggagctgaaggcggtgccctctcaacagcagggcatttgcaaagaagaaccggcccaggagcccatcatggagcggcccctcggcggggcgcaggcgtgggggcgccaggcaggtgctctgcagaggagtcaggctgcgccctgggcgcccgcacctgccatggtctgggacgtccctgtagaggaattccccctcaggtgtcccctcttcgcccagcaacgcgttcccgaggggggacccttgctggacacacgcaagaacgtccaggccactgagggcagaaccaaggcccccgcgagactgtgtgcaggggaaaacgcctccacgccaagtgagccagaaaagttcccccaggtgcgccggcagcgcggggcgggcgccggggagggcgagttcgtgtgcggcgagtgcgggaaggcgttccgccagagctcctccctcacgctgcaccggcgctggcacagccgggagaaggcttacaagtgcgatgaatgcggcaaggccttcacctggagcaccaaccttctggagcaccggcgcatccacaccggcgagaagcccttcttctgcggcgagtgcgggaaggccttcagctgccactcgtccctcaacgtgcaccagcgcatccacacgggcgagcggccctacaagtgcagcgcctgcgagaaggccttcagctgcagctcgctgctcagcatgcacctgcgggtgcacaccggcgagaagccctaccggtgcggcgagtgcggcaaggccttcaaccagcgtacacacctcacacgccaccaccgcatccacacgggcgagaagccctaccagtgcggctcctgcggcaaggccttcacctgccactcatccctcaccgtgcatgagaagatccacagcggggacaagccgttcaagtgcagcgactgcgagaaggccttcaacagccgctcgcgcctcaccctccaccagaggacgcacacgggcgagaagcccttcaagtgcgccgactgcgggaagggcttcagctgccacgcgtacctgctcgtgcaccggcgcatccacagcggcgagaagcccttcaagtgcaacgagtgcggcaaagccttcagctcccacgcctacctcatcgtgcaccggcgcatccacacaggcgagaagcccttcgactgcagccagtgttggaaggccttcagctgccactcgtccctcatcgtgcaccagcgcatccacaccggtgagaagccctacaagtgcagcgagtgcggcagagccttcagccagaaccactgtctcattaaacatcagaaaatccactccggggagaagtcgtttaagtgtgagaaatgtggggagatgttcaactggagctcgcacctcactgagcaccagaggctgcacagcgaggggaagcccttggccatccagttcaacaaacacctgctcagcacatactacgtgcctggcagcctgctgggtgcaggggatgctggactgagggacgtggatcccatcgacgcgctggatgtggcaaagctcttgtgcgtggttccccccagagctggcaggaatttctccctggggagcaaacctcgaaactaacatgatgtgctttggtgtcagtagctgctttctgagctactcaacaaggaaagcaccctggtcctccctggctcctagatccagaccaccttcctccaggtgtgggagccttgccttatcacccccatcaggtctgcatgccagggtgcctcctctagttaaagtcagtcacctccccagaagggccacactccaggaggagtgttgagagtcatttgaggtagtcttgccacctgttttccttgatgggcctggaagttgttgacaaggggaaagatctttcttgccaataaaaagaagggatatcgttgggtgccatggctcacacctgtaatcttaacactgtgggaggccaaggcaaggggatcacttgagcccaggagtctaggaccagcctggacaacatggtgagacctcgtctctacaaaaaatgcaaaaattagccagatgtggcggcatgtccctgtggtcccagctactcaggaggctgaggtgggaggatcatttgagcctaggaggtcaaggctgcagtgagccatgattcacagcactgcactgcagcctgggtgacaaagcaagaccctgtgtgaaattaaaaggaggtatatcaactgttgtatcctcggacgggctcctgacacggctttaatcaggagtttcctccataaactattattttcagaataataataaaacaagaattatgactagca

SEQ ID NO: 203690 - DNA, 3159 bp, Homo sapiens
  Payload ID: 20169
  Gene Name: zinc finger protein 74
  Uniprot ID: Q16587
  ENST ID: ENST00000400451
  CDS Start-End: 515-2449
gtagtttgcgcctatttcgcgcaggcgcgctttcccgcagcggccgcctgctgctctttgtggcagtcgcagtccttttgtgggagtccggtctgtccacttgccggtccctcagaccgtcggcggtctctgtccgcttcgggacctgtccgctggtcgctccgcgtccgatggctcctggccgcggaaccttaggcctggccctggtctccgagcgcgggttcgccgggaggagcgtgtggcgggggtgtgccggggcgtgagtgcgccgagcatggggctgagcctggtgtggggagtgggtatctgcggagccggcctgaaccccacctcagccgggcgcggggagggggctccgtgcgtgtgatcgtgcagctgtgagcgcgtggccgccccgcggggctccgctgcaggcccctcagccccaggagcagtactcgctcttcagggcctgccctggatcctggaggctacacagctgcccactcctcctggggaggctgccgtggaggccatggagatccctgccccggagcccgagaagacagctctttcctctcaggatcctgctctttccctgaaagagaatctcgaggatatatcgggttggggtcttcccgaagccaggtccaaggaatcggtgagtttcaaggatgtggctgtggacttcacccaggaggagtggggtcaactagactcccctcagagggccttgtaccgggatgtgatgttggagaactaccagaaccttcttgccctaggacctccactgcacaagccagatgtgatctctcatctggaacgaggcgaggagccatggagcatgcagagggaagtccccagagggccctgtccagaatgggagctgaaggcggtgccctctcaacagcagggcatttgcaaagaagaaccggcccaggagcccatcatggagcggcccctcggcggggcgcaggcgtgggggcgccaggcaggtgctctgcagaggagtcaggctgcgccctgggcgcccgcacctgccatggtctgggacgtccctgtagaggaattccccctcaggtgtcccctcttcgcccagcaacgcgttcccgaggggggacccttgctggacacacgcaagaacgtccaggccactgagggcagaaccaaggcccccgcgagactgtgtgcaggggaaaacgcctccacgccaagtgagccagaaaagttcccccaggtgcgccggcagcgcggggcgggcgccggggagggcgagttcgtgtgcggcgagtgcgggaaggcgttccgccagagctcctccctcacgctgcaccggcgctggcacagccgggagaaggcttacaagtgcgatgaatgcggcaaggccttcacctggagcaccaaccttctggagcaccggcgcatccacaccggcgagaagcccttcttctgcggcgagtgcgggaaggccttcagctgccactcgtccctcaacgtgcaccagcgcatccacacgggcgagcggccctacaagtgcagcgcctgcgagaaggccttcagctgcagctcgctgctcagcatgcacctgcgggtgcacaccggcgagaagccctaccggtgcggcgagtgcggcaaggccttcaaccagcgtacacacctcacacgccaccaccgcatccacacgggcgagaagccctaccagtgcggctcctgcggcaaggccttcacctgccactcatccctcaccgtgcatgagaagatccacagcggggacaagccgttcaagtgcagcgactgcgagaaggccttcaacagccgctcgcgcctcaccctccaccagaggacgcacacgggcgagaagcccttcaagtgcgccgactgcgggaagggcttcagctgccacgcgtacctgctcgtgcaccggcgcatccacagcggcgagaagcccttcaagtgcaacgagtgcggcaaagccttcagctcccacgcctacctcatcgtgcaccggcgcatccacacaggcgagaagcccttcgactgcagccagtgttggaaggccttcagctgccactcgtccctcatcgtgcaccagcgcatccacaccggtgagaagccctacaagtgcagcgagtgcggcagagccttcagccagaaccactgtctcattaaacatcagaaaatccactccggggagaagtcgtttaagtgtgagaaatgtggggagatgttcaactggagctcgcacctcactgagcaccagaggctgcacagcgaggggaagcccttggccatccagttcaacaaacacctgctcagcacatactacgtgcctggcagcctgctgggtgcaggggatgctggactgagggacgtggatcccatcgacgcgctggatgtggcaaagctcttgtgcgtggttccccccagagctggcaggaatttctccctggggagcaaacctcgaaactaacatgatgtgctttggtgtcagtagctgctttctgagctactcaacaaggaaagcaccctggtcctccctggctcctagatccagaccaccttcctccaggtgtgggagccttgccttatcacccccatcaggtctgcatgccagggtgcctcctctagttaaagtcagtcacctccccagaagggccacactccaggaggagtgttgagagtcatttgaggtagtcttgccacctgttttccttgatgggcctggaagttgttgacaaggggaaagatctttcttgccaataaaaagaagggatatcgttgggtgccatggctcacacctgtaatcttaacactgtgggaggccaaggcaaggggatcacttgagcccaggagtctaggaccagcctggacaacatggtgagacctcgtctctacaaaaaatgcaaaaattagccagatgtggcggcatgtccctgtggtcccagctactcaggaggctgaggtgggaggatcatttgagcctaggaggtcaaggctgcagtgagccatgattcacagcactgcactgcagcctgggtgacaaagcaagaccctgtgtgaaattaaaaggaggtatatcaactgttgtatcctcggacgggctcctgacacggctttaatcaggagtttcctccataaactattattttcagaataataataaaacaagaattatgacta

SEQ ID NO: 203691 - DNA, 2789 bp, Homo sapiens
  Payload ID: 20169
  Gene Name: zinc finger protein 74
  Uniprot ID: Q16587
  ENST ID: ENST00000403682
  CDS Start-End: 502-1038
atttcgcgcaggcgcgctttcccgcagcggccgcctgctgctctttgtggcagtcgcagtccttttgtgggagtccggtctgtccacttgccggtccctcagaccgtcggcggtctctgtccgcttcgggacctgtccgctggtcgctccgcgtccgatggctcctggccgcggaaccttaggcctggccctggtctccgagcgcgggttcgccgggaggagcgtgtggcgggggtgtgccggggcgtgagtgcgccgagcatggggctgagcctggtgtggggagtgggtatctgcggagccggcctgaaccccacctcagccgggcgcggggagggggctccgtgcgtgtgatcgtgcagctgtgagcgcgtggccgccccgcggggctccgctgcaggcccctcagccccaggagcagtactcgctcttcagggcctgccctggatcctggaggctacacagctgcccactcctcctggggaggctgccgtggaggccatggagatccctgccccggagcccgagaagacaggaatcggtgagtttcaaggatgtggctgtggacttcacccaggaggagtggggtcaactagactcccctcagagggccttgtaccgggatgtgatgttggagaactaccagaaccttcttgccctaggacctccactgcacaagccagatgtgatctctcatctggaacgaggcgaggagccatggagcatgcagagggaagtccccagagggccctgtccagaatgggagctgaaggcggtgccctctcaacagcagggcatttgcaaagaagaaccggcccaggagcccatcatggagcggcccctcggcggggcgcaggcgtgggggcgccaggcaggtgctctgcagaggagtcaggctgcgccctgggcgcccgcacctgccatggtctgggacgtccctgtagaggaattccccctcaggtgtcccctcttcgcccagcaacgcgttcccgaggggggacccttgctggacacacgcaagaacgtccaggccactgagggcagaaccaaggcccccgcgagactgtgtgcaggggaaaacgcctccacgccaagtgagccagaaaagttcccccaggtgcgccggcagcgcggggcgggcgccggggagggcgagttcgtgtgcggcgagtgcgggaaggcgttccgccagagctcctccctcacgctgcaccggcgctggcacagccgggagaaggcttacaagtgcgatgaatgcggcaaggccttcacctggagcaccaaccttctggagcaccggcgcatccacaccggcgagaagcccttcttctgcggcgagtgcgggaaggccttcagctgccactcgtccctcaacgtgcaccagcgcatccacacgggcgagcggccctacaagtgcagcgcctgcgagaaggccttcagctgcagctcgctgctcagcatgcacctgcgggtgcacaccggcgagaagccctaccggtgcggcgagtgcggcaaggccttcaaccagcgtacacacctcacacgccaccaccgcatccacacgggcgagaagccctaccagtgcggctcctgcggcaaggccttcacctgccactcatccctcaccgtgcatgagaagatccacagcggggacaagccgttcaagtgcagcgactgcgagaaggccttcaacagccgctcgcgcctcaccctccaccagaggacgcacacgggcgagaagcccttcaagtgcgccgactgcgggaagggcttcagctgccacgcgtacctgctcgtgcaccggcgcatccacagcggcgagaagcccttcaagtgcaacgagtgcggcaaagccttcagctcccacgcctacctcatcgtgcaccggcgcatccacacaggcgagaagcccttcgactgcagccagtgttggaaggccttcagctgccactcgtccctcatcgtgcaccagcgcatccacaccggtgagaagccctacaagtgcagcgagtgcggcagagccttcagccagaaccactgtctcattaaacatcagaaaatccactccggggagaagtcgtttaagtgtgagaaatgtggggagatgttcaactggagctcgcacctcactgagcaccagaggctgcacagcgaggggaagcccttggccatccagttcaacaaacacctgctcagcacatactacgtgcctggcagcctgctgggtgcaggggatgctggactgagggacgtggatcccatcgacgcgctggatgtggcaaagctcttgtgcgtggttccccccagagctggcaggaatttctccctggggagcaaacctcgaaactaacatgatgtgctttggtgtcagtagctgctttctgagctactcaacaaggaaagcaccctggtcctccctggctcctagatccagaccaccttcctccaggtgtgggagccttgccttatcacccccatcaggtctgcatgccagggtgcctcctctagttaaagtcagtcacctccccagaagggccacactccaggaggagtgttgagagtcatttgaggtagtcttgccacctgttttccttgatgggcctggaagttgttgacaaggggaaagatctttcttgccaataaaaagaagggatatcgttgggtgccatggctcacacctgtaatcttaacactgtgggaggccaaggcaaggggatcacttgagcccaggagtctaggaccagcctggacaacatggtgagacctcgtctctacaaaaaatgcaaaaa

SEQ ID NO: 203692 - DNA, 1839 bp, Homo sapiens
  Payload ID: 20169
  Gene Name: zinc finger protein 74
  Uniprot ID: Q16587
  ENST ID: ENST00000405993
  CDS Start-End: 1-1839
atggagatccctgccccggagcccgagaagacagctctttcctctcaggatcctgctctttccctgaaagagaatctcgaggatatatcgggttggggtcttcccgaagccaggtccaaggaatcggtgagtttcaaggatgtggctgtggacttcacccaggaggagtggggtcaactagactcccctcagagggccttgtaccgggatgtgatgttggagaactaccagaaccttcttgccctagaatgggagctgaaggcggtgccctctcaacagcagggcatttgcaaagaagaaccggcccaggagcccatcatggagcggcccctcggcggggcgcaggcgtgggggcgccaggcaggtgctctgcagaggagtcaggctgcgccctgggcgcccgcacctgccatggtctgggacgtccctgtagaggaattccccctcaggtgtcccctcttcgcccagcaacgcgttcccgaggggggacccttgctggacacacgcaagaacgtccaggccactgagggcagaaccaaggcccccgcgagactgtgtgcaggggaaaacgcctccacgccaagtgagccagaaaagttcccccaggtgcgccggcagcgcggggcgggcgccggggagggcgagttcgtgtgcggcgagtgcgggaaggcgttccgccagagctcctccctcacgctgcaccggcgctggcacagccgggagaaggcttacaagtgcgatgaatgcggcaaggccttcacctggagcaccaaccttctggagcaccggcgcatccacaccggcgagaagcccttcttctgcggcgagtgcgggaaggccttcagctgccactcgtccctcaacgtgcaccagcgcatccacacgggcgagcggccctacaagtgcagcgcctgcgagaaggccttcagctgcagctcgctgctcagcatgcacctgcgggtgcacaccggcgagaagccctaccggtgcggcgagtgcggcaaggccttcaaccagcgtacacacctcacacgccaccaccgcatccacacgggcgagaagccctaccagtgcggctcctgcggcaaggccttcacctgccactcatccctcaccgtgcatgagaagatccacagcggggacaagccgttcaagtgcagcgactgcgagaaggccttcaacagccgctcgcgcctcaccctccaccagaggacgcacacgggcgagaagcccttcaagtgcgccgactgcgggaagggcttcagctgccacgcgtacctgctcgtgcaccggcgcatccacagcggcgagaagcccttcaagtgcaacgagtgcggcaaagccttcagctcccacgcctacctcatcgtgcaccggcgcatccacacaggcgagaagcccttcgactgcagccagtgttggaaggccttcagctgccactcgtccctcatcgtgcaccagcgcatccacaccggtgagaagccctacaagtgcagcgagtgcggcagagccttcagccagaaccactgtctcattaaacatcagaaaatccactccggggagaagtcgtttaagtgtgagaaatgtggggagatgttcaactggagctcgcacctcactgagcaccagaggctgcacagcgaggggaagcccttggccatccagttcaacaaacacctgctcagcacatactacgtgcctggcagcctgctgggtgcaggggatgctggactgagggacgtggatcccatcgacgcgctggatgtggcaaagctcttgtgcgtggttccccccagagctggcaggaatttctccctggggagcaaacctcgaaactaa

SEQ ID NO: 203693 - DNA, 3744 bp, Homo sapiens
  Payload ID: 20169
  Gene Name: zinc finger protein 74
  ENST ID: ENST00000437275
  CDS Start-End: 227-436
ggtgtggggagtgggtatctgcggagccggcctgaaccccacctcagccgggcgcggggagggggctccgtgcgtgtgatcgtgcagctgtgagcgcgtggccgccccgcggggctccgctgcaggcccctcagccccaggagcagtactcgctcttcagggcctgccctggatcctggaggctacacagctgcccactcctcctggggaggctgccgtggaggccatggagatccctgccccggagcccgagaagacagctctttcctctcaggatcctgctctttccctgaaagagaatctcgaggatatatcgggttggggtcttcccgaagccaggtccaagagtttggctcttgtcacccaggctggagtgcagtggcgcaatcttggctcactgcaacctccacctcttgggttcaagcaattctcctgacctcaggaatcggtgagtttcaaggatgtggctgtggacttcacccaggaggagtggggtcaactagactcccctcagagggccttgtaccgggatgtgatgttggagaactaccagaaccttcttgccctaggacctccactgcacaagccagatgtgatctctcatctggaacgaggcgaggagccatggagcatgcagagggaagtccccagagggccctgtccagaatgggagctgaaggcggtgccctctcaacagcagggcatttgcaaagaagaaccggcccaggagcccatcatggagcggcccctcggcggggcgcaggcgtgggggcgccaggcaggtgctctgcagaggagtcaggctgcgccctgggcgcccgcacctgccatggtctgggacgtccctgtagaggaattccccctcaggtgtcccctcttcgcccagcaacgcgttcccgaggggggacccttgctggacacacgcaagaacgtccaggccactgagggcagaaccaaggcccccgcgagactgtgtgcaggggaaaacgcctccacgccaagtgagccagaaaagttcccccaggtgcgccggcagcgcggggcgggcgccggggagggcgagttcgtgtgcggcgagtgcgggaaggcgttccgccagagctcctccctcacgctgcaccggcgctggcacagccgggagaaggcttacaagtgcgatgaatgcggcaaggccttcacctggagcaccaaccttctggagcaccggcgcatccacaccggcgagaagcccttcttctgcggcgagtgcgggaaggccttcagctgccactcgtccctcaacgtgcaccagcgcatccacacgggcgagcggccctacaagtgcagcgcctgcgagaaggccttcagctgcagctcgctgctcagcatgcacctgcgggtgcacaccggcgagaagccctaccggtgcggcgagtgcggcaaggccttcaaccagcgtacacacctcacacgccaccaccgcatccacacgggcgagaagccctaccagtgcggctcctgcggcaaggccttcacctgccactcatccctcaccgtgcatgagaagatccacagcggggacaagccgttcaagtgcagcgactgcgagaaggccttcaacagccgctcgcgcctcaccctccaccagaggacgcacacgggcgagaagcccttcaagtgcgccgactgcgggaagggcttcagctgccacgcgtacctgctcgtgcaccggcgcatccacagcggcgagaagcccttcaagtgcaacgagtgcggcaaagccttcagctcccacgcctacctcatcgtgcaccggcgcatccacacaggcgagaagcccttcgactgcagccagtgttggaaggccttcagctgccactcgtccctcatcgtgcaccagcgcatccacaccggtgagaagccctacaagtgcagcgagtgcggcagagccttcagccagaaccactgtctcattaaacatcagaaaatccactccggggagaagtcgtttaagtgtgagaaatgtggggagatgttcaactggagctcgcacctcactgagcaccagaggctgcacagcgaggggaagcccttggccatccagttcaacaaacacctgctcagcacatactacgtgcctggcagcctgctgggtgcaggggatgctggactgagggacgtggatcccatcgacgcgctggatgtggcaaagctcttgtgcgtggttccccccagagctggcaggaatttctccctggggagcaaacctcgaaactaacatgatgtgctttggtgtcagtagctgctttctgagctactcaacaaggaaagcaccctggtcctccctggctcctagatccagaccaccttcctccaggtgtgggagccttgccttatcacccccatcaggtctgcatgccagggtgcctcctctagttaaagtcagtcacctccccagaagggccacactccaggaggagtgttgagagtcatttgaggtagtcttgccacctgttttccttgatgggcctggaagttgttgacaaggggaaagatctttcttgccaataaaaagaagggatatcgttgggtgccatggctcacacctgtaatcttaacactgtgggaggccaaggcaaggggatcacttgagcccaggagtctaggaccagcctggacaacatggtgagacctcgtctctacaaaaaatgcaaaaattagccagatgtggcggcatgtccctgtggtcccagctactcaggaggctgaggtgggaggatcatttgagcctaggaggtcaaggctgcagtgagccatgattcacagcactgcactgcagcctgggtgacaaagcaagaccctgtgtgaaattaaaaggaggtatatcaactgttgtatcctcggacgggctcctgacacggctttaatcaggagtttcctccataaactattattttcagaataataataaaacaagaattatgactagcatcactttccagtgaacattattatattgctagagaggagaataatcttgggtggtgggcatttggaaaaagtgaatttcctggacttaactcatgtaaatagctctactgcagagctgtgtgtttagtgacagtgcagtcaggggcattcccacagctgtcacagcacggcccagcatcattgtagccagatcctaacatgccaacatcacctcttgccatttagcccctagtgagaaattgggagctaccaggcaggtgcccagtgcattcagggaagatgggcacaacatcaggatgggtgtgtctggaagctcctcttcactgaccagggctgggcagggccaccctgggctggtgaggctgccctgcagggcttctcactatgtagcaccagtcaccagcccaggtcacagaagaagcccctcccagcacccactggagaggggaagctgaagcccagggagacgggctccatggtggtcccacatggagctgttttgcaaaccctggaaaaggcggctctccctgtcccaacactcttcagagacaggaagacagagttaatcttgaatgaatgttatttctacttagtcctaagcaagaataagctgccctcttggtgatcatactttatacggagtgctatcgtttatgaaatgctttcagtatgctttttaaattatgcaggcaaaataaccacacttcagaaaatgtggacttctgaaaaataaaatccccataattcttaataaaactgccttttgcactttga

SEQ ID NO: 203694 - DNA, 591 bp, Homo sapiens
  Payload ID: 20169
  Gene Name: zinc finger protein 74
  ENST ID: ENST00000420626
  CDS Start-End: 441-591
cttttgtgggagtccggtctgtccacttgccggtccctcagaccgtcggcggtctctgtccgcttcgggacctgtccgctggtcgctccgcgtccgatggctcctggccgcggaaccttaggcctggccctggtctccgagcgcgggttcgccgggaggagcgtgtggcgggggtgtgccggggcgtgagtgcgccgagcatggggctgagcctggtgtggggagtgggtatctgcggagccggcctgaaccccacctcagccgggcgcggggagggggctccgtgcgtgtgatcgtgcagctgtgagcgcgtggccgccccgcggggctccgctgcaggcccctcagccccaggagcagtactcgctcttcagggcctgccctggatcctggaggctacacagctgcccactcctcctggggaggctgccgtggaggccatggagatccctgccccggagcccgagaagacagaatgggagctgaaggcggtgccctctcaacagcagggcatttgcaaagaagaaccggcccaggagcccatcatggagcggcccctcggcggggcgcaggcgtgggggcgccaggcag

SEQ ID NO: 203695 - DNA, 3714 bp, Homo sapiens
  Payload ID: 20169
  Gene Name: zinc finger protein 74
  Uniprot ID: Q16587
  ENST ID: ENST00000611540
  CDS Start-End: 287-2221
gtagtttgcgcctatttcgcgcaggcgcgctttcccgcagcggccgcctgctgctctttgtggcagtcgcagtccttttgtgggagtccggtctgtccacttgccggtccctcagaccgtcggcggtctctgtccgcttcgggacctgtccgctggtcgctccgcgtccgatggctcctggccgcggaaccttaggcctggccctggtctccgagcgcggggcctgccctggatcctggaggctacacagctgcccactcctcctggggaggctgccgtggaggccatggagatccctgccccggagcccgagaagacagctctttcctctcaggatcctgctctttccctgaaagagaatctcgaggatatatcgggttggggtcttcccgaagccaggtccaaggaatcggtgagtttcaaggatgtggctgtggacttcacccaggaggagtggggtcaactagactcccctcagagggccttgtaccgggatgtgatgttggagaactaccagaaccttcttgccctaggacctccactgcacaagccagatgtgatctctcatctggaacgaggcgaggagccatggagcatgcagagggaagtccccagagggccctgtccagaatgggagctgaaggcggtgccctctcaacagcagggcatttgcaaagaagaaccggcccaggagcccatcatggagcggcccctcggcggggcgcaggcgtgggggcgccaggcaggtgctctgcagaggagtcaggctgcgccctgggcgcccgcacctgccatggtctgggacgtccctgtagaggaattccccctcaggtgtcccctcttcgcccagcaacgcgttcccgaggggggacccttgctggacacacgcaagaacgtccaggccactgagggcagaaccaaggcccccgcgagactgtgtgcaggggaaaacgcctccacgccaagtgagccagaaaagttcccccaggtgcgccggcagcgcggggcgggcgccggggagggcgagttcgtgtgcggcgagtgcgggaaggcgttccgccagagctcctccctcacgctgcaccggcgctggcacagccgggagaaggcttacaagtgcgatgaatgcggcaaggccttcacctggagcaccaaccttctggagcaccggcgcatccacaccggcgagaagcccttcttctgcggcgagtgcgggaaggccttcagctgccactcgtccctcaacgtgcaccagcgcatccacacgggcgagcggccctacaagtgcagcgcctgcgagaaggccttcagctgcagctcgctgctcagcatgcacctgcgggtgcacaccggcgagaagccctaccggtgcggcgagtgcggcaaggccttcaaccagcgtacacacctcacacgccaccaccgcatccacacgggcgagaagccctaccagtgcggctcctgcggcaaggccttcacctgccactcatccctcaccgtgcatgagaagatccacagcggggacaagccgttcaagtgcagcgactgcgagaaggccttcaacagccgctcgcgcctcaccctccaccagaggacgcacacgggcgagaagcccttcaagtgcgccgactgcgggaagggcttcagctgccacgcgtacctgctcgtgcaccggcgcatccacagcggcgagaagcccttcaagtgcaacgagtgcggcaaagccttcagctcccacgcctacctcatcgtgcaccggcgcatccacacaggcgagaagcccttcgactgcagccagtgttggaaggccttcagctgccactcgtccctcatcgtgcaccagcgcatccacaccggtgagaagccctacaagtgcagcgagtgcggcagagccttcagccagaaccactgtctcattaaacatcagaaaatccactccggggagaagtcgtttaagtgtgagaaatgtggggagatgttcaactggagctcgcacctcactgagcaccagaggctgcacagcgaggggaagcccttggccatccagttcaacaaacacctgctcagcacatactacgtgcctggcagcctgctgggtgcaggggatgctggactgagggacgtggatcccatcgacgcgctggatgtggcaaagctcttgtgcgtggttccccccagagctggcaggaatttctccctggggagcaaacctcgaaactaacatgatgtgctttggtgtcagtagctgctttctgagctactcaacaaggaaagcaccctggtcctccctggctcctagatccagaccaccttcctccaggtgtgggagccttgccttatcacccccatcaggtctgcatgccagggtgcctcctctagttaaagtcagtcacctccccagaagggccacactccaggaggagtgttgagagtcatttgaggtagtcttgccacctgttttccttgatgggcctggaagttgttgacaaggggaaagatctttcttgccaataaaaagaagggatatcgttgggtgccatggctcacacctgtaatcttaacactgtgggaggccaaggcaaggggatcacttgagcccaggagtctaggaccagcctggacaacatggtgagacctcgtctctacaaaaaatgcaaaaattagccagatgtggcggcatgtccctgtggtcccagctactcaggaggctgaggtgggaggatcatttgagcctaggaggtcaaggctgcagtgagccatgattcacagcactgcactgcagcctgggtgacaaagcaagaccctgtgtgaaattaaaaggaggtatatcaactgttgtatcctcggacgggctcctgacacggctttaatcaggagtttcctccataaactattattttcagaataataataaaacaagaattatgactagcatcactttccagtgaacattattatattgctagagaggagaataatcttgggtggtgggcatttggaaaaagtgaatttcctggacttaactcatgtaaatagctctactgcagagctgtgtgtttagtgacagtgcagtcaggggcattcccacagctgtcacagcacggcccagcatcattgtagccagatcctaacatgccaacatcacctcttgccatttagcccctagtgagaaattgggagctaccaggcaggtgcccagtgcattcagggaagatgggcacaacatcaggatgggtgtgtctggaagctcctcttcactgaccagggctgggcagggccaccctgggctggtgaggctgccctgcagggcttctcactatgtagcaccagtcaccagcccaggtcacagaagaagcccctcccagcacccactggagaggggaagctgaagcccagggagacgggctccatggtggtcccacatggagctgttttgcaaaccctggaaaaggcggctctccctgtcccaacactcttcagagacaggaagacagagttaatcttgaatgaatgttatttctacttagtcctaagcaagaataagctgccctcttggtgatcatactttatacggagtgctatcgtttatgaaatgctttcagtatgctttttaaattatgcaggcaaaataaccacacttcagaaaatgtggacttctgaaaaataaaatccccataattcttaataaaactgccttttgcactttgatacatt

SEQ ID NO: 203696 - DNA, 8578 bp, Homo sapiens
  Payload ID: 20170
  Gene Name: zinc finger protein 740
  Uniprot ID: Q8NDX6
  ENST ID: ENST00000416904
  CDS Start-End: 446-1027
aaacgggccggggttggtgtttgtaaacttgcctcggtcccggtgggggcagccgcggcggtggggttggcagggtgtgctggggcctggaggaggcgccgcgcggccagggagccagcgggaggccgcgcctggcaggtttctgaaacagatcgtgagcttcatcaagagaattcaactggaaaaccaagactggtagactctctttttcttcagacaataggcaggagccaggcagagtccagggattcttggaacacctatcttttcttcggaggacactaagttctatttgaagacaaagttcaatatggcaacaggactgatgggacacgaaggagtcgctaccgtgatttggtgacagttcttcaaaacgacagtgtctcaaggaaaggtggacctaggaactcctgaacttttgggttgccttaagtgagaaatcagcatggctcaggcaagtctcctggcttgtgaaggcctagcaggtgtgagtttggttcccactgcagccagcaagaagatgatgctgagccagattgccagcaagcaggccgagaatggcgagcgggcaggtagccctgatgtgctgaggtgctcgagtcagggtcaccgaaaagacagtgataagtcccggagccgcaaagatgatgacagcttgtctgaggcctctcattcaaaaaagactgttaaaaaggtggtggtagtggaacaaaatggttcttttcaagtaaagattcccaaaaattttgtttgtgaacactgctttggagcctttcggagcagttaccacctaaagaggcacatccttattcacactggtgagaagccatttgaatgcgatatatgtgatatgcgtttcatccagaagtaccacctggaacgccacaagcgtgtgcacagtggtgaaaagccttaccagtgtgaacggtgtcatcagtgtttttctcggacagatcgattactcagacacaaacggatgtgccaagggtgccagtccaagacttccgacgggcagttttctctataggcgcaaggggccccgggtggtgggagtgatcagaagaacctgccgaagagcacaccccctctggtctgatggtcccaccaccgccccatgtgaacctgtcccactcctggaggagtggacccaggagaccagaagagtgcatcaggggacagtggccccagaacctcagctctgtaaataatctgagactatgagtatctcggggaagttcttacagcattcctgggtaggggagctagtccctggacccttggctgaggtcataggtggggactcaaggtacaggaccaagactgaagtgtggctcccacaaccttggactccagctggcagctgaaatggaaaagattggggaaggggatttgtttgttctgttcttgtttttgtttatccaaaagcaacttcagcgggtaaactgtggatacaggtaatccagaggcataagagtcctggtccaaagtagggactatagctggtccagctctccccaaaaattgggtttttagttgcagtagctcctcagtgtttcacaatcctgcacttcgcctcctttttgaggaagaataaggtcaggaatggcagctgagcttactttggcttccttatacactgtagggacaaaaggaaaaacggggtggagcagacaagggctggatccaaaaagtggatggcacctcttccttcctcaagggaaaaggaagagttgtgccagtgggtgttgtcatggcccatgtcacattggcacctgatggcatcagctcaaatgcctttaggaggaaacttgggtgagagtggcccatgaagcccttttcttctttttttggggagtcggtcttggagatggtatgtggctacctcgctgccattgactcctaaagtgagacagatgtgttgagcaaggagtcatggaagtcaaagtgggttctctctccttgtgccctcttaggaacaacccaagactggtcccaagttggctaacagctgctcaagaaacaaaggaatctggggtcttctgacatgcctgttgagcagtaggagctgttctccctccccaagtcctatcactgtattcaggtagaggaggtagggaggggtctgtcctttggtcccaaaaaacaagatctcggcttgcttcctgatggccatccctacccaacagagtgtgggggatgggggtgggggtgctgcagagaaaagactaaagaagaaacctaatgtaggttccattcttaaccatattctttgctcctctctgctccaataccaccaccttgtccactcccaaaaaagtaatcgggtgtgtgtgtgtgtgtgagagagagtgtgtgtgagatatgaatgcatgtatttgtatgcttgcaggagatggcatattattgagccaaacccttctctggccctcaccttcagggaggatgagtggaaaatagcctcctcttgcccaaacatgaagggtgcttgaggtctcagcaggagctgaagaacacaatttggggaacagaagggcttttgttttggagggtttttttttttaagatgaattcaacagcctggtggttaggatgtttctaacccaagccagggcttgtgaacatgaattttctaaggtgaaataaaccttttctttctgctaaagaaagaatccttatgggaagttttggggtttggttgacccccactgtaacctgacctgacctgtggcgggtacgggaactgtcttagtaatcatggagactggctgaacctgagtgccaagctgtcagtagggtctgagatgggaaactcctgaaagtatgatttcatttcccagaaaatgtaaagaatggataccagcaatgattcctggctgttacctattctggaggggtggggttggggagggggttgtccatacctctgtggtatgagtatttcagggaaaaagaaagcaggcatggcacccattcgattttccctgacagcatctgagatccttttggggagacgctgaggagtgtttgctgccatgtactcttacagctctatgctgacactcccatttgatgtggtccagaacttagacctcagtccttggatcagccctgtggtccctgcaagcaggggcatctttctgcatgtgagccagcccccttcctgttcaagggttctgctggatctgggcttttcctgtccttcacttctgggatgattcaccccacatcttccagtaccctgtaaaccattttaaaatatttagaaaactatcctcccaaaaatgcttttgaaaatgagagccctctgtccctgccacttacagctagtctctttgggataggggtgtatgtggagagattcatgtaagtctcacatgagtgacctgtgcccctatgtgtactaatgtgtgtactgggtcagaaggtgccctgggttcccacagaccttggtttcctgcctgggtgggtgggagggagggaacttcagagagtatgtgcgaacagccatagcagagccacccctgccaaggacccagtgagggaaactcaggagcaggtggttggttcagttcccgcgctgatgtctggggcagtgcatgtgtgagaagagaggcgcaaagcagtgaaaggagtgatttggcatccagagggcccgggagccccacggataccccagggaagccactgactcacaccgctgcagaggctcctgggcccaatgcccgacccctgctggccagcatggggcctagcactggaagatgcctcaggtgtgtttggagtgggggaaacggaagtagggcacgctctcagagaccaggatagagagtcagggaacctgggaaagagtagtgccagttccgggtaggctgctgcaccaggccctaccagctcaggctataaacagtctgctttgccccaagtcttttccgtccacccccaacagccttgtcatcacttagctactgatcacgcccatggcttgacattggagggttacattagtggagtccgccacagcttcgaaccctctccccagatgccctttgcctctgctgtggccctggggttttatcaactgtccccttcctatcctcctctccaccctgttttttgttttttttttttttaaataatattttgctatgggggaggggaatatcaaatggacaagatcacttttaaatggtagtttttataagatgttataaacttgtatctttttaccattaaagtgcagtgtatgttccttcgtgatatatttaggatatttaaataaaaggaaaatggggcttttctacatactatctcctctttggggaagctttttcatactggttttagttgttttccttttttctccctacataatcaccccacaacttccagcaccctataagccattttaaaaccccttctccacagaggaacaagcaagtaggagcaaaaacagggcatcagttctgagcaagacgaaaaagcacacgcagcaggacggaaggaggctagacaccaacagatgcagtgtctctgacctgggacccccctgcatccgcagcacttgagaattcataggccctttccagacctggcttcctgggtcccagggtgcaccccgggagtttcctgcacattcgcgcttgggcacctctccctgccctcaggtggcaagaggaggatggacaagagctttcccgaggcccaggctataaacagtctgctttggccttgatgaggtaaagcaaagtgacagctgtggtctgaggtaagactttattgtatacttgggtggggtagcccagatggatgcaaggttgcaggcatgggaagcagccctcttgggtgtcactctgaaaatgaagtagggtggtggccgcacctcgccagtgaattagtcccctaccaaggtcttacagacccacccttcctctcaccctccagttcccactgtcctccaaggagaagagccttgggtaagtgtccctccctccttcagagagtgggactgtctgcctcttgaaagcgaggattgatggtggtcgtgatggcacttttgtagagaggattactgtcctggagaaagatgttgcagattataagcaaaaatcccaggattcctcgtcccctttctagacctaagaggccagccttgagccgaatcctaggagctgatggaagttagcagaggggttggttacatgtgccaggggctgggggaacccagtgggaggaatcagggctggtcttgtggtgggggaacagctaaaaaggggcctaaccaggaagtctcctcacctgcttccagttgagttgttgctgctccttctcaaagcgactgtattcccggcggtcatagatttccaccgagagccggtaagccaggaccagccccagccccactgccacgatgccccctacgcagcccagcacaatggcctgcgtgtggtctgctccctctgtgaacaagaaaccagacacacttgtgggagctggagcatagggacagatcatcagttgctcacagtgtgtccagcctgtccaaccctgtctgtcactgaaagcaaagggaacccagggaggtccaaggttatcctcaccgcccagggccttagcctcgtccacttgctcaattgcctctgcctttgtcctggattcacagttctgcttcagcccccagcctgtttcccattatcttcactctgcatccccagagttgagaccctgcccatcaaacttccagggtttgtggcatccctgcccacttactttcttggggtctcactctgagcacgaccgtgcctctggcgtcatcctccaccaagaagaagaacagctggttgtccagggtccgctctttgcaccagccatcatccaagataggggccaaggccagggtcacattggtatgggcacaagctgtactgcagttggtggccagtgggccagtcctgaaggccccacactctgcacagtccctgtgtagtagatgccaataggttaccagctgggcagttgtcacccaatgccccttgcccaactacaagcaggacggagagtaggcagatgggagtagctcaacaagccccactgtgcccctgctcccaagatgcaagacctgaggcctcaccggtgtctctcgcatggtgtcttgcagcctgggcattggtcgcatagagcaccatagtagccgtccaagcactggcagcggttgcatttgcagcgtccatgcccactgcagagccctccctcgggactgatgcaactgtccatgtccccactgcattcgcatgctctgcccgtgcggttggcatgacagtgacatactccacattggcagcgaccaaagcctggggtagagccatgcagagggtgacaaccatactccacacacacagttggccatcatgtggcacgacaagcccacgcatccaatctttttgaagtatgccaaccacaccctctaacccatacaccggaatcttttgatatttgccttccatgccaggagattcccagagcctaagtgccttgggaaggcctctcagaccccgcccttctccccaaggctccaggtacctccgcagaggatgccctcatgtcgctcacagctggcatcgtcacactcgcacagatgcccagagctctgtccactgcagctgcagcgtccacattgacagtgaccctttccactgcacaggggccctgtgccattgggagcccggcacccagattccaggtctggggaggacagctctgccacagagcactcacagagccgacctaggcggccaggggcacagctggaaggggaaggcaaaggagagaagtaggtcagagggtttgatcacccctgacttgtctctcccaggaacctctaaacccaagttctcaaaagagttggagacagacaaacagctgaaaggatgttaagtatagtgaaacactgaggggtgagagagtggagggagccccagtcagggggagggcctggacatacatgggaagcttcaagggatgaaactgagtggggagtcgggatgtcgaggagactcctgtgggggggatggaaagcagcggaggaatacgggccagggttggttggttgttgggagccaggtggttgaagggaagaggaggccctcacctgcatacaccacattgtaggtgtccctggccatcactgcagtggggagcctggggctgggtgtcactgcaattacagtcacacagcgtgtgcaactccacaatcagctcctctgagaagccaagggcccggagcctcaggagatggggctctgggaggcagtgggtggcttggagagaaacccagaaagtcacctgagaagaggcaggaatcaggccatggttatacacatgcacacacacataccccaaactcaccaatcatccagaacctcaccccttagtaaatgaagggatggggtcatgttaacacccaactcctagaaacatgcctgaggaagccactcagactgctccaggaaggatggatggaggactacctcaggctctcatgtcactccctgtacctgccacccatcttttcctgcctgcttaatttcccactcccacctccccctgcccgccttctgcctgtgcttgctggctctcaccgtctggttgattcggacgtggttgcactgtcctcgatcctcagccttaccctccctcttctcaggaccctcacactgggattcgtaagaaatgtggaccccaggagggagtgaagagtgttcaagggtcacggtggaagacaggctctatgggaagagagcgagtggataaccacgtgaaggcagaaaaggactccaaccccaccttatgtcctctccaggtgttcccaattctgccagcaccctgccctctgccacctggggctccttccattctgcccagtcgaggcatttctggagggaggacccgtgagaaccttgcatagaacatacaggatccagaggcctctaatacagcatttcagtgcagctgccagcaagggccactgagggtcacaggctggccaggtgctgtaaatgtacagagaccatgtttgtgaagccccacatcaggacacataacctgggtgcatgccaggtctaaagggcagattcattacagagtttatcttgggaaatttgatactgtctcagattttcttgccataggtttaggagatgctccctgttatcaagaagcctacagcctagttgcagaggtaagacctaaaccactaagaatttttatggttccttctacctgtaaaattctatggttcttgtgaagaatagctctgaattatttataaacttagtgaaagcaggctccagatctcacattgtttatgtacagactgactggggacaaatgccagcccttctgtttgttatctttgtgaccttggacaagtcacttagcctccttgtgtgggtttcctcatctgtaaaatagggatggtaacagttatgaagcaaggcttttggcagggttaaatgaagtagcaaacagtatgtacacctaggatggtgggcgcatgaaataaaagctcagtgattgaaacttt

SEQ ID NO: 203697 - DNA, 3806 bp, Homo sapiens
  Payload ID: 20171
  Gene Name: zinc finger protein 746
  Uniprot ID: Q6NUN9
  ENST ID: ENST00000340622
  CDS Start-End: 282-2216
gtggggctgtgcggccgcgctgcctccaggaagcctcacgggccttcgtctgccgggccgcggcgccggctcccaggatgcagtgtggaccggccgggcgctgacggaggcggcgcgactgcgggcggcgcggcgcaggggcagccagcgaggagcggcggcagaggaaaggccaggcaggcgccgcctgcggagagcaccgggcggccgggcctgcgtggtgccgcgcgcggcggcggcgacgacgacttcctccgggccgggcgggacagcgcagggccatggccgaggcggtcgcggctccgatttctccgtggacgatggcagccacgattcaggccatggagaggaagattgaatcgcaggctgctcgcctgctttccctagaaggtcgaaccgggatggccgagaagaagctggctgattgcgagaagacagccgtggagttcgggaaccagctggagggcaagtgggccgtgctggggaccctgctgcaggagtacgggctgctgcagaggcggctggagaacgtggagaacctgctgcgcaacaggaacttctggatcctgcggctgcccccgggcagcaagggggagtcccctaaggagtggggcaagctggaggactggcagaaggagctctacaagcacgtgatgaggggcaactacgagacgctggtctccctggactacgccatctccaagcccgaggtcctctcccagattgaacaagggaaggagccctgcaactggcgccgccctggccccaagattccagatgttcctgtggaccccagtccaggctcggggcccccagttcccgccccagacctcttgatgcagatcaagcaggagggtgagctccagctccaggagcagcaggccctgggcgtggaggcgtgggcagccgggcagccagatattggggaggagccctggggcctcagccagctggattccggagcaggagacatctccacggatgccacctctggtgtccattccaacttttccaccaccatcccgcccacctcctggcaaacggatctccctccccaccatccctcttcagcatgctcggacgggaccctgaagctcaacacagcagcctccacggaagatgtaaaaattgtaataaaaacagaagtccaggaagaggaggtggtggccacacccgtacatcctactgacctagaggctcacgggaccctgtttggaccaggccaagccacacggttcttccctagtcctgcccaggaaggagcctgggaaagccagggcagctccttccccagccaggaccctgtgctggggctgcgagagcccgcccggcctgagagggacatgggtgagctcagtcctgctgtggcccaggaggagacccctcctggggactggctcttcggaggggtccggtggggctggaatttccggtgtaaaccgccagtgggcctgaacccgaggacggggcccgaggggcttccttactcctccccggacaacggagaggccatcttggaccccagccaggccccaaggccattcaacgaaccctgtaaataccctggccggaccaaaggctttggccacaagccagggctgaagaagcaccccgcggcgccccccgggggccggcccttcacctgcgccacgtgtgggaagagcttccagctgcaagtcagcctgagcgcgcaccagcgcagctgtggggcgcccgacgggtcgggcccgggcacaggcggtggcggcagcggcagtggcggcggcggtggcggcagcggtgggggcagcgcacgggatggcagcgcccttcggtgtggggagtgcggccgttgcttcacgcgccccgcgcacctcatccgccatcgcatgctgcacaccggcgagcggcccttcccctgcaccgagtgtgagaagcgcttcaccgaacgctccaagctcatcgaccactaccgaacgcacacgggcgtgcggcccttcacctgcaccgtctgcggcaaaagcttcatccgcaaggaccacctccgcaagcaccagcgcaaccatgcagcgggcgccaagaccccggcccgaggccagccactcccgacgccgcccgcacctcctgatcccttcaagagccccgcctccaaaggacctttggcctccacagaccttgtgaccgactggacttgtggcctcagcgtcctgggacccaccgatggcggggacatgtgagcgcctccagccccatagcccctgccggccgcacgtgtaaaaagccccgtgtgcaggcagcagggcggcgtggaagcttcaggcagacgcgggacggggagaaccaaatgtccaagttgctgaactgatgatcactggagaaagagaaactatccaccaggacagctgccacctctaaaccaagtagaattctctgtgaaatgggagcgccgtagaattttaagtaatttaattgcaaacctgttttgttttttgttttttgtttttttttaattcttgaggaaaaagctggaaaatagtaatagggctatttaaattttgtaggtacttttggttttcagggcgtgcatttctgtcactatctcactgagtctgatagtgtgttggaaggttggccagttggggacccctggcccactgactcctggggatggggtcctgtgtgtgcccctgctctgcccagttgggctgagtgggcctagcgcaccaagcccctgggcagtgagggccattgggtcccttggagcacacctcagtgcagcaggaaggacccctccgggagtagcggttgcatttcccagcttgcctctcctgaaaaggccccccaaaagtgctggccccaacttttctctattttgggccatctgtggtacccgtcccaagggcacttggtggtgtcccctagtgtgtgactccctggcctcataaggacgagttgtctgaaatcccagcgttaggtctggggagatggagaagctgaaactggggagctgcaccacaaacgtctagctctcagcagagctgggagcaaagcctggccgcccaccccaacctggggctgcctcccactccgtgagatgcttctgtctcctgttcactttgtgtggtagtttcttattttcaaaatgcatctcatttgatcattactgtgaccttgggaagcagcaggacagggatttctttttagaggtgcaaactgctcagaggggacacacctcagcctctcactgtgggtacacgtggcgtgccatgagtggggaagagcaacaggcgagatgcctcattctactggaacatcactgtgggtgaacagagatttccaggttttccctcttaaaatatttgtcccacaccgacaagagtccagtcaccaggcctcaaaggaacttctgcttgtagcagccgcctcccctgtgccccagcctccttaatgtgtgcactctcagagggcacagctcgcgaggctgggtttgggggccaagtggcttgttcattccagcatctaacatcataaaggtgggcccagatttcttgattcgaccacagtgctgttcctaccacacaaatatccattcctgttttgttgaagcagccactggtcctcttgtttcccctgcagacggagggacctggcagtgcccattcattcagccccctcatgcatacttttattaggcgatagactagttaagaaaattgtttctatgtactgtatattttgtacctgtttacacttctaatattgatataactgatattttgaaaaataagagaaaacatcctgttaaaataaaacctaaccagcaccaa

SEQ ID NO: 203698 - DNA, 3797 bp, Homo sapiens
  Payload ID: 20171
  Gene Name: zinc finger protein 746
  Uniprot ID: Q6NUN9
  ENST ID: ENST00000458143
  CDS Start-End: 272-2209
gcggccgcgctgcctccaggaagcctcacgggccttcgtctgccgggccgcggcgccggctcccaggatgcagtgtggaccggccgggcgctgacggaggcggcgcgactgcgggcggcgcggcgcaggggcagccagcgaggagcggcggcagaggaaaggccaggcaggcgccgcctgcggagagcaccgggcggccgggcctgcgtggtgccgcgcgcggcggcggcgacgacgacttcctccgggccgggcgggacagcgcagggccatggccgaggcggtcgcggctccgatttctccgtggacgatggcagccacgattcaggccatggagaggaagattgaatcgcaggctgctcgcctgctttccctagaaggtcgaaccgggatggccgagaagaagctggctgattgcgagaagacagccgtggagttcgggaaccagctggagggcaagtgggccgtgctggggaccctgctgcaggagtacgggctgctgcagaggcggctggagaacgtggagaacctgctgcgcaacaggaacttctggatcctgcggctgcccccgggcagcaagggggagtcccctaaggagtggggcaagctggaggactggcagaaggagctctacaagcacgtgatgaggggcaactacgagacgctggtctccctggactacgccatctccaagcccgaggtcctctcccagattgaacaagggaaggagccctgcaactggcgccgccctggccccaagattccagatgttcctgtggaccccagtccaggctcggggcccccagttcccgccccagacctcttgatgcagatcaagcaggagggtgagctccagctccaggagcagcaggccctgggcgtggaggcgtgggcagccgggcagccagatattggggaggagccctggggcctcagccagctggattccggagcaggagacatctccacggatgccacctctggtgtccattccaacttttccaccaccatcccgcccacctcctggcaaacggatctccctccccaccatccctcttcagcatgctcggacgggaccctgaagctcaacacagcagcctccacggaagcagatgtaaaaattgtaataaaaacagaagtccaggaagaggaggtggtggccacacccgtacatcctactgacctagaggctcacgggaccctgtttggaccaggccaagccacacggttcttccctagtcctgcccaggaaggagcctgggaaagccagggcagctccttccccagccaggaccctgtgctggggctgcgagagcccgcccggcctgagagggacatgggtgagctcagtcctgctgtggcccaggaggagacccctcctggggactggctcttcggaggggtccggtggggctggaatttccggtgtaaaccgccagtgggcctgaacccgaggacggggcccgaggggcttccttactcctccccggacaacggagaggccatcttggaccccagccaggccccaaggccattcaacgaaccctgtaaataccctggccggaccaaaggctttggccacaagccagggctgaagaagcaccccgcggcgccccccgggggccggcccttcacctgcgccacgtgtgggaagagcttccagctgcaagtcagcctgagcgcgcaccagcgcagctgtggggcgcccgacgggtcgggcccgggcacaggcggtggcggcagcggcagtggcggcggcggtggcggcagcggtgggggcagcgcacgggatggcagcgcccttcggtgtggggagtgcggccgttgcttcacgcgccccgcgcacctcatccgccatcgcatgctgcacaccggcgagcggcccttcccctgcaccgagtgtgagaagcgcttcaccgaacgctccaagctcatcgaccactaccgaacgcacacgggcgtgcggcccttcacctgcaccgtctgcggcaaaagcttcatccgcaaggaccacctccgcaagcaccagcgcaaccatgcagcgggcgccaagaccccggcccgaggccagccactcccgacgccgcccgcacctcctgatcccttcaagagccccgcctccaaaggacctttggcctccacagaccttgtgaccgactggacttgtggcctcagcgtcctgggacccaccgatggcggggacatgtgagcgcctccagccccatagcccctgccggccgcacgtgtaaaaagccccgtgtgcaggcagcagggcggcgtggaagcttcaggcagacgcgggacggggagaaccaaatgtccaagttgctgaactgatgatcactggagaaagagaaactatccaccaggacagctgccacctctaaaccaagtagaattctctgtgaaatgggagcgccgtagaattttaagtaatttaattgcaaacctgttttgttttttgttttttgtttttttttaattcttgaggaaaaagctggaaaatagtaatagggctatttaaattttgtaggtacttttggttttcagggcgtgcatttctgtcactatctcactgagtctgatagtgtgttggaaggttggccagttggggacccctggcccactgactcctggggatggggtcctgtgtgtgcccctgctctgcccagttgggctgagtgggcctagcgcaccaagcccctgggcagtgagggccattgggtcccttggagcacacctcagtgcagcaggaaggacccctccgggagtagcggttgcatttcccagcttgcctctcctgaaaaggccccccaaaagtgctggccccaacttttctctattttgggccatctgtggtacccgtcccaagggcacttggtggtgtcccctagtgtgtgactccctggcctcataaggacgagttgtctgaaatcccagcgttaggtctggggagatggagaagctgaaactggggagctgcaccacaaacgtctagctctcagcagagctgggagcaaagcctggccgcccaccccaacctggggctgcctcccactccgtgagatgcttctgtctcctgttcactttgtgtggtagtttcttattttcaaaatgcatctcatttgatcattactgtgaccttgggaagcagcaggacagggatttctttttagaggtgcaaactgctcagaggggacacacctcagcctctcactgtgggtacacgtggcgtgccatgagtggggaagagcaacaggcgagatgcctcattctactggaacatcactgtgggtgaacagagatttccaggttttccctcttaaaatatttgtcccacaccgacaagagtccagtcaccaggcctcaaaggaacttctgcttgtagcagccgcctcccctgtgccccagcctccttaatgtgtgcactctcagagggcacagctcgcgaggctgggtttgggggccaagtggcttgttcattccagcatctaacatcataaaggtgggcccagatttcttgattcgaccacagtgctgttcctaccacacaaatatccattcctgttttgttgaagcagccactggtcctcttgtttcccctgcagacggagggacctggcagtgcccattcattcagccccctcatgcatacttttattaggcgatagactagttaagaaaattgtttctatgtactgtatattttgtacctgtttacacttctaatattgatataactgatattttgaaaaataagagaaaacatcctgttaaaataaaacctaaccagcacc

SEQ ID NO: 203699 - DNA, 5051 bp, Homo sapiens
  Payload ID: 20171
  Gene Name: zinc finger protein 746
  ENST ID: ENST00000461958
  CDS Start-End: 198-761
gtggaccggccgggcgctgacggaggcggcgcgactgcgggcggcgcggcgcaggggcagccagcgaggagcggcggcagaggaaaggccaggcaggcgccgcctgcggagagcaccgggcggccgggcctgcgtggtgccgcgcgcggcggcggcgacgacgacttcctccgggccgggcgggacagcgcagggccatggccgaggcggtcgcggctccgatttctccgtggacgatggcagccacgattcaggccatggagaggaagattgaatcgcaggctgctcgcctgctttccctagaaggtcgaaccgggatggccgagaagaagctggctgattgcgagaagacagccgtggagttcgggaaccagctggagggcaagtgggccgtgctggggaccctgctgcaggagtacgggctgctgcagaggcggctggagaacgtggagaacctgctgcgcaacaggaacttctggatcctgcggctgcccccgggcagcaagggggagtcccctaaggagtggggcaagctggaggactggcagaaggagctctacaagcacgtgatgaggggcaactacgagacgctggtctccctggactacgccatctccaagcccgaggtcctctcccagattgaacaagggaaggagccctgcaactggcgccgccctggccccaagattccagatgttcctgtggaccccagtccagatatcagcgtctcagatttccctggagccagtcagcacctttgaaagttaagggaaggacaggtggacacaggagaaaaaccaaattcctaaagtgaagacctgctgggtcatttgactagggagaccacatctctgcaaggctcgacccctgattcctccagaagacccgcccttgaccgtcccacctgccttggttttccctttcgtctgacactgagaaaggtggtggtccgcagaggccctcctgtgcgccacttgtgtgaaattaaatgcatcccccatgttcgtcatctcatctcagtcagatttgcactttcctaagggcagaagcatgttccgggctggccgctttgccagtcgtcatcgggacattgacagtttagctctacagatgcatttttaagaatcttctaggcgtcaaggacagtgctgaacactagaggacagaaagatggctgagaacagatactattgggctggaaaagagggttacaacccgtgcgcgtccccagcttcctagcctgggtgggaggttctgggtgggtgggtttcgttgtatttacaccatgtgtggaggcttccctcacttccacagcatcattcaatgagagtaaagaggggctggaaatacgctggttgctggtaagaccctgtaacactctctagctgcaccgtatgatgttcagcagcatccgtggcctctacccaccagtagacaagatgagtagacacaaactccactgtccatcctgagcctgttggcagggatctgtgtggcgtttatccctgtcccctttgtctgagaagccaggactcccagctcatcccttgccacatttggcctgacccatccccttgtgagacctcacctccccttctcctcacctcctgcacatccctccactgagccttgtgggactcagggctcagcagacccgccaggtcctgagtgttccctgctcggactgagctccaggggactgcagccctctgagtgcttgtcatcctcttccctgcctctgtcttgagcccaggcccactgggacagggtcctcacccctcagattgtgcctctgccagcctcaatccctctctagagaccttgcctttgggtcccaggccttgtctttttgctacttctgcagaccttccctctcttctcaacactcttcctgccctcagtcttggccatggcagcctccttgttgattgtcctgtgcccccccaacccatcccacagccatccgtgactgtgacgacagtgactttaccatacccaccatctccatctccagcacaccactccctggccgcctcctgccgtcccttcaattccgtctggtgtcctgattccagcagttttccagtccttcaagacctgcaagccatcgaccctgctgccttttcactgccctgactcatcctcatttccctccatgcccaccattgtggtccccccttacacacaccctcagcactcttgcccctgttttgttcattgtatccacttagtgaaatccatcggtgttctgcacctgcagccaagcagctgcacgtggctgcagagaaccaggtaagctggctgctggtgtcacgtgacattcatgaccagcgacttcagtgggcgctctgccacacagtcacaccgtgtctccttagcccaggggccagcaaactgtggctgagggccaaacctagctcatctgtttctgtatggtgcacagctgagaacagttttatattttaacccgttttttaaaagagaaacgcaccactcacacagccctctccacgccatctgcctgcaccagtgcccccttctctgccttcacttctgtgactgctaaactgtcaaccctccagccaaagccccacttcgatctggcaccagatcccacctcatgccatcttctcaagggcaatacaagcaatcctgccttgacctctaccccggcagccactgcccgcttgtctgttcccctttgtggcagagcccttggggacatctgcgcttgctgtctcctgcaccttcccccccactctgttaccccttccaccaaaacctctccaacctcggttaccagggccctccgtggtcctgaatggtctgtcttcttacttggccttgtcccctctactctgccacgtaggcccgtcatctcctgccagcccctctcctcctgccctgatcccccagtcttgcctcagcccagcagagtaatcccttttagacccaagtcctggctttccatctgacccgcaccgtcagctcaccacctccacttttctctcactctgcccagctgcagagtgctgttccctggtgctgttccctccgccctgtgccagggccttcgcagtgccctctactgggaatcctcctcaggcaggtcccacctgcaggcctttcgtgtcatcggcactgcaggccctccccacccaggactccaggcctactttcctgctttgggtcttccgtgttagacagtgtcacataatatatatgtttcctatttatagattcatcgtatgtcaggtctcctccattagaatgtcaatttcaaaagtataaaaatttttacctgtttaatcattttaggaacctagagtattgcctagtacagagtaggaattcaataactatttgctgaatgtatgctgtttcaaaatttaaaacgtgtgtgtgtgtgtgtgtgtgtgtgtgtgtgtgtgtgtgtgaaataatgtatttctgatagcatttaaattcctttttaggtctcccaggcctccctaggaattttctgtttattctttctatccacattttaaaacgtctgctgtgtactttggtagctgtaaacaatatataatacggttttttgtgttctgaaaaattacatagatgtcattatatttatcactcattattctgtatttcagacttatccatgttgatacatgtagatcaagttcattccttttaacagatgcttaatattccagaagcaactatattgtaacttattttccattcctccactgattggcacttaagctttttctgattgttcactctcacaagcaatactgtagtgagcgttcttgcgcctgtttttttgtggccctgtggggatgctgctccagggagtagacccagcggtggcctcaccacgtcgtaggcttgatttcatctcttccgttactgtatggccctccccaggggtacccagtgccagcgggtgctcctagaacttgcttcctaacgtctgcccagtttccataattacatttttgccgacctgatgggggtgagatggcctctcgtttcaacttgtattttcccccttaagttgcacgccctttttatacgattatttggctgcttctccagtgagttgtcttctgtttttctattgagatattcttcattttcttcttgattcagggcttctttgtatgtgttctagatacaaatcctttgtctattatttgtgttacaaacattttctccgtgtcggtggcaggtctttaacgttgtagttcttgtatggaagttttcactgttgaaagagtcaaacatgtcagtcttttcctttatgatctgtgctttttctgtagtgagatatccttgcttacctcactcaaggtcagaaagatactcttctctattttttttataaatttttaaaagttttgcttttcaaatttaagtctttaatttatctagaattaaaatttgtgtagcttgcaagggagggtttcagttttttctcccacaacgatggtctcattttccaacaaagtttgctgaatgtgttagcttttctccactgatttgtgatgcgattctgtcctgagctggtttctgcatgtgcacaagtctgtttctgggtgcttgcttctgtgtcattggtctctttgtcagtctctgcaccaacagcttgctcttttagcttcataataagccttgatatctagtagactaatccttctctgcttgttcttcaaaaaactgtcttggctattcttggatatttgttcttttatatgaattttgggatctgtatgtcaagttcctaagaaaatcctgttggaaatttgattggaattgcattgactttacagtctaatttctggagaattgctctcatgacaacattagcctttctactcattggaacactcatttattgaaggcttctatgtgcttgaataagattttacagttttcttctgatagttgtttttcattataaatgggatttttacagtttattagatgtattagttatttcaggtgtacaggtatgctgttgacttttgtttattaaaaaaaatcttgctctcatg

SEQ ID NO: 203700 - DNA, 3936 bp, Homo sapiens
  Payload ID: 20172
  Gene Name: zinc finger protein 747
  Uniprot ID: Q9BV97
  ENST ID: ENST00000252799
  CDS Start-End: 669-1244
aaaactaagctatgcccagaccaccttgggcacatgtcgtgaggacttcctgaggctgtcacgcgcgcgtcctcaaccttggcaagtaattgagatctgtctcggaatttctgggttcacactttttgctctcaacattgggaagaggctgctgtcgccgtttctgaggacaaaacgagacagtgatgggctgaagtccgattataaaaaggtccagagacgaaaactaacttctgagttcacgagggctgccttccgcagggcgctgctttgttcccgcaaacccgggcggaagctctgagctgcgccgcctcacctggcggggccggagcatgcgcggctggttttcaaggccggcgcctgtagccgcaacggccattttggattagggcaaggagagaactgggcctggagcgggggcgcggggaggggggcgtcgtcgtgggtacaattgcgcaggggcaaaggtcgagaggtcgcgctgccgccgttttatttgaagacatcgtccagttctgaccatggactcgcagccatcggcccttagtttccatcccctctagtgggccttcgggggctctactgacgtccctccttcccttggtaccgggccggggaagtgttctcgggcgcgggaggttccgcatgcccaggcctggccaggggagatgaccgatccgtcgctggggctgacagtccccatggcgccgcctctggccccgctccctccccgggacccaaacggggcgggatccgagtggagaaagcccggggccgtgagcttcgccgacgtggccgtgtacttctcccgggaggagtggggctgcctgcggcccgcgcagagggccctgtaccgggacgtgatgcgggagacctacggccacctgggcgcgctcggtgagagccccacctgcttgcctgggccctgcgcctccacaggccctgccgcgcctctgggagctgcgtgtggagttgggggccccggggccgggcaggcggcctcctcgcagcgtggggtttgcgttcttctcccccaggagtcggaggcagcaagccggcgctcatctcctgggtggaggagaaggccgaactgtgggatccggctgcccaggatccggaggtggcgaagtgtccgacagaagcggacccagcagattccagaaacaaggaagaggaaagacaaagggaagggacgggagccctggagaagcccgaccctgtggccgccgggtctcctgggctgaaggctccccaagccccctttgccgggttggagcagctgtccaaggcccggcgccggagtcgcccccgcttttttgcccacccccctgtcccccgagctgaccagcgtcacggctgctacgtgtgcgggaagagcttcgcctggcgctccacactggtggagcacatttacagccacaggggcgagaagcccttccactgcgcagactgcggcaagggcttcggccacgcttcctccctgagcaaacaccgggccatccatcgtggggagcggccccaccgctgtcccgagtgtggtcgggccttcatgcgccgcacggcgctgacttctcacctgcgcgttcacactggcgagaagccctaccgctgcccgcagtgtggccgctgcttcggcctgaagaccggcatggccaagcaccaatgggtccatcggcccgggggcgaggggcgtaggggccggcgccctggggggctgtctgtgaccctgactcctgtccgcggggacctggacccgcctgtgggcttccagctgtatccagagatattccaggaatgtgggtgacggcctaaaaagtgaccatctagacattgtgggcggcccgagatgggctcaggggcccgaacctctgcagcggcctgcagggaggtcccagaatccaccgcaagagctggcctggggtgcggacagtctgatcttgggctctcagcagcctcttctgccagcaccttgctccccgctgccctgggctctccaaggccccctttgctgaggcagggctgaggtgagaaccccccagacctccatacagggaagcaaaagctgtttctcctcccagagatgctaagaggattgaggtagagaagaaccttgttttctctgttgtctttttctttttacttttttaattttttgagacggagttttgctcttgttgcccaggctggagtgcaatggtgcgatctcgactcactgcaacttccacctcctggagtcaagcgattctcctgcctcagccacccaagtagctggaattacaggcacctgccactatgcccggctaactttttgtatttttagtagagatggggtttcaccatgttggctaggctggtctcgaactcctgccctcaggtgatccacccacctctgcctcccaaagtgctgggattacaggcgtgagccacctcacctggccttttcttttttattctttgaccttcccacaagacaatacccattgtctgttttttttgtttatttatttacttattaagacagcatcttgctcctcacccaggctggaatgcagtggtgtgaactgggctcactgcagcctagacctgctgggctcaaggaatcctcctgccccagcctctcagatggctgtgactacaggtgggcaacactatgcctggctaatttttaaatttttttgcagagatggggttcccactatgttgatcaggctggtctcaaactcctcggttcaagcaattcgcccaccttggcctcccaaagtgctgggattacaggggagccactgcactggccttcattgtctttttgctgcacaacctaaaaaaccagtgaccctgtattggatctcgcctgcagttgctgtattgatttgggcccaggcagtgtttttaagtgataagaattagtgatgaagatctaaagggatattttgcaccaaaatccaggtttctggcatctcttgaaaaatccaaagatttcgcaagttcacctaggctctcagaaagtcgcagttgttgggagttgggccggagccagaactcccaacttactgtggtccggccactcatcccatcagctcctgaccaagcatgagtagccattcatcatggcttgcttttagtgtttttggtgtttatcttaaagtacagcaaagaagaaagggaagtatttcttgaacccatgtctgtgtcaaaacagtccttgcatctttcctgtctttaggtacgcaccatctttgctgtctttaagtatgtgccatcatgggcagagggggctaggccaggaacacctggtgttagatttgtagccagtggcaaccgtacccatctgtatccccaagttctacacggaatccctccagcacttcacgactccattatccagctaccactaattcctttgtgggcagagtccagccacgggcagcccctgccctgcctctggtcaggacaacacctgcccaaggagagcaagggcctgtgacctctgctggcctgtgcgccctcacctgtcacccagctcagccctgtgtctggcctacccagggaggaaggaaccagatttatcagcctgaaaggaggtagaagttttggagaaaagacactgttcgggtgtcaagtaatgaactgactttattcgaacctcatctccaatccaatcccaccgtggtctctctctccctcagcttttctggggcgggttgactcgtgtgtcactttatcacaggggcacatggggtgagaagaggaaccttggcagtaggagatacctttgtaccaggttttaatttccagtgtacatctcagtcccctcccctaaccctcaacacagcctggggaaagcccagcttgcaacaccagttctcagcccagactgacagccagatagatcttggccctgagtttgccaattaaagatgccgtgattattaccta

SEQ ID NO: 203701 - DNA, 3504 bp, Homo sapiens
  Payload ID: 20172
  Gene Name: zinc finger protein 747
  Uniprot ID: Q9BV97
  ENST ID: ENST00000395094
  CDS Start-End: 240-812
gggggcgtcgtcgtgggtacaattgcgcaggggcaaaggtcgagaggtcgcgctgccgccgttttatttgaagacatcgtccagttctgaccatggactcgcagccatcggcccttagtttccatcccctctagtgggccttcgggggctctactgacgtccctccttcccttggtaccgggccggggaagtgttctcgggcgcgggaggttccgcatgcccaggcctggccaggggagatgaccgatccgtcgctggggctgacagtccccatggcgccgcctctggccccgctccctccccgggacccaaacggggcgggatccgagtggagaaagcccggggccgtgagcttcgccgacgtggccgtgtacttctcccgggaggagtggggctgcctgcggcccgcgcagagggccctgtaccgggacgtgatgcgggagacctacggccacctgggcgcgctcggtgagagccccacctgcttgcctgggccctgcgcctccacaggccctgccgcgcctctgggagctgcgtgtggagttgggggccccggggccgggcaggcggcctcctcgcagcgtggggtttgcgttcttctcccccaggagtcggaggcagcaagccggcgctcatctcctgggtggaggagaaggccgaactgtgggatccggctgcccaggatccggaggtggcgaagtgtccgacagaagcggacccagattccagaaacaaggaagaggaaagacaaagggaagggacgggagccctggagaagcccgaccctgtggccgccgggtctcctgggctgaaggctccccaagccccctttgccgggttggagcagctgtccaaggcccggcgccggagtcgcccccgcttttttgcccacccccctgtcccccgagctgaccagcgtcacggctgctacgtgtgcgggaagagcttcgcctggcgctccacactggtggagcacatttacagccacaggggcgagaagcccttccactgcgcagactgcggcaagggcttcggccacgcttcctccctgagcaaacaccgggccatccatcgtggggagcggccccaccgctgtcccgagtgtggtcgggccttcatgcgccgcacggcgctgacttctcacctgcgcgttcacactggcgagaagccctaccgctgcccgcagtgtggccgctgcttcggcctgaagaccggcatggccaagcaccaatgggtccatcggcccgggggcgaggggcgtaggggccggcgccctggggggctgtctgtgaccctgactcctgtccgcggggacctggacccgcctgtgggcttccagctgtatccagagatattccaggaatgtgggtgacggcctaaaaagtgaccatctagacattgtgggcggcccgagatgggctcaggggcccgaacctctgcagcggcctgcagggaggtcccagaatccaccgcaagagctggcctggggtgcggacagtctgatcttgggctctcagcagcctcttctgccagcaccttgctccccgctgccctgggctctccaaggccccctttgctgaggcagggctgaggtgagaaccccccagacctccatacagggaagcaaaagctgtttctcctcccagagatgctaagaggattgaggtagagaagaaccttgttttctctgttgtctttttctttttacttttttaattttttgagacggagttttgctcttgttgcccaggctggagtgcaatggtgcgatctcgactcactgcaacttccacctcctggagtcaagcgattctcctgcctcagccacccaagtagctggaattacaggcacctgccactatgcccggctaactttttgtatttttagtagagatggggtttcaccatgttggctaggctggtctcgaactcctgccctcaggtgatccacccacctctgcctcccaaagtgctgggattacaggcgtgagccacctcacctggccttttcttttttattctttgaccttcccacaagacaatacccattgtctgttttttttgtttatttatttacttattaagacagcatcttgctcctcacccaggctggaatgcagtggtgtgaactgggctcactgcagcctagacctgctgggctcaaggaatcctcctgccccagcctctcagatggctgtgactacaggtgggcaacactatgcctggctaatttttaaatttttttgcagagatggggttcccactatgttgatcaggctggtctcaaactcctcggttcaagcaattcgcccaccttggcctcccaaagtgctgggattacaggggagccactgcactggccttcattgtctttttgctgcacaacctaaaaaaccagtgaccctgtattggatctcgcctgcagttgctgtattgatttgggcccaggcagtgtttttaagtgataagaattagtgatgaagatctaaagggatattttgcaccaaaatccaggtttctggcatctcttgaaaaatccaaagatttcgcaagttcacctaggctctcagaaagtcgcagttgttgggagttgggccggagccagaactcccaacttactgtggtccggccactcatcccatcagctcctgaccaagcatgagtagccattcatcatggcttgcttttagtgtttttggtgtttatcttaaagtacagcaaagaagaaagggaagtatttcttgaacccatgtctgtgtcaaaacagtccttgcatctttcctgtctttaggtacgcaccatctttgctgtctttaagtatgtgccatcatgggcagagggggctaggccaggaacacctggtgttagatttgtagccagtggcaaccgtacccatctgtatccccaagttctacacggaatccctccagcacttcacgactccattatccagctaccactaattcctttgtgggcagagtccagccacgggcagcccctgccctgcctctggtcaggacaacacctgcccaaggagagcaagggcctgtgacctctgctggcctgtgcgccctcacctgtcacccagctcagccctgtgtctggcctacccagggaggaaggaaccagatttatcagcctgaaaggaggtagaagttttggagaaaagacactgttcgggtgtcaagtaatgaactgactttattcgaacctcatctccaatccaatcccaccgtggtctctctctccctcagcttttctggggcgggttgactcgtgtgtcactttatcacaggggcacatggggtgagaagaggaaccttggcagtaggagatacctttgtaccaggttttaatttccagtgtacatctcagtcccctcccctaaccctcaacacagcctggggaaagcccagcttgcaacaccagttctcagcccagactgacagccagatagatcttggccctgagtttgccaattaaagatgccgtgattattaccta

SEQ ID NO: 203702 - DNA, 1511 bp, Homo sapiens
  Payload ID: 20172
  Gene Name: zinc finger protein 747
  ENST ID: ENST00000568028
  CDS Start-End: 326-1318
gttttcaaggccggcgcctgtagccgcaacggccattttggattagggcaaggagagaactgggcctggagcgggggcgcggggaggggggcgtcgtcgtgggtacaattgcgcaggggcaaaggtcgagaggtcgcgctgccgccgttttatttgaagacatcgtccagttctgaccatggactcgcagccatcggcccttagtttccatcccctctagtgggccttcgggggctctactgacgtccctccttcccttggtaccgggccggggaagtgttctcgggcgcgggaggttccgcatgcccaggcctggccaggggagatgaccgatccgtcgctggggctgacagtccccatggcgccgcctctggccccgctccctccccgggacccaaacggggcgggatccgagtggagaaagcccggggccgtgagcttcgccgacgtggccgtgtacttctcccgggaggagtggggctgcctgcggcccgcgcagagggccctgtaccgggacgtgatgcgggagacctacggccacctgggcgcgctcggagtcggaggcagcaagccggcgctcatctcctgggtggaggagaaggccgaactgtgggatccggctgcccaggatccggaggtggcgaagtgtccgacagaagcggacccagattccagaaacaaggaagaggaaagacaaagggaagggacgggagccctggagaagcccgaccctgtggccgccgggtctcctgggctgaaggctccccaagccccctttgccgggttggagcagctgtccaaggcccggcgccggagtcgcccccgcttttttgcccacccccctgtcccccgagctgaccagcgtcacggctgctacgtgtgcgggaagagcttcgcctggcgctccacactggtggagcacatttacagccacaggggcgagaagcccttccactgcgcagactgcggcaagggcttcggccacgcttcctccctgagcaaacaccgggccatccatcgtggggagcggccccaccgctgtcccgagtgtggtcgggccttcatgcgccgcacggcgctgacttctcacctgcgcgttcacactggcgagaagccctaccgctgcccgcagtgtggccgctgcttcggcctgaagaccggcatggccaagcaccaatgggtccatcggcccgggggcgaggggcgtaggggccggcgccctggggggctgtctgtgaccctgactcctgtccgcggggacctggacccgcctgtgggcttccagctgtatccagagatattccaggaatgtgggtgacggcctaaaaagtgaccatctagacattgtgggcggcccgagatgggctcaggggcccgaacctctgcagcggcctgcagggaggtcccagaatccaccgcaagagctggcctggggtgcggacagtctgatcttgggctctcagcagcctcttctgccagcaccttgctccccgctgccctgggctctccaa

SEQ ID NO: 203703 - DNA, 2587 bp, Homo sapiens
  Payload ID: 20173
  Gene Name: zinc finger protein 749
  Uniprot ID: O43361
  ENST ID: ENST00000334181
  CDS Start-End: 251-2587
ctggcggcgccctcatggttgcgttagcatggctacctagggatctgttcactgatttagagggtcccagagctctgggtcgggactgaggtgaaagagcggaaaaacgcgagaagcggtgttccttctacacagaggctagagtgcggatcggctgagtcggctgcaggcgcccctgcctccgtcagcgtccaggtgaccgccgttcccgccccgctcttccctgggtggactggaggaggccgcgccgatgaacctgaccgaggattgtatggtctttgaggatgtggccatatatttctcccaagaggaatgggggatccttaatgatgctcagagacacctgcacagcaatgtgatgttggagaactttgcgcttttgtcatcagtaggttgttggcatggagccaaggatgaggaggtaccttccaagcagtgtgtttctgtaagagtgttacaggtcacaattccaaagccagctttgtccaccctgaaggcccagccctgcaagatgtgtagctcaattctgaaggacattctgcacctggctgagcacgatggaacacaccctgagcaagggctgtacacatgtgcagcagagcatgacctgcaccaaaaggagcagattagagagaagctcaccagaagtgatgagtggaggccttcatttgtgaaccacagtgctcacgtgggagagaggaacttcacatgcacgcagggtggcaaggattttactgccagctcagaccttctccagcaacaggtcttaaacagtgggtggaagctgtacagggatacccaggatggggaagcctttcaaggtgaacagaatgatttcaactccagccaaggtgggaaagacttttgccaccaacatgggctgtttgagcaccaaaaaacccataatggggagaggccttatgagttcagtgaatgtggggaattgtttaggtacaactccaaccttattaaatatcagcaaaatcatgctggagaaaggccttatgagggcactgaatatggaaagacctttattagaaagtccaacctagttcagcaccagaaaattcacagtgaaggctttctttcaaaaaggtctgaccccattgaacatcaggagattctcagtagaccaacaccttatgaatgcacccagtgtgggaaggcctttcttacacaggctcatctggttggtcaccagaaaacccatactggagaacagccctatgaatgcaacaagtgtgggaagttttttatgtataactccaaactcatcagacatcagaaagttcacactggggagaggcgttacgagtgcagtgaatgtgggaaattgtttatggacagcttcacactcggtagacatcagagagttcatactggagaaaggccttttgaatgcagcatatgtggaaaattctttagtcaccgctccacactcaatatgcaccagagagttcatgctggcaaaaggctttataagtgtagcgaatgtgggaaagcctttagcctcaaacataatgttgttcagcatctgaaaattcatactggagaacggccttatgagtgcactgaatgtgagaaggcctttgttagaaagtcccacctagttcagcaccagaaaatccacactgatgcattttcaaaaaggtctgacctcattcaacacaagaggattgacattaggccaaggccttatacatgcagtgaatgtgggaaggccttccttacacaggctcatctggttggtcaccagaaaatccatactggagaacggccttatgaatgcactcaatgtgcgaaggcctttgttagaaagtcccacctagttcagcatgagaaaatccacactgatgcattttcaaaaaggtctgacctcattcaacacaagaggattgacctcaggccaaggccttatgtgtgtagtgaatgtgggaaggccttccttacacaggctcatctagatggtcaccagaaaatccagactggagaacggcgttatgaatgcaatgaatgtgggaaattctttttggacagctacaaacttgttattcatcagagaattcacactggagaaaagccttataaatgcagcaaatgtgggaaattctttagatatcgctgtacactgagtagacatcagaaagttcacactggagaaagaccttatgagtgtagtgaatgtgggaaattttttagagatagctacaaactcattattcatcagagagttcatactggagaaaagccttatgaatgcagcaactgtgggaagtttcttagataccgctctacattcattaaacatcataaagtttgcactggggagaagcctcatgagtgcagtaaatgtagggaattgtttaggactaaatcgagccttattatacatcagcagtctcacactggagaaagtccttttaagttaagggaatgtgggaaagacttcaacaaatgtaatactggtcagcgccaaaaaactcacactggagaaaggtcttatgagtgtggtgaatccagcaaagtgtttaaatacaactccagcctcattaaacatcagataattcatactggaaaaaggccttag

SEQ ID NO: 203704 - DNA, 568 bp, Homo sapiens
  Payload ID: 20173
  Gene Name: zinc finger protein 749
  ENST ID: ENST00000415248
  CDS Start-End: 371-568
atggttgcgttagcatggctacctagggatctgttcactgatttagagggtcccagagctctgggtcgggactgaggtgaaagagcggaaaaacgcgagaagcggtgttccttctacacagaggctagagtgcggatcggctgagtcggctgcaggcgcccctgcctccgtcagcgtccaggtgaccgccgttcccgccccgctcttccctgggtggactggaggaggccgcgccgatgaacctgaccgaggttgttggcatggagccaaggatgaggaggtaccttccaagcagtgtgtttctgtaagagtgttacaggtcacaattccaaagccagctttgtccaccctgaaggcccagccctgcaagatgtgtagctcaattctgaaggacattctgcacctggctgagcacgatggaacacaccctgagcaagggctgtacacatgtgcagcagagcatgacctgcaccaaaaggagcagattagagagaagctcaccagaagtgatgagtggaggccttcatttgtgaaccacagtgctcacgtgggagagaggaacttcaca

SEQ ID NO: 203705 - DNA, 3713 bp, Homo sapiens
  Payload ID: 20174
  Gene Name: zinc finger protein 750
  Uniprot ID: Q32MQ0
  ENST ID: ENST00000269394
  CDS Start-End: 835-3006
ataagctccctccctgccggctcagctcctgaggaggaccagggacagagactctcaggagcagggtagagggtggaaggtccacagatcctcaaaggcctcactggacctcatggcaaggacgccatgaatactgtgcctcccagggtatgcgcgcttgagaatcaatccaagtgtttgcctcctgcgtacacatgctcaagttctaaaggaaagtctcacatgtctttatcatgacgccaaatattcatcgggtgtgattctgatgaatatagtaatctctattctaactgcggacacatcgaaagccctctgacatatggccgtccaggcagcaccgacgccgcactcacagacagttgagtctggagacagcgctgggagtcggcgagataacttgcttgctgggtccagtgctggggaggctgcccgcagcagctcggtgggtgcaaacacatgaatcgtagctgcgggcaggaggaatatcaggtgcatctctacgccccgagggctcaactcctacacttaaatccctcccactggaacagcaggctccagtttcacccagcaagcgtgagaacaggtactgcttcctgagcaccgccagccaccggcaccaagaccggccacatcccagcactgcccacctctgctcccagccgccagatgacggaggctctcgccagaccctcagcacgcagagctggcttctgatagaagtgatcgggaaagaaagcaaagcgggaggtgcctctttagaaaccacgaagtgcacgcggcgtcgacagtgatcacgccacctggacagccagagtccaaggcataaggaggaaaatgagtctcctcaaagagcggaagccaaaaaagccacattacatccccaggcctccaggaaagcccttcaagtataaatgtttccaatgtccctttacttgcaatgagaagtcacatctttttaatcacatgaagtatggtctttgtaaaaactcgattactttagtatcagagcaggatcgagttcccaagtgccctaaatctaactcactagaccccaagcaaaccaaccagcccgatgccacggcgaagccagcctcttccaagtctgtcgcaaatggactctctgccttcgactcgaagcttcagcacagctctgccagggaagacatcaaggaaaacctggagctgcaagcccggggaacccacaggtgcctgggacagaagccagccctccacagggcatcaccctgcaagagcccagctccggaagccgccctcggtgcccagcctgctctggaaggcgcagctcggccttctgcatttgttccagtcggcgagcacagactcaaggggccagacaacgccgaggcgcccgagacactggctttacacaaccccactgccaaggccgtgtctttccacaccaagtcggccttccacactcctggctacccctggaaagccggctcacctttccttccaccagagtttccacataaaatctcatctacaaaggggcttggggccatttccccttacatgcaccccacaatcccagagtacccgcctcacttttacacagagcacgggctggccaccatctactcgccttacctgctggctgggagctcgcctgagtgtgacgcacccctgctgtcagtctacggaacccaagacccgagacacttcctgcctcacccggggccgatccctaagcacctggctccatctccagccacatacgatcactacaggtttttccagcaatatccctctaacctgccgattccttacggattttacaggccagagtctgcattttcctcctatggtctcagactcccacctgtcactggcctcacccgagatcagagctctcacctgcttgaagaagccaccctggtctatccagcctcgagtccttccaggttaaacccttcggaccccaacagaaaacacgtcgagttcgaaagtccaattcctgaggctaaagactcctccaaggctgggcagagagacacggaagggtccaaaatgagcccccgcgcagggagtgcagccacgggctccccagggaggccgagccccaccgacttcatgcagacgagccagacctgcgaaggcctgtacgacctctccaacaaggcagcctccagcgcactgggaagactctacccgccagagcaaagcctcacagccttcaggcctgttaagaaaagcacagaatgcctacctgcccaggctgctgagaccacagcagagtctccagtaagcctcaatgttgtgaacggagaccctcctgctccgaccggaagcgcctctctcgtctcggaggccgcgccttccagtccggacgacagctccgggatgggccccctcaacctctccaagaaatcagagataaacctggcagccacccacgaacccacgtaccaaggcagcccccaggcggaaaccgccagcttctcagagctgcaggaccttccactcaatctctcggtgaaggacccctgtaacacccaggctccgaggcctgccttccccggtcgaccacgagctgcagaacctgctgctgctgttccacagaagactgggacagaaggttctgaggatgggcccagccaccctgagaccaagccaggcagcctcgacggtgacggggccccacccacaggccccggcgaggaggctccagacgcatgcgcggtggacagcagcgaggagcagaagcagacggcagccgtggccctgtgccagctggcggcctacagccccaggaacatccgggtgggcgatggggatgctgcggccccggaacctgcctgccggcaagacacacccacactgagctccatggagagccaagaggcccagtgtgacctcagacccaaaggacaaaagaggacaagtctaagggatgctggaaaatcccagcaaggagctaagaaggcgaagctgcaggacacggccagagtgttcacactacgaaggagggcccgggtgtcctaacgccgggttcacacgtgtgttcacagagctacggccacacacacgccttccaaggtggcaagctacaacacctctgaactggcactttcacatttttacaaatgcagctgctgcttctcaaaaaaacaaacaaacaaacaaacaaaaaaccctccaattcagtttttataaatattaagcatgaatattaaaaggtgcttctacttttggttgtaaaaacacctgaatgactctaagactgatatgtattttcaagtctaagctgtcttacagaagatcttttataaatgtttccttataaatatctcaccattacaacaaattgttttaactgtttttctattagctctagctgcatatttgatgtaaatgacaattactgaaaaaatgtcagaaaaaacattttcagtactaacattaaagtgccatatgtaaaaaagaaaaatgtgatttgtataactaaataacacacaaacatcaagaggctatttatacaaataatttatttccactagggaaagtgcattactggtgaaggtattatcaatttattctacttgcttataatgttacagtgaatgttctggcttactctgcctcactttccattccccaaaatgatgtgtatgttgctaattttccaataaactcatatgaaccataaggaaacataaaatgcaaataaacataaatctatgttatccttt

SEQ ID NO: 203706 - DNA, 1513 bp, Homo sapiens
  Payload ID: 20174
  Gene Name: zinc finger protein 750
  ENST ID: ENST00000572562
  CDS Start-End: 326-1300
agtttcacccagcaagcgtgagaacaggtactgcttcctgagcaccgccagccaccggcaccaagaccggccacatcccagcactgcccacctctggccagagtctgcattttcctcctatggtctcagactcccacctgtcactggcctcacccgagatcagagctctcacctgcttgaagaagccaccctggtctatccagcctcgagtccttccaggttaaacccttcggaccccaacagaaaacacgtcgagttcgaaagtccaattcctgaggctaaagactcctccaaggctgggcagagagacacggaagggtccaaaatgagcccccgcgcagggagtgcagccacgggctccccagggaggccgagccccaccgacttcatgcagacgagccagacctgcgaaggcctgtacgacctctccaacaaggcagcctccagcgcactgggaagactctacccgccagagcaaagcctcacagccttcaggcctgttaagaaaagcacagaatgcctacctgcccaggctgctgagaccacagcagagtctccagtaagcctcaatgttgtgaacggagaccctcctgctccgaccggaagcgcctctctcgtctcggaggccgcgccttccagtccggacgacagctccgggatgggccccctcaacctctccaagaaatcagagataaacctggcagccacccacgaacccacgtaccaaggcagcccccaggcggaaaccgccagcttctcagagctgcaggaccttccactcaatctctcggtgaaggacccctgtaacacccaggctccgaggcctgccttccccggtcgaccacgagctgcagaacctgctgctgctgttccacagaagactgggacagaaggttctgaggatgggcccagccaccctgagaccaagccaggcagcctcgacggtgacggggccccacccacaggccccggcgaggaggctccagacgcatgcgcggtggacagcagcgaggagcagaagcagacggcagccgtggccctgtgccagctggcggcctacagccccaggaacatccgggtgggcgatggggatgctgcggccccggaacctgcctgccggcaagacacacccacactgagctccatggagagccaagaggcccagtgtgacctcagacccaaaggacaaaagaggacaagtctaagggatgctggaaaatcccagcaaggagctaagaaggcgaagctgcaggacacggccagagtgttcacactacgaaggagggcccgggtgtcctaacgccgggttcacacgtgtgttcacagagctacggccacacacacgccttccaaggtggcaagctacaacacctctgaactggcactttcacatttttacaaatgcagctgctgcttctcaaaaaaacaaacaaacaaacaaacaaaaaaccctccaattcagtttttataaatattaagcatgaatattaaaaggtgcttctacttttggttg

SEQ ID NO: 203707 - DNA, 2347 bp, Homo sapiens
  Payload ID: 20175
  Gene Name: zinc finger protein 75a
  Uniprot ID: Q96N20
  ENST ID: ENST00000574298
  CDS Start-End: 474-1364
ttccggccggcgctctggctctgtacctggacagggctgcggtaggccagcggtgggctggcggttgcgctcctcagatcggcggcctttcgggcggtggcttgcgtttgagcctcagaaagcgaggagcggcctccacggaagccaagctggccgaggttgcagtccatgagctgggaaaggaggcagtgctcttgggagaaacagcagaggcctcaagtttcgggctgaagccaacagagtcccaaccagtgggcgtatcccaagatgaagaattttggaatacatacgagggtctgcaagaacagctcagcaggaatactcataaagagactgagcctgtgtatgagagggctgtgcctactcaacagattctagcttttcctgagcaaacaaacaccaaagactggacagtgacacctgagcacgtcttgcctgagtcccagagcttgttgacatttgaagaagtggccatgtatttttcccaggaagaatgggagttattggatcccactcagaaggccctctacaatgatgtaatgcaggaaaactatgagactgtcatctctctagcattgtttgtgctccccaaacctaaagtgatctcctgtctagagcaaggggaagagccatgggttcaagtatccccggagtttaaggatagtgccggaaaatctcctacagggttaaagctcaaaaacgacactgaaaatcatcagcctgtgtctctttctgacttagaaatacaagcatcagcaggcgtcatatcaaaaaaggccaaagtaaaagttccccagaaaacagcaggcaaagaaaatcattttgatatgcacagagtgggaaaatggcaccaagattttccagtgaagaaaagaaagaaactttcaacctggaaacaagagctgctcaaacttatggatcgtcacaagaaagattgtgcaagagagaagccttttaaatgtcaggaatgtgggaaaaccttcagagttagctctgaccttattaagcaccaaagaattcacactgaagagaaaccctataaatgtcaacagtgtgataagaggtttagatggagttcagatcttaataagcacttaacaacacaccaaggaataaaaccatataaatgttcatggtgtgggaaaagcttcagtcaaaatacaaatttacatacacaccaaagaactcatacaggagaaaagcccttcacatgtcatgaatgtggaaaaaaattcagtcagaactcccaccttattaaacaccggagaacccacacaggtgagcagccatatacttgtagcatatgcaggagaaacttcagcaggcggtcaagccttcttagacaccagaaactccacctgtgaagagaagcttgtccagtgtcctcattctgaagacattcaccaaatggagcttggcactaaaatttatgtaaaagaaaaatcacaaaccttgaaaaattttacatcagaaaatgggataaacatacatttcacagaaaataatcaagacttgctctgcagccactcagtagtcttctgtggtcacagaagtaaacattgttggctttgtattgatctctccagtcatttttgaacacatccaatagaaacattggcagcatggtcttccaaaacaaaaagcagtaacatgcatgtttaattgcataccattctcttcacagtagcaggcttaccaatttccatagtctcatgaggccgaaatgaattacaatgtaaagtgttccaggaaccaaattggattttctttcttttgtcattggacacggtttgcaaagttggacatcacttgagttccttcttaaacttttcggcaacttctcttggatcctgttatcacagttttttactgtgatgaaatcttgttaaccaccactagggaatctccagatgaactattaatgcactgtcttatgcctctcattggtgatgtttggaaaatagaagacatctctaatggaatcatgggggaaacgggttggaatttgtagccatggaatatatattagatgtaaagaattttctgcaataaaagaaactagacttgttaatccctgccttgcaatgtcagtaggataaagcagctataaaaattagtacttgcccaaggcctgaaagagaattagtgggaattaagatcaacttctcagttttgtttgtttactttttaattggcttttctttgttgttaagaatgagagacttaatttccatgggagttggagtgtgtgtgctgcaggcaggatcctgtggctcatttggcatggagacctggacatgtagtcagcaggagacggttccctaaataaaagatttgggcactggtg

SEQ ID NO: 203708 - DNA, 561 bp, Homo sapiens
  Payload ID: 20175
  Gene Name: zinc finger protein 75a
  ENST ID: ENST00000572999
  CDS Start-End: 449-561
tttaagcctttttttgtcattttttttagtgtcttatactacccacaatgtgggctgtacacctgtcgctctgcctccacccccacaaaccaaaagtaagttctgtggtaacaaggatgggaattatttctaggttgcagtccatgagctgggaaaggaggcagtgctcttgggagaaacagcagaggcctcaagtttcgggctgaagccaacagagtcccaaccagtgggcgtatcccaagatgaagaattttggaatacatacgagggtctgcaagaacagctcagcaggaatactcataaagagactgagcctgtgtatgagagggctgtgcctactcaacagattctagcttttcctgagcaaacaaacaccaaagactggacagtgacacctgagcacgtcttgcctgagtcccagagcttgttgacatttgaagaagtggccatgtatttttcccaggaagaatgggagttattggatcccactcagaaggccctctacaatgatgtaatgcaggaaaactatgagactgtcatctctctagcattgtttgtgct

SEQ ID NO: 203709 - DNA, 1225 bp, Homo sapiens
  Payload ID: 20175
  Gene Name: zinc finger protein 75a
  Uniprot ID: Q96N20
  ENST ID: ENST00000617839
  CDS Start-End: 279-1169
tgggagaaacagcagaggcctcaagtttcgggctgaagccaacagagtcccaaccagtgggcgtatcccaagatgaagaattttggaatacatacgagggtctgcaagaacagctcagcaggaatactcataaagagactgagcctgtgtatgagagggctgtgcctactcaacagattctagcttttcctgagcaaacaaacaccaaagactggacagtgacacctgagcacgtcttgcctgagtcccagagcttgttgacatttgaagaagtggccatgtatttttcccaggaagaatgggagttattggatcccactcagaaggccctctacaatgatgtaatgcaggaaaactatgagactgtcatctctctagcattgtttgtgctccccaaacctaaagtgatctcctgtctagagcaaggggaagagccatgggttcaagtatccccggagtttaaggatagtgccggaaaatctcctacagggttaaagctcaaaaacgacactgaaaatcatcagcctgtgtctctttctgacttagaaatacaagcatcagcaggcgtcatatcaaaaaaggccaaagtaaaagttccccagaaaacagcaggcaaagaaaatcattttgatatgcacagagtgggaaaatggcaccaagattttccagtgaagaaaagaaagaaactttcaacctggaaacaagagctgctcaaacttatggatcgtcacaagaaagattgtgcaagagagaagccttttaaatgtcaggaatgtgggaaaaccttcagagttagctctgaccttattaagcaccaaagaattcacactgaagagaaaccctataaatgtcaacagtgtgataagaggtttagatggagttcagatcttaataagcacttaacaacacaccaaggaataaaaccatataaatgttcatggtgtgggaaaagcttcagtcaaaatacaaatttacatacacaccaaagaactcatacaggagaaaagcccttcacatgtcatgaatgtggaaaaaaattcagtcagaactcccaccttattaaacaccggagaacccacacaggtgagcagccatatacttgtagcatatgcaggagaaacttcagcaggcggtcaagccttcttagacaccagaaactccacctgtgaagagaagcttgtccagtgtcctcattctgaagacattcaccaaatggagcttggca

SEQ ID NO: 203710 - DNA, 1118 bp, Homo sapiens
  Payload ID: 20175
  Gene Name: zinc finger protein 75a
  ENST ID: ENST00000612186
  CDS Start-End: 98-559
cttttattgcttttgtacaagaccagacaggatctcatttgttaaacgtggtaccaattgggtgtcttaacacaggagcagaacttcctagagcagaatgatgatggtagatctgaaagtggctgcgtacttggaccctcagatcagggctttgtgggagaccaaggggcctgcaagagagagctccggtcagagtaaaaaatctcctcaaatggactgtctcgatcctaagagctcttgctggcacttccggaatttcacctatgatgaagcaggtggaccccgtgaggctgtcagcaaacttcaagaattatgtcatctatggctgaagccagagatccactcaaaagagcagatactggaactgctggtgctggagcagttcctgactattctgcccagggagacacagacccagatgcagaagcaccatccacagagcattgaggaggctgtggctctggtagaacacttgcagagggaatctggtcaaacatggaatggggtgagaagaaagattcctgacatgtacagtgaaataggatgcaggtggatatagtagagatggtggcagttagttgagaaattagatggattaggtaggtcattgtttggttttttttttaaggacagttaaggtgggacttgaaactacaggcccacagaaaagttcacaggtttcagagattgtggtagatacttccctggccttagagaaagagagttgcttttgccctctttggagccagggtgaattgagggtgttgggcctagtctggcttggccaaggagacaggacttaagtacttagaaacagaataaaaggtaataaagagtcagggaggctggatgcagtggctcacacctgtaatctcagcactttaggaggctgaggcgggtagatcacctgaggtcaggagttcaagaccagcctggacagcatggtggaaccctctctctacaaaaataaacaaattagctgggcatgatgaccggtgcctgtaatcccggctatcctcgaggctgaggagggagaatcatttgaacctgggaggttgcagtgagccgagatcgcaccattgcactccagcctgggcaacacagcaagactccatctc

SEQ ID NO: 203711 - DNA, 2977 bp, Homo sapiens
  Payload ID: 20176
  Gene Name: zinc finger protein 75D
  Uniprot ID: P51815
  ENST ID: ENST00000370764
  CDS Start-End: 385-1632
agaactcgaccctggaagagagagtcggggtcaggtcttcgggaggtggagggatcgaatgagggaactgatattccaagactccccacatcttggagcttcactcgccaggcatcccgcgctttcctgacgtcgcttcccctagtggtgcagcagcggagagctttgctacccagagcagcagggaggcgtggccacagaggcagaggcgtagtcgagccgaggaagaggaaagtggcctccggggaagccagagctgactgaagtgctcttgggaagaacaattcattgatttggtaccaacctgatgcaccctgatttgtcaaaggtggtaccaggtgggtgtcagtgtcacatacaagagtaaaactgttcctagagcaaatggcgatgagagagctgaacgcggattcatgctcaagcccccagatgggggctatgtgggagactagtgggtctgtgaaagagaactccagtcagagtaagaaatacagcacaaaaatagagaatcttggtcctgagagcgcttgcaggcacttctggagcttccgttatcatgaagcaaccggaccgcttgagactatcagccaacttcagaaattgtgccatcagtggctgaggccagagatccactcaaaagagcagatcttggaaatgctggtgttagagcagttcctgagcattctgcccaaggagacccagaactgggtgcagaagcatcatccacagaatgtcaaacaggctctggtcctggtggaattcttgcagagggagcctgatggaacaaagaatgagagtttgttgacatttgaagatgtggctgtgtatttttctgaggaagagtggcaattattgaatcctcttgagaagactctctacaatgatgtaatgcaggatatctatgagactgtcatctctctagggttaaagctaaaaaatgacactggaaatgatcatcctatatctgtttctacatcagaaatacaaacatcaggatgcgaagtatcaaaaaagaccagaatgaaaattgcccagaaaacaatgggcagggaaaatcctggtgatacacacagtgtacagaaatggcatcgagcttttccaaggaagaaaagaaagaaacctgcaacttgtaaacaagagcttccaaaacttatggatcttcatgggaaaggccccacaggggagaaaccttttaagtgtcaggaatgtgggaaaagcttcagagttagctctgatcttattaaacaccacagaattcacactggagagaaaccctataaatgtcaacaatgtgacaggaggtttagatggagttcagatcttaataagcacttcatgacccatcaaggaataaaaccatatagatgctcatggtgtgggaaaagctttagtcataacacaaatctacacacacaccaaagaattcacacaggagagaagccctttaaatgtgatgaatgtggaaaaagattcattcagaactcccaccttattaaacaccagagaactcacacaggtgagcagccttatacgtgtagcttatgcaagagaaactttagtaggcgatcgagccttcttagacaccagaaactccacagaagaagggaagcatgtctagtgtctccaaactgaggaaagttaccatgtagagcttgactttagaagtggtgaaagaatacaaaattatgaggcacccaatgataggaatctgtgattaataaaacatttgggaagggtacatgttacacttcacaaaaaggaatctaagctgtctgttttattcagcattgcatcttctgtgcctagcacaagagttgatacataaggagtactttataaataaaaaaatgaaagtgtagtgatgagattcctttagctatctatctatatgtatatatctggttattcaaagcttccccacccccagtcatctaaatttttcaggtatcaagtgctcaacagacatatgatagtcaaggctcttagtctcattttttactctttgtcaagagaaatggaaaataagagtacttgggccctcttaagggagctcagagagaattactaaattagggacagtttcaatagttatcattctgtctacatgaacaatcaagaccaggactcagggaactttactctgtaacagaaagagaggattcagtgtttgccctgggagaattgtcccattcttgttgcttctctcctgagtacccactaccacaatgtcttctgtcaaggaattacaagtagcaagggaaggtctgaatgtaaggacaggcctagggaccttgcaagcacttgatatctctcctcttgctgactttgtcaacatagacatatagtgaaatgatgagggaggcagtcttggccctcatccaggtatctggtttttttttgtagaaagcacagataagtggtaaatggtctttttctgactttcattatgtggactggatggaggctttcaaactggtgccatactgctgcaggacctaaagggagccccatctttatggctgatcaactacaaccctatatgcctgaatactctgcaagaaggcctggagattttgcaaaactgatttattgagaatggcaaggagagccttgtgaacttttagctttggtgcacagctgataccaggagggaacatcctgaagtgtcagagaaaagtaaggcatatggctcacagtgatgatgccagtcagagccaggccagatggaaattgttttctgatgttactggttttcttttccctattagccaaagtgactatctcttaagagaagataatgtgacgtcaagggaagttggaaggcatggatttatatctatgtcagatcctggtttataatgttggccaaggcttatttatatatgtttatttagtattccataaaattgtacttcgtaatgaaaatgacacattttatcttaaatttagacaataaacaaaactttgttaccaaatc

SEQ ID NO: 203712 - DNA, 5592 bp, Homo sapiens
  Payload ID: 20176
  Gene Name: zinc finger protein 75D
  Uniprot ID: P51815
  ENST ID: ENST00000370766
  CDS Start-End: 2711-4243
gatacaatggtgtcgttcgggaaacgcagccctaacgttggtcctaagctgacaaattggtctgtggacgccaaacttccgtgctaggactttctgcgtgtggaccgggggcctagtcctgcgtgggtccaacacagacaggagaaagctgcctgcttttgtgcctcccggaggtcctggtagaagcgaaacggggacaggagctgcagcgtcccaagcccagtgaggcgaagctactggagacagctctgccgggtccaaagttgggctcaccggctggaacttgaaaccggagcacgccggactcctgctgaagccatcatctctctctcctggccccgggcgccttggccggcgggcacaactggtttcggggccaaggtggtctggaagcctgactgtggcgtctggcctgggctcccgcgagcggaaaaggttcccctcctgtgagagggaaactatggaagttcctacgcccggagccagaactcctgctgctcccgcccgacccaaggtctagcttggcggcctcccacctgtgcttctgagggttctgcttccaagaggctgctggtgcccgggacaccagcagtttcgccatgggtgtttcgccatgggagtttcgccatgggtgactttggcctgagatgcgctccatggagcagattctggagttgctggtgttggaggagttcctgactatcctgtcccaggacatccacagcagggtgcagaagctgcaacgggcgagctgtgaagaagctgtaactcttttaaagtatatgtatgacttttaaaagagagagcttgtgaaactgagggaataggtgagtgagagagaggttttatctgccatcttcctcaaggaggcccagcctcccctttattcatagggttctgggtctggtgggtccagaggactgagacatctcgctgtcttaattccccattcagattttcttgattgccctgagtagaccttacacgggccagtgattttttgttgttgttgttgttgttgtcttctctggaaccttcatcctccagatttccccccagtgcagtgaagagtgtgctattgcttttggtttccacggggaggcagtgtcgctgtcatagtgtccgctctggaggtagatcaaagggggctttcaactcctggctctgctccctactagctgtgcgactttgggcaagtgacttttgcttggctgggcttcactttctgcactggtcaaatgcagaaagggtaatagacccttctggggttgtttggaggattaaagggagagcagtatgtccgtaataatcgcactgctggcacacagctagtgcttgaaactgtgagctgctgttaggttaggggcagcagtctggtctcctctgcagagatgggtctcagttaattgtgaacttaaacagtttggcactgaggctttggggtcattgccccagggccacccaagtaagcttgtctaattgagaggaacaggagcagctggagaatgtgggggaggaaccgaagacctatgggggacatgtgtgtactgaaatgggctttctccccacaccctccacacaagcacatacacacattcactctgggtcatggcatcataaaaaccttgagtttaaaccatccctttctcttgttgggtccaaatggacagactctggttttctattgaagatttacacgcagattcctgtcataatttttcttttctatcgagccctgtcatgatgataagtgatagcaggttggttcctagatcatacaccatggacctagcacagaagtgttttcagaagagccttttccttacaaaacagcatgaaagtcattgagccaatggatactgagatttcaaactggagccaatggatacttagaggagccctgaagtgtagagtagttgctacttcttgttcactaggtctaattagcatgtcatcagtgtaacagactagtgtgttgtcttgtgaaagagaaaggtgataagatccctgtgaactaaactatgatgtagggcttgaaaattgatatacaatacgcctgaggtaggatggcgaaggtgtattcctggtcttaccagctgaaagtaaattgcttctggtggtctttactaacagttattgagaaaaaaagcattttcaaggtcaagaggtacatactaggttccaggggatatgttaatttgctcaagaaatgaaaccacatctggaacagcagctgcaattggagtcatcacctggcttagtttacaatgacccactaccatcttccaagatccatctgccttctgcataggccaaacaggtccacagaactcgaccctggaagagagagtcggggtcaggtcttcgggaggtggagggatcgaatgagggaactgatattccaagactccccacatcttggagcttcactcgccaggcatcccgcgctttcctgacgtcgcttcccctagtggtgcagcagcggagagctttgctacccagagcagcagggaggcgtggccacagaggcagaggcgtagtcgagccgaggaagaggaaagtggcctccggggaagccagagctgactgaagtgctcttgggaagaacaattcattgatttggtaccaacctgatgcaccctgatttgtcaaaggtggtaccaggtgggtgtcagtgtcacatacaagagtaaaactgttcctagagcaaatggcgatgagagagctgaacgcggattcatgctcaagcccccagatgggggctatgtgggagactagtgggtctgtgaaagagaactccagtcagagtaagaaatacagcacaaaaatagagaatcttggtcctgagagcgcttgcaggcacttctggagcttccgttatcatgaagcaaccggaccgcttgagactatcagccaacttcagaaattgtgccatcagtggctgaggccagagatccactcaaaagagcagatcttggaaatgctggtgttagagcagttcctgagcattctgcccaaggagacccagaactgggtgcagaagcatcatccacagaatgtcaaacaggctctggtcctggtggaattcttgcagagggagcctgatggaacaaagaatgaggtcacagcccatgagctgggaaaggaggcagtgctcttgggaggaacagcagtggccccaggcttcaagtggaagccagcagagccccaaccaatgggtgtgttccagaaagaatattggaatacataccgggtactacaagaacagctgggctggaacactcacaaagaaacccagcctgtatatgaaagagctgtgcatgatcaacagatgttagccctttctgagcagaaaagaatcaaacactggaagatggcatctaaactcatcctgcctgagtccctgagtttgttgacatttgaagatgtggctgtgtatttttctgaggaagagtggcaattattgaatcctcttgagaagactctctacaatgatgtaatgcaggatatctatgagactgtcatctctctagggttaaagctaaaaaatgacactggaaatgatcatcctatatctgtttctacatcagaaatacaaacatcaggatgcgaagtatcaaaaaagaccagaatgaaaattgcccagaaaacaatgggcagggaaaatcctggtgatacacacagtgtacagaaatggcatcgagcttttccaaggaagaaaagaaagaaacctgcaacttgtaaacaagagcttccaaaacttatggatcttcatgggaaaggccccacaggggagaaaccttttaagtgtcaggaatgtgggaaaagcttcagagttagctctgatcttattaaacaccacagaattcacactggagagaaaccctataaatgtcaacaatgtgacaggaggtttagatggagttcagatcttaataagcacttcatgacccatcaaggaataaaaccatatagatgctcatggtgtgggaaaagctttagtcataacacaaatctacacacacaccaaagaattcacacaggagagaagccctttaaatgtgatgaatgtggaaaaagattcattcagaactcccaccttattaaacaccagagaactcacacaggtgagcagccttatacgtgtagcttatgcaagagaaactttagtaggcgatcgagccttcttagacaccagaaactccacagaagaagggaagcatgtctagtgtctccaaactgaggaaagttaccatgtagagcttgactttagaagtggtgaaagaatacaaaattatgaggcacccaatgataggaatctgtgattaataaaacatttgggaagggtacatgttacacttcacaaaaaggaatctaagctgtctgttttattcagcattgcatcttctgtgcctagcacaagagttgatacataaggagtactttataaataaaaaaatgaaagtgtagtgatgagattcctttagctatctatctatatgtatatatctggttattcaaagcttccccacccccagtcatctaaatttttcaggtatcaagtgctcaacagacatatgatagtcaaggctcttagtctcattttttactctttgtcaagagaaatggaaaataagagtacttgggccctcttaagggagctcagagagaattactaaattagggacagtttcaatagttatcattctgtctacatgaacaatcaagaccaggactcagggaactttactctgtaacagaaagagaggattcagtgtttgccctgggagaattgtcccattcttgttgcttctctcctgagtacccactaccacaatgtcttctgtcaaggaattacaagtagcaagggaaggtctgaatgtaaggacaggcctagggaccttgcaagcacttgatatctctcctcttgctgactttgtcaacatagacatatagtgaaatgatgagggaggcagtcttggccctcatccaggtatctggtttttttttgtagaaagcacagataagtggtaaatggtctttttctgactttcattatgtggactggatggaggctttcaaactggtgccatactgctgcaggacctaaagggagccccatctttatggctgatcaactacaaccctatatgcctgaatactctgcaagaaggcctggagattttgcaaaactgatttattgagaatggcaaggagagccttgtgaacttttagctttggtgcacagctgataccaggagggaacatcctgaagtgtcagagaaaagtaaggcatatggctcacagtgatgatgccagtcagagccaggccagatggaaattgttttctgatgttactggttttcttttccctattagccaaagtgactatctcttaagagaagataatgtgacgtcaagggaagttggaaggcatggatttatatctatgtcagatcctggtttataatgttggccaaggcttatttatatatgtttatttagtattccataaaattgtacttcgtaatgaaaatgacacattttatcttaaatttagacaataaacaaaactttgttaccaaatcactc

SEQ ID NO: 203713 - DNA, 4651 bp, Homo sapiens
  Payload ID: 20177
  Gene Name: zinc finger protein 76
  ENST ID: ENST00000229405
  CDS Start-End: 502-957
tgagaagaccgccagggcgccctccctgcggaggcgagtccctcaccgcccctctacatcgtccttttcaataaggagctcttaatacctgcaactgcttccttcaaggggtggctggaagatcagtaggcaaggcctgcggactgcgcaccttaaagcgcttcgggaccgtaagacagtgagtgctgagcgcgcggccgggaagaagcctggaggctctgagctcggaggacagagaccgaagccccagggcctgcgtccctcacaacctgcgcctcctgtcctcccgcgctactcccgaagcgcaccttctcgcccgcaggccgcagaagtgatgacgcaaagccctcggggcctccgccacctcctcacgcttctgctggaccgaatccttggaatggacagatttgtgacccagaaggaaatctctgacctcagctgtggctcttggtgctggccagaagccaacttcatgtctgagtgcacgagcagcagtttgccatggagagcttggggctgcacacggtgacccttagtgatgggacaacagcctacgtccagcaagctgtcaaaggagagaagcttcttgaagggcaggtgatccagctcgaggatgggaccaccgcatacattcaccaggtgacggtacagaaagaagctctctcctttgaggatggtcagcctgtgcagctggaagatggcagcatggcttacatacaccgcacacccagagaaggctatgaccccagcaccctggaagccgtccaactggaagatggctccactgcctacattcaccaccctgtggctgtgccatcggagagcaccatcctggccgtacagacagaggtgggcttggaggacctggcagcagaggatgatgagggcttcagtgcagacgcagtggtggccctggagcagtatgccagcaagacttttcccccaggttcttcatgacagccagattccccgtaatggaaaagggcagcaagttggagacagagcattccgctgtggctacaagggctgtgggcgtctctacaccaccgctcatcacttaaaggtgcatgaacgagctcatacaggtgaccgtccatacagatgtgacttccccagctgtggaaaggcctttgccacaggtaacctgcctggtgggctgcttccagttgagggtggagggttctcgttctgtttgggacctctctgaagggaacccaacaccaggctgctttcctggagaaactaccgtcagagtactctgacttgcagggtgctctctctggaggaaaccttgttacgggagtgcaaggcagcatggttcaggccagcagaaggagcctggagggttggtggagagacccagcctcttgtgtcagctctgatgccaaccagctgtggattattgggtgggccattgcatctctctgggcttattttcccctctgtgaaactagtacctttagccatgagttctctaagtttcttttcatgctcatgttctggtatggctccaactgctcctggagagggaagcagggcagagtgggcttttccagcccctgcccagggcaggggtgggatagaggcagacatgggcttcttgagccaaaggaggtggagagcctgtgcatgaggtggacggtggaggatgagaccccactgggtgctcatctcaccccctgcctgccacatatggacaggctatggactgaagagccacgttcgtacccacactggtgagaaaccatacaagtgcccagaggagctgtgcagcaaggccttcaagacctcaggagacctgcagaagcatgtccgtacccacactggtgaacgcccgttccagtgcccttttgagggctgtggccgctccttcaccacatctaacatccgcaaggtacatgtgcgcacccacacaggcgagaggccctacacctgcccggagccccactgtggccgcggcttcaccagcgccaccaactataagaatcacgtgcgcatccacacagcccagtgtccccaggggagaagccatacgtttgcacggtgccaggctgcgggaaacgcttcaccgagtactcgagcttgtataagcaccacgtggtgcacacacactgcaagccctacacctgcagcacctgcggcaagacctaccggcagacctccaccttggccatgcacaagcgcagtgcccacggcgagctggaggccacggaggagagcgagcaggccctctatgagcagcagcaacttgaggccgcctctgcagccgaggagagtccgccacccaaacgaccccggatagcttacctttcggaggtgaaggaagagagagatgacatcccagcccaggtggcgatggtgactgaagaagatggggccccccaggtggctctgatcactcaggatggtgcccagcaggtcagcctgtccccggaagacctgcaggccctggggagtgccatcagtatggtcacccagcacggcagcaccaccctcaccatccccagtcctgatgccgacctggccacatctggcacacatacagtcaccatggtcagcgccgatggcacccagacgcagcccgtatgaccaggcggtttgcttggggtttcttattttgtcattcctttccatggggcgggcattaaagtgcagcctaaactagtcaagtcttcttaccaggacaaagattccccacaaaagaaggggtcttccccacagttcctgggccatgagcagctcttacctttaaaagcagttgaatggaggtcaagagacactttctaaatctcaattcaaccctgatttgttgtgcaaccttaggcaaatcacttttccatggacttctgtccattttcaagtgaggggattaaaatatctctggaattttttacagctctgtccttctgtgattcaaaatccctaaattaaattgggctctaagttgggaggaaacccagccttacttagctctgagcctcaggctaattaatctgacccatacggttttatccattctcttctgggttgttcccagcaccttaattggagggatgtttatttggattgtggggagggagagtatactgcaggtggaatggaagacctccttttgtctttcaggtcacaatcattacctctggggctgtggtggctgaggactcaagtgtagcatctcttcgtcatcaacaggtggcactgttggccacagccaacggaacgcacattgcagtgcaggtgagtagagatctgggaggaaaggggatcccacggccagagaagtcaacaaggaataaaggggaattagatgaggatcttgaagagaagggcatctgactcaaaaagagcccatttcagaggacagatccctttcctcctgcatccatgcatctgtctcaggctcgctcttggctgaggcagaatgttgaagcctcttctggccttcaggataactccgatggcagtccacctgtggtccaagcccttcatcattttgtgtctctgtttcttcatctggaaatgaaggaggctgacgtagatgatcaccacggttctcttcagccagtccttcctccgtgagcaagtgggtctctctgaccctggctattccagggccccctggccatgcctagcctaataggactcttcatccgtgaacttcatgtttattggagccctactaagtgctcagcgtgtggcactgggtagatgggggagagtcaaaaaaaaaagtaggccacatattactaacactggaatctagcagggagggtctcactgtctccttccttctgcacccccttccccacagctggaggaacagcagaccttagaggaggccatcaatgtggccactgcggccatgcagcaaggggctgtgaccctggagacaacagtgtcggagagtggctgctgagtccaagagggctgggtcccacaccatgctggaggaagtgccatctgcatggccactcttgcccccaagggcccaggctgtggctgacacatagaaggtggccacataggtctctggggtgagaagacagcaagaaaactgcctaactgaagggaatgggggccctgctcaagaagggggccaggcagctggaatcaggggagtgcatcatcctcgggagctgacaacagccaggctacaccagggcacccgcctctcaaaatcagctgggcgcccactctcctcctaaagaacacccttctggccctcagtctgttccccttctcaggtagagattggggctgctatggggactggccctgtagggttgagccacagacagctcttcagcccagtagcagtggagcaggccctgtcctgccctcccagcaataaccacctccctggaggccagctgagatgcctggctacttggcaccagggacttcctgacaccacagtcaattaattcctcaggggcctgtggctgaagaaaaggtgcccagcccccaccactcctcagctgccccccaacctctctatggcagagaggcagggagtggccctgtacatagactgctggggattgggtttgatttgttttgttttttttaattccattttgataatttttttcctgctctgggtggtggtggcacatggatgaatgagtatttaataaaagttccaaatttc

SEQ ID NO: 203714 - DNA, 2447 bp, Homo sapiens
  Payload ID: 20177
  Gene Name: zinc finger protein 76
  Uniprot ID: P36508
  ENST ID: ENST00000339411
  CDS Start-End: 165-1712
ggccggcgctggtggcggggcccggtgcatggcggtctgtcggcggagtcgccctcgggggctgtcagatttgtgacccagaaggaaatctctgacctcagctgtggctcttggtgctggccagaagccaacttcatgtctgagtgcacgagcagcagtttgccatggagagcttggggctgcacacggtgacccttagtgatgggacaacagcctacgtccagcaagctgtcaaaggagagaagcttcttgaagggcaggtgatccagctcgaggatgggaccaccgcatacattcaccaggtgacggtacagaaagaagctctctcctttgaggatggtcagcctgtgcagctggaagatggcagcatggcttacatacaccgcacacccagagaaggctatgaccccagcaccctggaagccgtccaactggaagatggctccactgcctacattcaccaccctgtggctgtgccatcggagagcaccatcctggccgtacagacagaggtgggcttggaggacctggcagcagaggatgatgagggcttcagtgcagacgcagtggtggccctggagcagtatgccagcaaggttcttcatgacagccagattccccgtaatggaaaagggcagcaagttggagacagagcattccgctgtggctacaagggctgtgggcgtctctacaccaccgctcatcacttaaaggtgcatgaacgagctcatacaggtgaccgtccatacagatgtgacttccccagctgtggaaaggcctttgccacaggctatggactgaagagccacgttcgtacccacactggtgagaaaccatacaagtgcccagaggagctgtgcagcaaggccttcaagacctcaggagacctgcagaagcatgtccgtacccacactggtgaacgcccgttccagtgcccttttgagggctgtggccgctccttcaccacatctaacatccgcaaggtacatgtgcgcacccacacaggcgagaggccctacacctgcccggagccccactgtggccgcggcttcaccagcgccaccaactataagaatcacgtgcgcatccacacaggggagaagccatacgtttgcacggtgccaggctgcgggaaacgcttcaccgagtactcgagcttgtataagcaccacgtggtgcacacacactgcaagccctacacctgcagcacctgcggcaagacctaccggcagacctccaccttggccatgcacaagcgcagtgcccacggcgagctggaggccacggaggagagcgagcaggccctctatgagcagcagcaacttgaggccgcctctgcagccgaggagagtccgccacccaaacgaccccggatagcttacctttcggaggtgaaggaagagagagatgacatcccagcccaggtggcgatggtgactgaagaagatggggccccccaggtggctctgatcactcaggatggtgcccagcaggtcacaatcattacctctggggctgtggtggctgaggactcaagtgtagcatctcttcgtcatcaacaggtggcactgttggccacagccaacggaacgcacattgcagtgcagctggaggaacagcagaccttagaggaggccatcaatgtggccactgcggccatgcagcaaggggctgtgaccctggagacaacagtgtcggagagtggctgctgagtccaagagggctgggtcccacaccatgctggaggaagtgccatctgcatggccactcttgcccccaagggcccaggctgtggctgacacatagaaggtggccacataggtctctggggtgagaagacagcaagaaaactgcctaactgaagggaatgggggccctgctcaagaagggggccaggcagctggaatcaggggagtgcatcatcctcgggagctgacaacagccaggctacaccagggcacccgcctctcaaaatcagctgggcgcccactctcctcctaaagaacacccttctggccctcagtctgttccccttctcaggtagagattggggctgctatggggactggccctgtagggttgagccacagacagctcttcagcccagtagcagtggagcaggccctgtcctgccctcccagcaataaccacctccctggaggccagctgagatgcctggctacttggcaccagggacttcctgacaccacagtcaattaattcctcaggggcctgtggctgaagaaaaggtgcccagcccccaccactcctcagctgccccccaacctctctatggcagagaggcagggagtggccctgtacatagactgctggggattgggtttgatttgttttgttttttttaattccattttgataatttttttcctgctctgggtggtggtggcacatggatgaatgagtatttaataaaagttccaaatttc

SEQ ID NO: 203715 - DNA, 2716 bp, Homo sapiens
  Payload ID: 20177
  Gene Name: zinc finger protein 76
  Uniprot ID: P36508
  ENST ID: ENST00000373953
  CDS Start-End: 267-1979
ggcgcgccaagaggaaaggaaagtgcggcggccctggaacctggatatcgcgcgaggcaagctgcgcgcgggcgggcgggctatggcgcaggcgggttgtggggccggcgctggtggcggggcccggtgcatggcggtctgtcggcggagtcgccctcgggggctgtcagatttgtgacccagaaggaaatctctgacctcagctgtggctcttggtgctggccagaagccaacttcatgtctgagtgcacgagcagcagtttgccatggagagcttggggctgcacacggtgacccttagtgatgggacaacagcctacgtccagcaagctgtcaaaggagagaagcttcttgaagggcaggtgatccagctcgaggatgggaccaccgcatacattcaccaggtgacggtacagaaagaagctctctcctttgaggatggtcagcctgtgcagctggaagatggcagcatggcttacatacaccgcacacccagagaaggctatgaccccagcaccctggaagccgtccaactggaagatggctccactgcctacattcaccaccctgtggctgtgccatcggagagcaccatcctggccgtacagacagaggtgggcttggaggacctggcagcagaggatgatgagggcttcagtgcagacgcagtggtggccctggagcagtatgccagcaaggttcttcatgacagccagattccccgtaatggaaaagggcagcaagttggagacagagcattccgctgtggctacaagggctgtgggcgtctctacaccaccgctcatcacttaaaggtgcatgaacgagctcatacaggtgaccgtccatacagatgtgacttccccagctgtggaaaggcctttgccacaggctatggactgaagagccacgttcgtacccacactggtgagaaaccatacaagtgcccagaggagctgtgcagcaaggccttcaagacctcaggagacctgcagaagcatgtccgtacccacactggtgaacgcccgttccagtgcccttttgagggctgtggccgctccttcaccacatctaacatccgcaaggtacatgtgcgcacccacacaggcgagaggccctacacctgcccggagccccactgtggccgcggcttcaccagcgccaccaactataagaatcacgtgcgcatccacacaggggagaagccatacgtttgcacggtgccaggctgcgggaaacgcttcaccgagtactcgagcttgtataagcaccacgtggtgcacacacactgcaagccctacacctgcagcacctgcggcaagacctaccggcagacctccaccttggccatgcacaagcgcagtgcccacggcgagctggaggccacggaggagagcgagcaggccctctatgagcagcagcaacttgaggccgcctctgcagccgaggagagtccgccacccaaacgaccccggatagcttacctttcggaggtgaaggaagagagagatgacatcccagcccaggtggcgatggtgactgaagaagatggggccccccaggtggctctgatcactcaggatggtgcccagcaggtcagcctgtccccggaagacctgcaggccctggggagtgccatcagtatggtcacccagcacggcagcaccaccctcaccatccccagtcctgatgccgacctggccacatctggcacacatacagtcaccatggtcagcgccgatggcacccagacgcagcccgtcacaatcattacctctggggctgtggtggctgaggactcaagtgtagcatctcttcgtcatcaacaggtggcactgttggccacagccaacggaacgcacattgcagtgcagctggaggaacagcagaccttagaggaggccatcaatgtggccactgcggccatgcagcaaggggctgtgaccctggagacaacagtgtcggagagtggctgctgagtccaagagggctgggtcccacaccatgctggaggaagtgccatctgcatggccactcttgcccccaagggcccaggctgtggctgacacatagaaggtggccacataggtctctggggtgagaagacagcaagaaaactgcctaactgaagggaatgggggccctgctcaagaagggggccaggcagctggaatcaggggagtgcatcatcctcgggagctgacaacagccaggctacaccagggcacccgcctctcaaaatcagctgggcgcccactctcctcctaaagaacacccttctggccctcagtctgttccccttctcaggtagagattggggctgctatggggactggccctgtagggttgagccacagacagctcttcagcccagtagcagtggagcaggccctgtcctgccctcccagcaataaccacctccctggaggccagctgagatgcctggctacttggcaccagggacttcctgacaccacagtcaattaattcctcaggggcctgtggctgaagaaaaggtgcccagcccccaccactcctcagctgccccccaacctctctatggcagagaggcagggagtggccctgtacatagactgctggggattgggtttgatttgttttgttttttttaattccattttgataatttttttcctgctctgggtggtggtggcacatggatgaatgagtatttaataaaagttccaaatttcca

SEQ ID NO: 203716 - DNA, 613 bp, Homo sapiens
  Payload ID: 20177
  Gene Name: zinc finger protein 76
  ENST ID: ENST00000498555
  CDS Start-End: 1-305
ccctcaccatccccagtcctgatgccgacctggccacatctggcacacatacagtcaccatggtcagcgccgatggcacccagacgcagcccgtcacaatcattacctctggggctgtggtggctgaggactcaagtgtagcatctcttcgtcatcaacaggtggcactgttggccacagccaacggaacgcacattgcagtgcaggtgagtagagatctgggaggaaaggggatcccacggccagagaagtcaacaaggaataaaggggaattagatgaggatcttgaagagaagggcatctgactcaaaaagagcccatttcagaggacagatccctttcctcctgcatccatgcatctgtctcaggctcgctcttggctgaggcagaatgttgaagcctcttctggccttcaggataactccgatggcagtccacctgtggtccaagcccttcatcattttgtgtctctgtttcttcatctggaaatgaaggaggctgacgtagatgatcaccacggttctcttcagccagtccttcctccgtgagcaagtgggtctctctgaccctggctattccagggccccctggccatgcctagcctaataggact

SEQ ID NO: 203717 - DNA, 1373 bp, Homo sapiens
  Payload ID: 20177
  Gene Name: zinc finger protein 76
  ENST ID: ENST00000469195
  CDS Start-End: 354-1373
ttccctgggcgctcagcctcgctggccatgcgtcaccccggccttggtgggggcggggctccgaagagctcggttcagatcccggccgcctgggctccaggagccccggaaccaggataagttggatggctgccgcggcgaagcggggggcggggtggaccgtgcccggtattttctatacgggttccggggcccggtagaggcgcgccaagaggaaaggaaagtgcggcggccctggaacctggatatcgcgcgagatttgtgacccagaaggaaatctctgacctcagctgtggctcttggtgctggccagaagccaacttcatgtctgagtgcacgagcagcagtttgccatggagagcttggggctgcacacggtgacccttagtgatgggacaacagcctacgtccagcaagctgtcaaaggagagaagcttcttgaagggcaggtgatccagctcgaggatgggaccaccgcatacattcaccaggtgacggtacagaaagaagctctctcctttgaggatggtcagcctgtgcagctggaagatggcagcatggcttacatacaccgcacacccagagaaggctatgaccccagcaccctggaagccgtccaactggaagatggctccactgcctacattcaccaccctgtggctgtgccatcggagagcaccatcctggccgtacagacagaggtgggcttggaggacctggcagcagaggatgatgagggcttcagtgcagacgcagtggtggccctggagcagtatgccagcaaggttcttcatgacagccagattccccgtaatggaaaagggcagcaagttggagacagagcattccgctgtggctacaagggctgtgggcgtctctacaccaccgctcatcacttaaaggtgcatgaacgagctcatacaggtgaccgtccatacagatgtgacttccccagctgtggaaaggcctttgccacaggctatggactgaagagccacgttcgtacccacactggtgagaaaccatacaagtgcccagaggagctgtgcagcaaggccttcaagacctcaggagacctgcagaagcatgtccgtacccacactggtgaacgcccgttccagtgcccttttgagggctgtggccgctccttcaccacatctaacatccgcaaggtacatgtgcgcacccacacaggcgagaggccctacacctgcccggagccccactgtggccgcggcttcaccagcgccaccaactataagaatcacgtgcgcatccacacaggggagaagccatacgtttgcacggtgccaggctgcgggaaacgcttcaccgagtactcgagcttgtataagcaccacgtggtgcacaca

SEQ ID NO: 203718 - DNA, 4061 bp, Homo sapiens
  Payload ID: 20178
  Gene Name: zinc finger protein 761
  ENST ID: ENST00000432094
  CDS Start-End: 308-2548
atggagtttcgctcttgttgctcaggctggagtgcaatggtgtgatctcggctcactgcaacctccgcctcccgggttcaagcgattctcctgcctcagcctctcgagtagctgagattacagagtattgcccgggctgtgagtgcagtctcatgatcttgggtcactgcaacctctgtttcctgggttcaagtgattcttgtgcctcagcatcccacgtagctgagattacaggattgacttctaaagactcttggtacgtgaggaagaaacccggaagaggaagaggagagcaaaggagtcagggatggctttttctcagggtctattgacattcagggatgtggccatagaattctctcaggaggagtggaaatgcctggaccctgctcagaggactctatacagggacgtgatgctggagaattataggaacctggtctccctggatatctcttccaaatgcacgatgaaggagttcttgtcaacagcgcaaggcaacagagaagtgttccatgcagggacattgcaaatacatgaaagtcatcacaatggagatttttgctaccaggatgttgataaagatattcatgactatgaatttcaatggcaagaagatgaaagaaatggccatgaagcacccatgacaaaaatcaaaaagttgacaggtattacagaacgatatgatcaaagtcatgctagaaacaagcctattaaagatcagcttggatcaagctttcattcgcatctgcctgaaatgcacatatttcagaccgaagagaaaattgataatcaagttgtgaagtctgtccacgatgcttccttggtttcaacagcccaaagaatttcttgtaggcccaaaacccatatatctaataaccatgggaataatttctggaattcttcattactcacacaaaaacaggaagtacacatgagagaaaaatctttccaatgtaatgagagtggcaaagcctttaattacagctcactcttaaggaaacatcagataatccatttagcagacaaatataaatgtgatgtatgtggcaagctctttaatcagaagcgaaacctagcatgccatcgtagatgtcacactggtgagaatccttacaagtgtaatgagtgtggcaagaccttcagtcagacgtcatcccttacatgccatcgtagacttcatactggagagaaaccttacaaatgtgaagaatgtgacaaagctttccatttcaaatcaatacttgaaagacataggataattcatactgaagagaaaccatataagtgtaatgagtgtggcaagacctttaggcagaagtcaatccttacacgccatcatcgacttcatactggagagaaaccttacaagtgtaatgagtgtggcaagacctttagtcacaagtcatcccttacatgccatcatagacttcatactggagagaaaccctacaaatgtaatgagtgtggcaagacctttagtcacaagtcatcccttacatgccatcgtagacttcatactggagagaaaccttacaaatgtgaagaatgtgacaaagcttacagtttcagatcaaattttgaaatacatcggaaaattcatactgaagacaatgcttacaagtgtaatgagtgtggaaagacctttagccggacatcatcccttacatgccatcgtagacgtcatactggagagcaaccttacaaatgtgaagaatgtgacaaagctttccgtttcaaatcaaaccttgaaagacataggagaattcatactggagagaaaccatacaagtgtaatgagtgtggcaagacctttagtcggaagtcatacctcacatgccatcatagacttcatactggagagaaagcttacaagtgtaatgagtgcggcaagacctttagttggaagtcatcccttacctgccatcgtagacttcattctggagagaaaccttacaagtgtaaggagtgtggcaagaccttcaatcagcagttaacccttaaacgccatcgtagacttcatagtggagagaacccttacaaatgtgaagatagtgacaaagcttacagtttcaaatcaaaccttgaaatacatcagaaaattcatactgaagagaatccttacaagtgtaatgagtgtggcaagaccttcagtcggacgtcatcccttacatgccatcgtagacttcataccggagagaaaccttacaaatgtgaagaatgtgacaaagctttccgtgtgaaatcaaaccttgaaggacataggagaattcatactggagagaaaccttacaagtgtaatgagtgtggcaagacctttagtcggaagtcatattttatatgccatcatagacttcatactggagagaaaccttataagtgtaatgagtgtggcaagaactttagtcagaagtcatcccttatatgccaccatagacttcatactggagagaaaccttacaagtgtaatgagtgtggcaagacctttagtcagaagtcaaaccttacatgccatcgtagacttcatactggagaaaaacaagtgtaatgaatgtggtgaggtttttaatcaacaagcacaccttgcaggtcatcatagaattcatactggggagaaaccttagaaatgtgaagcatgtgataaagtttacagtggcaaatcaagcctcagaagacaggagaattcatactggagagaaagcttataaatgtgaagaatgtcacaaagtttacagtcgcacatcaaaccgtgaaagacaggagaattcatactggagagaaaccataaaaatgtaagagtttgtgacaaggcttttgggcatgattcgcacctggcacaacatgctagaattcacactggagagaaaccttaccagtgtaatgagtgtggcaaagcctttagtaggcagtcaacacttgtttaccgtcaggcaatccatggtgtagggaaactttactaaggtaatgattgtcacaaagtcttcagtaatgctacaaccattgtgaatcactggagaatccataaggaagagagatcatactagggtaataaatgtggcagatttttcagacattgttcataccttgcagttcatcggtgaactcaacgctggagagaaaccttacaaatgtcatgactgtggcaaggtcttcagtcaagcttcatcctatgcaaaacataggagaattcatacaggagagaaacctcacatgtgtgatgatagtggcaaagccttcacttcacacctcatgagacatcagagaatgcatactggacagaaatcttacaaatgtcatcaatgtgccaaggtcttcagtctgagttcactccttgcagaatatgagaaaattcattttggaggtagttggtccatatgcaatgagtagagcaaaccatcaagcattaattgacattagggtcaattcagcattgacttgagtttgtattgacttaacattgagttcaagcattaattgacattagtgtttatgttaagaggattgggccaggcacatcagcttacacctgtaatctgagcgctttgggaggccaaggtgggtagatcacttgaggtcaggagtttgagatcagcctggccaacagacgtgagccattttcccagcctgttttttgtttctttaaaaaaactgatagggatttttatggatatcatgttgaatctaaatcacattgggttattatataatcatttcacaatattaatttttccaagctatcaatatgggttgtagctcaatgtttttaatcattttgatcaatgtttgtagatttcaaggtacaaacttctgacctttgtacgtttatttctaagtatttctttaagttctccagcaaatggaagtgttttaaaattttcttttaaaattgtttattgttaaagtatggaaattcaactaatttttggtgctgatactgtattgtgcaaatccactgactatgttacttagttccagtagtattttggttggctctttgtgattttctacacagaagattatgtcatctacaaacaaatataattttacttcttactttctga

SEQ ID NO: 203719 - DNA, 646 bp, Homo sapiens
  Payload ID: 20178
  Gene Name: zinc finger protein 761
  ENST ID: ENST00000613950
  CDS Start-End: 33-245
ggaagaggaagaggagagcaaaggagtcagggatggctttttctcagggtctattgacattcagggatgtggccatagaattctctcaggaggagtggaaatgcctggaccctgctcagaggactctatacagggacgtgatgctggagaattataggaacctggtctccctggggtcttgctgtgttgttgaaattcatcttgatctcctgagctcaagagatcctcctcagtctcccaagtagctgagattacaggtgccaaccaccatacctaattattggcttttatttttaagatttttgcatatgtgtggccgggcttggtggctcacgcctgtaatcccagcactttgggaggccaaggtgggtggatcacgaggtcaggcgatcgagaccagcccggccaacatggtgaaaccccgtctctactaaaaatagaaaaattagccgggtgtggtggcatgggcctgtaatcccagctacttgggaggctgaagcaggaggatcacatgaacctgggaatcggaggttgcagtgagccaagatcaccactgcacatctgcctggtgacagagtgagactccatctcaaaaaaataaataaaataaaatgaaatatttgcatatgtgtgtccttaaggctaa

SEQ ID NO: 203720 - DNA, 3967 bp, Homo sapiens
  Payload ID: 20178
  Gene Name: zinc finger protein 761
  ENST ID: ENST00000454407
  CDS Start-End: 215-2455
agttctacagctgaccctctttcgctattttcaaggtcaatagctgtgtgttcacacttctgcattttataaatgttactgtgattttcttgaggtggcgtgttgattctgagcaataaacaacatatttctaacattcaggattgacttctaaagactcttggtacgtgaggaagaaacccggaagaggaagaggagagcaaaggagtcagggatggctttttctcagggtctattgacattcagggatgtggccatagaattctctcaggaggagtggaaatgcctggaccctgctcagaggactctatacagggacgtgatgctggagaattataggaacctggtctccctggatatctcttccaaatgcacgatgaaggagttcttgtcaacagcgcaaggcaacagagaagtgttccatgcagggacattgcaaatacatgaaagtcatcacaatggagatttttgctaccaggatgttgataaagatattcatgactatgaatttcaatggcaagaagatgaaagaaatggccatgaagcacccatgacaaaaatcaaaaagttgacaggtattacagaacgatatgatcaaagtcatgctagaaacaagcctattaaagatcagcttggatcaagctttcattcgcatctgcctgaaatgcacatatttcagaccgaagagaaaattgataatcaagttgtgaagtctgtccacgatgcttccttggtttcaacagcccaaagaatttcttgtaggcccaaaacccatatatctaataaccatgggaataatttctggaattcttcattactcacacaaaaacaggaagtacacatgagagaaaaatctttccaatgtaatgagagtggcaaagcctttaattacagctcactcttaaggaaacatcagataatccatttagcagacaaatataaatgtgatgtatgtggcaagctctttaatcagaagcgaaacctagcatgccatcgtagatgtcacactggtgagaatccttacaagtgtaatgagtgtggcaagaccttcagtcagacgtcatcccttacatgccatcgtagacttcatactggagagaaaccttacaaatgtgaagaatgtgacaaagctttccatttcaaatcaatacttgaaagacataggataattcatactgaagagaaaccatataagtgtaatgagtgtggcaagacctttaggcagaagtcaatccttacacgccatcatcgacttcatactggagagaaaccttacaagtgtaatgagtgtggcaagacctttagtcacaagtcatcccttacatgccatcatagacttcatactggagagaaaccctacaaatgtaatgagtgtggcaagacctttagtcacaagtcatcccttacatgccatcgtagacttcatactggagagaaaccttacaaatgtgaagaatgtgacaaagcttacagtttcagatcaaattttgaaatacatcggaaaattcatactgaagacaatgcttacaagtgtaatgagtgtggaaagacctttagccggacatcatcccttacatgccatcgtagacgtcatactggagagcaaccttacaaatgtgaagaatgtgacaaagctttccgtttcaaatcaaaccttgaaagacataggagaattcatactggagagaaaccatacaagtgtaatgagtgtggcaagacctttagtcggaagtcatacctcacatgccatcatagacttcatactggagagaaagcttacaagtgtaatgagtgcggcaagacctttagttggaagtcatcccttacctgccatcgtagacttcattctggagagaaaccttacaagtgtaaggagtgtggcaagaccttcaatcagcagttaacccttaaacgccatcgtagacttcatagtggagagaacccttacaaatgtgaagatagtgacaaagcttacagtttcaaatcaaaccttgaaatacatcagaaaattcatactgaagagaatccttacaagtgtaatgagtgtggcaagaccttcagtcggacgtcatcccttacatgccatcgtagacttcataccggagagaaaccttacaaatgtgaagaatgtgacaaagctttccgtgtgaaatcaaaccttgaaggacataggagaattcatactggagagaaaccttacaagtgtaatgagtgtggcaagacctttagtcggaagtcatattttatatgccatcatagacttcatactggagagaaaccttataagtgtaatgagtgtggcaagaactttagtcagaagtcatcccttatatgccaccatagacttcatactggagagaaaccttacaagtgtaatgagtgtggcaagacctttagtcagaagtcaaaccttacatgccatcgtagacttcatactggagaaaaacaagtgtaatgaatgtggtgaggtttttaatcaacaagcacaccttgcaggtcatcatagaattcatactggggagaaaccttagaaatgtgaagcatgtgataaagtttacagtggcaaatcaagcctcagaagacaggagaattcatactggagagaaagcttataaatgtgaagaatgtcacaaagtttacagtcgcacatcaaaccgtgaaagacaggagaattcatactggagagaaaccataaaaatgtaagagtttgtgacaaggcttttgggcatgattcgcacctggcacaacatgctagaattcacactggagagaaaccttaccagtgtaatgagtgtggcaaagcctttagtaggcagtcaacacttgtttaccgtcaggcaatccatggtgtagggaaactttactaaggtaatgattgtcacaaagtcttcagtaatgctacaaccattgtgaatcactggagaatccataaggaagagagatcatactagggtaataaatgtggcagatttttcagacattgttcataccttgcagttcatcggtgaactcaacgctggagagaaaccttacaaatgtcatgactgtggcaaggtcttcagtcaagcttcatcctatgcaaaacataggagaattcatacaggagagaaacctcacatgtgtgatgatagtggcaaagccttcacttcacacctcatgagacatcagagaatgcatactggacagaaatcttacaaatgtcatcaatgtgccaaggtcttcagtctgagttcactccttgcagaatatgagaaaattcattttggaggtagttggtccatatgcaatgagtagagcaaaccatcaagcattaattgacattagggtcaattcagcattgacttgagtttgtattgacttaacattgagttcaagcattaattgacattagtgtttatgttaagaggattgggccaggcacatcagcttacacctgtaatctgagcgctttgggaggccaaggtgggtagatcacttgaggtcaggagtttgagatcagcctggccaacagacgtgagccattttcccagcctgttttttgtttctttaaaaaaactgatagggatttttatggatatcatgttgaatctaaatcacattgggttattatataatcatttcacaatattaatttttccaagctatcaatatgggttgtagctcaatgtttttaatcattttgatcaatgtttgtagatttcaaggtacaaacttctgacctttgtacgtttatttctaagtatttctttaagttctccagcaaatggaagtgttttaaaattttcttttaaaattgtttattgttaaagtatggaaattcaactaatttttggtgctgatactgtattgtgcaaatccactgactatgttacttagttccagtagtattttggttggctctttgtgattttctacacagaagattatgtcatctacaaacaaatataattttacttcttactttctg

SEQ ID NO: 203721 - DNA, 938 bp, Homo sapiens
  Payload ID: 20178
  Gene Name: zinc finger protein 761
  ENST ID: ENST00000610928
  CDS Start-End: 344-508
agcggatagcgtggagtgacggtgccaccgcggcgcatggagtttcgctcttgttgctcaggctggagtgcaatggtgtgatctcggctcactgcaacctccgcctcccgggttcaagcgattctcctgcctcagcctctcgagtagctgagattacagagtattgcccgggctgtgagtgcagtctcatgatcttgggtcactgcaacctctgtttcctgggttcaagtgattcttgtgcctcagcatcccacgtagctgagattacaggattgacttctaaagactcttggtacgtgaggaagaaacccggaagaggaagaggagagcaaaggagtcagggatggctttttctcagggtctattgacattcagggatgtggccatagaattctctcaggaggagtggaaatgcctggaccctgctcagaggactctatacagggacgtgatgctggagaattataggaacctggtctccctggacagggtcttgctgtgttgttgaaattcatcttgatctcctgagctcaagagatcctcctcagtctcccaagtagctgagattacaggtgccaaccaccatacctaattattggcttttatttttaagatttttgcatatgtgtggccgggcttggtggctcacgcctgtaatcccagcactttgggaggccaaggtgggtggatcacgaggtcaggcgatcgagaccagcccggccaacatggtgaaaccccgtctctactaaaaatagaaaaattagccgggtgtggtggcatgggcctgtaatcccagctacttgggaggctgaagcaggaggatcacatgaacctgggaatcggaggttgcagtgagccaagatcaccactgcacatctgcctggtgacagagtgagactccatctcaaaaaaataaataaaataaaatgaaatatttg

SEQ ID NO: 203722 - DNA, 3681 bp, Homo sapiens
  Payload ID: 20178
  Gene Name: zinc finger protein 761
  ENST ID: ENST00000334095
  CDS Start-End: 1-58
tgttgaaattcatcttgatctcctgagctcaagagatcctcctcagtctcccaagtagctgagattacagatatctcttccaaatgcacgatgaaggagttcttgtcaacagcgcaaggcaacagagaagtgttccatgcagggacattgcaaatacatgaaagtcatcacaatggagatttttgctaccaggatgttgataaagatattcatgactatgaatttcaatggcaagaagatgaaagaaatggccatgaagcacccatgacaaaaatcaaaaagttgacaggtattacagaacgatatgatcaaagtcatgctagaaacaagcctattaaagatcagcttggatcaagctttcattcgcatctgcctgaaatgcacatatttcagaccgaagagaaaattgataatcaagttgtgaagtctgtccacgatgcttccttggtttcaacagcccaaagaatttcttgtaggcccaaaacccatatatctaataaccatgggaataatttctggaattcttcattactcacacaaaaacaggaagtacacatgagagaaaaatctttccaatgtaatgagagtggcaaagcctttaattacagctcactcttaaggaaacatcagataatccatttagcagacaaatataaatgtgatgtatgtggcaagctctttaatcagaagcgaaacctagcatgccatcgtagatgtcacactggtgagaatccttacaagtgtaatgagtgtggcaagaccttcagtcagacgtcatcccttacatgccatcgtagacttcatactggagagaaaccttacaaatgtgaagaatgtgacaaagctttccatttcaaatcaatacttgaaagacataggataattcatactgaagagaaaccatataagtgtaatgagtgtggcaagacctttaggcagaagtcaatccttacacgccatcatcgacttcatactggagagaaaccttacaagtgtaatgagtgtggcaagacctttagtcacaagtcatcccttacatgccatcatagacttcatactggagagaaaccctacaaatgtaatgagtgtggcaagacctttagtcacaagtcatcccttacatgccatcgtagacttcatactggagagaaaccttacaaatgtgaagaatgtgacaaagcttacagtttcagatcaaattttgaaatacatcggaaaattcatactgaagacaatgcttacaagtgtaatgagtgtggaaagacctttagccggacatcatcccttacatgccatcgtagacgtcatactggagagcaaccttacaaatgtgaagaatgtgacaaagctttccgtttcaaatcaaaccttgaaagacataggagaattcatactggagagaaaccatacaagtgtaatgagtgtggcaagacctttagtcggaagtcatacctcacatgccatcatagacttcatactggagagaaagcttacaagtgtaatgagtgcggcaagacctttagttggaagtcatcccttacctgccatcgtagacttcattctggagagaaaccttacaagtgtaaggagtgtggcaagaccttcaatcagcagttaacccttaaacgccatcgtagacttcatagtggagagaacccttacaaatgtgaagatagtgacaaagcttacagtttcaaatcaaaccttgaaatacatcagaaaattcatactgaagagaatccttacaagtgtaatgagtgtggcaagaccttcagtcggacgtcatcccttacatgccatcgtagacttcataccggagagaaaccttacaaatgtgaagaatgtgacaaagctttccgtgtgaaatcaaaccttgaaggacataggagaattcatactggagagaaaccttacaagtgtaatgagtgtggcaagacctttagtcggaagtcatattttatatgccatcatagacttcatactggagagaaaccttataagtgtaatgagtgtggcaagaactttagtcagaagtcatcccttatatgccaccatagacttcatactggagagaaaccttacaagtgtaatgagtgtggcaagacctttagtcagaagtcaaaccttacatgccatcgtagacttcatactggagaaaaacaagtgtaatgaatgtggtgaggtttttaatcaacaagcacaccttgcaggtcatcatagaattcatactggggagaaaccttagaaatgtgaagcatgtgataaagtttacagtggcaaatcaagcctcagaagacaggagaattcatactggagagaaagcttataaatgtgaagaatgtcacaaagtttacagtcgcacatcaaaccgtgaaagacaggagaattcatactggagagaaaccataaaaatgtaagagtttgtgacaaggcttttgggcatgattcgcacctggcacaacatgctagaattcacactggagagaaaccttaccagtgtaatgagtgtggcaaagcctttagtaggcagtcaacacttgtttaccgtcaggcaatccatggtgtagggaaactttactaaggtaatgattgtcacaaagtcttcagtaatgctacaaccattgtgaatcactggagaatccataaggaagagagatcatactagggtaataaatgtggcagatttttcagacattgttcataccttgcagttcatcggtgaactcaacgctggagagaaaccttacaaatgtcatgactgtggcaaggtcttcagtcaagcttcatcctatgcaaaacataggagaattcatacaggagagaaacctcacatgtgtgatgatagtggcaaagccttcacttcacacctcatgagacatcagagaatgcatactggacagaaatcttacaaatgtcatcaatgtgccaaggtcttcagtctgagttcactccttgcagaatatgagaaaattcattttggaggtagttggtccatatgcaatgagtagagcaaaccatcaagcattaattgacattagggtcaattcagcattgacttgagtttgtattgacttaacattgagttcaagcattaattgacattagtgtttatgttaagaggattgggccaggcacatcagcttacacctgtaatctgagcgctttgggaggccaaggtgggtagatcacttgaggtcaggagtttgagatcagcctggccaacagacgtgagccattttcccagcctgttttttgtttctttaaaaaaactgatagggatttttatggatatcatgttgaatctaaatcacattgggttattatataatcatttcacaatattaatttttccaagctatcaatatgggttgtagctcaatgtttttaatcattttgatcaatgtttgtagatttcaaggtacaaacttctgacctttgtacgtttatttctaagtatttctttaagttctccagcaaatggaagtgttttaaaattttcttttaaaattgtttattgttaaagtatggaaattcaactaatttttggtgctgatactgtattgtgcaaatccactgactatgttacttagttccagtagtattttggttggctctttgtgattttctacacagaagattatgtcatctacaaacaaatataattttacttcttactttctg

SEQ ID NO: 203723 - DNA, 2621 bp, Homo sapiens
  Payload ID: 20179
  Gene Name: zinc finger protein 763
  Uniprot ID: Q0D2J5
  ENST ID: ENST00000343949
  CDS Start-End: 156-1349
gtccttgcgcagccggtggttgatatccgctgtatccatccccgagagggacctggtacctctacccaggtttctatcgctctgtctcctgcgctgtgcccttctgtagtcacaggagctgtagagaggaccccaggacatctgaaagccaggaaatgatgtttcaggaccctgtggcctgtgaggatgttgctgtgaacttcacccaggaggagtgggctttgctggatatttcgcagaggaaactctacagggaagtgatgctggaaactttcaggaacctgacctctatagggaaaaagtggaaagaccagaacattgaatatgagtaccaaaaccccaggagaaacttcaggagtctcatagaagggaatgtcaatgaaattaaagaagacagtcattgtggagaaacttttacccaggttccagatgacaggctgaacttccaggagaagaaagcttctcctgaagcaaaatcatgtgataactttgtatgtggagaagttggcataggtaactcatcttttaatatgaacatcagaggtgacattgggcacaaggcatacgagtatcaggactatgcaccaaagccatataagtgtcaacaacctaagaaagccttcagatatcacccctcctttagaacacaagaaaggaatcacaccggagagaaaccctatgcttgtaaagaatgtggaaaaacctttatttcccattcaggcattcgaagacgcatggtaatgcacagtggggatggaccttataaatgtaagttttgtgggaaagctgtccattgtctcagattatatcttatccatgaaagaactcacactggagagaaaccgtatgaatgtaaacaatgtgttaaatcctttagttattctgctacccatcgaatacatgaaagaactcacactggagaaaagccttatgaatgtcagcaatgtgggaaagcattccatagttccagttcttttcaagcacataaaagaacccacactgggggaaagccatatgaatgtaaacaatgtggcaaatccttcagttggtgtcattcctttcaaatacatgaaagaactcacactggggagaagccctgtgaatgtagcaaatgtaataaagcattccgtagttacagatcctatcttagacataaaaggagtcacacgggagagaagccttatcaatgtaaggaatgtagaaaagcattcacgtatcccagttcccttcgtagacatgaaaggacccactctgcgaaaaaaccttatgaatgtaagcagtgtgggaaagcattatcttataagttttcaaacacacctaagaatgcgctctggagaaagaccttataaatgttagatatgtgggaaaggcctttattctgccaagtcatttcgaagacatgaaaaaactcacactggagagaaaccctataaatgcatgccatgtggtaaagccttcaatctttccagttcctttcagtatcatgaaaggactcacactggagagaaaccctatgagtgtaagcaatgtgggaaagccttcagatgtgccccacaccttcgaaggcatggtaggactcactggagagaaaccctatgagtgtaaggaatgtgggaaagccttcagatctgcctcacaccttcaaattcatgaaaggacacaaacacacataagaatacactctggagaaagaccttataaatgtaagacatgtgggaaaggcttttattctcccacgtcatttcaaagacatgaaaaaactcacactgcagagaaaccctatgaatgcaagcaatgtggtaaagccttcagtagttccagttccttttggtaccatgaaaggactcacactggagagaaaccctatgagtgtaagcaatgtgggaaagccttcagatctgcctcaatccttcaaatgcatgctgggactcaccctgaagagaagccctacgagtgtaagcaatgtgggaaagccttcagatctgccccacaccttcgaatccatggtagaactcacactggagagaaaccctatgagtgtaaggaatgtgggaaagccttcagatctgccaagaaccttcgaattcatgaaaggacacaaacacacgtaagaatgcactctgtagaaagaccttataaatgtaagatatgtgggaaaggcttttattctgccaagtcatttcaaatacctgaaaaatcttacactggagagaaaccctatgagtgtaagcaatgtgggaaagcctttatttctttcacttcttttcgataacatgaaaggactcacactggagagaaaccctatgagtgtaagcaatgtggaaaaaccttcagatctacctcacaccttcgaaaacatggtaggactcacactggatagaaaccaaagcaggtgaatcacctgaggtcaggagttcaagactggcctgatcaatatgatgaaacccctgtctctactaaaactacaaaaattggccaggcgtggtggcctgcttctgtaatcctagctagttgggaggctggcacaggagaatcgcttgaatctggggggcagaggttgcagtgagccaagattgtgccattgcactctagcctgggcaacaggagcaaaactccgtctc

SEQ ID NO: 203724 - DNA, 1518 bp, Homo sapiens
  Payload ID: 20179
  Gene Name: zinc finger protein 763
  Uniprot ID: Q0D2J5
  ENST ID: ENST00000358987
  CDS Start-End: 128-1312
gctgtatccatccccgagagggacctggtacctctacccaggtttctatcgctctgtctcctgcgctgtgcccttctgtagtcacaggagctgtagagaggaccccaggacatctgaaagccaggaaatggaccctgtggcctgtgaggatgttgctgtgaacttcacccaggaggagtgggctttgctggatatttcgcagaggaaactctacagggaagtgatgctggaaactttcaggaacctgacctctatagggaaaaagtggaaagaccagaacattgaatatgagtaccaaaaccccaggagaaacttcaggagtctcatagaagggaatgtcaatgaaattaaagaagacagtcattgtggagaaacttttacccaggttccagatgacaggctgaacttccaggagaagaaagcttctcctgaagcaaaatcatgtgataactttgtatgtggagaagttggcataggtaactcatcttttaatatgaacatcagaggtgacattgggcacaaggcatacgagtatcaggactatgcaccaaagccatataagtgtcaacaacctaagaaagccttcagatatcacccctcctttagaacacaagaaaggaatcacaccggagagaaaccctatgcttgtaaagaatgtggaaaaacctttatttcccattcaggcattcgaagacgcatggtaatgcacagtggggatggaccttataaatgtaagttttgtgggaaagctgtccattgtctcagattatatcttatccatgaaagaactcacactggagagaaaccgtatgaatgtaaacaatgtgttaaatcctttagttattctgctacccatcgaatacatgaaagaactcacactggagaaaagccttatgaatgtcagcaatgtgggaaagcattccatagttccagttcttttcaagcacataaaagaacccacactgggggaaagccatatgaatgtaaacaatgtggcaaatccttcagttggtgtcattcctttcaaatacatgaaagaactcacactggggagaagccctgtgaatgtagcaaatgtaataaagcattccgtagttacagatcctatcttagacataaaaggagtcacacgggagagaagccttatcaatgtaaggaatgtagaaaagcattcacgtatcccagttcccttcgtagacatgaaaggacccactctgcgaaaaaaccttatgaatgtaagcagtgtgggaaagcattatcttataagttttcaaacacacctaagaatgcgctctggagaaagaccttataaatgttagatatgtgggaaaggcctttattctgccaagtcatttcgaagacatgaaaaaactcacactggagagaaaccctataaatgcatgccatgtggtaaagccttcaatctttccagttcctttcagtatcatgaaaggactcacactggagagaaaccctatgagtgtaagcaatgtgggaaagccttcagatgtgccccac

SEQ ID NO: 203725 - DNA, 582 bp, Homo sapiens
  Payload ID: 20179
  Gene Name: zinc finger protein 763
  ENST ID: ENST00000592625
  CDS Start-End: 173-313
ttcctgtcctcacctttgtccttgcgcagccggtggttgatatccgctgtatccatccccgagagggacctggtacctctacccaggtttctatcgctctgtctcctgcgctgtgcccttctgtagtcacaggagctgtagagaggaccccaggacatctgaaagccaggaaatggaccctgtggcctgtgaggatgttgctgtgaacttcacccaggaggagtgggctttgctggatatttcgcagaggaaactctacagggaagtgatgctggaaactttcaggaacctgacctctataggagtctcatagaagggaatgtcaatgaaattaaagaagacagtcattgtggagaaacttttacccaggttccagatgacaggctgaacttccaggagaagaaagcttctcctgaagcaaaatcatgtgataactttgtatgtggagaagttggcataggtaactcatcttttaatatgaacatcagaggtgacattgggcacaaggcatacgagtatcaggactatgcaccaaagccatataagtgtcaacaacctaagaaagccttcagatatcacccc

SEQ ID NO: 203726 - DNA, 573 bp, Homo sapiens
  Payload ID: 20179
  Gene Name: zinc finger protein 763
  ENST ID: ENST00000586494
  CDS Start-End: 334-573
gtccttgcgcagccggtggttgatatccgctgtatccatccccgagagggacctggtacctctacccaggtttctatcgctctgtctcctgcgctgtgcccttctgtagtcacaggagctgtagagaggaccccaggacatctgaaagccaggaaatggagtctcatagaagggaatgtcaatgaaattaaagaagacagtcattgtggagaaacttttacccaggttccagatgacaggctgaacttccaggagaagaaagcttctcctgaagcaaaatcatgtgataactttgtatgtggagaagttggcataggtaactcatcttttaatatgaacatcagaggtgacattgggcacaaggcatacgagtatcaggactatgcaccaaagccatataagtgtcaacaacctaagaaagccttcagatatcacccctcctttagaacacaagaaaggaatcacaccggagagaaaccctatgcttgtaaagaatgtggaaaaacctttatttcccattcaggcattcgaagacgcatggtaatgcacagtggggatggaccttataaatgt

SEQ ID NO: 203727 - DNA, 564 bp, Homo sapiens
  Payload ID: 20179
  Gene Name: zinc finger protein 763
  ENST ID: ENST00000481745
  CDS Start-End: 121-564
ccagcctgggcaacaagttgttgttttgaaaatccatctcaaaacaacaacaacaaaaatgctttatggaagaaagtacagaaagcgagaaagggatgtgatgaccaaagcagggaataaatgtttggagtccacggcaacttcttgggaatagagtctaggcccccactgctgtcactctcacccagcctcctctacacatgtgagatgtttcaggaccctgtggcctgtgaggatgttgctgtgaacttcacccaggaggagtgggctttgctggatatttcgcagaggaaactctacagggaagtgatgctggaaactttcaggaacctgacctctatagggaaaaagtggaaagaccagaacattgaatatgagtaccaaaaccccaggagaaacttcaggagtctcatagaagggaatgtcaatgaaattaaagaagacagtcattgtggagaaacttttacccaggttccagatgacaggctgaacttccaggagaagaaagcttctcctgaagcaaaatcatgtgataactttgtatgtggagaagttggcataggt

SEQ ID NO: 203728 - DNA, 2738 bp, Homo sapiens
  Payload ID: 20180
  Gene Name: zinc finger protein 764
  Uniprot ID: Q96H86
  ENST ID: ENST00000252797
  CDS Start-End: 82-1308
ctttctcgggcgcaggaggttccgcaggcccaggccaggccaggggaggcagccgatccgtcgtcggggttgacagttaccatggcgccgcctctggccccgctccctccccgggacccaaacggggccggacccgagtggagggagccgggggctgtgagcttcgcggacgtggccgtgtacttctgccgggaggagtggggctgcttgcggccagcgcagagggccctgtaccgggacgtgatgcgggagacctacggccacctgagcgctctcggaatcggaggcaacaagccagctctcatctcctgggtggaggaggaggccgaactgtggggtccggctgcccaggatccggaggtggcgaaatgtcagacacaaacggacccagcagattccagaaacaagaaaaaggaaagacaaagggaagggacgggagccctggagaagcccgaccctgtggccgccgggtctcctgggctgaagtctccccaagccccctcggccgggcccccttatggttgggagcagctgtccaaggcaccgcaccggggacgcccctccctctgtgcccacccccctgtcccccgagctgaccagcgtcatggctgctacgtgtgcgggaagagctttgcctggcgctccacactggtggagcacgtctacagtcacactggcgagaagcccttccactgcactgactgcggcaagggcttcggccacgcttcctccctgagcaaacaccgggccatccatcgtggggagcggccccaccgctgtctggagtgtggccgggccttcacgcagcgctcggcgctgacttcgcacctgcgcgtccacaccggcgagaaaccctatggctgcgccgactgtggccgccgcttcagccagagctctgccctctaccagcaccggcgcgtgcacagcggcgagacccccttcccctgcccggactgtggccgcgccttcgcctacccctcggacctgcggcgccacgtgcgcacccacaccggcgagaagccctacccgtgcccggactgcgggcgctgcttccgccagagctcggagatggcagcccacaggcgcacccacagcggcgagaagccctacccctgcccgcagtgcggccgccgctttggccagaagtcagccgtggccaaacaccagtgggttcatcggcccggggccgggggccacaggggccgggtcgccgggcgtctgtctgtgaccctgacccctggccacggagacctggacccgcccgtgggcttccagctgtacccggagatattccaggagtgtgggtgacggccttaaaagtgactatctagacattacgggaggcccgagatgggctcaggggcccgaacctctgcggcggcctgcagggaggtcccagaatctagggcaagagctggccctggggtgcggacagtctgatcttgggcccttagcagcctcctctgccagcaccttgctccccactgcccagggctctccaaggccccctctactgaggcagggctgagttgagaacccccagacctacataaggggaaccaaaagctgtttctcagcccagaggtgctaagaggactgaggtagaggagaaccttgttttacccattgtctttttaaattttttatcattatttttattcttgtgaccctcccagaacacaatactcattgtctttttatttatttatttatttatttctgagacagcttcctgctctgtcacccaggctggagtgcagtggtgtgaacagggctaactgcagcctcaacctgcagtgctcaaggaatcctctcccatcagccttccaaatatctgagactacaggcgggcaacactacggccagctaatttttaaattttacatagagatgaggttctcactgttgtccaggctggtctcaaactccttggctgaagtgatcctgtcgtctcggcttccgcaagtgctgggattacaggcgtgagctaccaccatgcctggcttccattgtctttgtgtgtgtgtgtgtgtgatggggttttgctcttgttgcccaggctggagtgcaatagcgcaatctcagctcactgcaacctctgcctccagagttcaagcaattctccttcctcagcctcccaagtagctgggactacaggcacccaccacctccattgtctttttactgcccaagttaaaatcctgtgactgtgtactggatctggcctgcggttgtcatatttattgatctgagtccaggcagtgtttttaagtgatatgagttagtagtgaaaattgaaaaggatattttacaaccaaatacaggttttctggtgtcttttgaaaaatccaaagatttggcaactcgacctaggctccgacaaaaccacagttgttgggagctgagccggagccagaactcacaattcaccgtggcccggccacccatccccaccactcccgtgggctcctgaccaagcaccacgtgccattcatcatggcttgcttttagtgtttttggtgtttatcttaaagtacagcgaagaagaaagggaagtatttcttagacccatgtctctgtccaaataggcctttccatctggcatttcccgctcatttatatgacttgctgagttcctatggtcatttgagtttgcaaacagtggtctgtagcactcaggttttctggagttggagagaaagggtggcaagagagaagtaaaagttggttttatttta

SEQ ID NO: 203729 - DNA, 2970 bp, Homo sapiens
  Payload ID: 20180
  Gene Name: zinc finger protein 764
  Uniprot ID: Q96H86
  ENST ID: ENST00000395091
  CDS Start-End: 317-1540
attttggatgagggtacggagagaacgcggactggagataccgggggcgttgtcttgggcacgactgcgtaggggcaaaggtcgagtacccgcgccgccgccattttttatgagggcatattccatttctgattatacacccgctgccatcggcaccgttagtttccacgccctctagtgcgccctcgggggccctagtaacctccctccttcccttgggcccgggccggggaggctttctcgggcgcaggaggttccgcaggcccaggccaggccaggggaggcagccgatccgtcgtcggggttgacagttaccatggcgccgcctctggccccgctccctccccgggacccaaacggggccggacccgagtggagggagccgggggctgtgagcttcgcggacgtggccgtgtacttctgccgggaggagtggggctgcttgcggccagcgcagagggccctgtaccgggacgtgatgcgggagacctacggccacctgagcgctctcggaatcggaggcaacaagccagctctcatctcctgggtggaggaggaggccgaactgtggggtccggctgcccaggatccggaggtggcgaaatgtcagacacaaacggacccagattccagaaacaagaaaaaggaaagacaaagggaagggacgggagccctggagaagcccgaccctgtggccgccgggtctcctgggctgaagtctccccaagccccctcggccgggcccccttatggttgggagcagctgtccaaggcaccgcaccggggacgcccctccctctgtgcccacccccctgtcccccgagctgaccagcgtcatggctgctacgtgtgcgggaagagctttgcctggcgctccacactggtggagcacgtctacagtcacactggcgagaagcccttccactgcactgactgcggcaagggcttcggccacgcttcctccctgagcaaacaccgggccatccatcgtggggagcggccccaccgctgtctggagtgtggccgggccttcacgcagcgctcggcgctgacttcgcacctgcgcgtccacaccggcgagaaaccctatggctgcgccgactgtggccgccgcttcagccagagctctgccctctaccagcaccggcgcgtgcacagcggcgagacccccttcccctgcccggactgtggccgcgccttcgcctacccctcggacctgcggcgccacgtgcgcacccacaccggcgagaagccctacccgtgcccggactgcgggcgctgcttccgccagagctcggagatggcagcccacaggcgcacccacagcggcgagaagccctacccctgcccgcagtgcggccgccgctttggccagaagtcagccgtggccaaacaccagtgggttcatcggcccggggccgggggccacaggggccgggtcgccgggcgtctgtctgtgaccctgacccctggccacggagacctggacccgcccgtgggcttccagctgtacccggagatattccaggagtgtgggtgacggccttaaaagtgactatctagacattacgggaggcccgagatgggctcaggggcccgaacctctgcggcggcctgcagggaggtcccagaatctagggcaagagctggccctggggtgcggacagtctgatcttgggcccttagcagcctcctctgccagcaccttgctccccactgcccagggctctccaaggccccctctactgaggcagggctgagttgagaacccccagacctacataaggggaaccaaaagctgtttctcagcccagaggtgctaagaggactgaggtagaggagaaccttgttttacccattgtctttttaaattttttatcattatttttattcttgtgaccctcccagaacacaatactcattgtctttttatttatttatttatttatttctgagacagcttcctgctctgtcacccaggctggagtgcagtggtgtgaacagggctaactgcagcctcaacctgcagtgctcaaggaatcctctcccatcagccttccaaatatctgagactacaggcgggcaacactacggccagctaatttttaaattttacatagagatgaggttctcactgttgtccaggctggtctcaaactccttggctgaagtgatcctgtcgtctcggcttccgcaagtgctgggattacaggcgtgagctaccaccatgcctggcttccattgtctttgtgtgtgtgtgtgtgtgatggggttttgctcttgttgcccaggctggagtgcaatagcgcaatctcagctcactgcaacctctgcctccagagttcaagcaattctccttcctcagcctcccaagtagctgggactacaggcacccaccacctccattgtctttttactgcccaagttaaaatcctgtgactgtgtactggatctggcctgcggttgtcatatttattgatctgagtccaggcagtgtttttaagtgatatgagttagtagtgaaaattgaaaaggatattttacaaccaaatacaggttttctggtgtcttttgaaaaatccaaagatttggcaactcgacctaggctccgacaaaaccacagttgttgggagctgagccggagccagaactcacaattcaccgtggcccggccacccatccccaccactcccgtgggctcctgaccaagcaccacgtgccattcatcatggcttgcttttagtgtttttggtgtttatcttaaagtacagcgaagaagaaagggaagtatttcttagacccatgtctctgtccaaataggcctttccatctggcatttcccgctcatttatatgacttgctgagttcctatggtcatttgagtttgcaaacagtggtctgtagcactcaggttttctggagttggagagaaagggtggcaagagagaagtaaaagttggttttatttta

SEQ ID NO: 203730 - DNA, 4569 bp, Homo sapiens
  Payload ID: 20181
  Gene Name: zinc finger protein 765
  Uniprot ID: Q7L2R6
  ENST ID: ENST00000396408
  CDS Start-End: 118-1689
gacccggaagcggacggcgtggagtgactatcccaccgccgcgggattgacttctaaagactcttggtatgtgaggaagaaacctggaagaggaagaggaaagcaaaggagtcagggatggctcttcctcagggtctattgacattcagggatgtggccatagaattctctcaggaggagtggaaatgcctggaccctgctcagaggactctatacagggacgtgatgctggagaattataggaacctggtctccctggatatctcttccaaatgcatgatgaaggagttctcgtcaacagcacaaggcaatagagaagtgttccatgcagggacatctcaaagacatgaaagtcatcacaatggagatttttgtttccaggatattgataaagatattcatgacattgagtttcagtggcaagaagatgaaagaaatggccatgaagcactcatgacaaaaatcaaaaagttgacaggtagtacagagcgatatgatcaaaattatgctggaaacaagcctgttaaatatcagcttggattcagctttcattcgcatctgcctgaactgcacatatttcacactgaagagaaaattgataatcaagttgtgaagtctatccacgatgcttccttggtttcaacagcccaaagaatttcttgtaggcctgaaacccatatttctaatgactatgggaataatttcctgaattcttcattattcacacaaaaacaggaagtacatatgagggaaaaatctttccaatgcaatgacagtggcaaagcctataattgtagctcactcttaaggaaacatcagttaatccatttaggagagaaacaatataaatgcgatatatgtggcaaggtctttaattcgaagcgatacgttgcacgccatcgtagatgtcacactggtgagaaaccttacaagtgtaatgagtgtggcaagaccttcagtcagacatattacctaacatgccatcgtagacttcatactggagagaaaccttacaaatgtgaagaatgtgacaaagctttccatttcaaatcaaagcttcaaatacataggagaattcatactggagagaaaccgtacaagtgtaatgagtgtggcaagacctttagtcagaagtcgtaccttacatgccatcgtaggcttcatactggagagaaaccttacaagtgtaatgagtgtggcaagacctttagtcggaagtcacattttacatgccatcatagagttcatactggagagaaaccttacaagtgtaatgagtgtagcaagacctttagtcacaagtcatctcttacataccatcgtagacttcatactgaagagaaaccttacaagtgtaatgagtgtggcaagaccttcaatcagcagttaacccttaacatttgtagacttcatagtggagagaaaccttacaaatgtgaagaatgtgacaaagcctacagtttcaaatcaaaccttgaaatacatcagaaaattcatactgaagagaatccttacaagtgtaatgagtgtggcaagaccttcagccggacgtcatcccttacataccatcatagacttcatactggacagaaaccttacaaatgtgaagattgtgatgaagctttcagtttcaaatcaaaccttgaaagacataggagaatttatactggagagaaactacacgtgtaatgagtgtggtaagaccttcaatcaggagttaacccttacatgccatcgtaggcttcatagtggagagaaaccttacaaatatgaagaacttgacaaagcttacaatttcaaatcaaaccttgaaatacatcagaaaattcgtactgaagagaatcttacaagtgtaatgagtgtggcaagaccttgagtcatacgtcatcttttgtgtaccatcataaacttcatagtggagagaccttacaaatgtgaagaatgtgaagaagctttctgtttcaaatccaaccttgaaagacataggagaattcacactggtgagaaaccttacaggtgtaatgagtgtggcaagaccttcagccagacctcatcccttacatgccattgtagacttcgtactggagagaaaccttacaaatgtgaagaatttgagttttccatttcaaatcaaaccttgaaagacaaaggagaattcatactggagagaaaccatacaagtgtaatgagtgtggcaagacctttagtcagaactcataccttacacgccatcgtagacttcatactggaggataccttacaaatgtaatgagtgtggcaagacctttagtcagaactcataccttacatgccatcatagacttcatactggagagataccttaaaagtgtagtgagtgtggcaagacctttagtctgaagtcataccttacgcaccatcgtagacttcatactggagaggtaccttacaaggataatgagtgtagaaaaacctttcatgggcagtcagcattttacaaatgtaatgattgtcaccaagtcttgagtaatgctacaactattgcaaatcattggagaatccataatgaagagagatcctacaagtgtgataaatgcagaataaatgcagaaaatttttcagacatccttcatacctttgcagttcatgggtgaagtcgtattagaaaccttacaaatgtgaagaatgtgatgaagctttcagattcaaatcaaaccttgatagtcatagaattcatactagagagaaaccttagcagtgtaatgaacgtggcaaggttttaaatcaaaaagcaaagcttgcacatcatcatagaattcatactggagataaacgttacaaatgtgaagcatgtgacaaagtttacagtcgcaaatcaagcctccaaagacaggagaattcatactggagagaaagcttacatatgtgaagaatgtcaccaagttttcagtcacactcaaaccttgaaagacacaggagaattcctactggagagatagcataaaaatgtaagagtttgtgacaaggctttcaggcataattcgcacctggcacaacatcctagaattcacattggagagaaagcttacaagtataatgaatgtgacaggtctttagtgggcagtcaacacttgtttaccatcaggcaatccatggtgtagggaaactttacttatgtaatgattgtcacaaagtcttcagttacactacaaccattgcgaatcattggagaatccataatgaagagagatcatactagtttaataaatttggcaaatttttcagacattgttcataacttgcagttcatcggcgaactcgtactggagagaaaccttacaaatgtcatgattgtgacaaggtctcagtcaagcttcattctatgcaaaacataggagaattcatacaggagagaaacctcacaagtgtgatgattgcggcaaagcctttaattcacattcacacctcactagacatcagagaatgcatactggacagaaatcttataaatgtcatcagtgtgccaaagtcttcagtctgagctcactccttgcaggatatcagaaaattcattttggagatagttgttccaaatacaatgtgtatagcaaaccatcaagcattaattgacactagagtcagttcagcattgacttgagtttgacttaacattgagttgaagccttaattgacattaaagtgtttatgttaagaggactgggccaggcacagtggctcacacctgtaatctgagcgctttgggaggccagcaccggtagatcacttgagttcaggagtttgaggtcagcctggccaacagacgtgagccattttcccagcctgttttttgtttctttaacaaaaactgatagggatttttttttttttttttgagatggagtttcactcttgttgcccaggctggactgcaatggagcgatcccagctcactacaacctccgcctcccaggttcaagcaattctcctgcctcagcctccagagtagctaggattacaggcatgagccaccacgcccagctaattttgtatttttagtagagatggggtttctccatgttggttaggctggtcttgaactcccagcctcagatgatccacccacctcggcctcccaaagtgctgggattacaggcgtgagccactgcgcccagccccagtgataaggatttttatgggtaccgtgttgaatctaaatcacattgggttatataatcatttaacaatattaatttttccaaaccataagtatgggttgtagctctatgtttctaatcattttgatcaatgtttgtagatttcaaggtaaaaacctctgacctttttacgtttatttctaagtatttcttactttaagttctccagccaatggaagtgttttaaaattttcttttaaagttgtttgttgttaaaagtatggaaattcaactaatttttggtgctgatactgtattgtgcaaatccactgaatatgttacttagttccagtagtattttggttgactctttgtgattttctgcacagaagatcatgtcgtctacaaacaaatataattttacttctttctttct

SEQ ID NO: 203731 - DNA, 522 bp, Homo sapiens
  Payload ID: 20181
  Gene Name: zinc finger protein 765
  ENST ID: ENST00000505866
  CDS Start-End: 139-522
ggacggcgtggagtgactatcccaccgccgcgggattgacttctaaagactcttggtatgtgaggaagaaacctggaagaggaagaggaaagcaaaggagtcagggatggctcttcctcagatatctcttccaaatgcatgatgaaggagttctcgtcaacagcacaaggcaatagagaagtgttccatgcagggacatctcaaagacatgaaagtcatcacaatggagatttttgtttccaggatattgataaagatattcatgacattgagtttcagtggcaagaagatgaaagaaatggccatgaagcactcatgacaaaaatcaaaaagttgacaggtagtacagagcgatatgatcaaaattatgctggaaacaagcctgttaaatatcagcttggattcagctttcattcgcatctgcctgaactgcacatatttcacactgaagagaaaattgataatcaagttgtgaagtctatccacgatgcttccttggtttcaacagcccaaagaatttct

SEQ ID NO: 203732 - DNA, 2059 bp, Homo sapiens
  Payload ID: 20181
  Gene Name: zinc finger protein 765
  Uniprot ID: Q7L2R6
  ENST ID: ENST00000504235
  CDS Start-End: 124-306
cgcgcagacccggaagcggacggcgtggagtgactatcccaccgccgcgggattgacttctaaagactcttggtatgtgaggaagaaacctggaagaggaagaggaaagcaaaggagtcagggatggctcttcctcagggtctattgacattcagggatgtggccatagaattctctcaggaggagtggaaatgcctggaccctgctcagaggactctatacagggacgtgatgctggagaattataggaacctggtctccctggagttgtcaggggagtgtccattggcagcacctgcctcctgagtgtctcccaggccatcaccatcagccccaggagctcaggtgggcagagcttaaagggaacgcccccaagcacgctggctcctgtgtgttcctcagctggctcctccctggtcaatatcattgttctcatgcacgtgaccggcaagtggagcaacaaaaataccacgaagacaaaagatctgggatactgttctgctgctgatcacgagggcaccagagagtcgctgacgcggcactgctgtccttccctgatgtgatctgcctggggctcatgctctggggcagcagctccatcgtttgcatcctgcacaggcacaagcggcgggtccagcacattcataggaccagcgtgtcccccacatcctcccctgagtccggagctaccaaaaccatcctcctggagcaggaaaggacaaggagtccccgaagctgacactgagttcatggggttgagctgacagcggccaacaggctgtgatgggatctcactctgtcggccaggctggaatgcaatggtgccaacttggctcagtgcaacctccccaccccgggctccaacaatcctcccatctcagcctctgaagtagctgggactacaggcgttatctcctgtccggggaagaggtgggcctctctccgtcgtgggaggagctctgaacttctccttcatccagggatgggccccagggacccaccagtggggctgggagaagcccccctcagcaggaagacagaggtgcctgggtggccgaggcctggaaggtctgcaccatggtgcacagaggccccggagctgggtgaggccagaaagctgctctggggtcagcggggaatgtgcctgctgaatctgtacctgagctacgtcttcacaaatggcctcagacctagagtgcagggagatcccctggcttttctgaagtggtggcaggtggtctcctgggtagcaggatctgggctgcttacttcccttacccagtgagggcccgcggggagctcttaagttgggcatcatggggctgcgtgatgtggctgctgtgcccacatcagagggtttttgtttcttttccaaagtcaagctgcactaatctagaccagggatccccacccctgggctgcagaccggtccccatgggtggcctgttaggaactggaccgcacagcaggaggtgagcagtgggtgagtgcgcgtgaccacctgagctctgccttctgtgagatcagcagcgccactgcatctcagaggaatgccaaccctactgtgaactgtgcatgcgagggatctgggttgcatgctctttatgagatcaaactaatgcctgatgatctcaggtggaacagtttaatcctgaaaccatccccccatctgtggaaaaactgccttccactaaaccagtccctggtgccaaaaacactgggaaccgctaatctagacagttctctgctaaggaagcacgtggttgagaagcatcagaatcgttcccacggaccatgctccggagtctcagcaggctcctgcagtgtgtttatccgtgcatcatgaaggaccctcatacggctgacgtgccttggctgatgcgaataacactgcagcaagcgtggcagtgcagatagctcttggaaatacccatttccttcagacgcatactcagaggtaggattgctggattgtttggtcattttgatttttaaaattaaaaagaattttaattctcatattgttttgagtaaaattaaattataacttgtaaggcaa

SEQ ID NO: 203733 - DNA, 884 bp, Homo sapiens
  Payload ID: 20181
  Gene Name: zinc finger protein 765
  ENST ID: ENST00000507045
  CDS Start-End: 113-370
ggaagcggacggcgtggagtgactatcccaccgccgcgggattgacttctaaagactcttggtatgtgaggaagaaacctggaagaggaagaggaaagcaaaggagtcagggatggctcttcctcagagttgtcaggggagtgtccattggcagcacctgcctcctgagtgtctcccaggccatcaccatcagccccaggagctcaggtgggcagagcttaaagggaacgcccccaagcacgctggctcctgtgtgttcctcagctggctcctccctggtcaatatcattgttctcatgcacgtgaccggcaagtggagcaacaaaaataccacgaagacaaaagatctgggatactgttctgctgctgatcacgagggcaccagagagtcgctgacgcggcactgctgtccttccctgatgtgatctgcctggggctcatgctctggggcagcagctccatcgtttgcatcctgcacaggcacaagcggcgggtccagcacattcataggaccagcgtgtcccccacatcctcccctgagtccggagctaccaaaaccatcctcctggagcaggaaaggacaaggagtccccgaagctgacactgagttcatggggttgagctgacagcggccaacaggctgtgatgggatctcactctgtcggccaggctggaatgcaatggtgccaacttggctcagtgcaacctccccaccccgggctccaacaatcctcccatctcagcctctgaagtagctgggactacaggtgtgcctcatcaccatgggctatttttatttttgtattttgtagaggcaaggtcttgccatgtttctcaggctggtctcaaactcctgggctcaagtgatctgcccacttgggcct

SEQ ID NO: 203734 - DNA, 7588 bp, Homo sapiens
  Payload ID: 20181
  Gene Name: zinc finger protein 765
  Uniprot ID: Q7L2R6
  ENST ID: ENST00000594030
  CDS Start-End: 95-277
gtgactatcccaccgccgcgggattgacttctaaagactcttggtatgtgaggaagaaacctggaagaggaagaggaaagcaaaggagtcagggatggctcttcctcagggtctattgacattcagggatgtggccatagaattctctcaggaggagtggaaatgcctggaccctgctcagaggactctatacagggacgtgatgctggagaattataggaacctggtctccctggagttgtcaggggagtgtccattggcagcacctgcctcctgagtgtctcccaggccatcaccatcagccccaggagctcaggtgggcagagcttaaagggaacgcccccaagcacgctggctcctgtgtgttcctcagctggctcctccctggtcaatatcattgttctcatgcacgtgaccggcaagtggagcaacaaaaataccacgaagacaaaagatctgggatactgttctgctgctgatcacgagggcaccagagagtcgctgacgcggcactgctgtccttccctgatgtgatctgcctggggctcatgctctggggcagcagctccatcgtttgcatcctgcacaggcacaagcggcgggtccagcacattcataggaccagcgtgtcccccacatcctcccctgagtccggagctaccaaaaccatcctcctggtgagcacgtttgtgtccttttacactctctcttcacctttcaagtttgtttggctcttttgaataatcccagtcagctggtggtgaacatctctgcaatgatcagtgcaggtttcccaactgtcagccgctttcttctcatgagtggagactcctgtgtatccaagctttgctttgcttagataagtaacacaaaaccccctaatcttatcagaaatatgtgaattggacatgtttgtacaatgtttatgtttcttcattgatctctagagacccataaacacggttatgaaacgaggcttgttagtgctgtgcttgccagcaggggccactgttttattctgtacctcctgatcccccctccaaccacaccgccctggagcagctctgtggaaaaagtggaatcagcttagaggttttggagaggaagatactgaaacgtaaacgatataagaaagtcacggtgcacaaatatacatacctcatttctgtgtcccttggagcagatgggggaatgtgcgcagatgcgaagctcttgctgtaatttatgtgacaaataataaaatatatgttttgtcggatccagaaatctcatgccttcagccaacatccataaactgacagtctaacttgttggcttgtaagtaaggtaaaaatctaaaactggccaggcgcggtggctcacgcctgtaatcccagcactttggagggccgaagcagacggattaactgaggtcgagaatttgagaccagcctgacaaacatggagaaacctcatctctactaaaaaaaaaaaaaaaagaaaagaaaaaagaaaaaacattagccaggcatggtggcacttgcctgtaatccgagctacttgggaggctgaggcagcagaatcacttgaatccaggaggcggtggttgcggtgaaccgagatcgcgccacagcactccattctgtgtgacaagagtgatactctgtctcaaaaaaaaatctaaaacattttgcaatttctgatagttttggtgatgctgagacagatatgactttgtgtaagaggaaggtagaaagattcttcactggcgtggttagtaggcagaaaatggctctctggaacaagcagcgaattctcacccaaactgaggtgaaatgacagtaagacttctccattcttttttttttttttttttgagacggagtttcattcttgttgcctaggctggagtgcaatggtacgatctcggctcactgcaacctctgcctcccaggttcaagtgattctcctgcctcagcctcccaaatagctgggattacaggcatgcgccaccaagcctggctaattttgtattttttagtagagacggggtttcaccatgttgttcaggctggtctcaaactcttgacctcaggtgatccgcccacctcagcctcccaaagtgctgggataacaggcttgagccacagtgcccgaccaagattcctccattctataacccttgaatgggactgttgtgtgagagggaggattgaaatgaactgtccgaatgtgatttatctgttgctcattctcttcctggcaggagcaggaaaggacaaggagtccccgaagctgacactgagttcatggggttgagctgacagcggccaacaggctgtggtaaacgctaatgaaacgagccttgttagtgctgtgcttgccagcaggggtcactgtttccttctgtacctcctgatccctccctccacccacaccgcactgcagcagctctggggaaaaagtggaatcagcttagaagtttttgggaggaagacactgaaagtcctacttttttttttcagatgggatctcactctgtcggccaggctggaatgcaatggtgccaacttggctcagtgcaacctccccaccccgggctccaacaatcctcccatctcagcctctgaagtagctgggactacaggtgtgcctcatcaccatgggctatttttatttttgtattttgtagaggcaaggtcttgccatgtttctcaggctggtctcaaactcctgggctcaagtgatctgcccacttgggcctcccaaagtgctgggattacagacgtgagccaccgtacctggcctaaaactcttttactcctgttgcatgcaaggatttaagtcaccaacgtacgtggattccagcaagaagggtcagtagacgcaggggtgggtaaaggtgctaaggatggtggggtgaagtgtggctgcaaacaggcagaaagagacaagcttctgaccctgaatagtcaccaaatgctggatggtgcaatgctaagaatgcagcacaggccgggcgtggtggctcacacctgtaatcccagcgctttggaaagccaaggtgggtggatcatgaggtcaagagatcgaaaccatcctggccaacatggtgaaaccccgtctctactaaaaatacaaaaattagctgggcgtggtggcatctctttgtctgtgtctttatttattacaatctctcatctccgcatacaggcgttatctcctgtccggggaagaggtgggcctctctccgtcgtgggaggagctctgaacttctccttcatccagggatgggccccagggacccaccagtggggctgggagaagcccccctcagcaggaagacagaggtgcctgggtggccgaggcctggaaggtctgcaccatggtgcacagaggccccggagctgggtgaggccagaaagctgctctggggtcagcggggaatgtgcctgctgaatctgtacctgagctacgtcttcacaaatggcctcagacctagagtgcagggagatcccctggcttttctgaagtggtggcaggtggtctcctgggtagcaggatctgggctgcttacttcccttacccagtgagggcccgcggggagctcttaagttgggcatcatggggctgcgtgatgtggctgctgtgcccacatcagagggtttttgtttcttttccaaagtcaagctgcactaatctagaccagggatccccacccctgggctgcagaccggtccccatgggtggcctgttaggaactggaccgcacagcaggaggtgagcagtgggtgagtgcgcgtgaccacctgagctctgccttctgtgagatcagcagcgccactgcatctcagaggaatgccaaccctactgtgaactgtgcatgcgagggatctgggttgcatgctctttatgagatcaaactaatgcctgatgatctcaggtggaacagtttaatcctgaaaccatccccccatctgtggaaaaactgccttccactaaaccagtccctggtgccaaaaacactgggaaccgctaatctagacagttctctgctaaggaagcacgtggttgagaagcatcagaatcgttcccacggaccatgctccggagtctcagcaggctcctgcaggtgagccccactggcctctcctcttccttccggacctcctcagctttggtaatggaaagctgcatcctcttctgtccccagttcctctctgggtgtcaggatctctaaaaccctctcagccgctgagaagtctgtctgtctgtctcacagtgtgtttatccgtgcatcatgaaggaccctcatacggctgacgtgccttggctgatgcgaataacactgcagcaagcgtggcagtgcagatagctcttggaaatacccatttccttcagacgcatactcagaggtaggattgctggattgtttggtcattttgatttttaaaattaaaaagaattttaattctcatattgttttgagtaaaattaaattataacttgtaaggcaactccatgttttttagaatttttaagaaaaataattgctctaccaattgactgtcccaacaacaacgtacaggggtattttttttcctccgcatcctcaccacttgttaccttttgtctttttaataatagcaatcctaagacatgtgaagtgatacctcactgtgattttgattggcattttccagatgattagtctattcaggccctttacttttttttgttgttgttgttgtttttgagatggattctcactctgttgcccaggctggagtgcgatggcacgatctcggctcactgcaacctccgccttccggggaggcgtgattagccaccacgcccggctaacttttgtattttagtagagatgaggtttcaccatcttggccaggctggtctcgaccccctgatctcaggtgatccactttgcccagcctcccaaattgttgggattacaggtgtgagccaccacgcccagcccctttgctcttttttaatagggttattactattaccatatttgcttttgagttgtgagtgttccttatatattttggatataaactccttatcacaggtatggtatatatggtttgaaatattttctcccattatcatgccccaatatcactaagttacatttcactgctccctcttgaacacctgaaaaaatttcctatttccatgtgtctgtatccaggttattgtcacttttacctgaagacacatttatatatgctgatattccccaataactaatatatttttactcttttttttttttttgagatggagtcctgctctgtcacccaggctggagtgcagtggcatgatctcagctcactgcaacctctgcctcccaggttcaagtgattctccttcctcagcctcccaggttgctgggattacaggcacatgccaccaccactagctaatttttttgtatttttattagagatgcggtttcaccacatgggtcaggctggtcttgaactccggacgtcatatgatccacccgcccttggtctcccaaggtgctgggattataggcatgagccgctgcacccggccctaactaatatattttaaataactttttgctcttggcacatggactaaaaccacatcaccaggccttcaatgacgtccaatgtctgccatcttatttccactccagctccgccccaggcatagttgcctttctttttattgaagccttctccttgccaagttaattaaagagaatgttttcttcatcaaattagaaattacatcctcagagctttccagtatttgtagttcttacaggccacatttattacaagtttatagactccaaacttctccactgaacagttaataaaaaggacacaggcttattgtaaaataattcatttagtgcctgccattctgattacactagaaatttagttctcctgctcagcgttctgttatgtgactgttcaatgcattacttaaaactgcaagattgaatagagagatcagcttctgacactgatgaatgcaaaccacaagaaaccaagtctcctctgcaaaatgatgaaaacactcgcaaagtcactaaaatcaatcatttcagacttctgaaatttaccaaagccacagaacaaagtgaaaagtatctatcccacagaaagtaccaaacttcagtaagacagcagcatttgtgtcattttaatgtggaggcattaccattaccctccatccttcgttcagtgtagagcactgacctcttttgaagctccttttaaacacctcctatcaggccagtcgcggtggctcaagcctgtaatcccagcactttggacgacagagcgagactccatctgaaaaaaagaaagaaaaaaaaaagagaaagtgacttttcaagactgtgatttatggtctcccctgggaaccaacagtatctgtgctgagagcagatatttgggtggaaggggctctggtgtgcagggcatgccttctgtagctcagtgcttctgacaatgggtccgaggggagaaacattggcattaacagggaacttgttaaagatgccaatttataaatgctacctcaaacctgcagaatcaaacattattacagtgggttgtggagtgccagatgacttatattcaccttaaagcttgagagtcagtgcttagctaagaggctctcagcccaggcttccagttggatcaaatggtcatattcagttactaccatcacctgtgccctccccatagcgtctgtctattggtgtcgggggaaacatccatgctgtttcaattaactaccctgcccccaggtgattctagggtgaggagaagtccagcatgagggcttccatatgcatttgtgaaggttgatggcagactgttccaaatgagaataatggtttccgtgatatgataaaagcaatgctattgaatatgatgatgactgatgagaagttttgcatagcattcgctgtaaaaaagccacttataggctgggcacggtggctcacgcctgtaattccagcattttcggaggctgaggtgagcagatcaccggaggtcaagagttcaagaccagcctggctaacatggtgaaaccctgtctcaactaaaaatgcaaacattagccagatgtggtggtggatgcctgtaatcccagctacttgggaggctgaggcaggagaactgcttgaatctgagaggtgtaggttgcagtgagctgacatcatgcctctgcactccagcctgggtgagagagcaagactacgtccaaaaaaaaaaaaaaagagagagagaattttcctgtaaataattaaaaagactaagcagccccagagataagacctcctgggatcattgtccctttatattgagtgataaagtaaccttccttgaagtatatcaatccataaccaatcaccttgctgcaccctatgtactggtcttgaatggaaaatgtggtgattcttctaaagcttctctgtctttccgtgtgtgtgaaacctaagggaacgctgatcccattcatttggagttgatgtttccaggtggctatcctcatgctttgtgttcaaataaactctgtgcttaatcat

SEQ ID NO: 203735 - DNA, 6298 bp, Homo sapiens
  Payload ID: 20182
  Gene Name: zinc finger protein 766
  Uniprot ID: Q5HY98
  ENST ID: ENST00000439461
  CDS Start-End: 44-1450
gcgcgcagccgcctgcagacccggaagtggatggcgtggagatatggcgcaactgcggcgcggacacttgacattcagggacgtggccatagaattctctcaggaggagtggaaatgcctggaccctgtgcagaaggctttatacagggatgtgatgttggagaactacaggaacctggtctccctgggaatctgtcttcctgacctgagtattatctccatgatgaagcaaaggacagagccctggactgtggagaatgaaatgaaagtagcaaaaaatccagataggtgggaaggtatcaaagatatcaacacagggaggagctgtgcagtgagaagcaaagcaggaaacaagcctattacaaatcaacttggattaacctttcagttacctctgccagaactggagatatttcaaggtgaagggaagatttatgaatgtaatcaagttcaaaagttcatcagccacagttcttcagtttcgccacttcaaagaatttactctggggtcaaaacccacatatttaataaacataggaatgattttgttgattttccattgctgtcacaagaacagaaagcacacattaggagaaaaccttacgaatgtaatgagcagggcaaagtcttcagagtgtcttcaagccttcctaatcatcaagtaatccacactgcagataaacctaacagatgtcatgaatgtggtaaaaccgtcagggacaagtcaggcctcgcagaacattggagaattcgtacaggagagaaaccttacaaatgtaaagagtgtggcaagctcttcaatcgaattgcataccttgcacgacacgagaaagtgcatactggagagagtccttacaaatgtaatgagtgtggcaaggtcttcagtcgaattacataccttgtacgacatcagaaaattcatactagagagaaacctcataaatgtaacaaatgtggcaaggtttatagtagcagttcatacctagcacaacattggagaattcatacaggagagaaactttacaaatgtaataaatgtggcaaagaatttagtgggcattcaagcctcaccacccatctgttaatccacactggagagaaaccttacaaatgtaaagaatgtgacaaagcttttaggcacaagttctccctgacagttcatcagagaaatcataatggagagaaaccttataaatgtcatgaatgtggcaaagtcttcactcaagtttcacatcttgcacgacatcagaaaattcacactggagagaaaccttacaaatgtaatgagtgtggcaaagtcttcactcagaattcacaccttgcaaatcatcagagaatccacactggagagaaaccttacaaatgccatgtgtgtggtaaggtctttaggcacagttcatggtttgtacagcatcagagaagtgttcatgagagagtccttacaaactgagtttggcaaactctatcataagttctagcagtaatcaacatccgagagtctatactagaaagaaatcatttaaatgtactatatgtggcacaggctgtatcgagacctaccaaatcactagacatcgaaacattcatctttggtgaaaccacacaaatggattgtgtgtgccaaggccaacaagtcaaaatatgttgaacctaatgatatgatgtgtataaagggtgcaaggacacgtggaaatgatctgtaatattcgggttattaaaaatgtaattggctgggcgcagtggctcacacctgtaatcctagcactttgggaggttgaggcaggtggatcacaaggtcaggagtttgagaccagcctggccaatatggtgaaacaccatatctactataaatacaaaaaaattagccaggcgtggtggcacatgcctgcaatcccagctactcgggaggctgaggcaggagaattgcttgaatccaggaggcagaggttgttgcagtgagctgagatcgcgccactgcactccaacctgggtgacagagcgagactccgtctcaaaaaaaaaaaaaaattatttgggtttgaaaggccaggggcagtggttcatgcctataatctcagcacaatagaaagccaagacaggagggtcacttgatgcctggagatcaagataagtatgggcaacgtagcaaggcccatccctacaaaataaaaaaaataagccaggcccttggcatgtgtctgtagttccagctactcaagaggccgaggcaagaggattgctcaagcccaggagtttgagagtttgagcagtgagctctgatcttgccatttgtactccagcttgggtgacagagcgagaccctgtctcaaaagaaaaaaaaggctagtttttatgacttcaacctgaactttgaaatttcttcatgtgccttccctacaggcctttcactgtggtctgggaaagaatcagtaagatgacagggctgacttcattagatgaggagcgtttctatccagtttcctggaggaataaggacactgccttttcagattaaagattgtctgatttagagaccatggaggtggacagagaataacaaaaccgtgatggcagtcatcatgcttattgcagttagcacacacttttcctgacaggcacagtgctgctgtgctctacaaatgaccatgaaatagagcacgccatgactttaggacacagggatttttatgggaagagagttcatcagggactgattacgtaggagagacgatgcaggggaaatggtggccaccgtctccattgaatagcaatagctgctgtttagcaaagactgattaaaaagtactctgatttttcaaatggaagagagaacagttaaatcagagtagagagtttaatcaaaactaccagtggaacatgttcttgagtaggattcacatttaactgctggcataatttgcaactgttggattttctcatgtttggaacaataaagttgaaattttccaaagtgtgaatgatttaccttctttctaccaatattgttttatctcgtctcaggaggatactttatagcagacaataataaggcaccattaggatttttaaattaatttatttttaaaattaaagttctagtgtacatgtccacaacatgcaggtttgttacataggtatacatgtgccatattcgtttgctgcacccatcaacttgtcatttacgttagatatttctcctaatgttatccctctgccagccccccaccccccgacaggccccggtgtgtgatgttacccgccttgtgtccaggtgttctcattgatcaattcccacctatgagtgagaacatggggtgtttggtcttctgtcactgtgatagtttgctgagaatgatggtttccagcttcatcaatgtccctgcaaaggacatgaactcatcctttttatggctgcatagtattccttttttttttttttttttgagatgaagttttgctctgtcactcaggctgaagtgcaatggcacgatcttggctcactgcatcctctgcctcccgggttcaagtgattctcctgtctacacctcccaagtagctggattacaggcatgcaccaccatacccggctaatttttttgtatttttagtagagatggggtttcaccatgttggccaggccggtctcgaagtcctgacctcgggtgatccagccacctcgggttcccgaagtgctaagattacaggcatgagccacggcgcctggccaggatttttaaggttgaagcatccacaacaattttgtgtgtgaaatgaaatgacatgcacttttgggtatatacacttgggtaagtatgattttgggtaataatacttagtacttaagttattctctctactctttgtttttgttttttgtttgttttgttttgttttgagatggagtttcgctcttgtttcccaggctggagtgcaatggtgtgatctcggctcaccgcaacctccgccttccaggttcaagtgattctcctgcctcagcctcccgagtagctgggattacatgcatgtgccaccatgcccagctaattttgtttttttagtagagacagggtttctccatattggtgaggctggtctcgaactcctgacctcaggtgatctgcccacctcggcctcccaaagtgctgggattataggcatgagccaccacacttggcctacctctctactctgccctaagatgcttttgtgggtaaagtgaaaatcacataacagtgcagcttcatcatcatatgccctcaatgttcatcactgttgataaacatgcactgtattatgtttctgtgtgcctttttcttgtgtgccaagtaagacccatggcaggcaccttcattttcaggaagcgaaaatacagatacagtaatatggaaaataggacaaagtgtggacttcaggatgaaaatattgtaacaatcttgctgttgacctcgtagcgctcagtgacataatttgaaaaaatattaatgttcagaaatgttctcttgaggatgaacacacagattgggaatttcgttttgctttggtagattaactagaaacttcacattttcacccttataacctttttggtaatttgaacttttgatcattcttctggaactgctttgacatccacctgaagtttggtttgggtattgagaatgatgatgccattcactaatgtgatctcaaaatgtttactccataatgaggctttctggggagagcagggtagacttccccggttggtccaaatatgactagggaatcggcataggtgactggcttggggtatgatgattgttaagggatagggcttgggcaggggtgcccacttgtggtttgaactttcagctggtgccaaaggagtgggcactgaggatttttcagttgaccagatgggcagaataggaagagggagtgcagaggtgtaaaaggcgttggtgttcagacatcacaaaatgcagtcaactctaggacaactctagcttcctctggaagctcctgccatcttggttaggaaagactctgattttcttcatgataatatcttacgttccttttatagttacagatacaggtctcattgcacaatatgattgttgaaaacacttgtgaaatttttttagtaaaattgcctaagatactttttatagtagacaatgaaaattagtgtgtgggtttataataaatataatgtattatataatatgattaaaatatatttgttataaatatgatattactagaagagcatttttccaaaagctatggaaatgtcattttcccgttacagcatcaagcaatatattccatggttcattttcaactctaataaaattatattttgtgtttatatatgcacgtatagacacatatataatattttttttttacttttttctttttctgtacattgcatccagatgctatgcttgtttgtttttttttttgagacagagtcttgctctgtcacccaggctggagtgcagcggtgtgatcttggctcattgcagcctccgcctcccaggctcaagtgattctcctgcctcggcctcccgaatagctgggattacagacatgcaccatcaccacacctggctaatttttgtatttgtaatagagatggggtttcaccatgttggccaggcatggtcttgaactcctgacttcaggtgatccacccgcttcggcctcccaaagtgttgggattacaggcatgagccaccatgcccggccagatgctatgcttaatacattttttccgaatgtcactctagtgaaaattttaggggacacaaaaatgagactgttgtttggagacaatattttttgacaagagtatgcacaagacaatggcaggtataaacgttttattgtaaatatgaaaaaggaaaaaatgctttcactatattagaggacttgaagtaacgtgaagtgattccaaccctttatctttattttatttatttattttattatttatttttttgagatggagtttcactcttgttgcctaagctggagtgcaatggagtgatctcagctcactgcaaccttcacctcccgggagcatgctgctctatcttttttttcagatgtttgagctattccaggttttttgggatttctgttggtttgttttgttttttgcttttctacataattgtttggataatcttgtcagtatctacgaagtgccttgatagtaaatatattaaccctgtgtatcaatttggggtaatttcacatttttttctatgttgagtttatcaataaattgatattgtatatgtctcta

SEQ ID NO: 203736 - DNA, 2331 bp, Homo sapiens
  Payload ID: 20182
  Gene Name: zinc finger protein 766
  ENST ID: ENST00000593612
  CDS Start-End: 378-1793
aaacagctttaacctggatgtggaggaggatgacattgagaatctcttagaggattgacttctaaagagtcatgttggccgggcgcgggggctcatacctgtaatcccggcactttgggaggccgagacgggcagatcacgaggtcaggagatcaagaccatcctggctaacacggtgaaaccccgtctctactacgaatacaaaaaattacctgggcgtgttggcgggcacctgtagtcccagctactcaggaggctgaggcaggagaatggtgtgaacccgggaggcggagcttgcagtgagctgagatcgggccacggcactccagcctgggtgacagagtgagactccgtctcaaaaaaaaacaaaaaaagtcatgttatgtgaaggagaagcccagaagaggaaagcagaggagtcaggcatgccacttactcagggacacttgacattcagggacgtggccatagaattctctcaggaggagtggaaatgcctggaccctgtgcagaaggctttatacagggatgtgatgttggagaactacaggaacctggtctccctgggaatctgtcttcctgacctgagtattatctccatgatgaagcaaaggacagagccctggactgtggagaatgaaatgaaagtagcaaaaaatccagataggtgggaaggtatcaaagatatcaacacagggaggagctgtgcagtgagaagcaaagcaggaaacaagcctattacaaatcaacttggattaacctttcagttacctctgccagaactggagatatttcaaggtgaagggaagatttatgaatgtaatcaagttcaaaagttcatcagccacagttcttcagtttcgccacttcaaagaatttactctggggtcaaaacccacatatttaataaacataggaatgattttgttgattttccattgctgtcacaagaacagaaagcacacattaggagaaaaccttacgaatgtaatgagcagggcaaagtcttcagagtgtcttcaagccttcctaatcatcaagtaatccacactgcagataaacctaacagatgtcatgaatgtggtaaaaccgtcagggacaagtcaggcctcgcagaacattggagaattcgtacaggagagaaaccttacaaatgtaaagagtgtggcaagctcttcaatcgaattgcataccttgcacgacacgagaaagtgcatactggagagagtccttacaaatgtaatgagtgtggcaaggtcttcagtcgaattacataccttgtacgacatcagaaaattcatactagagagaaacctcataaatgtaacaaatgtggcaaggtttatagtagcagttcatacctagcacaacattggagaattcatacaggagagaaactttacaaatgtaataaatgtggcaaagaatttagtgggcattcaagcctcaccacccatctgttaatccacactggagagaaaccttacaaatgtaaagaatgtgacaaagcttttaggcacaagttctccctgacagttcatcagagaaatcataatggagagaaaccttataaatgtcatgaatgtggcaaagtcttcactcaagtttcacatcttgcacgacatcagaaaattcacactggagagaaaccttacaaatgtaatgagtgtggcaaagtcttcactcagaattcacaccttgcaaatcatcagagaatccacactggagagaaaccttacaaatgccatgtgtgtggcctttcactgtggtctgggaaagaatcagtaagatgacagggctgacttcattagatgaggagcgtttctatccagtttcctggaggaataaggacactgccttttcagattaaagattgtctgatttagagaccatggaggtggacagagaataacaaaaccgtgatggcagtcatcatgcttattgcagttagcacacacttttcctgacaggcacagtgctgctgtgctctacaaatgaccatgaaatagagcacgccatgactttaggacacagggatttttatgggaagagagttcatcagggactgattacgtaggagagacgatgcaggggaaatggtggccaccgtctccattgaatagcaatagctgctgtttagcaaagactgattaaaaagtactctgatttttcaaatggaagagagaacagttaaatcagagtagagagtttaatcaaaactaccagtggaacatgttcttgagtaggattcacatttaactgctggcataatttgcaactgttggattttctcatgtttggaacaataaagttgaaattttccaaagtgtg

SEQ ID NO: 203737 - DNA, 554 bp, Homo sapiens
  Payload ID: 20182
  Gene Name: zinc finger protein 766
  ENST ID: ENST00000593703
  CDS Start-End: 78-554
agacccggaagtggatggcgtggagatatggcgcaactgcggcgcgaatctgtcttcctgacctgagtattatctccatgatgaagcaaaggacagagccctggactgtggagaatgaaatgaaagtagcaaaaaatccagataggtgggaaggtatcaaagatatcaacacagggaggagctgtgcagtgagaagcaaagcaggaaacaagcctattacaaatcaacttggattaacctttcagttacctctgccagaactggagatatttcaaggtgaagggaagatttatgaatgtaatcaagttcaaaagttcatcagccacagttcttcagtttcgccacttcaaagaatttactctggggtcaaaacccacatatttaataaacataggaatgattttgttgattttccattgctgtcacaagaacagaaagcacacattaggagaaaaccttacgaatgtaatgagcagggcaaagtcttcagagtgtcttcaagccttcctaatcatcaagtaatccacactgcagataaacctaacagatgtcat

SEQ ID NO: 203738 - DNA, 552 bp, Homo sapiens
  Payload ID: 20182
  Gene Name: zinc finger protein 766
  ENST ID: ENST00000595149
  CDS Start-End: 302-552
aaacagctttaacctggatgtggaggaggatgacattgagaatctcttagaggtggttcatgaggaatgggttaatgaggagtcattggaactgatacaggaacatgtagctgaagaagaggcaagagaatagggaactggctgggcacggtggctcacatctataatccctgcactttgggaggccgaggcaggtggatcacttgagggacacttgacattcagggacgtggccatagaattctctcaggaggagtggaaatgcctggaccctgtgcagaaggctttatacagggatgtgatgttggagaactacaggaacctggtctccctgggaatctgtcttcctgacctgagtattatctccatgatgaagcaaaggacagagccctggactgtggagaatgaaatgaaagtagcaaaaaatccagataggtgggaaggtatcaaagatatcaacacagggaggagctgtgcagtgagaagcaaagcaggaaacaagcctattacaaatcaacttggattaacctttcagttacctctgccagaact

SEQ ID NO: 203739 - DNA, 2065 bp, Homo sapiens
  Payload ID: 20182
  Gene Name: zinc finger protein 766
  ENST ID: ENST00000599581
  CDS Start-End: 22-339
ggaagtggatggcgtggagatatggcgcaactgcggcgcggacacttgacattcagggacgtggccatagaattctctcaggaggagtggaaatgcctggaccctgtgcagaaggctttatacagggatgtgatgttggagaactacaggaacctggtctccctgggaatctgtcttcctgacctgagtattatctccatgatgaagcaaaggacagagccctggactgtggagaatgaaatgaaagtagcaaaaaatccagataggtgggaaggtatcaaagatatcaacacagatggagtcctgttctgtcgcccaggctggagtacagtggtgtgatctcggctcactgcaacttccgcctcccagggaggagctgtgcagtgagaagcaaagcaggaaacaagcctattacaaatcaacttggattaacctttcagttacctctgccagaactggagatatttcaaggtgaagggaagatttatgaatgtaatcaagttcaaaagttcatcagccacagttcttcagtttcgccacttcaaagaatttactctggggtcaaaacccacatatttaataaacataggaatgattttgttgattttccattgctgtcacaagaacagaaagcacacattaggagaaaaccttacgaatgtaatgagcagggcaaagtcttcagagtgtcttcaagccttcctaatcatcaagtaatccacactgcagataaacctaacagatgtcatgaatgtggtaaaaccgtcagggacaagtcaggcctcgcagaacattggagaattcgtacaggagagaaaccttacaaatgtaaagagtgtggcaagctcttcaatcgaattgcataccttgcacgacacgagaaagtgcatactggagagagtccttacaaatgtaatgagtgtggcaaggtcttcagtcgaattacataccttgtacgacatcagaaaattcatactagagagaaacctcataaatgtaacaaatgtggcaaggtttatagtagcagttcatacctagcacaacattggagaattcatacaggagagaaactttacaaatgtaataaatgtggcaaagaatttagtgggcattcaagcctcaccacccatctgttaatccacactggagagaaaccttacaaatgtaaagaatgtgacaaagcttttaggcacaagttctccctgacagttcatcagagaaatcataatggagagaaaccttataaatgtcatgaatgtggcaaagtcttcactcaagtttcacatcttgcacgacatcagaaaattcacactggagagaaaccttacaaatgtaatgagtgtggcaaagtcttcactcagaattcacaccttgcaaatcatcagagaatccacactggagagaaaccttacaaatgccatgtgtgtggtaaggtctttaggcacagttcatggtttgtacagcatcagagaagtgttcatgagagagtccttacaaactgagtttggcaaactctatcataagttctagcagtaatcaacatccgagagtctatactagaaagaaatcatttaaatgtactatatgtggcacaggctgtatcgagacctaccaaatcactagacatcgaaacattcatctttggtgaaaccacacaaatggattgtgtgtgccaaggccaacaagtcaaaatatgttgaacctaatgatatgatgtgtataaagggtgcaaggacacgtggaaatgatctgtaatattcgggttattaaaaatgtaattggctgggcgcagtggctcacacctgtaatcctagcactttgggaggttgaggcaggtggatcacaaggtcaggagtttgagaccagcctggccaatatggtgaaacaccatatctactataaatacaaaaaaattagccaggcgtggtggcacatgcctgcaatcccagctactcgggaggctgaggcaggagaattgcttgaatccaggaggcagaggttgttgcagtgagctgagatcgcgccactgcactccaacctgggtgacagagcgagactccgtctc

SEQ ID NO: 203740 - DNA, 559 bp, Homo sapiens
  Payload ID: 20182
  Gene Name: zinc finger protein 766
  ENST ID: ENST00000595000
  CDS Start-End: 215-559
aaacagctttaacctggatgtggaggaggatgacattgagaatctcttagaggtggttcatgaggaatgggttaatgaggagtcattggaactgatacaggaacatgtagctgaagaagagggacacttgacattcagggacgtggccatagaattctctcaggaggagtggaaatgcctggaccctgtgcagaaggctttatacagggatgtgatgttggagaactacaggaacctggtctccctgggaatctgtcttcctgacctgagtattatctccatgatgaagcaaaggacagagccctggactgtggagaatgaaatgaaagtagcaaaaaatccagataggtgggaaggtatcaaagatatcaacacagggaggagctgtgcagtgagaagcaaagcaggaaacaagcctattacaaatcaacttggattaacctttcagttacctctgccagaactggagatatttcaaggtgaagggaagatttatgaatgtaatcaagttcaaaagttcatcagccacagttcttcagtttcgccacttcaaagaatt

SEQ ID NO: 203741 - DNA, 568 bp, Homo sapiens
  Payload ID: 20182
  Gene Name: zinc finger protein 766
  ENST ID: ENST00000600821
  CDS Start-End: 236-538
aaacagctttaacctggatgtggaggaggatgacattgagaatctcttagaggtggttcatgaggaatgggttaatgaggagtcattggaactgatacaggaacatgtagctgaagaagaggcaagagaatagggaactggctgggcacggtggctcacatctataatccctgcactttgggaggccgaggcaggtggatcacttgagcaatttccagtcctccaagctccattcatgggacacttgacattcagggacgtggccatagaattctctcaggaggagtggaaatgcctggaccctgtgcagaaggctttatacagggatgtgatgttggagaactacaggaacctggtctccctgggaatctgtcttcctgacctgagtattatctccatgatgaagcaaaggacagagccctggactgtggagaatgaaatgaaagtagcaaaaaatccagataggtgggaaggtatcaaagatatcaacacagatggagtcctgttctgtcgcccaggctggagtacagtggtgtgatctcggctcactgcaacttccgcctcccag

SEQ ID NO: 203742 - DNA, 588 bp, Homo sapiens
  Payload ID: 20182
  Gene Name: zinc finger protein 766
  ENST ID: ENST00000601711
  CDS Start-End: 365-588
ggaagtggatggcgtggagatatggcgcaactgcggcgcgattgacttctaaagagtcatgttggccgggcgcgggggctcatacctgtaatcccggcactttgggaggccgagacgggcagatcacgaggtcaggagatcaagaccatcctggctaacacggtgaaaccccgtctctactacgaatacaaaaaattacctgggcgtgttggcgggcacctgtagtcccagctactcaggaggctgaggcaggagaatggtgtgaacccgggaggcggagcttgcagtgagctgagatcgggccacggcactccagcctgggtgacagagtgagactccgtctcaaaaaaaaacaaaaaaagtcatgttatgtgaaggagaagcccagaagaggaaagcagaggagtcaggcatgccacttactcagggacacttgacattcagggacgtggccatagaattctctcaggaggagtggaaatgcctggaccctgtgcagaaggctttatacagggatgtgatgttggagaactacaggaacctggtctccctgggaatctgtcttcctgacctgagtattatctccat

SEQ ID NO: 203743 - DNA, 2315 bp, Homo sapiens
  Payload ID: 20183
  Gene Name: zinc finger protein 768
  Uniprot ID: Q9H5H4
  ENST ID: ENST00000380412
  CDS Start-End: 177-1799
cgcgctggagaggcgcggggtcaagacgtccggcctcgggggcccgggctgggccgccgagtcccctgggcggcgctgagcgggcgggaggcgggggcccgcggctcggggcaaccgaggccgggtcgcgggatcggccgccatcgccgccgccgctgcactgggagcccgcggggatggagcgggaggcgttgccgtggggcctcgagccccaggatgtgcagagttctgacgaaatgaggagccccgaagggtacctcagaggcaacatgagtgagaatgaggaagaggaaatttctcagcaagaaggcagtggggactatgaagtcgaagagataccatttgggcttgaaccccagagccctgggtttgagccacaaagcccagagtttgaaccccaaagccccagatttgagcctgaaagcccggggtttgagtcccgaagccctgggcttgtgcccccaagccctgagtttgcacccagaagccctgaatcagattctcagagccctgagtttgaatcccagagccctaggtatgaaccccaaagccctggctatgaacctcggagccccgggtatgaaccccggagccctggctatgaatctgagagctctagatatgaatcccagaacactgagctcaaaacccaaagcccagaatttgaagctcaaagttccaaattccaggaaggtgcggagatgcttctgaaccccgaggaaaagagtcctttgaatatctccgtaggagttcaccccctggactccttcactcaggggtttggggagcagcccacaggggacctgcccatagggccaccttttgagatgcccacaggggccctgctgtctacaccgcagtttgagatgcttcagaatcccctgggtctcacaggagcccttcgaggtccaggtcggcggggtggccgggccaggggtgggcagggccctcggcctaacatctgtggcatctgcgggaagagcttcgggcggggctccaccctgatccagcaccagcgcatccacaccggtgagaagccctacaaatgtgaggtctgcagcaaggccttctcccagagctctgacctcatcaaacaccagcgcacccacactggcgagcggccctacaaatgtccccgttgcggcaaggccttcgccgacagctcttacctgcttcgccaccagcgcactcactctggccagaagccctacaagtgcccacattgtggcaaggccttcggcgacagctcctacctcctgcgacaccagcgcacccacagccacgagcggccctacagctgcaccgagtgcggcaagtgctatagccagaactcgtccctgcgcagccatcagagggtgcacaccggtcagaggcccttcagctgtggcatctgcggcaagagcttctcccagcggtcggcccttatcccccatgcccgcagccacgcccgggagaagcccttcaagtgccctgagtgcggcaagcgctttggccagagctcggtgctggccatccacgcccgcacccacctgccaggccgcacctacagctgccccgactgcggcaagaccttcaatcgctcctccactctcatccagcaccagcgctcccacacgggcgagcggccctacaggtgcgccgtgtgcggcaagggcttctgccgctcctccacgcttctgcagcatcaccgggtccacagtggcgagcggccttacaagtgcgatgactgcggaaaggccttctcccagagctccgacctcatccgccaccagcggacccacgcggcgggccggcgctgacctggggccccagcaggggtgggaggtgtgggcagaagataaggggccagggagctagaggaacctttagggaggatagtggagaagccgcaggagaatggaggagctgaggatgctggaagaagagaaccagggtggaggaagtgacatgccctggagacttgtgggaagtgggttggagggaggccaggccggcagcgggaggccctgggagaaatggagagaggtcagcggagggctggcctcagccgcggctccttggtgggtgcctggcttggcaactgctagagcagggaggggggagggcaggggattacctaattagagtgggttagcttagattggtagctgctgaaactctcgttgagtcaggagcgggtaaaaggtaggtggggtggggagtggggccccggggtggggcctgggcctctgcgtgcaaaccccagcctccctcttcttcctcaggctttggagcccctgagtttgagttcaataaaaactttatgtggtaaacga

SEQ ID NO: 203744 - DNA, 1999 bp, Homo sapiens
  Payload ID: 20183
  Gene Name: zinc finger protein 768
  ENST ID: ENST00000562803
  CDS Start-End: 86-1615
acttcctgtgcgggggagggtgggggggtgctgggcggccgttggacagtgcagcccagcccggggccggggtccagaaggcaacatgagtgagaatgaggaagaggaaatttctcagcaagaaggcagtggggactatgaagtcgaagagataccatttgggcttgaaccccagagccctgggtttgagccacaaagcccagagtttgaaccccaaagccccagatttgagcctgaaagcccggggtttgagtcccgaagccctgggcttgtgcccccaagccctgagtttgcacccagaagccctgaatcagattctcagagccctgagtttgaatcccagagccctaggtatgaaccccaaagccctggctatgaacctcggagccccgggtatgaaccccggagccctggctatgaatctgagagctctagatatgaatcccagaacactgagctcaaaacccaaagcccagaatttgaagctcaaagttccaaattccaggaaggtgcggagatgcttctgaaccccgaggaaaagagtcctttgaatatctccgtaggagttcaccccctggactccttcactcaggggtttggggagcagcccacaggggacctgcccatagggccaccttttgagatgcccacaggggccctgctgtctacaccgcagtttgagatgcttcagaatcccctgggtctcacaggagcccttcgaggtccaggtcggcggggtggccgggccaggggtgggcagggccctcggcctaacatctgtggcatctgcgggaagagcttcgggcggggctccaccctgatccagcaccagcgcatccacaccggtgagaagccctacaaatgtgaggtctgcagcaaggccttctcccagagctctgacctcatcaaacaccagcgcacccacactggcgagcggccctacaaatgtccccgttgcggcaaggccttcgccgacagctcttacctgcttcgccaccagcgcactcactctggccagaagccctacaagtgcccacattgtggcaaggccttcggcgacagctcctacctcctgcgacaccagcgcacccacagccacgagcggccctacagctgcaccgagtgcggcaagtgctatagccagaactcgtccctgcgcagccatcagagggtgcacaccggtcagaggcccttcagctgtggcatctgcggcaagagcttctcccagcggtcggcccttatcccccatgcccgcagccacgcccgggagaagcccttcaagtgccctgagtgcggcaagcgctttggccagagctcggtgctggccatccacgcccgcacccacctgccaggccgcacctacagctgccccgactgcggcaagaccttcaatcgctcctccactctcatccagcaccagcgctcccacacgggcgagcggccctacaggtgcgccgtgtgcggcaagggcttctgccgctcctccacgcttctgcagcatcaccgggtccacagtggcgagcggccttacaagtgcgatgactgcggaaaggccttctcccagagctccgacctcatccgccaccagcggacccacgcggcgggccggcgctgacctggggccccagcaggggtgggaggtgtgggcagaagataaggggccagggagctagaggaacctttagggaggatagtggagaagccgcaggagaatggaggagctgaggatgctggaagaagagaaccagggtggaggaagtgacatgccctggagacttgtgggaagtgggttggagggaggccaggccggcagcgggaggccctgggagaaatggagagaggtcagcggagggctggcctcagccgcggctccttggtgggtgcctggcttggcaactgctagagcagggaggggggagggcaggggattacctaattagagtgggttagcttagattggtagctgctgaaactctcgttgagtcaggagcgggtaaaa

SEQ ID NO: 203745 - DNA, 2002 bp, Homo sapiens
  Payload ID: 20184
  Gene Name: zinc finger protein 77
  Uniprot ID: Q15935
  ENST ID: ENST00000314531
  CDS Start-End: 94-1731
accccgagcggctcaggtgtcctgtcgtgctcacctgcgccggtcgctggaccgcggggcgctaaccctggagagcccaggagcgggcgggacatggactgcgtgatctttgaggaagtggctgtgaacttcaccccagaagagtgggcattgctggatcatgctcagaggagcctctacagagatgtgatgctggagacctgcaggaaccttgcctccttggattgttacatttatgttagaaccagtggatcaagttctcagagggacgtttttgggaatggaatatccaatgatgaagagattgtaaagttcacaggaagtgattcctggtctatttttggagaaaattggagatttgataacactggagatcagcaccaaatcccacagaggcatctgagaagtcagctggggagactctgtgaaagtaatgaaggtcatcaatgcggagagaccttgagccagactgcgaaccttcttgtgcacaagagttaccctaccgaagctaaaccctctgagtgcactaagtgtggcaaagccttcgagaatcggcagagatctcacactggacagagaccgtgtaaggaatgtgggcaagcctgcagctgcctctcctgccaaagccctcctatgaaaacgcagactgtagagaaaccctgtaattgccaggactcaaggacagcatctgtgacatacgtgaaaagtctcagcagtaaaaagtcttatgaatgtcagaaatgtggaaaagctttcatttgtccctcatctttcaggggacatgtgaatagtcatcatgggcagaaaacccatgcatgtaaagtatgtgggaagacctttatgtattactcctaccttacacggcacgtaagaactcacacaggagagaaaccctatgagtgtaaggagtgtgggaaagccttcagctgtccctcatactttcgagaacatgtcagaacacacactggagagaaaccgtatgaatgtaagcattgtggaaaatcattcagctgttactcctcctttagagatcacgtgaggacgcacactggagagaaaccctgtcagtgtaaacattgcggaaaagcgttcacttgttactcgtctcttcgagaacatgggagaacgcacagtggagagaaaccctatgaatgtaaggaatgcggcaaagccttcaggtacccctcctctctgcgagcacacatgagaatgcacaccggagagaagccctatgtgtgcaagcagtgtgggaaggccttcggatgtcccacttactttagaagacatgtgaaaacacacagcggggtgaagccctatcaatgtaaagagtgtgggaaagcctacagtttttcctcctcccttcgaatccacgtgaggacgcatactggagagaagccctttgagtgtaagcattgtgggaaagccttcagctgtcactcctcccttcgagagcatgtgcgaacccacagcggagagaaaccgtacgaatgtaatcaatgtgggaaagccttcagccacgctcagtactttcaaaagcatgtgagatcacacagtggggtcaaaccctacgaatgtactgaatgtgggaaagcctacagttgttcctcgtcccttcgtgtgcacgtgagaacgcacactggagagagaccgtatgaatgcaagcagtgtgggaaaaccttcaggtatctcgcatcgcttcaagcacatgtgagaacacatgctggagcgtgaatctacgaatacagtggacctgggagagtgttcaaccgtaaaaccttgttgtaaatgtgagaaacgttatttatgtagagcatgtaggaaaacctggtatagcacttattttgtacctaaaaattcagagtaggagagaaatctcttaattatgattaatatggtattgcctttacatgcctcagccttaatagtgattccttttgtattaatttctagtgtatgtttgtgatataaacatttaataaatatcctgttttgtacgctttca

SEQ ID NO: 203746 - DNA, 5439 bp, Homo sapiens
  Payload ID: 20185
  Gene Name: zinc finger protein 770
  Uniprot ID: Q6IQ21
  ENST ID: ENST00000356321
  CDS Start-End: 346-2421
gttgccgcgccggccctgcggacgtgcgcgcgctgccttcgcggcacctgggcctgaggtgcgtgcctcccgggccctcgccagctccagatgcgtgaggaggacttcagaaacccgactgagaagtggagcgacccccagggagggtcggacctgcctcaataccgccaaggtctttcatttcttgttcgcttactttcgtgaaatcctcacatcgttttaatggtactagtcaagacaagaaaatcaacaggctttcagccttgaggcaacattggatattattgagacatctgtggaatttaagaacagtatggagctcatcagagtatatcattgaagaatatgatggctgaaaacaatttaaaaatgctaaagattcaacagtgtgtggtagccaacaaactacctagaaacaggccatatgtttgcaatatttgttttaagcactttgaaacaccatcaaaattagctaggcactatctcattcatactggtcaaaagccatttgaatgtgatgtgtgtcataaaacctttagacaactagttcatctggagaggcatcaactaactcatagtctgccttttaaatgtagtatttgtcagcgtcactttaaaaatctgaagacatttgtgaagcaccaacaacttcacaatgaaacctatcagaataatgttaaacaggtcagaagattgctggaggccaagcaagaaaagtcaatgtatggagtgtataatacttttaccacagaggaaagatgggcattacacccgtgctctaagtctgatcccatgtatagcatgaaaagaagaaagaatattcatgcatgtacaatctgtggcaagatgtttccatcacagtcaaaacttgataggcatgtacttattcatactggtcagaggccttttaaatgtgtcttgtgtactaaatcttttcgacagtcaactcacttaaaaatccaccaacttacacattcagaagaaagaccttttcaatgttgtttttgtcaaaaaggatttaagattcaaagcaaacttctgaagcataaacaaatccatactaggaataaggcttttcgggctcttttattaaagaagaggcgtacagaatctcgccccctgcctaataagttaaatgcaaatcagggtggttttgaaaatggtgagattggtgaatctgaggagaataatccacttgatgtccactcaatttatattgtcccttttcaatgtccaaagtgtgaaaagtgttttgaatcagagcagattctcaatgaacacagctgttttgctgctagaagtggcaaaattccaagcaggttcaaaagaagctacaactataaaaccattgttaaaaaaatcttggccaagcttaagcgtgctaggagtaaaaaattagataactttcaatctgagaaaaaagtatttaaaaagagtttcttgagaaattgtgatcttatttctggtgagcagagctctgaacaaacccagagaacatttgtgggttctcttggcaaacatggaacatataaaacaattggcaatagaaagaagaaaacattgactttgccattttcttggcaaaatatgggaaaaaatttgaaaggcatccttacgacagaaaacatattaagcattgataattcagtgaataagaaagacttgtcaatctgtggttcatcaggtgaggaattctttaataactgtgaggtacttcagtgtggtttttcagttccaagggaaaacatacgtactagacataagatatgtccttgtgacaaatgtgagaaggtatttccttctatatccaaactaaaaagacactatttaattcatactggacagaggccctttggctgtaatatttgtgggaaatcttttagacagtcagctcacttaaaaagacatgaacagactcataatgaaaagagtccttatgcatctctttgccaagtagaatttggaaacttcaacaatctttctaatcattcaggtaataatgttaactataatgcttcccaacaatgtcaggctcctggtgttcaaaaatacgaggtctcagagtcagatcaaatgtcaggagttaaggcagagtcacaggattttattcctggtagcaccgggcaaccctgtcttcctaatgtacttttggaatcagagcaaagcaatcctttttgcagttattcagagcatcaggagaaaaatgatgtcttcctgtaccgatgcagtgtttgtgctaaaagtttccgatctccatctaaactggaaagacactacctaattcatgcagggcagaaaccatttgaatgctcagtttgtggcaaaacattcagacaggctcctcactggaagagacatcagcttactcactttaaagaacgaccacaagggaaagtggttgccttagattcggttatgtaaattgtcgcaaccactaacaattgtggtctctggtgatcttatttttaaagcctgtattatttaaaatgcatttttattgaaaggcctgcattaaactgaatggtttcacaggcatttgcttgtcctgcatagtaaggaggtagaatacatagaaaattaatacaatgttttagaaacagccaagttaattttagaggcaagaacatgatttgatgctataaagtaggcattttaatattgtaaacatatactttggctgtattgaaaaatataaatccatgatggctgtacaaataatttagcctcattcattttttaaaggaattattccttaagacatgccatctctttttagatatactcaaaagactgagaggcaaaacttggcttttagctgcagcacatagccctgttatatttgatttattttacatttcatatgaaagcataattttgtccacatgtgactcaaattgcattggtaattttttttttttttttgtaagttaaaaaaactacagagacactaaaggtgaaaatggatgagacaattatagtattattttcattggtctttttttttgagatggagtctcactctttcgccaggctagagtgcagtggcgccatctaggctcactgcaacctccgcatcccagattccagcgattctcctgcctcagcctcctgagtagctgggattacaggtgcctgccatcacgcctggctaatttttgtatttttagtagagacgggggttcaccaagttggccaggatggtctcgatctcttgaccttgtgactcacccgcatcggcctcccaaagtgctgggattacaggcatgagccaccgcacccgacggtcttttcaaagctatttatttttaggactatgtggtaatttcaccttcaggtgataaggattttttttttctcccagctagtgctatctttctcaaaataatttaaaagtaggcgagaggctaggatgtacctatatttaccatgtttacttaccaggaatattttctaagtgccatagtctttttcataatacgtatgagttttaccttttcagaggaataatttcaagtcatttatttgctcattaatgatagcagtagtcatagacttaagactattctagagatcttcatctccataagacttttacatttattttagtaaacttttctttctatgcctctttaatggagtggttctgttatttaagcctgttctaagtttgatcaaatggcaatgactaggtctagttttagtttttatttttgcaggagtctattgctaaagaattttattttgatgcttgttaaatttttattttaattaataaggtagtcattcctgtagagggataagatgcttgtagagttgtgggtatcattccaaatagaactgttatgatttgggaaatattctttactacaaaggacttatttcataattacaaattttccttcatatttgcctttgtttataaaatcttcaggaatgacattctctagcaataaaaggaatgaaccgttatgtttctaagctgaaaagaggaacaggtgggtaattatcctgccatacttaaatatagtggaaaatcctctattgagaatgtggataaatgaacaattgtaagttttgcatcataaactgagaactttcttttgacaggggggaggcgggagggatagtaggtgggggtgatctgcttgcttcttttaccacaggtgatttttaagtaacttgggtttaatttacagagatgaaacatgacagtctgagtaaaatacccagtgatgtagaagtgtgcctgtttattatgtagatacagacatccagcaaaaacaggagaatcacatgctttaaagaacactttctcttaggtttccttgagatatgttcctccagtgcaagcaagataatggtttacagaatttgctttacacaaaacttgtcaagaactcatctgttaaaagcaaggaataactagtttatattttccaataatgttcaaggttttctccttaatatgtttgaaattattgattttggcatttttctaagcaatttatgtaattttatttgaagaaaatgttttgtataatgtttttcccagcctaaacagggagagtcctaacagtgttgtgcttgtatgattctgagactttatttgcgtaagtgatactactatactttatttttgacccatgcctttttaagctgtttcatattgaaaggtggaatattgtaaaaattttgtcaaagatgtactgtagtgctatttgaagtacctgtaacaaaacagttggccctctgtatccatgtactctgcatctgtggattaaaccaattgcagatcaaaaatattagaaaaaataaaaataatacaaataaaaatacagtataacagttatttaaatagcatttacattgcattaggtattagtctagggataaagtatacaggcggatgtgcgttggttatatacaaatatgtcattttatgtaagggacttgagtatacttggatttttggtatctgtgggttggggggacggtccaggaaccaataccccatggataccaagggacaactgtacttatttacctttattgtcattgcaagcttcttatggaaactttataggaatgaaaatatacatgttaagaagattaaacattagatagtagatggtttgttgcatgctagaactgttagtattgttgaatcaattactttggtttcatgaaaaaataaacgataaatatctttaaagagaactagaagaattttttgtttgagtgattccaggctgtagtatgatcatttactgaagtagtttgattggctggctaacttagaattattgtttcttgttttgtactgcaataggggttataattgtaagataaaaatgtgtgtgtgtttaagggaagtaggtggtggttaaaattcttggaaaattttcagaatactttaaaaataaagttccaagttacaca

SEQ ID NO: 203747 - DNA, 563 bp, Homo sapiens
  Payload ID: 20185
  Gene Name: zinc finger protein 770
  ENST ID: ENST00000559564
  CDS Start-End: 167-563
gtgcctcccgggccctcgccagctccagatgcgtgaggaggacttcagaaacccgactgagaagtggagcgacccccagggagggtcggacctgcctcaataccgccaagacatctgtggaatttaagaacagtatggagctcatcagagtatatcattgaagaatatgatggctgaaaacaatttaaaaatgctaaagattcaacagtgtgtggtagccaacaaactacctagaaacaggccatatgtttgcaatatttgttttaagcactttgaaacaccatcaaaattagctaggcactatctcattcatactggtcaaaagccatttgaatgtgatgtgtgtcataaaacctttagacaactagttcatctggagaggcatcaactaactcatagtctgccttttaaatgtagtatttgtcagcgtcactttaaaaatctgaagacatttgtgaagcaccaacaacttcacaatgaaacctatcagaataatgttaaacaggtcagaagattgctggaggccaagcaagaaaagtcaatgtatggagtgtataatactt

SEQ ID NO: 203748 - DNA, 2371 bp, Homo sapiens
  Payload ID: 20186
  Gene Name: zinc finger protein 771
  Uniprot ID: Q7L3S4
  ENST ID: ENST00000319296
  CDS Start-End: 378-1331
tttcgggcggagcagaggcactgggcgcagcggagacctccaagccggccccaggagacgggccgcgaggttaggttggaactcggcggcaaggaccttgaacgccgggctggggcggctccaggtgcttgggagtcgggggactgcggaggacgccaagtctgagctcgccgccctctccgagccgtttgggccggacgcctgggtccttcgggctccgccccagggggtggggctatatgttcggaccaatgaccggccgtccctgcggtcccgccccctccccgcccccggagccgcggcctcgctgagtgcccagccgcccggcgcccaggcctggggcaccgcgagtgccgaaccttcggctggacaccaagatgcctggcgaacagcaggcagaggaagaggaggaggaagagatgcaggaggagatggtgctgctggtgaagggtgaggaggatgagggtgaggagaagtatgaggtggtgaaactcaagatccccatggacaacaaggaggtcccgggcgaggcgcccgcgccgtccgccgacccggcgcgtccccacgcgtgccccgactgcggccgcgccttcgcgcgccgctccacgctggcgaagcacgcgcgcacgcacacgggcgaacggcccttcgggtgcaccgagtgcgggcggcgcttctcacagaagtcggcgctgaccaaacacggccgcacgcacacgggcgagcggccctacgagtgccccgagtgcgacaaacgcttctcggccgcctcgaacctgcggcagcaccggcggcggcacacgggcgagaagccgtacgcatgcgcgcactgcggccgccgcttcgcgcagagctccaactacgcacagcacctgcgcgtgcacacgggcgagaagccgtacgcgtgcccggactgcggacgcgcctttggcggcagctcgtgcctggcgcgccaccgacgcacgcacacgggcgagcggccctacgcttgcgccgactgcggcacgcgcttcgctcagagctcggcgctggccaagcaccggcgcgtgcacacgggcgagaagccgcaccgctgcgctgtgtgtggccgtcgcttcggccaccgctccaacctggcggagcacgcgcgcacgcacacaggcgagcggccctacccctgcgccgagtgcggccgccgcttccgcctaagctcgcacttcattcgccaccgacgcgcgcacatgcggcgccgcctgtatatttgcgccggctgcggcagggacttcaagctgccccctggcgccacggccgccactgccaccgagcgttgcccggagtgtgagggcagctgagtcccgcagggctgcggaggggcgcgctggggcttcgacctggctgcactaacccaggctcctcctcgccccggcctccgggtctgggaaattgaggggacggcaggcccggctgccctggaactgggagacagggagaatcccctgccggggtccctggaaacagtgcccaccccacatcactacattccctcggcccgtgttagtgaataaagtattatatcctcaccccacccgtgcctgtgagtgaggtgggtgggagaggaagaaagttggggttctccaggctcaggtgccaagtgagttgtcaaggaaccaaatggggatgtaaacctaaaaggggttcccggcacctcggtttgtgttggttggaggtgatcgcacacttggcccttggttacgtcctcataaccttagacctgaaagggcccataaatatactatgttcacgatcagacacgcactgcattcggcagagctccagtgagcaaggcacgaccctcagatctcagtctagtgaaggagagaaaactgtaataacactacgttaaaggttttaactgctttgttatgtaagcttacccagcccggcgcacagtgactcacgcctgtaatcccagcactttgggagggcgaggctagcagatcacttgaggttaggagttcgataccagcctggccaacatggtgaaacccggtctctactaaaaatacaaaaattaactgggtgtggtggcgggcgcctgtaatcccagctactgagggggctgaggcatgagaatcacttgaacctgggagacagaggttgcaatgaaccgagatagtgccattgcactccggcctgggcaacagaggaagactgcctcaaacaaacaaaaaacaacaaaccaaaccaaaccaaaccaaaaaaatctcaaagcgattggacctagcagctcatgcctgtaatctccagcactttgggaggcggaggcaggaggatctcttgaagtcaagagtttgagatcagcctggagaacaaagtgagacccccatctatt

SEQ ID NO: 203749 - DNA, 1454 bp, Homo sapiens
  Payload ID: 20186
  Gene Name: zinc finger protein 771
  Uniprot ID: Q7L3S4
  ENST ID: ENST00000434417
  CDS Start-End: 274-1227
gctccaggtgcttgggagtcgggggactgcggaggacgccaagtctgagctcgccgccctctccgagccgtttgggccggacgcctgggtccttcgggctccgccccagggggtggggctatatgttcggaccaatgaccggccgtccctgcggtcccgccccctccccgcccccggagccgcggcctcgctgagtgcccagccgcccggcgcccaggcctggggcaccgcgagtgccgaaccttcggctgctccccgcctcaggacaccaagatgcctggcgaacagcaggcagaggaagaggaggaggaagagatgcaggaggagatggtgctgctggtgaagggtgaggaggatgagggtgaggagaagtatgaggtggtgaaactcaagatccccatggacaacaaggaggtcccgggcgaggcgcccgcgccgtccgccgacccggcgcgtccccacgcgtgccccgactgcggccgcgccttcgcgcgccgctccacgctggcgaagcacgcgcgcacgcacacgggcgaacggcccttcgggtgcaccgagtgcgggcggcgcttctcacagaagtcggcgctgaccaaacacggccgcacgcacacgggcgagcggccctacgagtgccccgagtgcgacaaacgcttctcggccgcctcgaacctgcggcagcaccggcggcggcacacgggcgagaagccgtacgcatgcgcgcactgcggccgccgcttcgcgcagagctccaactacgcacagcacctgcgcgtgcacacgggcgagaagccgtacgcgtgcccggactgcggacgcgcctttggcggcagctcgtgcctggcgcgccaccgacgcacgcacacgggcgagcggccctacgcttgcgccgactgcggcacgcgcttcgctcagagctcggcgctggccaagcaccggcgcgtgcacacgggcgagaagccgcaccgctgcgctgtgtgtggccgtcgcttcggccaccgctccaacctggcggagcacgcgcgcacgcacacaggcgagcggccctacccctgcgccgagtgcggccgccgcttccgcctaagctcgcacttcattcgccaccgacgcgcgcacatgcggcgccgcctgtatatttgcgccggctgcggcagggacttcaagctgccccctggcgccacggccgccactgccaccgagcgttgcccggagtgtgagggcagctgagtcccgcagggctgcggaggggcgcgctggggcttcgacctggctgcactaacccaggctcctcctcgccccggcctccgggtctgggaaattgaggggacggcaggcccggctgccctggaactgggagacagggagaatcccctgccggggtccctggaaacagtgcccaccccacatcactacattccctcggcccgtgttagtgaataaagtattatatcctc

SEQ ID NO: 203750 - DNA, 1187 bp, Homo sapiens
  Payload ID: 20186
  Gene Name: zinc finger protein 771
  ENST ID: ENST00000564550
  CDS Start-End: 24-212
gctccccgcctcaggacaccaagatgcctggcgaacagcaggcagaggaagaggaggaggaagagatgcaggaggagatggtgctgctggtgaagggtgaggaggatgagggtgaggagaagtatgaggtggtgaaactcaagatccccatggacaacaaggagagacacgatctcgctttgtcacccaggctggagtgcagtggcacgtgattgtagctcactgcagccttgaactcttgggctcaagtgatcctccttcctcggcctaccaagttgttgggactacaagtgcaccccaccacacctggctaatttttcactttttgtagagacgaggtctaactgtgttgcccaggctggtgtccaactcctggcctcaagtaatcctccttccttggcctcccgaagtgctaagattacaggtgtgagtcactgcacctggcctcatactgggaatttgatctcacttagcctacctggcctttctcgggacactggggcagaggaggatcttaatgagctggattcagctcctcttaccaagatttttcctcgggcatccaaggccccttctcctgggctggagacatcaacagtgcttgtatggagaatttctttttcagaagtcagtgaactcagcatgaggaagccctcaggctgtccaaagtcacctgaaagagggtgccaaggaaaaacgggccagaaaaatgtagatctgatgagacaagttctctccacagtggctgatgtattgaaataaaccaatagatttcaaaaccagggcaagactggaaaatgtgaccttgaattcagatggtaccaaacatactgtggggagtttctccatttaaagtatcaagttgtattttaaccttgaatccctcttggagtgtgccagggacgtggaatccagcctctgtcacatcttggtcacgtgagttcagaacagtgtagcctgaatgacggcatggtctcatgggcaccctgagtccatcctggctcccactggccatgtgaatttcatcgccctcagcctcagctttctcagctatcaaaagagagaacacccagctcaaggcgggtgacaggaggatttaatacaataacatacatagtgttgtcaaagcttaatactttgttattgattgttgctattgttatcagtatagatactatttaaaccag

SEQ ID NO: 203751 - DNA, 2415 bp, Homo sapiens
  Payload ID: 20186
  Gene Name: zinc finger protein 771
  ENST ID: ENST00000566625
  CDS Start-End: 46-204
aggcctggggcaccgcgagtgccgaaccttcggctggacaccaagatgcctggcgaacagcaggcagaggaagaggaggaggaagagatgcaggaggagatggtgctgctggtgaagggtgaggaggatgagggtgaggagaagtatgaggtggtgaaactcaagatccccatggacaacaaggaggaggctgagtgcccctagagggcagggacccgtgagtcctctctgcatcccaacaacagcaaagagcctagcaatcaggaggggaaactgaacccatgaatgtttgaagaccaaataaatgctcccctcccctcccccacaactcagactctaccaggaagctttccatctactcacaagagttctgccagctcccccacttccccaaccaaggccaggaggagattccgaggctgatggaactgttcccagtctcgttccgcagcaaactcagcatggaggcggcggctgaaataggacaaaggagtgtaagtccaagtctccgggttagagggtgatgcaggggccagaggcagctacccccgtagtatgtaatggggcctgggaccaggagattctgcaactaattcattggatggtattgtgcaggtcatttcctctttccggaacttggttccctcatctataaaatgggcgtgcccctgaactgcccttaacatctcgccaaaactaacaaaaccctcttcattattccatctcctgctgctacttctgcagtttcctccacctggaatcgccgcacatcaaaatgcaatttctcttacagaaggtagttccacagacccttcctctaagaagcctttcttgacctcctccagcaaaaaataacgtctcccacctctcagcacttcgtttgcccctctcgtacccccggcgcctggagagcagaggcggtatctggtgccggtatcttcccagggctaggctgaagggcgttcctagttaccactcggaggcaccacccaatttcccttgcctcaggtgtgcaccgctgcgcccattttgcagatgaggtaagaaggctcacccagggacagcccacagagccaggacccgagccccgctgccagcccgcttcccgaccacgtggaggaaccctccccaaaacgcgggagaaaggggcgacttccccaccccgagctgggccaggcctgcttacatgtcctcgagcgtgggctccgggctgaagctgaaccggccgggagcagcagtgtcctctccccccgtgtccccacgaatctccccaccggccacagacatgccgcccaccgctgcaccgcgacttcacggaaaacccacgagccacgctcgaagccccgcctccagagctccgaccaattacgggagttctctattgcctcacggggcggagcctgaggaaagagaccaatgacttttgtggagtttgctacagccctccccttccctcactggaccaatctgagggagcttcaagcgcgcgtttctagtcttaggccctggaattcttccgctaggccctgtgtctaaaggtagaggtaccaattcgacctggggaagagacgaagggcagagggtgggggaagcgcaggcgcgtcacttcgtttatgggcgccagagggcgccaaagcgaaacggcagcggaagagggcccgtcaggtggaaaaccctataaatgaaaggccctatgcataggtattaaatcagggcttaaggacgttgagaaacctcgaggccaacccccacactatttggatgggattgaaggggaagagcggagtaagatcagacggcagtaggacttcagctccccgccatcgctgtgtcctgtggttgaaacgatggaggtcgccccatccctgtcctaagggaggcagtaggccccagcgcaacgtacattgccctgaaacacgtggccccttatggtctggcctgtgccggcctctccagcctcatgggtccccagcacggctcctccaccccacacacgagaactccaggctccactcacaccagggaatacgcgaggtggcgagtcacagggttgctgctttcaaatcagaaccactgagttattggccatgggaggagcagagatctttatgaaaccctagaacaggtgtagtcttgcaaagaatgatttattattgtacccttattagggctactatctctgatttccacgtttaaagaggcttccagcttgctggaagtgaaagcgtaagaaagcgcaggaagaggcagagtcagattttggaaattaaaatcccaaggctgtgacaattgcaattctaggtatatgccctagagaaattaatgaatatgtgcagagagacacatgcaagaagttcattacagttttgtttctaagagtgaaaaaaattgaaaataaaatgactatcaacggaa

SEQ ID NO: 203752 - DNA, 5419 bp, Homo sapiens
  Payload ID: 20187
  Gene Name: zinc finger protein 772
  Uniprot ID: Q68DY9
  ENST ID: ENST00000343280
  CDS Start-End: 262-1731
gggcgggacttcctctaccatcctcgggtggacattttgtttgcttttccattaatccactggtttagtttccagaacgcaatgtcagacctgaggtgacagaaaagggaaaacgtgagagagtgtcttcttccctgaagagaggtgggcctgaggcttgacagtggcgctgcctgagtgacctagccgctgggctgggccctggacagctgatcccaggttcctgcacttgtcgccacccttccgtagtccacaggcctgatggcggcggctgagccgatgggcccggcacaggttcccatgaactcagaagtaattgtggaccctatacaggggcaggtgaactttgaggacgtgttcgtgtacttctcccaggaggagtgggtgctccttgatgaggctcagaggctcctgtaccgtgatgtgatgctggagaactttgcacttatggcctctctgggacatacatctttcatgtcccacatagttgcctcactggtgatgggtagtgagccctgggtacctgactgggtggacatgaccctagctgttgccacagagactccaggtgggagtgaccctggttgttggcatggaatggaggatgaagagataccttttgagcagagcttttctataggaatgtcacagatcaggattcccaagggaggtccttctactcagaaggcttacccctgtgggacatgtggcctggtcttaaaagacattttgcacttggctgagcaccaggaaacacacccagggcagaaaccatacatgtgtgtgctgtgtgggaaacagttctgcttcagtgcaaaccttcaccagcaccagaagcagcacagtggagagaaaccctttagaagtgataagagcaggccctttcttctgaacaactgtgctgtgcaatcaatggagatgtcttttgtgacaggggaggcttgtaaggacttcctagccagctcaagcattttcgagcaccatgcccctcacaatgagtggaagccacacagcaacaccaagtgtgaggaggcctctcactgtggaaaaaggcattacaaatgcagtgaatgtgggaaaaccttcagccgcaaagactcacttgttcaacaccagagagtccacactggagaaaggccttatgagtgcggtgaatgtgggaaaacctttagccgcaaacccatacttgctcagcaccagagaatccacactggagaaatgccttatgagtgtggcatatgtgggaaagtttttaatcatagctctaaccttattgtacatcaaagagtacacactggagcaaggccttacaagtgcagtgaatgtgggaaagcctatagtcacaaatctacacttgttcagcatgagagtatccatactggagaaaggccatatgagtgcagcgaatgtggaaaatactttggtcacaaatacagactcattaaacattggagtgttcatactggagcaaggccttatgagtgcatcgcatgtgggaagttctttagccaaagctctgaccttattgcacatcaaagagttcataatggtgaaaagccttatgtgtgcagtgaatgtggaaaagcctttagccacaaacatgtacttgttcagcatcatagaattcacactggagaaaggccatataagtgcagtgaatgtgggaaggccttcaggcagagggcttccctcatccgccactggaaaattcacactggagaaaggccttaggatgggagataattccgtttccttgttcaacataataactgacatcagagagaagctccaagcatagcctttatgtgtagccgacagccagaagtagaactttatacactcaaacactcaccctggggaggttcttccgagtgccagctatatgggaagccttctggagctatgctgaattttctagactcttgctggaatttcgtcaaggcagtgcctgttagaagccatctgtctttgtgctggaagagtcctgccttgtgccaaagtaaccccaatgtgtttcaaaagacagacctctgtactattcccttccctggagggaatcatcagtagcctgaggccatcaaggattctcactttttttctgccccactactggtttaagcatgagcatgacccagttttagccagaaaaatgggagctttgttctgctgaccactggcagaggtttcccttcatggatatagttgatctcacatggcacttgggacgaatttttctagccttcaagacacctgacctgaaattggctgcctcatattctggttttgcaacaaatgccttaatttttagactatctgaaatcttgaggattctgttcgctttgtgggttgggttgagaacagaattgagctaagccagtatgaagggaagaacagcttttgtgagagctccaactatctgtatctctgaagtgatagtaggatggcaaagactagctcttatgctagtgtcaagctaacttacttgactgcttcagctctcctaggaaagaatgccagtctttgtaggcctaatcttttggtctatatgttaagattttttgtgtaattgaggtcaccctaagcagtgggcatttgttgtgataatctctaatgtgtctgggagcaacatgaattacgtcccttgttcccagaagatacttcatattcccaaggcttcttgaggagaatttgaactcagtggacatgtcaagatctctgaagtctatttttcagtaggcagttgatattggctgtcctccagaaggcccaggtaggaatcatagttggtgcagaaacccagattaataaaggaatgagaaaactgcagcaaactatagggaatatgacccttctaaaggtacatccacatgtgtttccattactctggctccattatgagggtttacagaaatatttccatacctgtgtctcttatggctaaggttactgtccagaagtcagtctaaacatttttgcaataaactgcacatatttatagtgtaccatttgataagttttgatacatgttggcacttctcaaaccaaaagtttcctgattccttttatattttctccctttccttcacccatccccaggcaactattgatccgttgtcactgtagatttgtttgtatttcctagaattctacagagatagagtaatttaatatgtattctaatgtttttggcttcttaaactctgaaattaaggctcatggtggtgttctgtgtttcatagttcatttcttttcatttgtactttgctaagagtgttccattgtagagaaatagtttcaaagcaagtgatccaggagagaactcacacaagaacaaagccacagtatctgtcattaccttaaactgaaagtgatgagccgtcatttctgctatatttcataagtaaccctagctaatcctggttaaaagtggaagagaactacacaaaggtgaaaatagggatttgtggggcgttttcttggactctggtgaccataatcctatatggtttttttctttttctgttttagttgtttaatatgaattacattgactgatttttttaaatgttaagccaaccttgcatttctgtaataattcccatttggtcatgatgtattagtcatttagtatattgttgaatttgatttgctattttgttttgttttgttttgtttttttgtaacaagttttgcaccaatgttcacgagtgatatttgtccctaactttctttcttgcttgcttgcttttttttctttgtaattttatatcttgcccaggtttggctttggtatcagcataatgccagctttatagagtaagttgggaagtattcctgctcttcagctctctggaagagtttgtgaataattggtattatttcttccttaaatgtttggtagaattcaccaaggaagctgtctgggcctggagtttgttttgtaggaaagtttctaactataagtttgatttctgtggtagatagagggctgtacaagttatatgtacatctgtctgtgtgtgtgttgtctgtctgtcactctggccctgaagtgtgttttgtaggacagcatctaactacaagtttgatttccatggtagatggagggctatactagttatatatacatctgtctgtccgtccatctgtttgtcactccatccatccatctatctctagagtgagctttgatggtttgtgtctttcaaggagtttttctgttttatttaagtactcaaatttttcaaaatattattttcatacttgtagaatttgtagtggtgcaacctcttctattcctgatactggtaatgtctatatttttcttttaaccttgattggtttgggtagagatttatcaattttacaattttattgatcttaaagtacttggtattattgaattttctgttttctgatattttgggatttttcttttccattttgagttttactaatgccttccgcttttattggatttcatttcttttgctactttttaacatggaagctgaggtccttcatttcaaacctttgggtttttttcccctaatatggggaagagatgttaatgttaaaaatctatctgagaactgctttaattacctcccatcaagcttgatgtggtttcatttttttttttgagacagtgtcttgctctgtcatccaggttggagtgcagtggcgcgatctcggctcactgcaagctctgcctcctgggttcacaccattctcctgcctcagcctcccgagtagcttggactacaggcgcctgccaccatgcctggctaattttttgtatttttagtagagacgaggtttcaccgtgttagccaggatggtctcgatctcctgatcttgtgatccgcctgcctcagcctcccaaagtgctgggattacaggcgtgagcccagccgatgtggtttcattttagttgagtttaggatgttttccagttaaaaaaattcttcttgacacatggctctttttaaatgtatgttatttaattcctaaatatttggggattttgcttatctttctggtagtttctgcaataattccattgtggtcagagtacattaagacttgaattatttacatttattgagatttgctttgtggcccagaatatgggctatcttggtatgagttacatgttcacttgaaatgtatactgtactctcgtttgatgaaggggttctacaagtgttgattaggtaaaaatggttgatgttatttaagttttttctatctttattgacattctgtggttttggttccagcaattattttaagaggattgttgacatctctgaatattaaattggatttacttctctgcagttctgtcagattttgcttcacatattttagtatgtttttattaggtgaataataaatatttcctattttatgtcca

SEQ ID NO: 203753 - DNA, 1799 bp, Homo sapiens
  Payload ID: 20187
  Gene Name: zinc finger protein 772
  Uniprot ID: Q68DY9
  ENST ID: ENST00000356584
  CDS Start-End: 224-1570
gtttgcttttccattaatccactggtttagtttccagaacgcaatgtcagacctgaggtgacagaaaagggaaaacgtgagagagtgtcttcttccctgaagagaggtgggcctgaggcttgacagtggcgctgcctgagtgacctagccgctgggctgggccctggacagctgatcccaggttcctgcacttgtcgccacccttccgtagtccacaggcctgatggcggcggctgagccgatgggcccggcacaggttcccatgaactcagaagtaattgtggaccctatacaggggcaggtgaactttgaggacgtgttcgtgtacttctcccaggaggagtgggtgctccttgatgaggctcagaggctcctgtaccgtgatgtgatgctggagaactttgcacttatggcctctctgggttgttggcatggaatggaggatgaagagataccttttgagcagagcttttctataggaatgtcacagatcaggattcccaagggaggtccttctactcagaaggcttacccctgtgggacatgtggcctggtcttaaaagacattttgcacttggctgagcaccaggaaacacacccagggcagaaaccatacatgtgtgtgctgtgtgggaaacagttctgcttcagtgcaaaccttcaccagcaccagaagcagcacagtggagagaaaccctttagaagtgataagagcaggccctttcttctgaacaactgtgctgtgcaatcaatggagatgtcttttgtgacaggggaggcttgtaaggacttcctagccagctcaagcattttcgagcaccatgcccctcacaatgagtggaagccacacagcaacaccaagtgtgaggaggcctctcactgtggaaaaaggcattacaaatgcagtgaatgtgggaaaaccttcagccgcaaagactcacttgttcaacaccagagagtccacactggagaaaggccttatgagtgcggtgaatgtgggaaaacctttagccgcaaacccatacttgctcagcaccagagaatccacactggagaaatgccttatgagtgtggcatatgtgggaaagtttttaatcatagctctaaccttattgtacatcaaagagtacacactggagcaaggccttacaagtgcagtgaatgtgggaaagcctatagtcacaaatctacacttgttcagcatgagagtatccatactggagaaaggccatatgagtgcagcgaatgtggaaaatactttggtcacaaatacagactcattaaacattggagtgttcatactggagcaaggccttatgagtgcatcgcatgtgggaagttctttagccaaagctctgaccttattgcacatcaaagagttcataatggtgaaaagccttatgtgtgcagtgaatgtggaaaagcctttagccacaaacatgtacttgttcagcatcatagaattcacactggagaaaggccatataagtgcagtgaatgtgggaaggccttcaggcagagggcttccctcatccgccactggaaaattcacactggagaaaggccttaggatgggagataattccgtttccttgttcaacataataactgacatcagagagaagctccaagcatagcctttatgtgtagccgacagccagaagtagaactttatacactcaaacactcaccctggggaggttcttccgagtgccagctatatgggaagccttctggagctatgctgaattttctagactcttgctggaatttcgtcaaggcagtgcctgttagaagcc

SEQ ID NO: 203754 - DNA, 5130 bp, Homo sapiens
  Payload ID: 20187
  Gene Name: zinc finger protein 772
  Uniprot ID: Q68DY9
  ENST ID: ENST00000427512
  CDS Start-End: 309-1442
gggcgggacttcctctaccatcctcgggtggacattttgtttgcttttccattaatccactggtttagtttccagaacgcaatgtcagacctgaggtgacagaaaagggaaaacgtgagagagtgtcttcttccctgaagagaggtgggcctgaggcttgacagtggcgctgcctgagtgacctagccgctgggctgggccctggacagctgatcccaggttcctgcacttgtcgccacccttccgtagtccacaggcctgatggcggcggctgagccgatgggcccggcacaggttgttggcatggaatggaggatgaagagataccttttgagcagagcttttctataggaatgtcacagatcaggattcccaagggaggtccttctactcagaaggcttacccctgtgggacatgtggcctggtcttaaaagacattttgcacttggctgagcaccaggaaacacacccagggcagaaaccatacatgtgtgtgctgtgtgggaaacagttctgcttcagtgcaaaccttcaccagcaccagaagcagcacagtggagagaaaccctttagaagtgataagagcaggccctttcttctgaacaactgtgctgtgcaatcaatggagatgtcttttgtgacaggggaggcttgtaaggacttcctagccagctcaagcattttcgagcaccatgcccctcacaatgagtggaagccacacagcaacaccaagtgtgaggaggcctctcactgtggaaaaaggcattacaaatgcagtgaatgtgggaaaaccttcagccgcaaagactcacttgttcaacaccagagagtccacactggagaaaggccttatgagtgcggtgaatgtgggaaaacctttagccgcaaacccatacttgctcagcaccagagaatccacactggagaaatgccttatgagtgtggcatatgtgggaaagtttttaatcatagctctaaccttattgtacatcaaagagtacacactggagcaaggccttacaagtgcagtgaatgtgggaaagcctatagtcacaaatctacacttgttcagcatgagagtatccatactggagaaaggccatatgagtgcagcgaatgtggaaaatactttggtcacaaatacagactcattaaacattggagtgttcatactggagcaaggccttatgagtgcatcgcatgtgggaagttctttagccaaagctctgaccttattgcacatcaaagagttcataatggtgaaaagccttatgtgtgcagtgaatgtggaaaagcctttagccacaaacatgtacttgttcagcatcatagaattcacactggagaaaggccatataagtgcagtgaatgtgggaaggccttcaggcagagggcttccctcatccgccactggaaaattcacactggagaaaggccttaggatgggagataattccgtttccttgttcaacataataactgacatcagagagaagctccaagcatagcctttatgtgtagccgacagccagaagtagaactttatacactcaaacactcaccctggggaggttcttccgagtgccagctatatgggaagccttctggagctatgctgaattttctagactcttgctggaatttcgtcaaggcagtgcctgttagaagccatctgtctttgtgctggaagagtcctgccttgtgccaaagtaaccccaatgtgtttcaaaagacagacctctgtactattcccttccctggagggaatcatcagtagcctgaggccatcaaggattctcactttttttctgccccactactggtttaagcatgagcatgacccagttttagccagaaaaatgggagctttgttctgctgaccactggcagaggtttcccttcatggatatagttgatctcacatggcacttgggacgaatttttctagccttcaagacacctgacctgaaattggctgcctcatattctggttttgcaacaaatgccttaatttttagactatctgaaatcttgaggattctgttcgctttgtgggttgggttgagaacagaattgagctaagccagtatgaagggaagaacagcttttgtgagagctccaactatctgtatctctgaagtgatagtaggatggcaaagactagctcttatgctagtgtcaagctaacttacttgactgcttcagctctcctaggaaagaatgccagtctttgtaggcctaatcttttggtctatatgttaagattttttgtgtaattgaggtcaccctaagcagtgggcatttgttgtgataatctctaatgtgtctgggagcaacatgaattacgtcccttgttcccagaagatacttcatattcccaaggcttcttgaggagaatttgaactcagtggacatgtcaagatctctgaagtctatttttcagtaggcagttgatattggctgtcctccagaaggcccaggtaggaatcatagttggtgcagaaacccagattaataaaggaatgagaaaactgcagcaaactatagggaatatgacccttctaaaggtacatccacatgtgtttccattactctggctccattatgagggtttacagaaatatttccatacctgtgtctcttatggctaaggttactgtccagaagtcagtctaaacatttttgcaataaactgcacatatttatagtgtaccatttgataagttttgatacatgttggcacttctcaaaccaaaagtttcctgattccttttatattttctccctttccttcacccatccccaggcaactattgatccgttgtcactgtagatttgtttgtatttcctagaattctacagagatagagtaatttaatatgtattctaatgtttttggcttcttaaactctgaaattaaggctcatggtggtgttctgtgtttcatagttcatttcttttcatttgtactttgctaagagtgttccattgtagagaaatagtttcaaagcaagtgatccaggagagaactcacacaagaacaaagccacagtatctgtcattaccttaaactgaaagtgatgagccgtcatttctgctatatttcataagtaaccctagctaatcctggttaaaagtggaagagaactacacaaaggtgaaaatagggatttgtggggcgttttcttggactctggtgaccataatcctatatggtttttttctttttctgttttagttgtttaatatgaattacattgactgatttttttaaatgttaagccaaccttgcatttctgtaataattcccatttggtcatgatgtattagtcatttagtatattgttgaatttgatttgctattttgttttgttttgttttgtttttttgtaacaagttttgcaccaatgttcacgagtgatatttgtccctaactttctttcttgcttgcttgcttttttttctttgtaattttatatcttgcccaggtttggctttggtatcagcataatgccagctttatagagtaagttgggaagtattcctgctcttcagctctctggaagagtttgtgaataattggtattatttcttccttaaatgtttggtagaattcaccaaggaagctgtctgggcctggagtttgttttgtaggaaagtttctaactataagtttgatttctgtggtagatagagggctgtacaagttatatgtacatctgtctgtgtgtgtgttgtctgtctgtcactctggccctgaagtgtgttttgtaggacagcatctaactacaagtttgatttccatggtagatggagggctatactagttatatatacatctgtctgtccgtccatctgtttgtcactccatccatccatctatctctagagtgagctttgatggtttgtgtctttcaaggagtttttctgttttatttaagtactcaaatttttcaaaatattattttcatacttgtagaatttgtagtggtgcaacctcttctattcctgatactggtaatgtctatatttttcttttaaccttgattggtttgggtagagatttatcaattttacaattttattgatcttaaagtacttggtattattgaattttctgttttctgatattttgggatttttcttttccattttgagttttactaatgccttccgcttttattggatttcatttcttttgctactttttaacatggaagctgaggtccttcatttcaaacctttgggtttttttcccctaatatggggaagagatgttaatgttaaaaatctatctgagaactgctttaattacctcccatcaagcttgatgtggtttcatttttttttttgagacagtgtcttgctctgtcatccaggttggagtgcagtggcgcgatctcggctcactgcaagctctgcctcctgggttcacaccattctcctgcctcagcctcccgagtagcttggactacaggcgcctgccaccatgcctggctaattttttgtatttttagtagagacgaggtttcaccgtgttagccaggatggtctcgatctcctgatcttgtgatccgcctgcctcagcctcccaaagtgctgggattacaggcgtgagcccagccgatgtggtttcattttagttgagtttaggatgttttccagttaaaaaaattcttcttgacacatggctctttttaaatgtatgttatttaattcctaaatatttggggattttgcttatctttctggtagtttctgcaataattccattgtggtcagagtacattaagacttgaattatttacatttattgagatttgctttgtggcccagaatatgggctatcttggtatgagttacatgttcacttgaaatgtatactgtactctcgtttgatgaaggggttctacaagtgttgattaggtaaaaatggttgatgttatttaagttttttctatctttattgacattctgtggttttggttccagcaattattttaagaggattgttgacatctctgaatattaaattggatttacttctctgcagttctgtcagattttgcttcacatattttagtatgtttttattaggtgaataataaatatttcctattttatgtcca

SEQ ID NO: 203755 - DNA, 587 bp, Homo sapiens
  Payload ID: 20187
  Gene Name: zinc finger protein 772
  ENST ID: ENST00000450712
  CDS Start-End: 212-430
attaatccactggtttagtttccagaacgcaatgtcagacctgaggtgacagaaaagggaaaacgtgagagagtgtcttcttccctgaagagaggtgggcctgaggcttgacagtggcgctgcctgagtgacctagccgctgggctgggccctggacagctgatcccaggttcctgcacttgtcgccacccttccgtagtccacaggcctgatggcggcggctgagccgatgggcccggcacaggttcccatgaactcagaagtaattgtggaccctatacaggtgaggggagaatgtccatgctctcaccgatcccacccccacccaatacgctctccagcattgtggtgttatatagaacactctcctgctactctccgatctcttgggtctgaggactctggagaagccccaagcccagggtcctgactccgggccaggggttttatggaggggtttccatttctgccaaccattggaataaggttggaaggttgttccaggcacaggaaccagcctgtgcaaaatacttagaggggcaggtgaactttgaggacgtgttcgtgtacttctcccaggaggagtg

SEQ ID NO: 203756 - DNA, 1601 bp, Homo sapiens
  Payload ID: 20187
  Gene Name: zinc finger protein 772
  ENST ID: ENST00000425074
  CDS Start-End: 258-386
gggacttcctctaccatcctcgggtggacattttgtttgcttttccattaatccactggtttagtttccagaacgcaatgtcagacctgaggtgacagaaaagggaaaacgtgagagagtgtcttcttccctgaagagaggtgggcctgaggcttgacagtggcgctgcctgagtgacctagccgctgggctgggccctggacagctgatcccaggttcctgcacttgtcgccacccttccgtagtccacaggcctgatggcggcggctgagccgatgggcccggcacaggttcccatgaactcagaagtaattgtggaccctatacaggttgttggcatggaatggaggatgaagagataccttttgagcagagcttttctataggaatgtcacagatcaggattcccaagggaggtccttctactcagaaggcttacccctgtgggacatgtggcctggtcttaaaagacattttgcacttggctgagcaccaggaaacacacccagggcagaaaccatacatgtgtgtgctgtgtgggaaacagttctgcttcagtgcaaaccttcaccagcaccagaagcagcacagtggagagaaaccctttagaagtgataagagcaggccctttcttctgaacaactgtgctgtgcaatcaatggagatgtcttttgtgacaggggaggcttgtaaggacttcctagccagctcaagcattttcgagcaccatgcccctcacaatgagtggaagccacacagcaacaccaagtgtgaggaggcctctcactgtggaaaaaggcattacaaatgcagtgaatgtgggaaaaccttcagccgcaaagactcacttgttcaacaccagagagtccacactggagaaaggccttatgagtgcggtgaatgtgggaaaacctttagccgcaaacccatacttgctcagcaccagagaatccacactggagaaatgccttatgagtgtggcatatgtgggaaagtttttaatcatagctctaaccttattgtacatcaaagagtacacactggagcaaggccttacaagtgcagtgaatgtgggaaagcctatagtcacaaatctacacttgttcagcatgagagtatccatactggagaaaggccatatgagtgcagcgaatgtggaaaatactttggtcacaaatacagactcattaaacattggagtgttcatactggagcaaggccttatgagtgcatcgcatgtgggaagttctttagccaaagctctgaccttattgcacatcaaagagttcataatggtgaaaagccttatgtgtgcagtgaatgtggaaaagcctttagccacaaacatgtacttgttcagcatcatagaattcacactggagaaaggccatataagtgcagtgaatgtgggaaggccttcaggcagagggcttccctcatccgccactggaaaattcacactggagaaaggccttaggatgggagataattccgtttccttgttcaacataataactgacatcagagagaagctccaagcatagcctttatgtgtagccgacagccagaagtagaactttatacactcaaacactcaccct

SEQ ID NO: 203757 - DNA, 737 bp, Homo sapiens
  Payload ID: 20187
  Gene Name: zinc finger protein 772
  ENST ID: ENST00000600175
  CDS Start-End: 243-359
atcctcgggtggacattttgtttgcttttccattaatccactggtttagtttccagaacgcaatgtcagacctgaggtgacagaaaagggaaaacgtgagagagtgtcttcttccctgaagagaggtgggcctgaggcttgacagtggcgctgcctgagtgacctagccgctgggctgggccctggacagctgatcccaggttcctgcacttgtcgccacccttccgtagtccacaggcctgatggcggcggctgagccgatgggcccggcacaggttcccatgaactcagaagtaattgtggaccctatacaggaacacgagctgaacaactactcatgcaagaaagcacattcataagaaccagaaaactagatgagtgatcggagtacctgattttaacataatatcaagaagaaaggcattgaagtgggtaggaaaggtagtcttgcattgcttaaaccacccctttcccatcccttggcagaccaacatgcagagaaaaatctgtgtgcttgtagaagagagcacgaagtgagtgtgggactgcattggaacctggtgctgcccaggcacagaagaacacaacacggcacaattctacttgtgcccatggagacagcatttacaccagcctggggccagaagcaaattcctttcaacccccgtgaaaggaacctgagtctcagctggcaccaccaacagctgaccgaagtggcctggggcccagaataagtt

SEQ ID NO: 203758 - DNA, 482 bp, Homo sapiens
  Payload ID: 20187
  Gene Name: zinc finger protein 772
  ENST ID: ENST00000601768
  CDS Start-End: 196-273
agtttccagaacgcaatgtcagacctgaggtgacagaaaagggaaaacgtgagagagtgtcttcttccctgaagagaggtgggcctgaggcttgacagtggcgctgcctgagtgacctagccgctgggctgggccctggacagctgatcccaggttcctgcacttgtcgccacccttccgtagtccacaggcctgatggcggcggctgagccgatgggcccggcacaggaacacgagctgaacaactactcatgcaagaaagcacattcataagaaccagaaaactagatgagtgatcggagtacctgattttaacataatatcaagaagaaaggcattgaagtgggtaggaaaggtagtcttgcattgcttaaaccacccctttcccatcccttggcagaccaacatgcagagaaaaatctgtgtgcttgtagaagagagcacgaagtgagtgtgggactgcattggaacctggtgctgcc

SEQ ID NO: 203759 - DNA, 1554 bp, Homo sapiens
  Payload ID: 20187
  Gene Name: zinc finger protein 772
  ENST ID: ENST00000610548
  CDS Start-End: 301-1554
gggcgggacttcctctaccatcctcgggtggacattttgtttgcttttccattaatccactggtttagtttccagaacgcaatgtcagacctgaggtgacagaaaagggaaaacgtgagagagtgtcttcttccctgaagagaggtgggcctgaggcttgacagtggcgctgcctgagtgacctagccgctgggctgggccctggacagctgatcccaggttcctgcacttgtcgccacccttccgtagtccacaggcctgatggcggcggctgagccgatgggcccggcacaggttcccatgaactcagaagtaattgtggaccctatacaggggcaggtgaactttgaggacgtgttcgtgtacttctcccaggaggagtgggtgctccttgatgaggctcagaggctcctgtaccgtgatgtgatgctggagaactttgcacttatggcctctctgggacatacatctttcatgtcccacatagttgcctcactggtgatgggtagtgagccctgggtacctgactgggtggacatgaccctagctgttgccacagagactccaggtgggagttgttggcatggaatggaggatgaagagataccttttgagcagagcttttctataggaattgcaaaccttcaccagcaccagaagcagcacagtggagagaaaccctttagaagtgataagagcaggccctttcttctgaacaactgtgctgtgcaatcaatggagatgtcttttgtgacaggggaggcttgtaaggacttcctagccagctcaagcattttcgagcaccatgcccctcacaatgagtggaagccacacagcaacaccaagtgtgaggaggcctctcactgtggaaaaaggcattacaaatgcagtgaatgtgggaaaaccttcagccgcaaagactcacttgttcaacaccagagagtccacactggagaaaggccttatgagtgcggtgaatgtgggaaaacctttagccgcaaacccatacttgctcagcaccagagaatccacactggagaaatgccttatgagtgtggcatatgtgggaaagtttttaatcatagctctaaccttattgtacatcaaagagtacacactggagcaaggccttacaagtgcagtgaatgtgggaaagcctatagtcacaaatctacacttgttcagcatgagagtatccatactggagaaaggccatatgagtgcagcgaatgtggaaaatactttggtcacaaatacagactcattaaacattggagtgttcatactggagcaaggccttatgagtgcatcgcatgtgggaagttctttagccaaagctctgaccttattgcacatcaaagagttcataatggtgaaaagccttatgtgtgcagtgaatgtggaaaagcctttagccacaaacatgtacttgttcagcatcatagaattcacactggagaaaggccatataagtgcagtgaatgtgggaaggccttcaggcagagggcttccctcatccgccactggaaaattcacactggagaaaggccttag

SEQ ID NO: 203760 - DNA, 1506 bp, Homo sapiens
  Payload ID: 20187
  Gene Name: zinc finger protein 772
  ENST ID: ENST00000615214
  CDS Start-End: 262-1506
gggcgggacttcctctaccatcctcgggtggacattttgtttgcttttccattaatccactggtttagtttccagaacgcaatgtcagacctgaggtgacagaaaagggaaaacgtgagagagtgtcttcttccctgaagagaggtgggcctgaggcttgacagtggcgctgcctgagtgacctagccgctgggctgggccctggacagctgatcccaggttcctgcacttgtcgccacccttccgtagtccacaggcctgatggcggcggctgagccgatgggcccggcacaggggcaggtgaactttgaggacgtgttcgtgtacttctcccaggaggagtgggtgctccttgatgaggctcagaggctcctgtaccgtgatgtgatgctggagaactttgcacttatggcctctctgggacatacatctttcatgtcccacatagttgcctcactggtgatgggtagtgagccctgggtacctgactgggtggacatgaccctagctgttgccacaggttgttggcatggaatggaggatgaagagataccttttgagcagagcttttctataggaatcttcagtgcaaaccttcaccagcaccagaagcagcacagtggagagaaaccctttagaagtgataagagcaggccctttcttctgaacaactgtgctgtgcaatcaatggagatgtcttttgtgacaggggaggcttgtaaggacttcctagccagctcaagcattttcgagcaccatgcccctcacaatgagtggaagccacacagcaacaccaagtgtgaggaggcctctcactgtggaaaaaggcattacaaatgcagtgaatgtgggaaaaccttcagccgcaaagactcacttgttcaacaccagagagtccacactggagaaaggccttatgagtgcggtgaatgtgggaaaacctttagccgcaaacccatacttgctcagcaccagagaatccacactggagaaatgccttatgagtgtggcatatgtgggaaagtttttaatcatagctctaaccttattgtacatcaaagagtacacactggagcaaggccttacaagtgcagtgaatgtgggaaagcctatagtcacaaatctacacttgttcagcatgagagtatccatactggagaaaggccatatgagtgcagcgaatgtggaaaatactttggtcacaaatacagactcattaaacattggagtgttcatactggagcaaggccttatgagtgcatcgcatgtgggaagttctttagccaaagctctgaccttattgcacatcaaagagttcataatggtgaaaagccttatgtgtgcagtgaatgtggaaaagcctttagccacaaacatgtacttgttcagcatcatagaattcacactggagaaaggccatataagtgcagtgaatgtgggaaggccttcaggcagagggcttccctcatccgccactggaaaattcacactggagaaaggccttag

SEQ ID NO: 203761 - DNA, 2206 bp, Homo sapiens
  Payload ID: 20188
  Gene Name: zinc finger protein 773
  Uniprot ID: Q6PK81
  ENST ID: ENST00000282292
  CDS Start-End: 141-1469
cgctgcggcgaccagctccggaaagcgcggtggggacgcgctgtgttctcgcagctcagaggcgggtctgaggctcggtggcggcgcccagggtggcccgggccctttcctcggtcgttgtctcaccgccacaggctccgatggcggcggccacgctgagggaccccgctcagcagggctatgtgacctttgaggacgtggctgtctacttctcccaggaggaatggagattgcttgatgacgctcagaggctcctctaccgcaatgtgatgctggagaactttacacttctggcctctctgggacttgcatcttccaagacccatgaaataacccagctggagtcatgggaggagcccttcatgcctgcttgggaagttgtgacttcagccatactgagaggtagttggcaaggagccaaggctgaggcagctgctgagcagagtgcttctgtagaagtgcccagttcaaacgttcagcaacaccagaagcagcactgtggagagaaacccttaaaaagacaagagggcagggtcccagttttgaggagttgcagagtccacctatcagagaagtccttgcaaagcagggaagttgggaaggatcttctgaccagctcaggtgttctcaagcaccaggtgactcacacgggagagaagtcacataggagctccaaaagtagggaggcctttcatgctggaaaaaggcattacaaatgcagtgaatgtgggaaagcctttggtcagaaatatttacttgttcagcaccagagactgcacactggggaaaagccttatgaatgcagtgaatgtgggaagttatttagccataagtccaacctttttatacaccaaatagttcacactggagaaaggccttatgggtgtagtgactgtggaaaatcctttagccgtaatgctgacctcattcaacaccagagagttcacactggagaaaagccttttacatgcagtgaatgtggaaaagctttcaggcataattccacacttgttcagcatcacagaatccacactggagtaaggccttatgagtgcagtgaatgtggaaaattgtttagtttcaactccagcctcatgaaacatcagagagttcacactggagaaagaccttataagtgcagtgaatgtggaaaattctatagccacaagtccagccttatcaatcattggcgtgttcacactggagaaaggccttatgagtgcagtgaatgtgggaaattttttagccaaagctcaagcctcatgcaacatcgaaaagttcacactggagaaaaaccttttaagtgcaatgaatgtgggagattctttagtgagaattccagccttgttaaacatcagagggttcacactggagcaaagccttatgagtgcagggaatgtgggaaattttttcgccacagctccagtcttgttaaacatcgaaggattcacactggagaaatacaatgattgtgagaaatcctttagctggtgtttcaacctcattcaacaccagaaagttcacagtgtaaaaaagtcttgaaggttactaatggaaatccattagctatacctccaaactcattcaacactggacagttcacagagtggacaatgtagtgaatatggtaaaaggcctcagccaaaggcctaaccgtattcaacaccagaaagtttagactggagaaaggccttagactgtcgctgaatcaatatgacctgacttaaagcagaaacagccaggcgtggtggctgacacctgttattctcaccactttgggaggctgaagcgggcggatcacaaggtcaggacatcgaaaccatcctggttaacacaatgaaaccacatctctactaaaaatacaaaaatttactgggcatggtggtgggcgcctgtagtcccagctactcaggaggctgaggcagaagaatggcatgaacctaggaggcagagtttgcggtgagctgagatcacgccactgcactccagactgggtgacagagtgagactctgtctaaaaaaaaaaaaaaaaaaaattagcccggcgtggtggcaggcaactgtagtcccagctacttggggggctgaggcaggagatttgcttgaacccgggaggcggaggttgcattgagccgagatcacgccactgcactccagcttgggtgacagagtgagacttcgtctcaaaaaaaaaaaaaaaaaacaa

SEQ ID NO: 203762 - DNA, 5832 bp, Homo sapiens
  Payload ID: 20188
  Gene Name: zinc finger protein 773
  ENST ID: ENST00000599847
  CDS Start-End: 143-496
ttcgctgcggcgaccagctccggaaagcgcggtggggacgcgctgtgttctcgcagctcagaggcgggtctgaggctcggtggcggcgcccagggtggcccgggccctttcctcggtcgttgtctcaccgccacaggctccgatggcggcggccacgctgagggaccccgctcagcagggctatgtgacctttgaggacgtggctgtctacttctcccaggaggaatggagattgcttgatgacgctcagaggctcctctaccgcaatgtgatgctggagaactttacacttctggcctctctgggacttgcatcttccaagacccatgaaataacccagctggagtcatgggaggagcccttcatgcctgcttgggaagttgtgacttcagccatactgagagtttggctgcgtaacaggtcggcaaatctcctcactcagatattcttcccgaaccgacagccacaagtggcgcccgaacagggacgtgagtgaagaaggtctgctggagcagagaaagtgaaactgaccagaagaatgagaaaccccaggacaagtctgctggcagtggatataaggtcagtgccctaaagaggtactgggagtgggaagtttctgaatcagggtaacatagggcagaatttgtctgctgaagagcaacattatatgcagtcacttaaaggtttacttaaacaatctggtgctcaggttagttctcaaacactagctaagctgctgcaggaggttatcacgcataacccatggtttccacagacagacactcttgatgtggaaaactggggtgaagatttgcttacggcataggatatgagacttacaaattaaactattggcaatccaggatttaaaatgttaaagaaaatgagatatcagagcagacaaggcttaggaaagtccctacaggaaaaccctgatcctatatcaataactgggcaaacagatagaaaagggctaggtcgtcagatttctgatgtgggtcattgatatttctcctccacccactgctttgccactagagtggctaacaaacctgtatgggtggatcaatggcccctttcacaggagaaactaactcaactccatcagctagtaaaagagcgattggatgcaggacatattgaagagtcagcccctggaattcaccagtatttgtaataccaaaaaagtcaggaaaatggggactgctacatgatttgagagctattaatgcacagattaaaccaatgggtgcattacagcaaggtctgccatccctggcaggcatttccaagagactggcctcttgtagtaatagatcttattgttttttttactatactattacatcagcaggataggcctggatatgccttctctgtgccttctgttaatcaaagggagcctgtctcttgttatcaatggaaagttttgccccaaggcgtgcttaacagtcctacattatatcagaattttgtaggacaggcattaaaggagccttgtaatgtgtttcccactggctatgtcattcattatatggatgatattcttttggccgctcctacagatcaaatcttacatcagttattcagagaaacaaaacaggctttgactaaatggaatctcaaaatagctcctgaaaaggtgcaaaccacctccccataccagtacttaggcactattattactgaaagaagtgttcagcctcagaaagtagtcatctgtagggacagattacaaactttgaatgatttccaacaattatcaggggacattaattggctgcacccaatgctaggtattgctacttattaactcaaacacctttatcagaccctccaaggagattcttcattagactctcctcggcaacttactaaggaggcagaagctgaattatagcttgtagaacagatgcttcagcaacaacatgccacctggttacagccacaaaagcctttgcttctgtttattcttcctacctcccattctccaacaggacttttaggccaattcatacacaaatctgtaatagtattagaatggcttttttatccaatcagacagtgaaatctttgcaaatttatctttctttaattactcaacttataacaataggtaggcatagatcaaaaatgtttatgggatgtgatccagacaaaattattgttcccttggattcccaacaacaggccacagcatgggaaatgtcgactgcatggcaaatcactctcacagattttgtaggaataatagataaccattatccatcagacaaaattttgcaattttatgaagttcacccttttacccttcctgtaatcactcatcacaagcctattccaggcagacagacctattttactgatgactcttctaaaggctgtgcagctatttatggacctaagcatactgaaacaataaagacctctggagtttcagctcaatgctcagaattagtggcagttattcaagttttacagctcaccgctttatctcctattaacattgtctgtgattcagcctatattgtaaatgtagccagtcacattgagactgccactattaaaagcaccctagaaccagagctgtataatttgtttctaagacttcaacaagctgttcactctcatgctgctccttttcatatttctcatatttgctatcacacacaacttcctggaccactatctctaggtaacaataaagcagataaactaatcggttctgtatttcaacaagcccaatcttctcatgcattcctgcatcaaaacacctctgcccttactcgtatgtttcatctgccttgcagccaggcttgagctattgcgcaagcctaccccacttgccagcctgtccctggcgttgcacccatggaaggatgtaacccactaggcttggctccatatgaaatctggcagatggatgttacacatatagcagcctttggcaaactcagctatgttcatgtgactacagacacttactcccatatgctacatgtcacgtgccaaactggggaaacagctggtcatgtctgatgacattgtctgtcaccttttgcccatatgggggtccctacacaatgaaaaactgacaatggacctgcttatgttagtcatgcttttcaaaattttttacagttatgggcaatcactcataaaacagaaattccttacaatcctcaaggacaaggaatcatagagtgggcacatcaaacattacaatgcatgttgaaaaaacaaaaatggggactaggagaccagctaccacctcaaacaaaattacatttagccttatttactttaaattttttgactcctggtatggatattaagactctggcagaatgacattggcaaatgttagagggaaaaaggaaagtttacccaaaggtattacagaaatccccggaagaaggacaatggaaaggcccggtagacttactgatatggggacgagggtttgcttgtgtttttacaggagatggacaatccgtgtgggtgccctcaaggtgtgtgtgaccatggaacgggagactggagaaatccatggatctcaactgtgggcccagctcctccagtacgagccatgagctagttgaatctgaatgcaaagacagaacaaggaccgactggagtcacactgacatcaacccccataaaatggggacagctcaagaaaaccacacaggaagctgagaaactgctggagcaaaacccctgactccatgtttatggccatgctagctgtaatatcctgtgcggtatgttttccctgtgcagaggcaaaaacttattgggcatatattcctaacccaccagtagtacgaccggtactcgggagcaacactcctcctgagatatatcatgatcagggagcatggacaccaggacccctaactccccctgacagagagtgattagattctcagaacaatggtatcaattatactgcaccattggagggacttctttatgtgtcacccaggatgcatcactcaaccgcagttgccttgcaattcagtcccaagcatgcttgagttaccatggaaaaattatgtacctattaggccttagctctattaatattactggtgtagttactaatcactcctggccccatcacccaaattgtattgattgtacagaatgggctccctttgataattctcacccctgtccttggactcagtgtcttggccccttagctaaacaacagtccatgttaatgggagacattatcgactggggtccccatggtcatttagatgggagaagtgagaatcagacctcatggcataaattttgctggcactggtggcgaaacttgaacatctcttcgctacatcccaatctgctacacaacttgcttggcacagaatgggctttagcccacctttgcctcaatggcattatcaaggaaagagaggtccaattcaggagtcaatatggaagacagcactcccatttatgaatggcagcatttgggttgggacactatccaataatagtaataatgctcaatgcagttttaatgttacctttgtagaaaatactaccacacagtttacaatttgtatttttaatccgtatgtttttctagcagcaaaaaaggaccaactccgggtaaacaatgcccaatcgatttgtgatgcctgtcaactgtatcattgccttaatcatagcacaatacaaacacacagcatatccaccctaataattctaggtcacattcctggattatagattcctgtaaatctgtccgagccttgggaggccacccccgctttacattttgtaaaactccttcttattcagcttactcatcgtgctcgtagagctttaggcatgataatttttgctataatttccctagtcacactaataacctctgctgtgttgtcctcagtagcactgcacagctccattcaaacagctcaatgtgtgaaaaattggatgtgcacagccgaccaggaatggatgcttcaaaataaaattaacaccaagatacaaacagaagtggcaatgttaaagactactgttctgtggctaggataacaaatacaaagcctgaagttgcagcagcaattgcattgtcattttaaccctattcatatttgtgtaactaatttggaatataatcaaagtgaatatccaaggaactttgtaaaggcccatttacagggagttttacattcaatgttacttttgatattaatgattcacaaagtaaaatccttaacttgaataagcagactcaagtgcttcagccctctttaaaagcttgggcagaattccagcaaggtttagggagccttaacccttggacctacttcaaacagcacctcaatgtcttttttgtgattatcggaataatgttattatgtttctgttttttgttcatagtctgtaaaatcagctggaccaccaaccggcaattgagagctgcacagcctgcaattacctttattcaattaatacaaaaacagaaaaggggggaggttggaggccgaaagaatgagggtcgtgaccaactcagtataccactggaggctatatgagcaaacagcaaactgttctcatgaatgcaggatgctggcaagctgacaactgcatctgccaccagaaggaatgctgagggcagtcataccccacgtgcagtgttccttgtggttatctataggaacatctggaggctgttgtataaagaaagcaattatgtgagcctgtgataaatcaagcagctgaccaaccattacctcttcctccctgttgattctacctaataaatacaaagggctgtagaagctcagggcccttgttccctagaag

SEQ ID NO: 203763 - DNA, 929 bp, Homo sapiens
  Payload ID: 20188
  Gene Name: zinc finger protein 773
  ENST ID: ENST00000597061
  CDS Start-End: 125-478
tccggaaagcgcggtggggacgcgctgtgttctcgcagctcagaggcgggtctgaggctcggtggcggcgcccagggtggcccgggccctttcctcggtcgttgtctcaccgccacaggctccgatggcggcggccacgctgagggaccccgctcagcagggctatgtgacctttgaggacgtggctgtctacttctcccaggaggaatggagattgcttgatgacgctcagaggctcctctaccgcaatgtgatgctggagaactttacacttctggcctctctgggacttgcatcttccaagacccatgaaataacccagctggagtcatgggaggagcccttcatgcctgcttgggaagttgtgacttcagccatactgagagtttggctgcgtaacaggtcggcaaatctcctcactcagatattcttcccgaaccgacagccacaagtggcgcccgaacagggacgtgagtgaagaaggtctgctggagcagagaaagtgaaactgaccagaagaatgagaaaccccaggacaagtctgctggcagtggatataaggagatggacaatccgtgtgggtgccctcaaggtgtgtgtgaccatggaacgggagactggagaaatccatggatctcaactgtgggcccagctcctccagtacgagccatgagctagttgaatctgaatgcaaagacagaacaaggaccgactggagtcacactgacatcaacccccataaaatggggacagctcaagaaaaccacacaggaagctgagaaactgctggagcaaaacccctgactccatgtttatggccatgctagctgtaatatcctgtgcggtatgttttccctgtgcagaggcaaaaacttattgggcatatattcctaacccaccagtagtacgaccggtactcgggagcaaca

SEQ ID NO: 203764 - DNA, 2019 bp, Homo sapiens
  Payload ID: 20188
  Gene Name: zinc finger protein 773
  Uniprot ID: Q6PK81
  ENST ID: ENST00000598770
  CDS Start-End: 147-1472
gttgttcgctgcggcgaccagctccggaaagcgcggtggggacgcgctgtgttctcgcagctcagaggcgggtctgaggctcggtggcggcgcccagggtggcccgggccctttcctcggtcgttgtctcaccgccacaggctccgatggcggcggccacgctgagggaccccgctcagggctatgtgacctttgaggacgtggctgtctacttctcccaggaggaatggagattgcttgatgacgctcagaggctcctctaccgcaatgtgatgctggagaactttacacttctggcctctctgggacttgcatcttccaagacccatgaaataacccagctggagtcatgggaggagcccttcatgcctgcttgggaagttgtgacttcagccatactgagaggtagttggcaaggagccaaggctgaggcagctgctgagcagagtgcttctgtagaagtgcccagttcaaacgttcagcaacaccagaagcagcactgtggagagaaacccttaaaaagacaagagggcagggtcccagttttgaggagttgcagagtccacctatcagagaagtccttgcaaagcagggaagttgggaaggatcttctgaccagctcaggtgttctcaagcaccaggtgactcacacgggagagaagtcacataggagctccaaaagtagggaggcctttcatgctggaaaaaggcattacaaatgcagtgaatgtgggaaagcctttggtcagaaatatttacttgttcagcaccagagactgcacactggggaaaagccttatgaatgcagtgaatgtgggaagttatttagccataagtccaacctttttatacaccaaatagttcacactggagaaaggccttatgggtgtagtgactgtggaaaatcctttagccgtaatgctgacctcattcaacaccagagagttcacactggagaaaagccttttacatgcagtgaatgtggaaaagctttcaggcataattccacacttgttcagcatcacagaatccacactggagtaaggccttatgagtgcagtgaatgtggaaaattgtttagtttcaactccagcctcatgaaacatcagagagttcacactggagaaagaccttataagtgcagtgaatgtggaaaattctatagccacaagtccagccttatcaatcattggcgtgttcacactggagaaaggccttatgagtgcagtgaatgtgggaaattttttagccaaagctcaagcctcatgcaacatcgaaaagttcacactggagaaaaaccttttaagtgcaatgaatgtgggagattctttagtgagaattccagccttgttaaacatcagagggttcacactggagcaaagccttatgagtgcagggaatgtgggaaattttttcgccacagctccagtcttgttaaacatcgaaggattcacactggagaaatacaatgattgtgagaaatcctttagctggtgtttcaacctcattcaacaccagaaagttcacagtgtaaaaaagtcttgaaggttactaatggaaatccattagctatacctccaaactcattcaacactggacagttcacagagtggacaatgtagtgaatatggtaaaaggcctcagccaaaggcctaaccgtattcaacaccagaaagtttagactggagaaaggccttagactgtcgctgaatcaatatgacctgacttaaagcagaaacagccaggcgtggtggctgacacctgttattctcaccactttgggaggctgaagcgggcggatcacaaggtcaggacatcgaaaccatcctggttaacacaatgaaaccacatctctactaaaaatacaaaaatttactgggcatggtggtgggcgcctgtagtcccagctactcaggaggctgaggcagaagaatggcatgaacctaggaggcagagtttgcggtgagctgagatcacgccactgcactccagactgggtgacagagtgagactctgtct

SEQ ID NO: 203765 - DNA, 548 bp, Homo sapiens
  Payload ID: 20188
  Gene Name: zinc finger protein 773
  ENST ID: ENST00000593916
  CDS Start-End: 167-472
actcagcttgccggaagctggttgttcgctgcggcgaccagctccggaaagcgcggtggggacgcgctgtgttctcgcagctcagaggcgggtctgaggctcggtggcggcgcccagggtggcccgggccctttcctcggtcgttgtctcaccgccacaggctccgatggcggcggccacgctgagggaccccgctcagggctatgtgacctttgaggacgtggctgtctacttctcccaggaggaatggagattgcttgatgacgctcagaggctcctctaccgcaatgtgatgctggagaactttacacttctggcctctctgggacttgcatcttccaagacccatgaaataacccagctggagtcatgggaggagcccttcatgcctgcttgggaagttgtgacttcagccatactgagagtcccgaaccgacagccacaagtggcgcccgaacagggacgtgagtgaagaaggtctgctggagcagagaaagtgaaactgaccagaagaatgagaaaccccaggacaagtctgctggcagtgg

SEQ ID NO: 203766 - DNA, 3202 bp, Homo sapiens
  Payload ID: 20189
  Gene Name: zinc finger protein 774
  Uniprot ID: Q6NX45
  ENST ID: ENST00000354377
  CDS Start-End: 187-1638
actttccggccgctggctgtcgaagccggagtcccacctgtgtccccacagccctgtcacgaatcccggtcgggttctgggaggcacagcctcggggttgcgggccgggtgcggctcggcggtggaggactcacttcctgctccatccccggctgggccctggggcggaactgatgacgcttgataatgtggctggggacttcagggaagagtgggttacctggacactgcttagagaatcctctccaggaatgccacccagcacagttagaagaatgggctctcaaaggaatttccaggcctagtgtaatctcccagccggagcagaaagaagagccatgggtcctaccactccaaaactttgaggcgaggaagatcccgagggaaagccacacagactgtgagcatcaggtggcaaagctcaatcaggacaattctgaaacagcagaacaatgtggaacatcctcagaaaggaccaataaagatctttctcatactcttagttggggaggaaactgggagcaaggcctagaattagaagggcaacatggaacccttccaggagagggccagctggagtccttttcacaggagagggatttaaacaagctcctggatggatatgtaggagagaagcctatgtgtgcagaatgcgggaaaagctttaaccagagttcctatctcataagacacctaagaacccacactggcgagaggccctatacgtgcattgagtgtgggaaaggcttcaaacagagctcagaccttgtcacccatcgcagaacacacacaggagagaagccctaccaatgcaaggggtgtgagaagaaattcagcgacagctcaacactcatcaaacatcagagaacccacacaggggagagaccctatgagtgcccagagtgtggaaagacttttgggcggaagccacacctcataatgcaccaaagaacccacacaggcgagaagccctacgcgtgcctggaatgtcacaaaagcttcagtcgaagctcaaatttcatcactcaccagaggacccacacaggggtgaagccttacaggtgtaatgactgtggggagagttttagccagagctcggatttgattaagcaccaacgaacccacacgggagaacggcccttcaaatgcccggagtgcgggaagggcttcagagatagttctcattttgtagctcacatgagcactcattcaggagagaggcctttcagttgtcctgactgccacaaaagcttcagtcagagctcacatttggtcacgcaccaaagaacacacacaggtgagagaccttttaagtgcgaaaactgtgggaaaggattcgccgacagctccgccctcattaagcaccaacgaatccacaccggagaaagaccctacaaatgtggagagtgtgggaagagcttcaatcagagctcccactttattacccatcagcgaatccacttaggagacaggccctatcgatgtcctgagtgtggcaagaccttcaatcagcgttcccatttcctcacacaccagagaacgcatacaggagaaaaacctttccactgtagtaaatgtaacaagagcttccgtcagaaagcgcatcttttatgccatcaaaacacccatttgatttaggaagtagtctttggtgttcagctgctcccttgcacattttcattgctactgtcttcaagcaccccaaatagagaaaacctgggcgtcagtggctcaatttgggccctgatctattctccctctttcttgtctatgttataacagagaggataaacttaaagggtccaaataacggtccgaatacaaaaggcattccttcagtgtgtgactgactcttagggaaatgtgagtttaatagttgatgcccgccaggcgtggtggctcacccctgtaatcccagcacttttgggaggccaaggtgggtggatcacttgaggtcaggagttgagaccagcctggtgagcatggtgaaacctcatctctactaaaaatgcaaaaattagctgggcatggtggcacgtgcctgtagtcccagctactcgggaggccgaggcagaagaatcatttgaactcagaaggtgcaggttgcagtgagttgagatcatgccactgcactccagcctgggcaacagagagagactctgtctccaaaaaaattaaaaagttgatgcctagttactaaatgagaagtgagaaaaatgtggcctagagatcacatgttcaccacctagtacagtgcctggcacaacatagatgctcaataactaaatggtcccatcattattaatgattaatagttgaggtcttatataaaggctttaatgcagtacctggcccttaaaagacactcagtacaagattggtggcttttatcagtcttattactcaattagaaatttattagtgtagtccccccgccccaaactcagaacgtgaaagaaattagattggaactagaaggtttggggttggaatacacaaattgaataaaatggaaatgcactgccagttcagtgctgtgcaggcattagtcaccagaggtctcactgccatgacaaggccaaattatcgtagaggatgtttgcggtcttgtgacttggaggctgaaagaatttcagaagctcttttaaatggcagtgtatggcagtgtatctaccagaggtttgctgtcatctgacacagagaaaatatcctacaatgaacaagccagagggacctggtagaggactataaaattgtggaagcaaaattgctgagaatgtcaaatgatattacagggatcctccctggcatttagctgaaggaagcaactcttgttttctaatttgctgggtcattggccatttagttttaggttaatataattctctgatccttttagggccatccaggttatgcactagtacattcctacattcaattgaaataaattgagggacggcaagtgtgttggaaagaacaccgacttcattgagaaggtaaagtatttgagtcctggccctgacgcttaatttggccagactttcatcttctcccagcctcaagttttacctacctcacaaggttgttgtgaggatctaaaaatacacacacacacacacacacacacacacacacacacactttgttggttaactataaatgtaatatctctatgttataattctgttgctaatgtcttttt

SEQ ID NO: 203767 - DNA, 5613 bp, Homo sapiens
  Payload ID: 20189
  Gene Name: zinc finger protein 774
  ENST ID: ENST00000379090
  CDS Start-End: 92-355
ggttgcgggccgggtgcggctcggcggtggaggactcacttcctgctccatccccggctgggccctggggcggaactgatgacgcttgataatgtggctggggacttcagggaagagtgggttacctggacactgcttagagaatcctctccaggaatgccacccagcacagttagaagaatgggctctcaaaggaatttccaggcctagtgtaatctcccagccggagcagaaagaagagccatgggtcctaccactccaaaactttgaggcgaggaagatcccgagggaaagccacacagggccatccaggttatgcactagtacattcctacattcaattgaaataaattgagggacggcaagtgtgttggaaagaacaccgacttcattgagaaggtgaagtcttgctctgttgcccatgctggagtgcaatggcatgatcttggctcactgcaacctctgcctcccaggttcaagcgattctcctgcctcagcctccggagtagctgggattacagatgcatgtcaccatgcccagctaattttatatgttaagtagagacggggtttcaccatgttggccaggcgggtcttgacctcctgacctcaggtgatccacctgccttggcctcccaaagtgctgggattacaggcgagagccacctcacctggccacctatcactttgattttcatgttgtttggctatggtaaaatgtgagctctcgaagggcaatgtgagatttgctttgtggccctgccaatcccctccctcctccctgtcttcctgcccacccccccccactcccccgccagccatgagcagggaatatttcaatgctattgctgagagtggaggtaaccctttctatagttttcttttgtttctacctcatgactagatgattcactgcttgaacatgctccacacatccgttctttctcactccaaaattgaggtcatcaccaagccccattaattttacctcccagattcctctcgaacctatctgtcaaatctgtccatcttcactgccacccttcagtaccaaatgaccagtctcttacctgaattcctgtagcagcctccaaactgatcttcctgatatgatttttgctctgaaaaaactggtttcactcacagaaaccagagtgaacttttaaaatcctaaatcgaatcacatcacttctcagcagctttccattgcttttagaatgaagacccaaatccttacccaggcctaagaggcccttgtggttttgtcccctccccctccatcctcttgtgatatccccttccctctcccttgcctcacctcagcactcttgagttctctgctccttggtcatgccaaggttgtgtgctctttagacccttggtactaactgttccctctgcccagaatgttcctcgcccagtcctttgtgttgcctcctatttgtcaaccaggtttcagcctaaacctatctccttaggaagactttccctaactatcccatctaaattagtcaccctccatcacattatcctcttttttcatcaaagtccttacacctgtctggcaatttcttattaattgatttgtttttggtaaactccacgaaaggtgggagtcatttctcttgtttccattctttccacagcacttagaacagtgcctggcacatggtaggtgctcaatatgtgtttactggatgaattaatgagtgcatgctcatgggcaaggatctcattgtgctggaaaagcagcagagtgagacaaaactggacaggtgagtgaaggtcacaccaagaaggttcttagctgccaaactaaagggtttggatcttactctctggagaaaagggtgtagctagtggttttataggagaggagaggcgcgatccgcacttgagaaggtcaatttggccgctgtgtgtaggtcatattacggagaaaaaaactaaaggctttgagacaatccatgatgtaaagggcttagcacagtgcccagcacgcagtaggtctccagcgagtcgttatcaccaagcaccagggcaggcaccacaacaaaaagataagatccctaacccttcttttacctcgaaataattcctcctagaccctatcatcgcattccttctcttccccttttgtcaaacttccactcacatgtagatattctcagggttatcatgcctaggcctttttaatagggccacttaccctagcatgcttctacaactggaccctcaaaggtcttttagggctgagtgtggtggctcacacctgtaatgccagcattttgggaggccgaagccagaggactgcttgagcccagaggttcaagaccagcctgggcaccatagccagaccctgtctctacaaaaaatagtttcaacaaattagccaggcatggtgatgtgcgcctgtcatcccaagtacttgggaggctgaggtgggaggattgcggattgcctgagcccaggagttcaaggctgcagtgagctgtgatcataccaccgtactccagattgcgtgacagagctagaacttgtctcttaaaaaaaaaaaaagacttaatttccacatctgaaggcctcttgttagtcttcttctgattcaacaactctttactgtttgatgccatttacatatgtttattattttttagagatggggtctcattcttttgctgaggctggagagcagtggtgcgatcatggctcactgcagcctcaacctcccagactcaagcaatcctcctgtctcagcctcctgagtaacagctaggactacaggcacatgccaccaagcccggccttttaaaatttttggtagaggccaggtgtggtggctcatgcttgtaatcccagcactttgggaggtccaggcgagtggatcacctgaggtcaggagtttgagaccagcatggctaatatggtgaaaccccgtctctagtaaaagtacaaaaattagccaggcgtggtcgtgggcgcctgtgatcccagctactcgggaggctgaggcaggagaatcacttgaacctgggaggcggaggttgcagtgagctgagatcgtgtcattgcactccagcccaggtgacaagagcgaaactccatctccaataataataataataataataataataactttgctagagacagggttcccctatgttgcccaggctggtcttgaactcctgacctcaagcaactctcccaccttggcctcccaaagcgctgggattacaggtgtgagctactgcaccaggcccatatgcctttttaaaaaaattatcttttccattggtgactatgaggttgagagatgattctcctacatttctggctgctcctcttcaagtaccttccctggctcctctggatttttttgttttgttttgttttgttttgttttgtttttgagacaaagtcttgctttgttgcccaggctggagtgcagtggcaggatcttggctcaccagctcactgcaacctccacctcccaggttcaagggattctggtgcctcagcctccagagtagctgggactacaggcccagctaatttttgtacttttggtagagatgggggtttcaccaggctggtcttgaactcctgcctcaggtgatctgcccacctcggcctcccaaagtgctgggattctaggcatgagccaccgcgcctggcctggctcctcttcttcttccactcagatatgcctgaccctgtcaacactttggttgaggtcttctttcttctttcttttttgctccgcacatttagcttatgacttcaaccatcatttctcagagcatgggtctggctcaacctctctcctgaatttcagacctacaagtctagctacttggtggagacctccccagaatgacctgctgcttcccaaaagcagactctccaaattacagtcagtatctcccccggaagcattcccccaggcatttctctttctgccttcaattccccattctcctacattgccttgccagaagcctgctggtcagcttggatttctttttgtccttttttttctatattttgctggtgcctagtcatgtagttgctgcctctacactttctcttctttaaaaaaaattattaaagcaccacgtgcttgttgtaaacatttccagaaaatacagaagtgctcaaagtgaaaaaatggaaatgccttgtcccttcctcattccctgccctaacctcacgccccagattcagctatgtaatagtctgtcatgccaagtcttatttccagctcctcttttccatccccactgccatcatctgaactaaacggattgttttccatctggtctccttggcttttcctttcagtgcagctcaacagacattaatcaagtgccttccacacaccaaagtcctaccctagatcctagaggttcagagacaagtaagatagttaaagagatccacattccagagctgtttaactttgggcaagttacttaatctctctgacccttacttccttatctgtaaaatgatgctaatcccagcacctttttcatgggtttggacgagcattaatgagatgatccatgtaaaactctttgtactaactacctggtacactgtatctgctccataaatgtcagtgacaacaatgataataatgacaatgtttggaggagtttatagcttaatggagagacttaaagcataagaattatctaggcgaagaatgatgagaaaatatttttggaaaaggaaaacaaacagttctactaaaattaaaaggctgatgtagagacttgggaaactgggaggtaagagctcggactgtgtcctctaagacagtaattcccgaagtgtgagcaaaagtccacctgcatcagtcttacttggggtgattgctcaaaatgaggatttaatggctgcacctccgagcaagttggtaatttacatatcggaatgctatccatcaaggaaaatgggcagactacagttacatgcatcaacacagacaagcttcaaacaatattgagtgtaaaaagcaagacatagaaatatatatttagtaagagtaaaaatacagtaaaggtaaaaaagaggcaaaactaaacaatatattgcttaagcaataaggatacacaaactaatgaaaatcaaaggatttactaatacaaacttcagtatagtaattaattggaatgggagagaaagatgcaaagtttctatttctttttttgttttgttttgagacagtgtctcattctgttgccaaggcaggagtgcagtggcaggatctcagatcactgcaagctcagcctcctgggttcaagtggttcttctgcctcagcctcccaagtagctgggattacaagcatgcaccaccacacccagctaatttttgtaattttagtagagatggagtttcaccatgttggccaggctggtctcgaactcctggtcttaagtaatccgcccacctctgccatcaaagtttctgtttcttaagttggctgccgagtacacaggttttctttgtaaaataattatttaaattgttaatatgcattacttatatgcttttcatttacaatgtatttcacaagaaaaataaaacaaagcaaataagaaaac

SEQ ID NO: 203768 - DNA, 541 bp, Homo sapiens
  Payload ID: 20189
  Gene Name: zinc finger protein 774
  ENST ID: ENST00000560038
  CDS Start-End: 129-263
acgaatcccggtcgggttctgggaggcacagcctcggggttgcgggccgggtgcggctcggcggtggaggactcacttcctgctccatccccggctgggccctggggcggaactgatgacgcttgataatgtggctggggacttcagggaagagtgggttacctggacactgcttagagaatcctctccaggaatgccacccagcacagttagaagaatgggctctcaaaggcctgggttggactctcacctctgccacttaacttctgagacttctgaggtctttgtggaaaaggagaatttccaggcctagtgtaatctcccagccggagcagaaagaagagccatgggtcctaccactccaaaactttgaggcgaggaagatcccgagggaaagccacacagactgtgagcatcaggtggcaaagctcaatcaggacaattctgaaacagcagaacaatgtggaacatcctcagaaaggaccaataaagatctttctcatactcttagttggggaggaaactgggagcaaggcctaga

SEQ ID NO: 203769 - DNA, 284 bp, Homo sapiens
  Payload ID: 20189
  Gene Name: zinc finger protein 774
  ENST ID: ENST00000558586
  CDS Start-End: 49-284
ctgatgcacattgaggtctcttgctttaggaactgatgacgcttgataatgtggctggggacttcagggaagagtgggttacctggacactgcttagagaatcctctccaggaatgccacccagcacagttagaagaatgggctctcaaaggaatttccaggcctagtgtaatctcccagccggagcagaaagaagagccatgggtcctaccactccaaaactttgaggcgaggaagatcccgagggaaagccacacagactgtgagcatcaggtggcaaagct

SEQ ID NO: 203770 - DNA, 2257 bp, Homo sapiens
  Payload ID: 20190
  Gene Name: zinc finger protein 775
  Uniprot ID: Q96BV0
  ENST ID: ENST00000329630
  CDS Start-End: 108-1721
ggtgcccaagtcgccctcggggtggcagttcccgttaaccttagccacaaagtcaaagatggcaggaaagggacacagccggcgctgatgctgggaggcctccagggatggagagtggcctggctggcaacggcacaggagctgggctggtgatgaaggtcaagcaggagaagccggagcggctgctgcagacgctggcgccgcaggccatgcttgtggagaaggacaaggagaacatatttcagcagcaccggggcctcccgccacgccagaccatggggcggcctcgagccctggggggacaggaggagtctgggagtccaaggtgggcccctcccactgagcaggatgcggggctggcaggccgggctcccgggtcagcctccggccccctgagcccctcgctttcctccggcgagggtcactttgtatgcctggactgcgggaagaggttcagctggtggtcgtccctgaagatccaccagcgcacccacaccggggagaagccgtacctctgcggcaagtgcggcaagagcttcagccagaagccgaacctggcgcgccaccagcggcaccacacgggcgagcgacccttctgctgccccgagtgcgcgcggcgcttcagccagaagcagcacctgctcaagcaccagaagacccactcccggcccgccacccactcgtgccccgagtgcgagcgctgcttccgtcaccaggtgggcctccgcatccaccagcgcgcgcacgcccgggaccgccagggctcccgcgccggcctgcacgagctgattcaggacgcggcggcgcgccgggcctgtcgcctgcagccggggccgccgcgggggcgccccgagtgggcctggctggggctctgccagggctggtggggccagcccggggcccgggccgcggtctccggccccgaggggccgggcgagccgcgccagttcatctgcaacgagtgtggcaagagcttcacctggtggtcgtcgctgaacatccaccagcgcatccacactggcgagcgcccctatgcgtgccccgagtgcggccgccgcttcagccagaagcccaacttgacgcggcacctgcgcaaccacacaggcgagcgcccgcacccctgcccgcactgtggccgcggcttccgccagaagcagcacctgctcaagcacctgcgcacgcacctgcccggcgcccaggctgcgccctgccccagctgcggtaagagctgccgcagccgcgccgcgctgcgcgcccaccagcgcgcccacgctgtcgctgagcccgccgttccggccggggaaccgggcgaccagccgcaggccgaggccatcccgggcttggccgcgaggccgcggagctcccaacggtccccgggggcccgggacacgctgtggggccggggacaagcgggcctcgctgggcctggcgagccgcgccagttcatctgcaacgagtgcggcaagagcttctcgtggtggtcggcgctcaccatccaccagcgcatccacacgggtgagcggccctacccgtgccccgagtgcggccgccgcttcagccagaagcccaacctgacgcggcaccggcgcaaccacacaggcgagcggccctacctgtgtcccgcctgcggccgcggcttcagccagaagcagcacctgctcaagcaccagcgcgtgcaccgcgcggcccctgcgtgcagccccaaggaggaggcgcgctagtggactggacctcagcggacccgtggtggtgcgggggatgtttgcggggtgtgtgtggggagtgggggtggccaggattgctggctcttagaaccccttagagcgggaccggtggattccttaaggctctgaagggctgagaacagttctagaagcgtcccaaagggtgctgggaaaggtcccagcgtgggttgagggaggagggaagatccgagttcctcaccgcgggccgggatgtgaccaccctcttcagaggttggaccccaggcttcaagcaccgagtgaggggtctgttggggacgctgggagagtctctggtgtgaagtggcttaggtctggactggtcagctgtggcaccagccggtcctgcccacgcttcaggatggccgggggctgcccctgtgggagagttgccaagactcggcgataccaaggatggaagccagaggctgtggcgagggagagccaagcatattcccagcaccagggccactgctggcacgtcgtagacatccaataaatatttttggaaggag

SEQ ID NO: 203771 - DNA, 675 bp, Homo sapiens
  Payload ID: 20190
  Gene Name: zinc finger protein 775
  ENST ID: ENST00000490973
  CDS Start-End: 178-675
attgtctctagggctttctgtcttgctgtaacgtctctccagccagctgcagctcctgctgacttatcccaccccagcgcaggtcatccaacggtgacttatggccccggcctcctggctcgatgaggatggcaggaaagggacacagccggcgctgatgctgggaggcctccagggatggagagtggcctggctggcaacggcacaggagctgggctggtgatgaaggtcaagcaggagaagccggagcggctgctgcagacgctggcgccgcaggccatgcttgtggagaaggacaaggagaacatatttcagcagcaccggggcctcccgccacgccagaccatggggcggcctcgagccctggggggacaggaggagtctgggagtccaaggtgggcccctcccactgagcaggatgcggggctggcaggccgggctcccgggtcagcctccggccccctgagcccctcgctttcctccggcgagggtcactttgtatgcctggactgcgggaagaggttcagctggtggtcgtccctgaagatccaccagcgcacccacaccggggagaagccgtacctctgcggcaagtgcggcaagagcttcagccagaagccgaacctggcgcgccaccagcggcaccacacgggcgagcgacccttctgctgcccc

SEQ ID NO: 203772 - DNA, 635 bp, Homo sapiens
  Payload ID: 20190
  Gene Name: zinc finger protein 775
  ENST ID: ENST00000478789
  CDS Start-End: 202-635
cccggcggggggaggttggggacgggcctggcagttgtgaactcgaacctgccgctgtcgccgcggcggggcggggagcgagagtgggccgcggaggccggccttcgggctccatggacgggcgccgcgtccctgcacagcccgccgcagagatggcaggaaagggacacagccggcgctgatgctgggaggcctccagggatggagagtggcctggctggcaacggcacaggagctgggctggtgatgaaggtcaagcaggagaagccggagcggctgctgcagacgctggcgccgcaggccatgcttgtggagaaggacaaggagaacatatttcagcagcaccggggcctcccgccacgccagaccatggggcggcctcgagccctggggggacaggaggagtctgggagtccaaggtgggcccctcccactgagcaggatgcggggctggcaggccgggctcccgggtcagcctccggccccctgagcccctcgctttcctccggcgagggtcactttgtatgcctggactgcgggaagaggttcagctggtggtcgtccctgaagatccaccagcgcacccacaccggggagaagccgtacctctgcggcaagtgcggcaagagcttcag

SEQ ID NO: 203773 - DNA, 5292 bp, Homo sapiens
  Payload ID: 20191
  Gene Name: zinc finger protein 776
  Uniprot ID: Q68DI1
  ENST ID: ENST00000317178
  CDS Start-End: 264-1820
acttccggcgtcctctactagtggccattttgattggtgttgggtgtattttccagtgagagaccgcggagtgttgggtcgtgtagaagtgactgaacccagaaggtggagacgagacgttgtcccgactgcacagaggctgctctgcagctccttaaaggcgctaggcgtgacccgcaccaaggccgggatcgggaccaccgtgcccgggtacctgcactgctcgccccctcctttcgaccccgctttccccacccagtcggatggcggcggccgcgctgaggcccccggctcagggcactgtgacctttgaagatgtggctgtgaacttttcccaggaggaatggagtctccttagtgaggctcagagatgcctttatcatgacgtgatgctggagaacctgacacttatatcttctctaggttgttggtatggagcaaaagacgagacaccttctaagcagaccctttctatacaacaggagtccccactcaggacacattggacaggtgtatgtaccaagaaggtccacctctggggaatgtgtggccctctcctgggagatatcttacaccagggaacacaacacaatcagaaattgaatgggtttggggcatatgaaaaaaaattggatgacgatgcaaaccatcatcaagaccagaagcagcacattggagagaaatcgtacagaagcaatgccaagggaacatcttttgtaaagaactgtaaattccatatgtcacatgagccatttatctttcatgaggttgggaaagactttttgtccagcttgagattactccaacaagaggacattcacacttcagggaagtcaaactttgaaactaagcatgggataccccttcagggtggaaaaactcattacatctgtggagagtccacaataccgtttagcaacaaacactcacttgtccttcaccagagacttctccctagagaaggaccttatgtatgcagtgattctgggaaattcactagcaaaagtaatagttttaataatcatcagggagttcgcactggaaaaagaccttatcagtgtggacaatgtgatgaatcattttggtataaggcccacctcactgaacaccagagagttcacactggagaaagaccttatgagtgtggagaatgtgataaatcttttagtcataagcacagtcttgttgaccatcagcgagttcacactggagaaagaccttatgaatgtgacgaatgtgggaaatcttttagccataagcgcagccttgttcaccaccagcgagttcacactggagaaagaccttatcagtgtggagaatgtgggaaatcgtttaatcacaagtgcaacctcattcagcatcagcgagttcacactggagaaagaccttttgagtgtacggcatgtgggaagttatttaggagcaactcccacctaaaggaacaccagagagttcacactggagaaagaccctatgagtgtaaagaatgtaggaaatcatttaggtacaagtcacacctcactgaacaccagagagttcacactggagaaaggccatatgagtgtagagaatgtgggaaatgttttcatcaaaagggcagtctcattcaacatcagcagatccactctggagaaaggccacatgagtgtggagaatgtgggaaatgttttcatcaaaagggcagtctcattcgacatcagcagattcactctggagaaaggccacatgagtgtggagaatgtggaaagtgttttcgtcaaaagggaaacctcattaaacatcaacgagttcacacgggagaaagacatcatgaatgttgaaaatttggcagatctgttggtaaaaagagcaccctcattcaacattcgtgagatcacactggaaagcacttatgagtatggagaatgtgcaaaatcatctagccaaaaggttggcctcattcaacaatagcaagatcacactggggaaaggctttctgagtgtagagaatgtatgaaatcctgtacatagaagttttgcctcaccaaataccagaagggtcacactggagaaagaccctatagttatggggaatttgggaaattacctaacaagaagtcccacctcactgaacactactgagttcacagttgagaaaggccatatgactgtaaggaatttgtaaaattatttagccagaagagctgcattactattcatcagataatttacaatggagaaaggccacataataatttctcacataataaatgtgagaaatcatttccgtacagctctgcgctccatgttcgtaagagttcacactggacaaagccttatgagagcagcgagtagaaaatcctttgtgggaaaactctggtttcattaaacacaggagagttcatgctagagaaaggcctcaacagtgtagcaaatatggaaagacattcactagaagctctgccctgcaagttcacactagagaaagcccttctcagtgaagtaaatttggaaaattgattagtcaaacctctatgctccttcaaaatcagagttcacactggatcaaggctttatggtgtgacaaatatggcacattctttatctaaatgtctaacatattatgcacagacaagctcctgctgtggaagtgccttttgagtgcagagcatttgcgagggcttcactcttctttcactggataccagaatgttgacaggagaaaaataacatagatgtgtgggaatattacttcttgtccagtgtaactgtgggagagagcccttatgaggacaccatcaacctatattgaatgtcatatgtccagtagctgcataaattccaggtatatgggagctgtattgcatttcttatcctgcgtatgtccttgccagatttatttcattcttaggtctctggcaaaagccatttcatctctaccacttggcaggtacctacagtgcatcactcatgcactccatcatattccagaaaaaaagttcaagttgtctcccattcagcagtggtatttttgagtagcctctgcactcgttcctttctcatttctctatgaagagttaggccatggacctgactcagttctggcctagagcagaagtgtccaatcttttggctttcctggtccacattggaagaagaattgtcttgtgccgcatatgaaatacattaacactaatgatagctgatgaacttttttaaaaaatcacacaaaaaccctcataatgttttaagaaagtttacaaatttgtgttgggctgcattcaaagctgtcctgagatacatgcggcccacaagctgcgggttggaccagcttggcctagagaatttttctgattacttgacaagatgggctgtctttcctaggaatctcatgattgtcatgattcttaaaatggaattttccagcctcttaactcaccaacccaagtacaagctgcctctcattgttctggtttctgctatgatgaagtccttatttaagcttccttcaatcttgggaattgtattgactgtattgtgtgaattgtatactcactgcattgtgtggcttagatacaacatggttctggtaccatgaaggattctggtaccatgaaagtttgttggggttactaaactgtgtgactcttagggaacagtatgaaggcagaatatagctctgcatttgtggcctagtttggatggctgcctaaggcctccaaataaagacttcagggctttgtgatctttatttttagatgaaatagtgcaataatatgtgttttcataaatcaacctgagtaggggacagttttagtgacacactttggtgcttctgagaacagcacaaaattattctcttgtttataatggatattgcattctgctcagtactggtgagggaaatctgttctcaagtcctacagtgcattcatgtgtcctgaagtccagaattctgtaggatagtgtcctacgttataagcctggagaaagaaatcataattctttaatttttatttttttagggaaatgatgtcactctgaaactcaggctggaatacactggcatggtcatacctcactgcggcctcaaactcctgggctcaagtgatcctcctgcctcagcctcccgagtacctgagattagcccaggtaatttaagaattttttatagagatagggttttgctattttaccctgactgatgttcaactcctggcctcaagtaatcctctagcatacgcccttgaaagcactaggattacaggtgtgagccaccatgcccagcccaaaaataatttttgtagaattagcatttctaggtagtgaagcagactgcaacagaatagttgggatatactttttttaaaaaggcatccacaatgattcagtcactatgtctgtgatggacaagcaggtacagaaattttcaggacctccataattatgaatctagtgtagcttaggtcattgtcagactaaatctaaaggttttgtggatttctgtagcctatctgggctgcataccaaaaagccatccctgaattagtaggaggaagaggatagggagaaaggaaatctcttagtccagtgatgtggcctttgcaaccagccagcattccaatttaatcaggtggaaatgatcttcctggctcataagtatttggtatcacacaggctaattgccccccttagggcgtgatgagagttaggagagtcaatgtaaaatcacataacctatttgtcaaaaataatgttaaatccagatagttctttcaaattaaatttttaaagctgtaataagactgggcatggtgactcatgcctgttatcccaacactttgggagtccagggtgggagtattgcttgaggtaagaagtttgagactagcctgggtcccatagtaagaccctgtctcttaaaaaataaatactatctttctctctggcctctccatgctccagacaatcactgaattacaatatttgcttaacagtagattaatgtcaattttctggaattttatatgactgatataacatgtttcctcttttcatacctgagtactctcctgagccctatttatttagatgttcttcttttttctttattattatttttatttcacatagcagggatgcatattttgacattcatcaatcatgatatatgagtagttcattctttttatcttagaatatgacatgctatggaaatcactgtatacgaattcatctgcttatggatatgttattgcttcttatttttgtctgttaggaataaaactgcttgttaagcacatttgaatgcaa

SEQ ID NO: 203774 - DNA, 549 bp, Homo sapiens
  Payload ID: 20191
  Gene Name: zinc finger protein 776
  ENST ID: ENST00000431353
  CDS Start-End: 219-395
gtattttccagtgagagaccgcggagtgttgggtcgtgtagaagtgactgaacccagaaggtggagacgagacgttgtcccgactgcacagaggctgctctgcagctccttaaaggcgctaggcgtgacccgcaccaaggccgggatcgggaccaccgtgcccgggtacctgcactgctcgccccctcctttcgaccccgctttccccacccagtcggatggcggcggccgcgctgaggcccccggctcagggcactgtgacctttgaagatgtggctgtgaacttttcccaggaggaatggagtctccttagtgaggctcagagatgcctttatcatgacgtgatgctggagaacctgacacttatatcttctctagcattttatttcttttaggttgttggtatggagcaaaagacgagacaccttctaagcagaccctttctatacaacaggagtccccactcaggacacattggacaggtgtatgtaccaagaaggtccacctctggggaatgtgtggccctctcctgggagatatcttacacca

SEQ ID NO: 203775 - DNA, 546 bp, Homo sapiens
  Payload ID: 20191
  Gene Name: zinc finger protein 776
  ENST ID: ENST00000451849
  CDS Start-End: 1-116
atgtggctgtgaacttttcccaggaggaatggagtctccttagtgaggctcagagatgcctttatcatgacgtgatgctggagaacctgacacttatatcttctctagggaaatgatgtcactctgaaactcaggctggaatacactggcatggtcatacctcactgcggcctcaaactcctgggctcaagtgatcctcctgcctcagcctcccgagtacctgagattagcccaggtaatttaagaattttttatagagatagggttttgctattttaccctgactgatgttcaactcctggcctcaagtaatcctctagcatacgcccttgaaagcactaggattacaggtgtgagccaccatgcccagcccaaaaataatttttgtagaattagcatttctaggtagtgaagcagactgcaacagaatagttgggatatactttttttaaaaaggcatccacaatgattcagtcactatgtctgtgatggacaagcaggtacagaaattttcaggacctccataattatgaatctagtgtagct

SEQ ID NO: 203776 - DNA, 3233 bp, Homo sapiens
  Payload ID: 20192
  Gene Name: zinc finger protein 777
  Uniprot ID: Q9ULD5
  ENST ID: ENST00000247930
  CDS Start-End: 325-2820
ccctggctccccttggaagcacagcccgcgtccctggaacccgggctgcactgagctggtcacatgaactccgggctttctctggtgtgacgggtttcttagatccctttgtgagcgcaggttttgaaagggaacgaccccgggttctgggtgtgagaggcgcaggggatcggcgggaggaaggctgtcggagccaatcaagccgcctccagaccccagcacgtcgcctgggctgcgcgctccgactgcgcctccgcccgcgcgcctcccggcctcgcccgagggtgcctgggcaggcgaggaccccaggttcagcagctggacatggagaaccaacgctcatcacctctgtcgttccccagtgttccacaagaagaaaccttacgtcaggcccctgctggactcccccgagaaactctgttccaatcccgcgttcttcctcccaaagaaattccttctttgtctcccaccattccccgtcaaggctccctgccccaaacttccagtgctcccaagcaagagacttctggccggatgccacatgtgctccagaagggaccctcactcctgtgttctgccgcttctgagcaagagacttctctccagggccccctggcttcccaggaagggacccagtatccacccccagctgctgctgaacaagaagtctcccttctctcccactccccccaccaccaggaagcccccgttcactcccctgaagctcctgagaaagaccccctgaccctttccccaacagttcccgagactgacatggacccgctgctccagagcccggtttcccaaaaggacacccctttccagatctcttctgcagtccagaaggaacagccgctccccacggcagagatcacccgcttggctgtgtgggctgccgtccaagcagtggagaggaagctggaggcccaggccatgaggctactgaccctggaaggcaggacggggacaaatgaaaagaagatagccgactgcgagaagacagccgtggagttcgcgaaccatctggagagcaagtgggtcgtgttggggaccctgctgcaggagtatgggctgctgcagaggcggctggagaacatggagaacctgctgaaaaacagaaatttctggatcctgcggctgccccccggcagcaatggagaagttcccaaggtccctgtcacatttgatgatgttgctgtgcacttctcggagcaggagtggggaaacctgtctgagtggcagaaggagctctacaagaacgtgatgaggggcaactacgagtccctggtttccatggactatgcaatttccaaaccagacctcatgtcacagatggagcgcggggagcggcccaccatgcaggagcaggaagactctgaggagggcgaaacgccgacagatcccagtgctgcgcacgatgggatcgtgattaagatcgaggtacagaccaacgacgagggctcagaaagtttggagacacctgagcccctgatgggacaggtggaagagcacggcttccaggactcagagctgggtgacccctgtggggaacagccagacctggacatgcaggagccagagaacacgctggaggagtccacggaaggctccagcgagttcagcgaactgaagcagatgctggtgcagcagaggaactgcacggaggggatcgtgatcaagacagaggaacaagacgaggaggaagaagaggaggaggaggatgagctgccgcagcacttgcaatcccttgggcagctgtccgggagatatgaggccagtatgtaccagaccccgctgcccggggagatgtcccccgagggcgaggagagccccccgcccctgcagctaggaaaccccgcagtgaaaaggctggcgccctccgtgcacggtgagcggcacctgagcgagaaccgcggggcctcgagccagcagcagcggaaccggcgcggcgagcggcccttcacatgcatggagtgcggcaagagcttccgcctgaagatcaacctcatcatccaccagcgcaaccacatcaaggaggggccctacgagtgcgccgaatgcgagatcagcttccggcacaagcaacagctcacgctgcaccagcgcatccaccgcgtgcgcggaggctgcgtctcacccgaacgcgggcccacgttcaaccccaagcacgcgctcaagccgcgtcccaagtcacccagctctggtagcggcggcggtggccctaagccctacaagtgccccgagtgcgacagcagcttcagccacaagtccagcctgaccaaacaccagatcacgcacacgggtgagcggccctacacgtgccccgagtgcaagaagagcttccgcctgcacatcagcttggtgatccatcagcgcgtgcacgcgggcaagcatgaggtctccttcatctgcagcctgtgcggcaagagcttcagccgcccctcgcacctgctgcgccaccagcggactcacacaggcgagcggcccttcaagtgccccgagtgcgagaagagcttcagcgagaagtccaagctcaccaaccactgccgcgtgcactcgcgcgagcggccgcacgcctgccccgagtgcggcaagagcttcatccgcaagcaccacctcctggaacaccggcgcatccacacaggcgagcggccctaccactgcgccgagtgcggcaagcgcttcacgcagaagcatcacctgctggagcaccagcgcgcgcacacgggcgagcggccctacccctgcacgcactgcgccaagtgcttccgctacaagcagtcgctcaagtaccacctgcggacccacacgggcgagtgagcgcgcgccccgccgccgccgcccggccaggtgcgcgggccgtgccccccctcggacaccgccaggcccgagcccagcgggcgggggcggggcgccccccagcccctttgccgtgagctccccctctcctctcgtccctcctcccaaggacatgggggcagtgagaccaggtcccttgctgccgcgtttccccgggggccccaggggggagggcgcggacctggggaaccctttcgggctgttaatttccttgacaataaaatggatgaaaccaatcagcacggggggcgtgatttggccgccggccactcagaggggcggtgtagggcccatctagttggggatagaactttataattaccttttggatactgtggttctatttgataataatagagtaatttttaaaagaa

SEQ ID NO: 203777 - DNA, 2386 bp, Homo sapiens
  Payload ID: 20193
  Gene Name: zinc finger protein 778
  Uniprot ID: Q96MU6
  ENST ID: ENST00000306502
  CDS Start-End: 171-2234
tggccttggcttcaggaaaggagcattcagacgcttccgtcagcctcccaggatggcagcccctgacctggcccacggacgcggtgacctttgacgacgtggctgtggacttcacccaggaggaatggactttactggacccatctcagagagacctctacagagatgtgatgctggaaaactacgagaacctggcctcagtaggacatcacctgttccaacccagtgtgatctattggctggagcaggaagaggagttgagggcagggcggagagcagttctccaagaatggcgacttaaaaccaaagggccagcacttcggcaggatagatcttggttcagagcatcaaatgagacacagacggcaagaagccacaatggagggcagctctgtgaccgcacgcagtgtggagaagctttcagtgaacactcaggcctcagcacacacgtgagaactcaaaatacaggagacagttgtgtgtctaatcattatgaaagggacttttttattccatgccagaaaaccttgttcaaaattggagagcagttttccgtgttgggtcagtgtggaaaagccttcagctctactccaaatgttgtttcccagcaagcatgcactcgggacagatctcttgactacagcagctgtggggaagtgttccttaatcagtcataccttcaggcacgtgcgggaagtcacaacggagaagaaacatggaaatggaagccgtgtgggaaagctctaactcactccatgggctgcgccacacctgttgaaatgcatgccgtcaggaatccccacgtatgtagggaatgtgggaaggcctttaggtacactgcctaccttactggtcgcgtgcaagtccaccctggggaaaagccctgtgaattggaagaatgtggaaaagcctcccctgtttcttccagcctaactcaacatgtaagaattcatgctgcagagaaaccctgtgaatgtaaagaatgcggaaaagccttcactggactctcaggtctttctaaacacgtccaaacagaccctggacagaagccctatgaatgtaaggactgtgggaaagcctgcggtgggttttatctactgaatgagcatggaaaaactcacacgagggagaagccctttgcatgtgtggtttgcggaaaatattttagaaattcctcatgccttaataatcatgttcgaattcacactggaataaaaccctatacatgcagctactgtgggaaggccttcactgtgcgctgtggccttactagacacgtacgaacacacacgggcgagaagccatacacgtgtaaggactgcgggaaagccttctgtacatcctcgggccttactgagcatgtaaggactcacactggagagaaaccatatgaatgtaaagattgtgggaaatccttcactgtttcttcaagcctgactgagcacgcgagaatccataccggagagaaaccctacgaatgtaagcagtgtggcaaagccttcacagggcgctcaggcctcactaaacacatgcggacacacaccggggagaagccctatgaatgtaaggactgtgggaaagcctacaatagggtttatctactgaatgagcatgtgaaaactcacacagaggagaagccctttatatgtacggtatgcaggaaatccttcagaaattcctcgtgcctgaataagcacattcagattcacactggaataaaaccttatgaatgtaaggactgtgggaaaacattcactgtttcttcgagcctaaccgagcacatacgaactcacactggagagaaaccttatgaatgtaaagtatgcggaaaggccttcaccacatcctcacaccttatcgtgcacataagaacccacaccggtgagaaaccctacatatgtaaggagtgtgggaaagcctttgcttcctcctcacaccttatcgaacacagaaggactcacacaggagagaaaccttacatatgtaacgagtgtgggaaagccttccgtgcctcctctcacctgcataaacatggaagaattcacactgggcagaaaccctataaatgtaaggaatgtgggaaagcatacaataggttttatctactaaaagaacatttaaaaacttacactgaagagcaggtttttgtatgtaaggactgtggaaaatcttttaagaattcctcatgccttaaccatcacactcaaattcacactgatgagaaacctttctaatgtaaagaatgtggggaagctgtcagctacactcattcacgttgaagacatgaaagacctctcgttctccagatgtccatgacttgaggaatgtggctaggcaatcagcatctcatcacaacccggcaggcaggaactcaccctggagccct

SEQ ID NO: 203778 - DNA, 3608 bp, Homo sapiens
  Payload ID: 20193
  Gene Name: zinc finger protein 778
  ENST ID: ENST00000433976
  CDS Start-End: 340-2613
ctgtcttacagctgatccggttcttgcggcggtgcgtgctggcgccggagagttccgcgcgtgtcctcgggctgtccgcggggaagctggtccgggagtgggcgcccgcccgcctgcctcgcgccttgcgcccccggcaccgcttccagaagggaaagtcgccgccgctcgcggtagacccgggcagcgcttccattccgcggagctggaaatagggatccagccatccgtgggtcaggaggaatggagactgtaccttccacatagattcacaagctgccctgcagtggccttggcttcaggaaaggagcattcagacgcttccgtcagcctcccaggatggcagcccctgacctggcccacggaggtcatgtttctagggactcagtctgccttcatgaagaacagacacaggcagcagggatggtggctggctggctgataaattgttaccaggacgcggtgacctttgacgacgtggctgtggacttcacccaggaggaatggactttactggacccatctcagagagacctctacagagatgtgatgctggaaaactacgagaacctggcctcagtaggacatcacctgttccaacccagtgtgatctattggctggagcaggaagaggagttgagggcagggcggagagcagttctccaagaatggcgacttaaaaccaaagggccagcacttcggcaggatagatcttggttcagagcatcaaatgagacacagacggcaagaagccacaatggagggcagctctgtgaccgcacgcagtgtggagaagctttcagtgaacactcaggcctcagcacacacgtgagaactcaaaatacaggagacagttgtgtgtctaatcattatgaaagggacttttttattccatgccagaaaaccttgttcaaaattggagagcagttttccgtgttgggtcagtgtggaaaagccttcagctctactccaaatgttgtttcccagcaagcatgcactcgggacagatctcttgactacagcagctgtggggaagtgttccttaatcagtcataccttcaggcacgtgcgggaagtcacaacggagaagaaacatggaaatggaagccgtgtgggaaagctctaactcactccatgggctgcgccacacctgttgaaatgcatgccgtcaggaatccccacgtatgtagggaatgtgggaaggcctttaggtacactgcctaccttactggtcgcgtgcaagtccaccctggggaaaagccctgtgaattggaagaatgtggaaaagcctcccctgtttcttccagcctaactcaacatgtaagaattcatgctgcagagaaaccctgtgaatgtaaagaatgcggaaaagccttcactggactctcaggtctttctaaacacgtccaaacagaccctggacagaagccctatgaatgtaaggactgtgggaaagcctgcggtgggttttatctactgaatgagcatggaaaaactcacacgagggagaagccctttgcatgtgtggtttgcggaaaatattttagaaattcctcatgccttaataatcatgttcgaattcacactggaataaaaccctatacatgcagctactgtgggaaggccttcactgtgcgctgtggccttactagacacgtacgaacacacacgggcgagaagccatacacgtgtaaggactgcgggaaagccttctgtacatcctcgggccttactgagcatgtaaggactcacactggagagaaaccatatgaatgtaaagattgtgggaaatccttcactgtttcttcaagcctgactgagcacgcgagaatccataccggagagaaaccctacgaatgtaagcagtgtggcaaagccttcacagggcgctcaggcctcactaaacacatgcggacacacaccggggagaagccctatgaatgtaaggactgtgggaaagcctacaatagggtttatctactgaatgagcatgtgaaaactcacacagaggagaagccctttatatgtacggtatgcaggaaatccttcagaaattcctcgtgcctgaataagcacattcagattcacactggaataaaaccttatgaatgtaaggactgtgggaaaacattcactgtttcttcgagcctaaccgagcacatacgaactcacactggagagaaaccttatgaatgtaaagtatgcggaaaggccttcaccacatcctcacaccttatcgtgcacataagaacccacaccggtgagaaaccctacatatgtaaggagtgtgggaaagcctttgcttcctcctcacaccttatcgaacacagaaggactcacacaggagagaaaccttacatatgtaacgagtgtgggaaagccttccgtgcctcctctcacctgcataaacatggaagaattcacactgggcagaaaccctataaatgtaaggaatgtgggaaagcatacaataggttttatctactaaaagaacatttaaaaacttacactgaagagcaggtttttgtatgtaaggactgtggaaaatcttttaagaattcctcatgccttaaccatcacactcaaattcacactgatgagaaacctttctaatgtaaagaatgtggggaagctgtcagctacactcattcacgttgaagacatgaaagacctctcgttctccagatgtccatgacttgaggaatgtggctaggcaatcagcatctcatcacaacccggcaggcaggaactcaccctggagccctatgcagcagacacagagaaagccctcagtgttctctaaggtcttgctgaatatggatggtatccagtagagagaactctattgatgtgtgatatgcagcagcattgttgctgttctgctcagtactttgatgatcccttgtgatctcacaatgaagaaaaaccttaggagggtgagaattgttgggaagtcattttttacattacatctttcctcaccctttagtaaacgtggtgattgacacttgaagtgttgtgaatgtatggaagatagcagtcgcttccctgtgttctaaaaccttgtgggctaacttgagacatgtctttctgggggttctgtagacgtattttgaatctttatgatgctgcactgatcattcttggagtgaggactctgttccctgtagaaatcctccagtctggttgctacagtgtccacgtcgcagcctggctaacagtaggccttgaggactcagatgtgatcctgtgtgagcagtgtaggctctggttggttagtcttgaggatccagatgtgattctttgagcagcgtaggctctggttggttagtcttgaggatccagatgtgattctgtgagcagtgtaagctctggttggttagtcttcaggatccagatgtgatcttgtgtgagcactgtaggctctggttggttagtcttgaggatccagatgtgattctgtgagcagtgtaggctctggttggttagtcttgaggatgcagatgtgattctgtgtgagcagcgtaggctctggttggttagtcttgaggatccagatgtgattctgtgagcagcataggctctggttggttagtcttgaggatcca

SEQ ID NO: 203779 - DNA, 1431 bp, Homo sapiens
  Payload ID: 20193
  Gene Name: zinc finger protein 778
  ENST ID: ENST00000567651
  CDS Start-End: 57-200
gcagtggccttggcttcaggaaaggagcattcagacgcttccgtcagcctcccaggatggcagcccctgacctggcccacggaggtcatgtttctagggactcagtctgccttcatgaagaacagacacaggcagcagggatggtggctggctggctgataaattgttaccaggacatcacctgttccaacccagtgtgatctattggctggagcaggaagaggagttgagggcagggcggagagcagttctccaagaatggcgacttaaaaccaaagggccagcacttcggcaggatagatcttggttcagagcatcaaatgagacacagacggcaagaagccacaatggagggcagctctgtgaccgcacgcagtgtggagaagctttcagtgaacactcaggcctcagcacacacgtgagaactcaaaatacaggagacagttgtgtgtctaatcattatgaaagggacttttttattccatgccagaaaaccttgttcaaaattggagagcagttttccgtgttgggtcagtgtggaaaagccttcagctctactccaaatgttgtttcccagcaagcatgcactcgggacagatctcttgactacagcagctgtggggaagtgttccttaatcagtcataccttcaggcacgtgcgggaagtcacaacggagaagaaacatggaaatggaagccgtgtgggaaagctctaactcactccatgggctgcgccacacctgttgaaatgcatgccgtcaggaatccccacgtatgtagggaatgtgggaaggcctttaggtacactgcctaccttactggtcgcgtgcaagtccaccctggggaaaagccctgtgaattggaagaatgtggaaaagcctcccctgtttcttccagcctaactcaacatgtaagaattcatgctgcagagaaaccctgtgaatgtaaagaatgcggaaaagccttcactggactctcaggtctttctaaacacgtccaaacagaccctggacagaagccctatgaatgtaaggactgtgggaaagcctgcggtgggttttatctactgaatgagcatggaaaaactcacacgagggagaagccctttgcatgtgtggtttgcggaaaatattttagaaattcctcatgccttaataatcatgttcgaattcacactggaataaaaccctatacatgcagctactgtgggaaggccttcactgtgcgctgtggccttactagacacgtacgaacacacacgggcgagaagccatacacgtgtaaggactgcgggaaagccttctgtacatcctcgggccttactgagcatgtaaggactcacactggagagaaaccatatgaatgtaaagattgtgggaaatccttcactgtttcttcaagcctgactgagcacgcgagaatccataccgg

SEQ ID NO: 203780 - DNA, 568 bp, Homo sapiens
  Payload ID: 20193
  Gene Name: zinc finger protein 778
  ENST ID: ENST00000564906
  CDS Start-End: 326-568
acagctgatccggttcttgcggcggtgcgtgctggcgccggagagttccgcgcgtgtcctcgggctgtccgcggggaagctggtccgggagtgggcgcccgcccgcctgcctcgcgccttgcgcccccggcaccgcttccagaagggaaagtcgccgccgctcgcggtagacccgggcagcgcttccattccgcggagctgggatccagccatccgtgggtcaggaggaatggagactgtaccttccacatagattcacaagctgccctgcagtggccttggcttcaggaaaggagcattcagacgcttccgtcagcctcccaggatggcagcccctgacctggcccacggaggtcatgtttctagggactcagtctgccttcatgaagaacagacacaggcagcagggatggtggctggctggctgataaattgttaccaggacgcggtgacctttgacgacgtggctgtggacttcacccaggaggaatggactttactggacccatctcagagagacctctacagagatgtgatgctggaaaactacgagaacctggcctcagta

SEQ ID NO: 203781 - DNA, 11031 bp, Homo sapiens
  Payload ID: 20193
  Gene Name: zinc finger protein 778
  Uniprot ID: Q96MU6
  ENST ID: ENST00000620195
  CDS Start-End: 333-2522
acagctgatccggttcttgcggcggtgcgtgctggcgccggagagttccgcgcgtgtcctcgggctgtccgcggggaagctggtccgggagtgggcgcccgcccgcctgcctcgcgccttgcgcccccggcaccgcttccagaagggaaagtcgccgccgctcgcggtagacccgggcagcgcttccattccgcggagctggaaatagggatccagccatccgtgggtcaggaggaatggagactgtaccttccacatagattcacaagctgccctgcagtggccttggcttcaggaaaggagcattcagacgcttccgtcagcctcccaggatggcagcccctgacctggcccacggaggtcatgtttctagggactcagtctgccttcatgaagaacagacacaggcagcagggatggtggctggctggctgataaattgttaccaggacgcggtgacctttgacgacgtggctgtggacttcacccaggaggaatggactttactggacccatctcagagagacctctacagagatgtgatgctggaaaactacgagaacctggcctcagtagaatggcgacttaaaaccaaagggccagcacttcggcaggatagatcttggttcagagcatcaaatgagacacagacggcaagaagccacaatggagggcagctctgtgaccgcacgcagtgtggagaagctttcagtgaacactcaggcctcagcacacacgtgagaactcaaaatacaggagacagttgtgtgtctaatcattatgaaagggacttttttattccatgccagaaaaccttgttcaaaattggagagcagttttccgtgttgggtcagtgtggaaaagccttcagctctactccaaatgttgtttcccagcaagcatgcactcgggacagatctcttgactacagcagctgtggggaagtgttccttaatcagtcataccttcaggcacgtgcgggaagtcacaacggagaagaaacatggaaatggaagccgtgtgggaaagctctaactcactccatgggctgcgccacacctgttgaaatgcatgccgtcaggaatccccacgtatgtagggaatgtgggaaggcctttaggtacactgcctaccttactggtcgcgtgcaagtccaccctggggaaaagccctgtgaattggaagaatgtggaaaagcctcccctgtttcttccagcctaactcaacatgtaagaattcatgctgcagagaaaccctgtgaatgtaaagaatgcggaaaagccttcactggactctcaggtctttctaaacacgtccaaacagaccctggacagaagccctatgaatgtaaggactgtgggaaagcctgcggtgggttttatctactgaatgagcatggaaaaactcacacgagggagaagccctttgcatgtgtggtttgcggaaaatattttagaaattcctcatgccttaataatcatgttcgaattcacactggaataaaaccctatacatgcagctactgtgggaaggccttcactgtgcgctgtggccttactagacacgtacgaacacacacgggcgagaagccatacacgtgtaaggactgcgggaaagccttctgtacatcctcgggccttactgagcatgtaaggactcacactggagagaaaccatatgaatgtaaagattgtgggaaatccttcactgtttcttcaagcctgactgagcacgcgagaatccataccggagagaaaccctacgaatgtaagcagtgtggcaaagccttcacagggcgctcaggcctcactaaacacatgcggacacacaccggggagaagccctatgaatgtaaggactgtgggaaagcctacaatagggtttatctactgaatgagcatgtgaaaactcacacagaggagaagccctttatatgtacggtatgcaggaaatccttcagaaattcctcgtgcctgaataagcacattcagattcacactggaataaaaccttatgaatgtaaggactgtgggaaaacattcactgtttcttcgagcctaaccgagcacatacgaactcacactggagagaaaccttatgaatgtaaagtatgcggaaaggccttcaccacatcctcacaccttatcgtgcacataagaacccacaccggtgagaaaccctacatatgtaaggagtgtgggaaagcctttgcttcctcctcacaccttatcgaacacagaaggactcacacaggagagaaaccttacatatgtaacgagtgtgggaaagccttccgtgcctcctctcacctgcataaacatggaagaattcacactgggcagaaaccctataaatgtaaggaatgtgggaaagcatacaataggttttatctactaaaagaacatttaaaaacttacactgaagagcaggtttttgtatgtaaggactgtggaaaatcttttaagaattcctcatgccttaaccatcacactcaaattcacactgatgagaaacctttctaatgtaaagaatgtggggaagctgtcagctacactcattcacgttgaagacatgaaagacctctcgttctccagatgtccatgacttgaggaatgtggctaggcaatcagcatctcatcacaacccggcaggcaggaactcaccctggagccctatgcagcagacacagagaaagccctcagtgttctctaaggtcttgctgaatatggatggtatccagtagagagaactctattgatgtgtgatatgcagcagcattgttgctgttctgctcagtactttgatgatcccttgtgatctcacaatgaagaaaaaccttaggagggtgagaattgttgggaagtcattttttacattacatctttcctcaccctttagtaaacgtggtgattgacacttgaagtgttgtgaatgtatggaagatagcagtcgcttccctgtgttctaaaaccttgtgggctaacttgagacatgtctttctgggggttctgtagacgtattttgaatctttatgatgctgcactgatcattcttggagtgaggactctgttccctgtagaaatcctccagtctggttgctacagtgtccacgtcgcagcctggctaacagtaggccttgaggactcagatgtgatcctgtgtgagcagtgtaggctctggttggttagtcttgaggatccagatgtgattctttgagcagcgtaggctctggttggttagtcttgaggatccagatgtgattctgtgagcagtgtaagctctggttggttagtcttcaggatccagatgtgatcttgtgtgagcactgtaggctctggttggttagtcttgaggatccagatgtgattctgtgagcagtgtaggctctggttggttagtcttgaggatgcagatgtgattctgtgtgagcagcgtaggctctggttggttagtcttgaggatccagatgtgattctgtgagcagcataggctctggttggttagtcttgaggatccagatgtgattctgtgagcagcgtaggctctggttggttagtcttgaggatccagatgtgattctgtgagcagcgtaggctctgcttggttagtcttgaggatccagatgtgatcctgcgtgagcagcgtaggctctggttggttagtcttgaggatccagatgtgatcctgtgtgagcagcgtaggctctggttggttagtcttgaggatccagatgtgattctgtgagcagtgtaggctctggttggttagtcttaggtatccagatgtgatcctgtgtgagcagcgtaggctctggttggttagtcttgaggatccagatgtgatcctgtgtgagcagcgtaggctctggttggttagtgttgaggatccagatgtgattctgtgagcagtgtaggctctggttggttagtcttgaggatccagatgtgatcctgtgtgagcagtgtaggctctggttggttagtcttaagtatccagatgggatcctgtatgagcagcgtaggctctggttggttagtcatgctcttaggcatgacccacctgtagggtcccacactggccaatgttggggcataacacagctctacattttatgaaaatgcccttgttcctctcccatacctgatcccttcagataaaacaccagggtgcaaggaggggcagagtggagaggggcgaggtctgtaccctgagatgcccccgtttcatggccgtggagggagaaccaccaccccccacgtggggaggagggaattcctgtaccttaggcagtgccggacgggtgagagccctgagtgtccttgttgacctccagatcctcttcacagcatgcagagcggtcctggcagctgctgcaatctggcactcctggggcagctgctgcgatccggcactgatgaggcagctgctgtgatccggcattcatggggcagctgctgcgacccggcactcctggggcagctgctgcttgtgtgtgtgctgctcctttgtgtaccatgaaaacagaccagggacacggctggtcctgatgttctgtggcgcttggccctgtcactggcgcttcttggatgaggcccttaaacacacacagtggcagagcaagacttcatgtgagtgacacgaatgtgtgtcctctggctgcagcaatcctgggttatgttttttgtggccatcagggcagcagctgcttggtgactgtttctgtggtgttgaatccccacggtataaaggtaatctacaacgaggtgaacaataaatcctggatggacagacccgtgcaccttcatattacgtgtttgaaatcctggatggacagacccgtccaccttcatgtcacgtgtttgaaattctggatggacagacccatgcaccttcatgttacgtgtttaaaattctggatggacagacccgtgcaccttcctgtcacatgtttgaaatcctggatggacagacctgtgcaccttcatgtcacgtgtttgaaattctggatggacagagccatgcaccttcatgttacgtgtttgttgtggagaggagtgggttgtgccatgtttctcttgtgggattgagtgtggctatttagctcatctgttgccacctttaattgttggcattgacactaaaggtcatcagattagcgggaaccagcttgtggggttgtagcggctcctggactggtctcaggtgacatcctgattggctgaaataagtcctgcaggtctctgctagaactgactcacagttgcctgagtccagaacttgtgggtcacaggtgacgccaggactgcatcatcctggtgctcggactcctagtgacagcatcctgagcaggcggtagcccagacaccaccctgcctgatatgcccactgttggtggagacatcaccccagcacagacctcaattaagacgactacccctccgacgactccccctcccttcactggaggtgacttcacgcacttcttcagaacctcctcagcagcgatgcccatggactggggttcctaaggcacaaatttgatatttgagattctgtgatgagctgagcttgctgtccgctaacccgtgatcctggtgtaatctcaaccaaaacccacagccctgcaccccttgcctgtaggaaaatctggtaggagttagtagtgtctgtgaagtctcaataattgataccaaaatgttttgtttcaccaggaggtgcccgcctcctatcagcctctgggaaggccactgtctccccagtgccttctcctccgctgcagctttccatctcatctccttactcccttgacttggcttcacacagagcctcttctttacacatactaactgtttgcttcataccctcctgcagcagaactacagacctgccatcctgataattgtcaaactcatccctttatcacctttataactcctcaaggatattatcattggacccccaacatttcaaagtgattttcttgagtaataccatatgctgtgatgtggatgtgattggtttgccctcatcaagtctcatgttgagctttgaccctcagtgtggcagtgctgggagggggcctggtgggggtttgggtcatgggggcaccctcctgaatggttggataccattcattcttgctgtgtcaagcctggattggtttgtaggggaatgcactagttactgggagcatggttgtgataaagccaagccgtccctcgggtttggctcactgcccttgaccttctctgccctgtttgacacagcaaatagtcctcaccagaagcaggtcagatgccagtgctatgcttgcacagcctgctgaaccatgagccaaataagcctctttctaagttacccacagcctcagatatgtagcaacacagacagactaagacaccaagcatgatggaaaactgggttatgggcaggactgcaagtactggttaggcagatacctgtatttctcttcctaactctcagaacgtgttctgtgtcacttagggcaacttatgccctcctgtgtgaaaatctccactcccaatgtctgagggttcctcagagtaagataaaatattaaaggaccaattgtattaattatgttttttttttttttgttagggtacattttcatcctggggtcttgctgtgggggctagaccgtccctctcaggctagatcattcctaaagatggtaaacaacttgctggaaacatgcactgcatatacaaatcaactcactgcatatgcacatcaactcactgcatatgcaactcaactcacaccgtatatgcaactcaactcacaccgtgtatgcaaatcaactcgcactgcgtatgcaactcaactcgcactgcgtatgcaactcaactcgcactgcgtatgcgaatccactcactgcctatgcaactcagctcgctctgcgtatgcaactgagctcgctctgcgtatgcaacccagctcgctctgcgtatgcaactcaagtcgcactgcgtatgcaactcagctcgctctgcgtatgcaactcagctcgcactgcgtatgcaactcagctcgcactgcgtatgcaagtcagctcgctctgcgtatgcaactcagctcgctctgcgtatgcaactcagctcgcactgcgtatgcaactcagctcgcactgcgtatgcaactcagctcgctctgcgtatgcaactcagctcgctctgcgtatgcaactcagctcgctctgcgtatgcaactcagctcgcactgcgtatgcaactcagctcgctctgcgtatgcaactcagctcgctctgcgtatgcaactcagctcgcactgcgtatgcaactcgcactgcgtatgcaactcaactcgcactgcgtatgcaactcaactcgcactgcgtatgcaactcaactcgcactgcgtgtgcaactcaactcgcactgcgtgtgcaactcaactcacactgcgtatgcaactcagcttgctctgtgtatgcaactcaactcgcactgcgtatgcaaatcaactcactgcatatgcaactcagctcgcactgcatatgcaacgcaactcaactcatactgcatatgcaactcaactcacactgtatgcaactcagctcgctctgcatatgcaattcaactcgcactgcgtatgcaaatcaacttactgcatatgcaactcaactcactgcgtatgcaactcaactcgcactgcatatgcaactcaactcgcactgcgtatgcaactcaactcgcactgcgtatgcaactcagctcgcactgcgtatgcaactcaactgttgcaagtacttatttccggccacttcctttttctaactaccacaccaagccagtatttctcctccctgaagtcagcccaggatgaggcactagacagcaggacatgctgtatgcccttgggcctgctggaagtatgcagactagccagccccagacttcatcctgccctgtcctgcctttcctgtgaaaaccctgtggcctctgcctcccctggctctgacttctgcctcctgcccagctctgcagctccccttgggccctgcctggagtgatgtgccgccttctcttgacactgtgagtgataaactttccatgtcaggaacctgtgtgtgtcactcactcaccttgacgagtccgcgtctaggccccaccagtggtgtggttttcctcatagtctctctacctaagcacatgtctgtgacaaggtcttacccagcccagggattcttgaactatctgtaggaactgccatgttgactcctgggcagttttattctttctctctactcgttcaaccttcttagggagtgacgttttttccaaagtggttgtgaaacagcatctccttggggtgttggtttgcacttctcttcattactgatagtatgaacatggttttgcttacgctggctattttcctttttggatgaagtacctggtcttgttttttcctggtttgtttgatctttgttcttttttagaaatagtgaggctgttgtgaggtgagtcaccacttgtgacttagaagattgcagtggtttccacttcacctgtttccacttttgtgatgatgccttaaggaaaaagattgtgccaggtgtggtggctcaggcctgtaatcccaacactttgggaggccgaggtgggtggatcacaaggtcaggagatcaagaccatcctggccaacatggtgaaacgccatctctactaaaaatagaaaaattggctagatgtggtggtgcacgcctgtaatcccagctccttgggaggctgaggcaggagaattgcttgaagatgggaagcacagattgcagtgaaccgagatcgcgccactgcactccagcctggcaacagagtgagactctgtctcaaaaaaaaaggaaaaatatttcttaattttggcatactcaaatttatacaacctttcctttatcttcatcagaaatttcttttctcctaaggccttaaatatgctgtactattttggcttccacagtttctatgttttatcccaagttgcttaatccatttggagttgatttttgttgaccgtatctgtagagtgtaatgtcatttttcccactatggacataaaaatttttgcaaggcctcttttttttaatgaagaaaagaggtttattttgttcacaattctgaaggcctggagggtcccagaagcttggcaccagcacccactaggctccagatcggggcctcatgctgacttccgttttcacacaacgagtgggaaacaggtgtcctaacactgtgagagaaaaaatccgaaagtttagtttttcccattcgcttgccctggcctccaggcagtcctgcagcagcaaacacatcatcagccttaggagctggcctgtgaggttgaccactctgtaggtggacgagcctcgcccgagaagagacatgagcagttctgcgtaggctttaagacagaatcaacatggaaagcacgacccacatggtttcaatagaacttgcctcctgaacctgactaggttactcgcctgatgaaccagtatctccatcacccgtgggactgacagacccagagtgtcataacctaaaattcagaagtgtagactataatcttaaattattcagcatatgtgcaacagccttggggagcagtgttatgataccaaatggctaacattcatgacctcagtatcctggaagaaaaggagaaagtgtgatgtagtaaaaccacttgaaaaaataatgatgaaacatttctcatatttggtgtaagataaaaacttaagtttgaagaggttccatgagccccagacaggataaacctaaagaaaaccaagcccaggccgggggcggtggctcacacctgtaatcccagcactttgggaggccgaggtgggcggatcacaaggtcaggagatcatgaccatcctggccaacacagtgaaacctcgtctctagtaaaaaaaaaaaaaaaaaagaaaaatacaaaaatttagttgggcgtggtggcgggcgactgcagtcccagctactggggaggctgaggcaggagaatggcgtgaacccgggaggcagagcatgcagtgagctgagattgcaccactgcactccagcctgggcaacagagcgagactctgtctcaaaaaagaagaaagaaaagaaaaccaagcccctgccaccacgaagctgccgaaagctacagagtgaaagtcttggaaggaggctgagaaagtggacacagtgcttccagaagaacaattcaattgaccgggtttctcgtcggaagccatagaggccaacaggaaatgtaggagcatttttcaagttctgaaataaaaagaaatgccaacccagattgctatatccaacaaaatatcctttaggaatgaaacagaagtaacgatgaggcaatacaaagaattgcctgcagacctggtttaaataaatggttacagaaaactcttaaggaaacctggaacaaaggaaaagcaatagaagagtaaatacctgagtaaatagatcagatcattctactcttgagttctttaaaatatatattattgtcaaaagcaaaaattatcacatggggtttcaactgatgtatatttaatacataagacaactacaacatgaaggtgaggggcaacgtggctggacggcgtggaggttccgtgctccatttcagtggcaaaataccattccagaaggactggaaaagctaagtctgtatattttaattactaaagaagtgtacagctgggtgtggtggctcacgcctgtaatcccaccactttgggagagtgaggtgggtggatcacttgaggtcaggagtttgagaccagcttggccaacatggtgaaaccccatctctactaagaaatacaaaaattagctgtgtgtggttgggggcacctgtaatctcagcttctcaggaggctgaggcaggagaatcacttgaacccaggaggtggaggttgcagtcagtcgagattgtgccacggcactccagcctgggtgacagagcaagactctgtct

SEQ ID NO: 203782 - DNA, 3674 bp, Homo sapiens
  Payload ID: 20194
  Gene Name: zinc finger protein 780A
  Uniprot ID: O75290
  ENST ID: ENST00000340963
  CDS Start-End: 226-2151
aaggtcttcacgtctgaggaagagatctgtggctgcgggagatctctgcggattggggctccagcctgactgacccgacagtgcgggtggcctagggggaggcgctcagatcgtatttttatccaaaagaaggacctggaggaggatgagagcgttactgctgcacacctaaagtcaagggggagaagcccgaggaagattgaccagttttgtaattctagcaacatggtccatggatcagtgacattcagggatgtggccattgacttctctcaggaggagtgggagtgcctgcagcctgatcagaggaccttgtacagggatgtgatgttggagaactacagccacctgatctcactgggaagttccatttctaaaccagatgtaattacgttactagagcaagagaaagagccctggatggttgtaaggaaagaaacaagcagacggtatccagatttggagttaaaatatggacctgagaaagtatctccagaaaatgatacctctgaagtaaatttacccaaacaggttataaagcaaataagtacaactcttggcattgaggccttttattttagaaatgactcagaatatagacaatttgagggactacagggatatcaagaaggaaatatcaatcaaaagatgatcagctatgaaaaactgcctactcatactcctcatgcttctcttatttgcaatacacataaaccgtatgaatgtaaggaatgtgggaaatactttagtcgtagtgcaaatcttattcagcatcagagtattcatactggagagaaaccctttgaatgtaaggagtgtgggaaagcctttcgacttcacatacaatttactcgacatcagaaatttcatactggtgagaaaccttttgaatgtaacgaatgtggaaaggcctttagtcttcttaccctgcttaatcgccataagaacattcacacaggtgagaaactgtttgaatgtaaggaatgtgggaagtcctttaatcgtagctcaaaccttgttcaacatcagagtattcattctggtgtaaaaccatatgaatgtaaggagtgtgggaaaggctttaatcgtggtgcacaccttattcagcatcagaaaattcattccaatgagaaaccctttgtatgtaaggaatgtgggatggcctttcgatatcattaccaacttattgaacattgccaaattcatactggtgagaaaccctttgaatgtaaagaatgtggaaaggcgtttactcttctgacaaagcttgttcgacatcagaagattcatactggtgagaaaccctttgaatgcagggaatgtgggaaggcctttagtcttctcaaccagcttaatcgccataagaacattcacacaggtgaaaaaccgtttgaatgtaaggaatgtgggaagtcctttaatcgtagctcaaaccttgttcaacatcagagtattcatgctggtataaaaccatatgaatgtaaggagtgtgggaaaggctttaatcgtggtgcacaccttattcagcatcagaaaattcattccaatgagaaaccttttgtatgtagggaatgtgagatggcctttagatatcattgccaacttattgaacattctcgaattcatactggtgacaagccatttgaatgtcaagactgtgggaaggccttcaatcgtggctcaagccttgttcaacatcagagtattcacactggtgagaagccctatgaatgtaaggagtgtgggaaggcttttagactttacctacaactttcccaacatcagaaaactcacacaggtgaaaaaccatttgaatgtaaggaatgtgggaaattctttcgtcgtggttcaaatcttaatcaacatcgaagtattcatactggaaagaaaccctttgaatgtaaggaatgtgggaaagcctttcgacttcatatgcaccttattcgacatcagaaattgcatactggtgagaaaccctttgaatgtaaggagtgtgggaaagcctttcgacttcatatgcaacttattcgacatcagaaattgcatactggtgagaaaccctttgaatgtaaggaatgtggaaaggtttttagtcttcccacccagcttaatcgccataagaacattcacacaggtgagaaggcatcttgaatgtaaggaatgtggaaagtcctttaatcgtgtctcaaaccatgttcaacatcagagtattcgtgctggtgtaaaaccatgtgaatgtaaggggtgtgggaaaggcttcatttgtggttcaaacgttattcagcatcagaaaattcattccagtgagaaactctttgtatgcaaggagtggaggacgacctttagatatcattaccacttatttaacattaccaaattcacactggtaaaaaaccctttgaatgtaaagaatgtggaaaggccttcagttttctgacacagcttgctggacttcaggtcattcatactggcgagaagccatttgaatttgagaaatgtgggaaggccttcaatagtggctcaaaccttgttcaacatcagagtattcatactggtgagaaactctatgaatgtaaggagtgtgggaaaactttcagatttagtttggtcctgactgcacatcaaagaattcatactggtatgaaaccctgtgaatgtacagaatgtgggaagacctttagttgtagctcaaacattgttcaacatgttaaaattcatactggtgagaaacgctataatgtaaggaatatgggaaagcatttgctgtggatgatcagctgtctcaacatcagaaaattcagaatagttagaaattttgtgacaataaggagtgtggacaagccttcactgtgtacgaaaaatttactcaacaccagagagctcatattgatgagaaatcttgtgaacataaaagaatgtgtgaagaactttcatcatggcctgggatttgctcaacttctgagtattcatacttctgagaaatctttgagtgtaaggaatgtggggcgttttatagccacactaaataccttagagttcggagaagataattcttgtgagaaagtctttgaatgaggaatatagggtagttgtcatgttcacaatgtactccctatgaaataatttaccagatacaggcatacctcgctgaattgtgcattgcagttattgtgttttatacaaactgaaggtttgtggcaaccctgtggtgagcaagacgatcaggtccattttcccaacgtcaggtgtgcatttcatgtctttatgtcacattttggtaattctcagaatatttcaaactatttcattgttatatatctatcatggtgatcaatgaccagtgatttttgatgttgctattgtaattgctttgggataccacaaattctgcccataaaagatggtaaacctagttgatacttgttgtgggttttgaaagaatagtcaaatatacaatcatataccccaacctagattcaaaattgttaacaatttgcacgtttattttttgtatatttgttgtaccattgagaataagttttagacatcatgacactttaccctttatttaatcaacgtgtgtatcaaccaaacatgaagacaatatagacaatatcatatagccattgtaccataattaccgttaaggaaagtattcataattctgtaatatc

SEQ ID NO: 203783 - DNA, 7500 bp, Homo sapiens
  Payload ID: 20194
  Gene Name: zinc finger protein 780A
  ENST ID: ENST00000450241
  CDS Start-End: 313-2136
gaggaagagatctgtggctgcgggagatctctgcggattggggctccagcctgactgacccgacagtgcgggtggcctagggggaggcgctcagatcgtatttttatccaaaagaaggacctggaggaggatgagagcgttactgctgcacacctaaagtcaagggggagaagcccgaggaagattgaccagttttgtaattctagcaacatggtccatggatcagtgacattcagggatgtggccattgacttctctcaggaggagtgggagtgcctgcagcctgatcagaggaccttgtacagggatgtgatgttggagaactacagccacctgatctcactgggaagttccatttctaaaccagatgtaattacgttactagagcaagagaaagagccctggatggttgtaaggaaagaaacaagcagacggtatccagatttggagttaaaatatggacctgagaaagtatctccagaaaatgatacctctgaagtaaatttacccaaacaggttataaagcaaataagtacaactcttggcattgaggccttttattttagaaatgactcagaatatagacaatttgagggactacagggatatcaagaaggaaatatcaatcaaaagatgatcagctatgaaaaactgcctactcatactcctcatgcttctcttatttgcaatacacataaaccgtatgaatgtaaggaatgtgggaaatactttagtcgtagtgcaaatcttattcagcatcagagtattcatactggagagaaaccctttgaatgtaaggagtgtgggaaagcctttcgacttcacatacaatttactcgacatcagaaatttcatactggtgagaaaccttttgaatgtaacgaatgtggaaaggcctttagtcttcttaccctgcttaatcgccataagaacattcacacaggtgagaaactgtttgaatgtaaggaatgtgggaagtcctttaatcgtagctcaaaccttgttcaacatcagagtattcattctggtgtaaaaccatatgaatgtaaggagtgtgggaaaggctttaatcgtggtgcacaccttattcagcatcagaaaattcattccaatgagaaaccctttgtatgtaaggaatgtgggatggcctttcgatatcattaccaacttattgaacattgccaaattcatactggtgagaaaccctttgaatgtaaagaatgtggaaaggcgtttactcttctgacaaagcttgttcgacatcagaagattcatactggtgagaaaccctttgaatgcagggaatgtgggaaggcctttagtcttctcaaccagcttaatcgccataagaacattcacacaggtgaaaaaccgtttgaatgtaaggaatgtgggaagtcctttaatcgtagctcaaaccttgttcaacatcagagtattcatgctggtataaaaccatatgaatgtaaggagtgtgggaaaggctttaatcgtggtgcacaccttattcagcatcagaaaattcattccaatgagaaaccttttgtatgtagggaatgtgagatggcctttagatatcattgccaacttattgaacattctcgaattcatactggtgacaagccatttgaatgtcaagactgtgggaaggccttcaatcgtggctcaagccttgttcaacatcagagtattcacactggtgagaagccctatgaatgtaaggagtgtgggaaggcttttagactttacctacaactttcccaacatcagaaaactcacacaggtgaaaaaccatttgaatgtaaggaatgtgggaaattctttcgtcgtggttcaaatcttaatcaacatcgaagtattcatactggaaagaaaccctttgaatgtaaggaatgtgggaaagcctttcgacttcatatgcaccttattcgacatcagaaattgcatactggtgagaaaccctttgaatgtaaggagtgtgggaaagcctttcgacttcatatgcaacttattcgacatcagaaattgcatactggtgagaaaccctttgaatgtaaggaatgtggaaaggtttttagtcttcccacccagcttaatcgccataagaacattcacacaggtgagaaggcatcttgaatgtaaggaatgtggaaagtcctttaatcgtgtctcaaaccatgttcaacatcagagtattcgtgctggtgtaaaaccatgtgaatgtaaggggtgtgggaaaggcttcatttgtggttcaaacgttattcagcatcagaaaattcattccagtgagaaactctttgtatgcaaggagtggaggacgacctttagatatcattaccacttatttaacattaccaaattcacactggtaaaaaaccctttgaatgtaaagaatgtggaaaggccttcagttttctgacacagcttgctggacttcaggtcattcatactggcgagaagccatttgaatttgagaaatgtgggaaggccttcaatagtggctcaaaccttgttcaacatcagagtattcatactggtgagaaactctatgaatgtaaggagtgtgggaaaactttcagatttagtttggtcctgactgcacatcaaagaattcatactggtatgaaaccctgtgaatgtacagaatgtgggaagacctttagttgtagctcaaacattgttcaacatgttaaaattcatactggtgagaaacgctataatgtaaggaatatgggaaagcatttgctgtggatgatcagctgtctcaacatcagaaaattcagaatagttagaaattttgtgacaataaggagtgtggacaagccttcactgtgtacgaaaaatttactcaacaccagagagctcatattgatgagaaatcttgtgaacataaaagaatgtgtgaagaactttcatcatggcctgggatttgctcaacttctgagtattcatacttctgagaaatctttgagtgtaaggaatgtggggcgttttatagccacactaaataccttagagttcggagaagataattcttgtgagaaagtctttgaatgaggaatatagggtagttgtcatgttcacaatgtactccctatgaaataatttaccagatacaggcatacctcgctgaattgtgcattgcagttattgtgttttatacaaactgaaggtttgtggcaaccctgtggtgagcaagacgatcaggtccattttcccaacgtcaggtgtgcatttcatgtctttatgtcacattttggtaattctcagaatatttcaaactatttcattgttatatatctatcatggtgatcaatgaccagtgatttttgatgttgctattgtaattgctttgggataccacaaattctgcccataaaagatggtaaacctagttgatacttgttgtgggttttgaaagaatagtcaaatatacaatcatataccccaacctagattcaaaattgttaacaatttgcacgtttattttttgtatatttgttgtaccattgagaataagttttagacatcatgacactttaccctttatttaatcaacgtgtgtatcaaccaaacatgaagacaatatagacaatatcatatagccattgtaccataattaccgttaaggaaagtattcataattctgtaatatcattccattttcagatttcttcattggcttccaaaccatcttttacagctattcatattcaaaggagaatccattgcagaatctgcattgcatttggttatctctctttagtgtattgtagcctggaaatcctatgaatgtaggcgctcaaattttggtaggtattagaatcaacagtggcacttagtaaagctacagaggcttaagccctagcttataattctgggcctctatgttttttattatttctccaggtgattgtgataccaaccagagttagagagccactgacctagaacatttctcctttctcctcattcttctttttttttttttttttgcagttgcaagatttaatagagtgaaaacagagctcccatacaaagggaggggacccaaagagggtagtcgttgccggctcgaatgcctgggtttatatcctgatcattgtccctcccgctgtgctctcaggcaatagatgattggctatttctttacctcctgtttttgcctaattagcattttagcgggctctctttcttacctgatgggtcgggtgtgagctgagttgcaagccccgtgtttaaaggtggatgtggtcaacttcccatctaggcttagggattcttaatcggcctaggaaatcctgctagtcctgtttctcagtaccccctctcaacaggaaaacccaagtgctgttggggaggttggccaacaactgctctaattgcttcctgctgaattggggtgtagtaggggttgtgcagttgagatttcctctggaggggtgccttcgatgtcattaacattggagcatgggctagcaggccggtccaggggtccgcggtagattttagtcatggactgcatctggggctccatttgaagaatgagttgtggctttacagcttcgattctggaaaagacaaacttaacaaggaggttaaagatacagagattgaaatgtatggcctgcagtgcaggggattatttctttggcacacttcacaggccctgactatctgcttgatagttttgaaaaggcctggtccatctcctcattcttaaaaaatgagattgaattttgattagcccaggaaaattgtctatgtgtttagatttctttctttatagtgtcatttagtgttgttctctttgttgcatattctgtacaagggaatttgagtccagaggctctgttaggtcagattaaacattttggggaagaatactttgtaggctatttgtatggcatatttcactgtcagaaaacatttaagtacaggtccttgcattagtgaaactaagtttgatcatttgggtaagctggtaaccgccataagtccattgtaaagatctaatttgtagtgcataaataatctatggagagactttgacctctgaatatttataatcatgtgtattttagctgtggattgaatacaaaatgaaaattgaaatagactattcaaaaatgaatgccattaaggttgtcaacataagtcaacttgtgtgataaggctgacagtatattcagtacaaaattagcaccctctagtttattcagggagccaagattattttgtctggaaccttgtttttgttcagcatttatcatcagcacctatacatcatggctggtatgtgagctgttgataaactttgaaaaaaattaagcctttaaatcaagctataaaacatgataccattgtggcatcatgaattagagagattaacttttttaaagatcaataataatcctttgtgattttattccagtgcatttaaaaatctataaaatgataatttatattgatagctttcttctttttgtgaatatatccttatcagattattatgcttttgatagactacttaattctatttcttaacatttaattgtatctataatcataggtaaagttataattttctaaacatttttcaggttttgttaatgcagtgatcttataaatcttacaaaacgaggctatttaaaacctggctttctagtctcatgttcctattttttatttccactttcatctttttcatattgattctctttgactttcttttttgaactcaacagattccctgggtattaacccagcacaactcctttatgggtcattgcacattctggtatctcattaagaattgtcataaaaaagagatcccaggaggccttccagtgaaactctatcatcatgcaatcttgggatttctaagttggaagtcacagtccctttgcaaacataataaaacactttaaaatatttgctaaagttacaaaccaattatgtaaaaatttaaaaatcacctactacttttaaaagcagagaaggcatccatagactatttccttgcttacaagctcagtgaacatactgaattcacttataaaaagaattttctcaattttagttgcttttcaaaaaattcttattccttttatttgtaattctttgacattgttgctgcttcacagttttggtaattggacagtttggtctttattatgatattaacatttttacctgtcctgaaacaaggaaatacaatcaaagaaacagaagattggtggaccttgaaccacattatgatatcagatgacccagagtcatggttactaagttgcttaaatttttagtaacaaagatgtattagaaagtgacaggtcaattcaataatggtttttttggatacatttaattatataatccccttaagttgtgcttagtcagcagtatttaatctgttgtctattatatatctaactggtctgttatgtttattatatatttatatattgcttattcatatcttattggagtaactcatttttaaaacaatatatttcatctcctaggagaagaggatcgagtatgtgtttttattctttttcattaggacattggggtattttcttattgtgaaatgtattgaatatttcatttatttggtttgtgagtctgaccttcactccctagcactgatttttatttggccctccttttacctgattcataggagttacgagtagccgttaatatggatacatttttcccatttctagtacactgccccttccaaaagtgtctggcttactcaaacttttctgtatttgttccatcttgcttttacagatcaatacaaataggtaactataccttctaaacaaacatcaagttggtggaaaaaaggcatatgaacagttctttctcacctactatcaacaaacagtaaattaaacattcctaactgcagcctccttttgtaaaatttataaccatttatcttttgagtgtgacatgatactagatgtatgataattacatgttttgtgtatcagtatgaacatgatttttaacagacttgttccaatgaactattatagagatggtccccaacaatgtcaactaacaatttctcagctttatgatggtacaaaagtgatatgttgctatagtttggatatttgtccctccaaatctcatgttgaagtttgatctcagtgttggaggtggggcctaatggaaggtgtttgggtcatggtggaagatccctcatgaataaattaatgccctctctggattgaggggtgagtgagctatcgctctgttaatttttgtgagagctggttgttcaaaagaacctggcacctcctccctcaccctcttgttttctctcttgccatgtgatgtctgcatacactggctctcccttcatcatctgccatgagtggaagcagcctgagacccttagcagaagcagatgctgcaccatgattcttgtacattctgcagaacagtgagccaaataaacctctttattaatca

SEQ ID NO: 203784 - DNA, 3600 bp, Homo sapiens
  Payload ID: 20194
  Gene Name: zinc finger protein 780A
  Uniprot ID: O75290
  ENST ID: ENST00000455521
  CDS Start-End: 149-2077
acttccggtctccggggtcgacgacatagcgggtcgtatttttatccaaaagaaggacctggaggaggatgagagcgttactgctgcacacctaaagtcaagggggagaagcccgaggaagattgaccagttttgtaattctagcaacatggtccatggatcagtgacattcagggatgtggccattgacttctctcaggaggagtgggagtgcctgcagcctgatcagaggaccttgtacagggatgtgatgttggagaactacagccacctgatctcactggcaggaagttccatttctaaaccagatgtaattacgttactagagcaagagaaagagccctggatggttgtaaggaaagaaacaagcagacggtatccagatttggagttaaaatatggacctgagaaagtatctccagaaaatgatacctctgaagtaaatttacccaaacaggttataaagcaaataagtacaactcttggcattgaggccttttattttagaaatgactcagaatatagacaatttgagggactacagggatatcaagaaggaaatatcaatcaaaagatgatcagctatgaaaaactgcctactcatactcctcatgcttctcttatttgcaatacacataaaccgtatgaatgtaaggaatgtgggaaatactttagtcgtagtgcaaatcttattcagcatcagagtattcatactggagagaaaccctttgaatgtaaggagtgtgggaaagcctttcgacttcacatacaatttactcgacatcagaaatttcatactggtgagaaaccttttgaatgtaacgaatgtggaaaggcctttagtcttcttaccctgcttaatcgccataagaacattcacacaggtgagaaactgtttgaatgtaaggaatgtgggaagtcctttaatcgtagctcaaaccttgttcaacatcagagtattcattctggtgtaaaaccatatgaatgtaaggagtgtgggaaaggctttaatcgtggtgcacaccttattcagcatcagaaaattcattccaatgagaaaccctttgtatgtaaggaatgtgggatggcctttcgatatcattaccaacttattgaacattgccaaattcatactggtgagaaaccctttgaatgtaaagaatgtggaaaggcgtttactcttctgacaaagcttgttcgacatcagaagattcatactggtgagaaaccctttgaatgcagggaatgtgggaaggcctttagtcttctcaaccagcttaatcgccataagaacattcacacaggtgaaaaaccgtttgaatgtaaggaatgtgggaagtcctttaatcgtagctcaaaccttgttcaacatcagagtattcatgctggtataaaaccatatgaatgtaaggagtgtgggaaaggctttaatcgtggtgcacaccttattcagcatcagaaaattcattccaatgagaaaccttttgtatgtagggaatgtgagatggcctttagatatcattgccaacttattgaacattctcgaattcatactggtgacaagccatttgaatgtcaagactgtgggaaggccttcaatcgtggctcaagccttgttcaacatcagagtattcacactggtgagaagccctatgaatgtaaggagtgtgggaaggcttttagactttacctacaactttcccaacatcagaaaactcacacaggtgaaaaaccatttgaatgtaaggaatgtgggaaattctttcgtcgtggttcaaatcttaatcaacatcgaagtattcatactggaaagaaaccctttgaatgtaaggaatgtgggaaagcctttcgacttcatatgcaccttattcgacatcagaaattgcatactggtgagaaaccctttgaatgtaaggagtgtgggaaagcctttcgacttcatatgcaacttattcgacatcagaaattgcatactggtgagaaaccctttgaatgtaaggaatgtggaaaggtttttagtcttcccacccagcttaatcgccataagaacattcacacaggtgagaaggcatcttgaatgtaaggaatgtggaaagtcctttaatcgtgtctcaaaccatgttcaacatcagagtattcgtgctggtgtaaaaccatgtgaatgtaaggggtgtgggaaaggcttcatttgtggttcaaacgttattcagcatcagaaaattcattccagtgagaaactctttgtatgcaaggagtggaggacgacctttagatatcattaccacttatttaacattaccaaattcacactggtaaaaaaccctttgaatgtaaagaatgtggaaaggccttcagttttctgacacagcttgctggacttcaggtcattcatactggcgagaagccatttgaatttgagaaatgtgggaaggccttcaatagtggctcaaaccttgttcaacatcagagtattcatactggtgagaaactctatgaatgtaaggagtgtgggaaaactttcagatttagtttggtcctgactgcacatcaaagaattcatactggtatgaaaccctgtgaatgtacagaatgtgggaagacctttagttgtagctcaaacattgttcaacatgttaaaattcatactggtgagaaacgctataatgtaaggaatatgggaaagcatttgctgtggatgatcagctgtctcaacatcagaaaattcagaatagttagaaattttgtgacaataaggagtgtggacaagccttcactgtgtacgaaaaatttactcaacaccagagagctcatattgatgagaaatcttgtgaacataaaagaatgtgtgaagaactttcatcatggcctgggatttgctcaacttctgagtattcatacttctgagaaatctttgagtgtaaggaatgtggggcgttttatagccacactaaataccttagagttcggagaagataattcttgtgagaaagtctttgaatgaggaatatagggtagttgtcatgttcacaatgtactccctatgaaataatttaccagatacaggcatacctcgctgaattgtgcattgcagttattgtgttttatacaaactgaaggtttgtggcaaccctgtggtgagcaagacgatcaggtccattttcccaacgtcaggtgtgcatttcatgtctttatgtcacattttggtaattctcagaatatttcaaactatttcattgttatatatctatcatggtgatcaatgaccagtgatttttgatgttgctattgtaattgctttgggataccacaaattctgcccataaaagatggtaaacctagttgatacttgttgtgggttttgaaagaatagtcaaatatacaatcatataccccaacctagattcaaaattgttaacaatttgcacgtttattttttgtatatttgttgtaccattgagaataagttttagacatcatgacactttaccctttatttaatcaacgtgtgtatcaaccaaacatgaagacaatatagacaatatcatatagccattgtaccataattaccgttaaggaaagtattcataattctgtaatatc

SEQ ID NO: 203785 - DNA, 2396 bp, Homo sapiens
  Payload ID: 20194
  Gene Name: zinc finger protein 780A
  Uniprot ID: O75290
  ENST ID: ENST00000414720
  CDS Start-End: 256-732
acttccggtctccggggtcgacgacatagcgggtcgtatttttatccaaaagaaggacctggaggaggatgagagcgttactgctgcacacctaaagtcaaggaacaggagcattgggaatatgtgattcattgcgactgctggttgtatattaagaaaatgagtgaggggctcaaatgatctaggacagaaattctttctttttaaatcgacagatataattgtatgtatttatcatgtgcaacatgaagttttatggggagaagcccgaggaagattgaccagttttgtaattctagcaacatggtccatggatcagtgacattcagggatgtggccattgacttctctcaggaggagtgggagtgcctgcagcctgatcagaggaccttgtacagggatgtgatgttggagaactacagccacctgatctcactgggaagttccatttctaaaccagatgtaattacgttactagagcaagagaaagagccctggatggttgtaaggaaagaaacaagcagacggtatccagatttggagttaaaatatggacctgagaaagtatctccagaaaatgatacctctgaagtaaatttacccaaacagatttcttcattggcttccaaaccatcttttacagctattcatattcaaaggagaatccattgcagaatctgcattgcatttggttatctctctttagtgtattgtagcctggaaatcctatgaatgtaggcgctcaaattttgttgcaagatttaatagagtgaaaacagagctcccatacaaagggaggggacccaaagagggtagtcgttgccggctcgaatgcctgggtttatatcctgatcattgtccctcccgctgtgctctcaggcaatagatgattggctatttctttacctcctgtttttgcctaattagcattttagcgggctctctttcttacctgatgggtcgggtgtgagctgagttgcaagccccgtgtttaaaggtggatgtggtcaacttcccatctaggcttagggattcttaatcggcctaggaaatcctgctagtcctgtttctcagtaccccctctcaacaggaaaacccaagtgctgttggggaggttggccaacaactgctctaattgcttcctgctgaattggggtgtagtaggggttgtgcagttgagatttcctctggaggggtgccttcgatgtcattaacattggagcatgggctagcaggccggtccaggggtccgcggtagattttagtcatggactgcatctggggctccatttgaagaatgagttgtggctttacagcttcgattctggaaaagacaaacttaacaaggaggttaaagatacagagattgaaatgtatggcctgcagtgcaggggattatttctttggcacacttcacaggccctgactatctgcttgatagttttgaaaaggcctggtccatctcctcattcttaaaaaatgagattgaattttgattagcccaggaaaattgtctatgtgtttagatttctttctttatagtgtcatttagtgttgttctctttgttgcatattctgtacaagggaatttgagtccagaggctctgttaggtcagattaaacattttggggaagaatactttgtaggctatttgtatggcatatttcactgtcagaaaacatttaagtacaggtccttgcattagtgaaactaagtttgatcatttgggtaagctggtaaccgccataagtccattgtaaagatctaatttgtagtgcataaataatctatggagagactttgacctctgaatatttataatcatgtgtattttagctgtggattgaatacaaaatgaaaattgaaatagactattcaaaaatgaatgccattaaggttgtcaacataagtcaacttgtgtgataaggctgacagtatattcagtacaaaattagcaccctctagtttattcagggagccaagattattttgtctggaaccttgtttttgttcagcatttatcatcagcacctatacatcatggctggtatgtgagctgttgataaactttgaaaaaaattaagcctttaaatcaagctataaaacatgataccattgtggcatcatgaattagagagattaacttttttaaagatcaataataatcctttgtgattttattccagtgcatttaaaaatctataaaatgataatttatattgatagctttcttctttttgtgaatatatccttatcagattattatgcttttgatagactacttaattctatttcttaacatttaattgtatctataatcataggtaaagttataattttctaaacatttttcaggttttgttaatgcagtgatcttataaatcttacaaaacga

SEQ ID NO: 203786 - DNA, 546 bp, Homo sapiens
  Payload ID: 20194
  Gene Name: zinc finger protein 780A
  ENST ID: ENST00000595773
  CDS Start-End: 79-546
acttccggtctccggggtcgacgacatagcggggggagaagcccgaggaagattgaccagttttgtaattctagcaacatggtccatggatcagtgacattcagggatgtggccattgacttctctcaggaggagtgggagtgcctgcagcctgatcagaggaccttgtacagggatgtgatgttggagaactacagccacctgatctcactgggaagttccatttctaaaccagatgtaattacgttactagagcaagagaaagagccctggatggttgtaaggaaagaaacaagcagacggtatccagatttggagttaaaatatggacctgagaaagtatctccagaaaatgatacctctgaagtaaatttacccaaacaggttataaagcaaataagtacaactcttggcattgaggccttttattttagaaatgactcagaatatagacaatttgagggactacagggatatcaagaaggaaatatcaatcaaaagatgatcagctatgaaaaactgcctactcatactcctcatgcttct

SEQ ID NO: 203787 - DNA, 665 bp, Homo sapiens
  Payload ID: 20194
  Gene Name: zinc finger protein 780A
  ENST ID: ENST00000599368
  CDS Start-End: 338-665
ggggggcagctacatgttgagaaccacagcgtcctcagagctctgtccccagaaaccagctccaaactggttgtactggttgaatcgattcctcttccttttacttccttcctatttcgtgtgaagtgagggaaattgtggctatggagggagggtgttttcaaacttagtctgcgctccaagaaatgcctggagtctcacgcttgccgtatccttctccagtcgtatttttatccaaaagaaggacctggaggaggatgagagcgttactgctgcacacctaaagtcaagggggagaagcccgaggaagattgaccagttttgtaattctagcaacatggtccatggatcagtgacattcagggatgtggccattgacttctctcaggaggagtgggagtgcctgcagcctgatcagaggaccttgtacagggatgtgatgttggagaactacagccacctgatctcactgggaagttccatttctaaaccagatgtaattacgttactagagcaagagaaagagccctggatggttgtaaggaaagaaacaagcagacggtatccagatttggagttaaaatatggacctgagaaagtatctccagaaaatgatacctctgaagtaaatttacccaaacaggttataaagcaaataagtacaa

SEQ ID NO: 203788 - DNA, 2044 bp, Homo sapiens
  Payload ID: 20194
  Gene Name: zinc finger protein 780A
  Uniprot ID: O75290
  ENST ID: ENST00000594395
  CDS Start-End: 116-2044
tcgtatttttatccaaaagaaggacctggaggaggatgagagcgttactgctgcacacctaaagtcaagggggagaagcccgaggaagattgaccagttttgtaattctagcaacatggtccatggatcagtgacattcagggatgtggccattgacttctctcaggaggagtgggagtgcctgcagcctgatcagaggaccttgtacagggatgtgatgttggagaactacagccacctgatctcactggcaggaagttccatttctaaaccagatgtaattacgttactagagcaagagaaagagccctggatggttgtaaggaaagaaacaagcagacggtatccagatttggagttaaaatatggacctgagaaagtatctccagaaaatgatacctctgaagtaaatttacccaaacaggttataaagcaaataagtacaactcttggcattgaggccttttattttagaaatgactcagaatatagacaatttgagggactacagggatatcaagaaggaaatatcaatcaaaagatgatcagctatgaaaaactgcctactcatactcctcatgcttctcttatttgcaatacacataaaccgtatgaatgtaaggaatgtgggaaatactttagtcgtagtgcaaatcttattcagcatcagagtattcatactggagagaaaccctttgaatgtaaggagtgtgggaaagcctttcgacttcacatacaatttactcgacatcagaaatttcatactggtgagaaaccttttgaatgtaacgaatgtggaaaggcctttagtcttcttaccctgcttaatcgccataagaacattcacacaggtgagaaactgtttgaatgtaaggaatgtgggaagtcctttaatcgtagctcaaaccttgttcaacatcagagtattcattctggtgtaaaaccatatgaatgtaaggagtgtgggaaaggctttaatcgtggtgcacaccttattcagcatcagaaaattcattccaatgagaaaccctttgtatgtaaggaatgtgggatggcctttcgatatcattaccaacttattgaacattgccaaattcatactggtgagaaaccctttgaatgtaaagaatgtggaaaggcgtttactcttctgacaaagcttgttcgacatcagaagattcatactggtgagaaaccctttgaatgcagggaatgtgggaaggcctttagtcttctcaaccagcttaatcgccataagaacattcacacaggtgaaaaaccgtttgaatgtaaggaatgtgggaagtcctttaatcgtagctcaaaccttgttcaacatcagagtattcatgctggtataaaaccatatgaatgtaaggagtgtgggaaaggctttaatcgtggtgcacaccttattcagcatcagaaaattcattccaatgagaaaccttttgtatgtagggaatgtgagatggcctttagatatcattgccaacttattgaacattctcgaattcatactggtgacaagccatttgaatgtcaagactgtgggaaggccttcaatcgtggctcaagccttgttcaacatcagagtattcacactggtgagaagccctatgaatgtaaggagtgtgggaaggcttttagactttacctacaactttcccaacatcagaaaactcacacaggtgaaaaaccatttgaatgtaaggaatgtgggaaattctttcgtcgtggttcaaatcttaatcaacatcgaagtattcatactggaaagaaaccctttgaatgtaaggaatgtgggaaagcctttcgacttcatatgcaccttattcgacatcagaaattgcatactggtgagaaaccctttgaatgtaaggagtgtgggaaagcctttcgacttcatatgcaacttattcgacatcagaaattgcatactggtgagaaaccctttgaatgtaaggaatgtggaaaggtttttagtcttcccacccagcttaatcgccataagaacattcacacaggtgagaaggcatcttga

SEQ ID NO: 203789 - DNA, 498 bp, Homo sapiens
  Payload ID: 20194
  Gene Name: zinc finger protein 780A
  ENST ID: ENST00000599972
  CDS Start-End: 227-498
ctctgcggattggggctccagcctgactgacccgacagtgcgggtggcctagggggaggcgctcagagtaggaacccgggggtgcagacgggatctgccggatccccaggctcgtatttttatccaaaagaaggacctggaggaggatgagagcgttactgctgcacacctaaagtcaagggggagaagcccgaggaagattgaccagttttgtaattctagcaacatggtccatggatcagtgacattcagggatgtggccattgacttctctcaggaggagtgggagtgcctgcagcctgatcagaggaccttgtacagggatgtgatgttggagaactacagccacctgatctcactgggaagttccatttctaaaccagatgtaattacgttactagagcaagagaaagagccctggatggttgtaaggaaagaaacaagcagacggtatccagatttggagttaaaatatggacctgagaaagtatctccaga

SEQ ID NO: 203790 - DNA, 446 bp, Homo sapiens
  Payload ID: 20194
  Gene Name: zinc finger protein 780A
  ENST ID: ENST00000601715
  CDS Start-End: 116-446
tcgtatttttatccaaaagaaggacctggaggaggatgagagcgttactgctgcacacctaaagtcaagggggagaagcccgaggaagattgaccagttttgtaattctagcaacatggtccatggatcagtgacattcagggatgtggccattgacttctctcaggaggagtgggagtgcctgcagcctgatcagaggaccttgtacagggatgtgatgttggagaactacagccacctgatctcactggcaggaagttccatttctaaaccagatgtaattacgttactagagcaagagaaagagccctggatggttgtaaggaaagaaacaagcagacggtatccagatttggagttaaaatatggacctgagaaagtatctccagaaaatgatacctctgaagtaaatttacccaaacaggttataaagcaaataagtacaa

SEQ ID NO: 203791 - DNA, 3472 bp, Homo sapiens
  Payload ID: 20194
  Gene Name: zinc finger protein 780A
  Uniprot ID: O75290
  ENST ID: ENST00000595687
  CDS Start-End: 211-2136
gaggaagagatctgtggctgcgggagatctctgcggattggggctccagcctgactgacccgacagtgcgggtggcctagggggaggcgctcagatcgtatttttatccaaaagaaggacctggaggaggatgagagcgttactgctgcacacctaaagtcaagggggagaagcccgaggaagattgaccagttttgtaattctagcaacatggtccatggatcagtgacattcagggatgtggccattgacttctctcaggaggagtgggagtgcctgcagcctgatcagaggaccttgtacagggatgtgatgttggagaactacagccacctgatctcactgggaagttccatttctaaaccagatgtaattacgttactagagcaagagaaagagccctggatggttgtaaggaaagaaacaagcagacggtatccagatttggagttaaaatatggacctgagaaagtatctccagaaaatgatacctctgaagtaaatttacccaaacaggttataaagcaaataagtacaactcttggcattgaggccttttattttagaaatgactcagaatatagacaatttgagggactacagggatatcaagaaggaaatatcaatcaaaagatgatcagctatgaaaaactgcctactcatactcctcatgcttctcttatttgcaatacacataaaccgtatgaatgtaaggaatgtgggaaatactttagtcgtagtgcaaatcttattcagcatcagagtattcatactggagagaaaccctttgaatgtaaggagtgtgggaaagcctttcgacttcacatacaatttactcgacatcagaaatttcatactggtgagaaaccttttgaatgtaacgaatgtggaaaggcctttagtcttcttaccctgcttaatcgccataagaacattcacacaggtgagaaactgtttgaatgtaaggaatgtgggaagtcctttaatcgtagctcaaaccttgttcaacatcagagtattcattctggtgtaaaaccatatgaatgtaaggagtgtgggaaaggctttaatcgtggtgcacaccttattcagcatcagaaaattcattccaatgagaaaccctttgtatgtaaggaatgtgggatggcctttcgatatcattaccaacttattgaacattgccaaattcatactggtgagaaaccctttgaatgtaaagaatgtggaaaggcgtttactcttctgacaaagcttgttcgacatcagaagattcatactggtgagaaaccctttgaatgcagggaatgtgggaaggcctttagtcttctcaaccagcttaatcgccataagaacattcacacaggtgaaaaaccgtttgaatgtaaggaatgtgggaagtcctttaatcgtagctcaaaccttgttcaacatcagagtattcatgctggtataaaaccatatgaatgtaaggagtgtgggaaaggctttaatcgtggtgcacaccttattcagcatcagaaaattcattccaatgagaaaccttttgtatgtagggaatgtgagatggcctttagatatcattgccaacttattgaacattctcgaattcatactggtgacaagccatttgaatgtcaagactgtgggaaggccttcaatcgtggctcaagccttgttcaacatcagagtattcacactggtgagaagccctatgaatgtaaggagtgtgggaaggcttttagactttacctacaactttcccaacatcagaaaactcacacaggtgaaaaaccatttgaatgtaaggaatgtgggaaattctttcgtcgtggttcaaatcttaatcaacatcgaagtattcatactggaaagaaaccctttgaatgtaaggaatgtgggaaagcctttcgacttcatatgcaccttattcgacatcagaaattgcatactggtgagaaaccctttgaatgtaaggagtgtgggaaagcctttcgacttcatatgcaacttattcgacatcagaaattgcatactggtgagaaaccctttgaatgtaaggaatgtggaaaggtttttagtcttcccacccagcttaatcgccataagaacattcacacaggtgagaaggcatcttgaatgtaaggaatgtggaaagtcctttaatcgtgtctcaaaccatgttcaacatcagagtattcgtgctggtgtaaaaccatgtgaatgtaaggggtgtgggaaaggcttcatttgtggttcaaacgttattcagcatcagaaaattcattccagtgagaaactctttgtatgcaaggagtggaggacgacctttagatatcattaccacttatttaacattaccaaattcacactggtaaaaaaccctttgaatgtaaagaatgtggaaaggccttcagttttctgacacagcttgctggacttcaggtcattcatactggcgagaagccatttgaatttgagaaatgtgggaaggccttcaatagtggctcaaaccttgttcaacatcagagtattcatactggtgagaaactctatgaatgtaaggagtgtgggaaaactttcagatttagtttggtcctgactgcacatcaaagaattcatactggtatgaaaccctgtgaatgtacagaatgtgggaagacctttagttgtagctcaaacattgttcaacatgttaaaattcatactggtgagaaacgctataatgtaaggaatatgggaaagcatttgctgtggatgatcagctgtctcaacatcagaaaattcagaatagttagaaattttgtgacaataaggagtgtggacaagccttcactgtgtacgaaaaatttactcaacaccagagagctcatattgatgagaaatcttgtgaacataaaagaatgtgtgaagaactttcatcatggcctgggatttgctcaacttctgagtattcatacttctgagaaatctttgagtgtaaggaatgtggggcgttttatagccacactaaataccttagagttcggagaagataattcttgtgagaaagtctttgaatgaggaatatagggtagttgtcatgttcacaatgtactccctatgaaataatttaccagatacaggcatacctcgctgaattgtgcattgcagttattgtgttttatacaaactgaaggtttgtggcaaccctgtggtgagcaagacgatcaggtccattttcccaacgtcaggtgtgcatttcatgtctttatgtcacattttggtaattctcagaatatttcaaactatttcattgttatatatctatcatggtgatcaatgaccagtgatttttgatgttgctattgtaattgctttgggataccacaaattctgcccataaaagatggtaaacctagttgatacttgttgtgggttttgaaagaatagtcaaatatacaatcatataccccaacctagattcaaaattgtt

SEQ ID NO: 203792 - DNA, 467 bp, Homo sapiens
  Payload ID: 20194
  Gene Name: zinc finger protein 780A
  ENST ID: ENST00000601688
  CDS Start-End: 149-467
acttccggtctccggggtcgacgacatagcgggtcgtatttttatccaaaagaaggacctggaggaggatgagagcgttactgctgcacacctaaagtcaagggggagaagcccgaggaagattgaccagttttgtaattctagcaacatggtccatggatcagtgacattcagggatgtggccattgacttctctcaggaggagtgggagtgcctgcagcctgatcagaggaccttgtacagggatgtgatgttggagaactacagccacctgatctcactgggaagttccatttctaaaccagatgtaattacgttactagagcaagagaaagagccctggatggttgtaaggaaagaaacaagcagacggtatccagatttggagttaaaatatggacctgagaaagtatctccagaaaatgatacctctgaagtaaatttacccaaacaggttataaagcaaa

SEQ ID NO: 203793 - DNA, 498 bp, Homo sapiens; identical to SEQ ID NO: 203789
  Payload ID: 20194
  Gene Name: Zinc finger protein 780A
  ENST ID: ENST00000627069
  CDS Start-End: 227-498

SEQ ID NO: 203794 - DNA, 665 bp, Homo sapiens; identical to SEQ ID NO: 203787
  Payload ID: 20194
  Gene Name: Zinc finger protein 780A
  ENST ID: ENST00000628727
  CDS Start-End: 338-665

SEQ ID NO: 203795 - DNA, 3600 bp, Homo sapiens; identical to SEQ ID NO: 203784
  Payload ID: 20194
  Gene Name: Zinc finger protein 780A
  ENST ID: ENST00000630528
  CDS Start-End: 149-2077

SEQ ID NO: 203796 - DNA, 2396 bp, Homo sapiens; identical to SEQ ID NO: 203785
  Payload ID: 20194
  Gene Name: Zinc finger protein 780A
  ENST ID: ENST00000630440
  CDS Start-End: 256-732

SEQ ID NO: 203797 - DNA, 467 bp, Homo sapiens; identical to SEQ ID NO: 203792
  Payload ID: 20194
  Gene Name: Zinc finger protein 780A
  ENST ID: ENST00000626417
  CDS Start-End: 149-467

SEQ ID NO: 203798 - DNA, 7500 bp, Homo sapiens; identical to SEQ ID NO: 203783
  Payload ID: 20194
  Gene Name: Zinc finger protein 780A
  ENST ID: ENST00000629480
  CDS Start-End: 313-2136

SEQ ID NO: 203799 - DNA, 446 bp, Homo sapiens; identical to SEQ ID NO: 203790
  Payload ID: 20194
  Gene Name: Zinc finger protein 780A
  ENST ID: ENST00000630978
  CDS Start-End: 116-446

SEQ ID NO: 203800 - DNA, 3472 bp, Homo sapiens; identical to SEQ ID NO: 203791
  Payload ID: 20194
  Gene Name: Zinc finger protein 780A
  ENST ID: ENST00000626829
  CDS Start-End: 211-2136

SEQ ID NO: 203801 - DNA, 2044 bp, Homo sapiens; identical to SEQ ID NO: 203788
  Payload ID: 20194
  Gene Name: Zinc finger protein 780A
  ENST ID: ENST00000626168
  CDS Start-End: 116-2044

SEQ ID NO: 203802 - DNA, 546 bp, Homo sapiens; identical to SEQ ID NO: 203786
  Payload ID: 20194
  Gene Name: Zinc finger protein 780A
  ENST ID: ENST00000625733
  CDS Start-End: 79-546

SEQ ID NO: 203803 - DNA, 3674 bp, Homo sapiens; identical to SEQ ID NO: 203782
  Payload ID: 20194
  Gene Name: Zinc finger protein 780A
  ENST ID: ENST00000628273
  CDS Start-End: 226-2151

SEQ ID NO: 203804 - DNA, 3538 bp, Homo sapiens
  Payload ID: 20195
  Gene Name: zinc finger protein 780B
  ENST ID: ENST00000221355
  CDS Start-End: 703-2760
gttgacgacctagctgggtaaggtcttcacgtcctaggaagaaatcggtggctgcgggaggtcttcgtggactgggactcgaacctgaccgacccggcagtgcgggggagaagcccgaggaagattgaccaattttgtaattctagaaacatggtccatggagtgcatctcgttatgttgcccaggctgtttgccaactcctgggctcaagcagtccttccaccttggtctcccaaagtgctggtataacaggcatgagccaccacaccaggccagcagcaggattcttgaagaatgtggatcagtgacattcagggatgtggccattgacttctctcaggaggagtgggagtgcctgcagcctgatcagaggaccttgtacagggatgtgatgttggagaactacagccacctgatatcactgggaagttccatttctaagccagatgtgattacattactagagcaagagaaagagccctggattgttatttggagtcaaaatatggacctgagaaaatatctccagaaaatgatatttttgaaataaatttacccaaacatgttataaagcaaataagtaaaacacttggcctcgaggccttttattttagaaatgactcagaatatagaagtagatttgagggacgacagggacatcaagaaggatatatcaaccagaagatcatcagctatgaagaaatgcctgcttatactcatgcttctcctattcataatacacataaaccatatgaatgtaaggaatgtgggaaatactttagttgtggttcaaatcttattcagcatcagagtattcatactggagagaaaccctataaatgcaaagaatgtgggaaagcctttcaacttcacatacaacttactcgacatcagaaatttcatactggtgagaaaacttttgaatgtaaggaatgtggaaaagcctttaatcttcccacccagcttaatcgccataagaacattcacacagttaagaaactgtttgaatgtaaggaatgtgggaagtcttttaatcgtagctcaaaccttactcagcatcaaagtattcatgctggtgtaaaaccatatcaatgtaaggagtgtgggaaagcctttaatcgtggttcaaatcttattcagcatcaaaaaattcattccaatgagaaaccctttgtatgtagggaatgtgagatggcctttcgatatcattaccaactcattgaacattgccgaattcatactggcgagaaaccctttgaatgtaaagaatgcagaaaggcctttactcttctgacaaagcttgttcgacatcagaagattcatatgggtgagaagccctttgaatgcagggaatgcgggaaggcctttagtctcctcaatcagcttaatcgccataagaatattcacacaggtgaaaaaccatttgaatgtaaagaatgtgggaagtcctttaatcgtagttcaaaccttattcaacaccagagtattcatgctgatgtaaaaccatatgaatgtaaggagtgtgggaaaggctttaatcgtggtgcaaatcttattcagcatcaaaaaattcattccaatgagaaaccctttgtatgtagggaatgtgagatggcctttcgatatcattaccaacttattcaacattgccaaattcatactggtgggaaaccctttgaatgtaaagaatgtggaaaggcctttagtcttctgacacagcttgctcgacataagaacattcatactggtgagaaaccatttgaatgtaaagactgtgggaaggccttcaatcgtggctcgaaccttgttcaacatcagagtattcacactggtgagaagccctatgaatgtaaggagtgtgggaaggcttttagacttcacctacaactttctcaacatgagaaaactcatacaggtgagaaaccctttgaatgtaaggaatgtgggaaattctttcgtcgtggttcaaatcttaatcaacatcgaagtattcataccggaaagaaaccctttgaatgtaaggaatgtgggaaagcctttcgacttcatatgcaccttattcgacatcagaaatttcatactggtgagaagccctttgaatgtaaggaatgtggcaaggccttcagtcttcacacccagcttaatcaccataagaacattcacacaggtgagaagccatttaaatgtaaagaatgtgggaagtcctttaatcgtgtctcaaaccttgttcaacatcagagtattcatgctggtgtaaaaccatatgaatgtaaggagtgtgggaaaggctttagtcgtgtttcaaaccttattcagcatcagaaaactcattccagtgcgaaaccctttgtatgtaaggagtgtaggaagacctttagatatcattaccagcttactgaacattaccgaattcatactggtgagaaaccctttgaatgtaaagaatgcggaaaggcctttggtcttctgacacagcttgctcaacatcagatcattcatactggtgagaagccatttaaatgtaaggagtgtgggaaggcctttaatcgtggctcaaaccttgttcaacctcagagtattcatactggtgagaaaccctatgaatgtaaggagtgtgggaaggcttttagacttcacctacaactttctctgcatcaaaaacttgtacaggtgagaaaccctttgaatgtaagaaatgtgggacagccttcagacatcagtagcaacttactgaacatcagaaaattcatacttgggtgaaaacctttgaatgtaaggaatgtgggaaggcctttcaatatcattaccaatttcatggacattatagatttcatattcgtgagaacccttatgaatgtcaaggatgtgggaaatgctttaccagtggtagaaaccttagagtacatcagagaattcatactggtgagaaaccatatcaatgtgaagaatgtgggaaagcctttagtcatagttcaaacctgttaaacatgttaaaattcatactgatgagaaaccctatgaatgtaaggaatgtgaaaaggcctttagcagtaattatgatcttactgtacatctgagaatccgtactgctgagaaaccctgtgagtgtaaagaatgtggaaaacttttggatttagcttagtctttactgcacatcaaagaattcatactggtatgaaccgtatgaatgtaaagaatgtggaaagacctttacttgtagctcgagccttgttcaacatgttaaaattcatactggtgagcaaccctgtgaatgtaaaggatgtgggaagacctttagacttagttcagtcctttctgcacatcacagaattcatactggcatgaaaccctatgaatgtaaagaatgtgagcaaacccttactgtgaatgatctgcttacgcaacatcagaaaattcattatagttagaagttttatgaatataaggagtgtagacaagccttcactgtgtatgaaaaatttactcaacaccagagaattcatattgatgagaaatcctgtgaacataaaagaatgtg

SEQ ID NO: 203805 - DNA, 8665 bp, Homo sapiens
  Payload ID: 20195
  Gene Name: zinc finger protein 780B
  Uniprot ID: Q9Y6R6
  ENST ID: ENST00000434248
  CDS Start-End: 67-2568
tggggttgacgacctagctgggggagaagcccgaggaagattgaccaattttgtaattctagaaacatggtccatggatcagtgacattcagggatgtggccattgacttctctcaggaggagtgggagtgcctgcagcctgatcagaggaccttgtacagggatgtgatgttggagaactacagccacctgatatcactgggaagttccatttctaagccagatgtgattacattactagagcaagagaaagagccctggattgttgtaagtaaagaaacaagcagatggtatccagatttggagtcaaaatatggacctgagaaaatatctccagaaaatgatatttttgaaataaatttacccaaacatgttataaagcaaataagtaaaacacttggcctcgaggccttttattttagaaatgactcagaatatagaagtagatttgagggacgacagggacatcaagaaggatatatcaaccagaagatcatcagctatgaagaaatgcctgcttatactcatgcttctcctattcataatacacataaaccatatgaatgtaaggaatgtgggaaatactttagttgtggttcaaatcttattcagcatcagagtattcatactggagagaaaccctataaatgcaaagaatgtgggaaagcctttcaacttcacatacaacttactcgacatcagaaatttcatactggtgagaaaacttttgaatgtaaggaatgtggaaaagcctttaatcttcccacccagcttaatcgccataagaacattcacacagttaagaaactgtttgaatgtaaggaatgtgggaagtcttttaatcgtagctcaaaccttactcagcatcaaagtattcatgctggtgtaaaaccatatcaatgtaaggagtgtgggaaagcctttaatcgtggttcaaatcttattcagcatcaaaaaattcattccaatgagaaaccctttgtatgtagggaatgtgagatggcctttcgatatcattaccaactcattgaacattgccgaattcatactggcgagaaaccctttgaatgtaaagaatgcagaaaggcctttactcttctgacaaagcttgttcgacatcagaagattcatatgggtgagaagccctttgaatgcagggaatgcgggaaggcctttagtctcctcaatcagcttaatcgccataagaatattcacacaggtgaaaaaccatttgaatgtaaagaatgtgggaagtcctttaatcgtagttcaaaccttattcaacaccagagtattcatgctgatgtaaaaccatatgaatgtaaggagtgtgggaaaggctttaatcgtggtgcaaatcttattcagcatcaaaaaattcattccaatgagaaaccctttgtatgtagggaatgtgagatggcctttcgatatcattaccaacttattcaacattgccaaattcatactggtgggaaaccctttgaatgtaaagaatgtggaaaggcctttagtcttctgacacagcttgctcgacataagaacattcatactggtgagaaaccatttgaatgtaaagactgtgggaaggccttcaatcgtggctcgaaccttgttcaacatcagagtattcacactggtgagaagccctatgaatgtaaggagtgtgggaaggcttttagacttcacctacaactttctcaacatgagaaaactcatacaggtgagaaaccctttgaatgtaaggaatgtgggaaattctttcgtcgtggttcaaatcttaatcaacatcgaagtattcataccggaaagaaaccctttgaatgtaaggaatgtgggaaagcctttcgacttcatatgcaccttattcgacatcagaaatttcatactggtgagaagccctttgaatgtaaggaatgtggcaaggccttcagtcttcacacccagcttaatcaccataagaacattcacacaggtgagaagccatttaaatgtaaagaatgtgggaagtcctttaatcgtgtctcaaaccttgttcaacatcagagtattcatgctggtgtaaaaccatatgaatgtaaggagtgtgggaaaggctttagtcgtgtttcaaaccttattcagcatcagaaaactcattccagtgcgaaaccctttgtatgtaaggagtgtaggaagacctttagatatcattaccagcttactgaacattaccgaattcatactggtgagaaaccctttgaatgtaaagaatgcggaaaggcctttggtcttctgacacagcttgctcaacatcagatcattcatactggtgagaagccatttaaatgtaaggagtgtgggaaggcctttaatcgtggctcaaaccttgttcaacctcagagtattcatactggtgagaaaccctatgaatgtaaggagtgtgggaaggcttttagacttcacctacaactttctctgcatcaaaaacttgtacaggtgagaaaccctttgaatgtaagaaatgtgggacagccttcagacatcagtagcaacttactgaacatcagaaaattcatacttgggtgaaaacctttgaatgtaaggaatgtgggaaggcctttcaatatcattaccaatttcatggacattatagatttcatattcgtgagaacccttatgaatgtcaaggatgtgggaaatgctttaccagtggtagaaaccttagagtacatcagagaattcatactggtgagaaaccatatcaatgtgaagaatgtgggaaagcctttagtcatagttcaaacctgttaaacatgttaaaattcatactgatgagaaaccctatgaatgtaaggaatgtgaaaaggcctttagcagtaattatgatcttactgtacatctgagaatccgtactgctgagaaaccctgtgagtgtaaagaatgtggaaaacttttggatttagcttagtctttactgcacatcaaagaattcatactggtatgaaccgtatgaatgtaaagaatgtggaaagacctttacttgtagctcgagccttgttcaacatgttaaaattcatactggtgagcaaccctgtgaatgtaaaggatgtgggaagacctttagacttagttcagtcctttctgcacatcacagaattcatactggcatgaaaccctatgaatgtaaagaatgtgagcaaacccttactgtgaatgatctgcttacgcaacatcagaaaattcattatagttagaagttttatgaatataaggagtgtagacaagccttcactgtgtatgaaaaatttactcaacaccagagaattcatattgatgagaaatcctgtgaacataaaagaatgtgtgaagaactttcatcgtggcctgggatttgctcaacatcagagtattcatactgctgagaactcctttgagtgtaaagaatgtgggatattttatagccacactaaatgccttagagttcagagaagataattttggtgagaaagttactgatgtgaggaatgtagagtagctgccatgttcacagtttactgcccgtgaaatattttactggatacaggcgtaccttgcttaattgtgcattgcagttactgcattttatacacactgaaggtttgcagcaaccttgcagtgaataagtctatcagcaccattttccaaacagcatatgcacatttcatgtctttgtgtcacactttgctagttttcataatatttcaaactttttcattgttaaatctgttatggtgatctgtgaccagtgttttttgattactagtgtaattgttactagtgtaattgtttggggataccacaaatcctgcccataaaagatggtgaacctagttgataattgttgtgggttttgaaagaatagtaaaatatatacacatatcccccccacctagattcaaaattgttaacaatttgccacatttattttttgtatatttgttgtaccattgagaataagttttagaccattgagaataagttttagatatcatgacactttactccttgttacatcagcatgtgtgttacccaaacataaagacaatatcatataaccatagtaccataattacccttaaggaaaatattcataattctgtaatatcattccatcttcagatttcttccttggcctgcaaaccatcttttacagctattcattttctctttttttttttttttttttgagatggagtctcgctctgtcgcccagactggagtgcagtggtgcgatctgggctcactgcaagctctgcctcctgggttcacgccattctcccgcctcagcctcctgagtagctgggactagaggcacccgccaccatgcccagctaattttttgtatttttagtagagacagggtttcactctgttagccaggatggtctcgatctcctgacctcgtgatccacccgccttggcctcccaaagtgctgggattacaggcatgagccagcatgcctggcctacagctattcattttctaaggagagtccattgcagattctgcattgcatttggttatctctctttagtgtattgtagcatggaaaccccatgaaagtatgctctcaaattatggtgggtatcagaatcccctgtggaacttagtaaacctacagaagtgtagccctagtttataagcctgggcctctgttttttattatttctccaggttttgtgtctgtgataccaaccagagttagagagccactggtctagaacatttctcattttaaaaaaatgacattgaattttgagtagcccagaaatgttgttggctatgtgtttagatttctttctttatagtgtcatttagccttgttcttggttgtattttctttacaagggaaagtaagtccagaggctttcttaggtctagattaaacgttttggggaagaatactttgtaggttatttctatgtcatattgtactgtcagaaaacatttaagtacaggtccttgcattagtgaaactaaggatgatcatttgggtaagctggtaaccgccgtaagtccattgtaaagatttagtttgtagtgggtaagtaatctatggagagacgttgtcatctctgaaaagttatagtcacgtgtacttaagccctggattgaatacaaaatgaaaattgaaatagactattgagaaatgaatgccattaaagcgtcaacataattcaacttgtgtgatatggctgacactgtactcagtacaaaactggcaccctttggattgtatagggagccaagattgtccggaacctcttttttgttcagcatttatcaccagcacctataccatggctggtacatgagctgttgataaaaatttgaaaaaatattaaccctttaaatcaagctgtaaaacatgataccattaagccgggagcagtggcctcatgcctgtaatcccagcactttgggaggccaaggtgggcagatcacctgaggtcaggagtttgagaccaacttggccaacatggcaaaactccatctctcctaaaaataaaaaaattagctggacatggtggtgcattcctgtaatcccagctacttgggaggctgaggcaggagaatcactcgaaattggaaggtggaggtggcagtgagccaagatcgtgccactgcactccagcctgggcgacaaagtgagacttcatctcaaaaaaaccccaaaacaaaacatgataccgatgtggcatcatgaattagattaaattttttttaagattaagaataatcctttgtgattttattccattgtgttgaaaaatctataaagtgataatttatattgatagctttcttctttttatgaatataccctggtcagatgattattctttcaatagactacttaattctatcttttaccatttaattgcatctataatcataagtaaagttataattttccaagtatttttcaggtattgatattgcaatgatgttatacaacttataaaacaagattatataaaacttggctttcaaatcttatgttcctattttttatttccagtttcatcttttttctatccattctcttgaactttcttctttgaaatcagcagagtccctgggtattaacctagcacaactcctttctgggtcattgcacatcccggtagtatcattaagagttgtcagaaagatccctggcagcctttcggtgaaactctatcatcatgcaatcatggcagtactatgttggaagtcagagtccctttgcaaacataataaaacactttaatatatttgttaaagttacaaaccaagtatgtacaaatttaaaaatcacggccaggcacggtggctcacgcctgtaatccccaacttaaaatggtttgacttataattttcagctttataatagtacaaaagtgatatgctgctatagtttggatatttatcccctccaaatctcatattgaagtttgatcccaatgttggaggtggggcctaatgggaggtgtgtgggtcatgggagaagatccctcatgaataaattaatgtcctctctggattggggggtgaattatcactctgttagttcctatgagagctggttgtacaaaagagcctggcacctccttcctcaccctcttgcttcctctcttgccatgtgatgtctgcatacactgccccctttcatctgccatgagtggaagcagcctgaggcccttaccagaagcagatgttgcaccatgattcttgtaaatcctacagaacactgagccaaataaacctctttctttattaataacccaacctcagacattcctttatagcaacacaaaactaagacatactcagtcagagtatgctccttgacttaaaatggggctatatctagataaacccattgttaaattgaaaatattgtagaccataaatgcacatatggtgtatgatgttttcaatttatgatgggtttatttggacataactccccgtaagttgagaagcacctgtagtaattattattatttatgctcaaattgacataatgtggccagtaggaatccatttacattttttttttactacttatttttttcttttgatgttttaaaggaatattgttttcaggccgtaagaggatgtttaagactgaccctgtttgttggttcatgtcccccatgcctcttgtcctgagtcatggaatcaactcatgatttaataccctcttatcttagggagtcctggttccttttagaggaaaaaagaattagagaccaaaaaatctggctgctgtgagtgcacatggcagttacaggtatggaaaaaaagatgctgcttttgttagaattcttttaatagtttcagagttgaaaatgtcatcctaaggtcagaagttccctctgaattttctcaacttacatttctatgatctgctcttgtttgcatttggtattttattgaattatgttttatgtatggtgatagctgagaagtttatctccttttaaggcctggctgaaatgatacattaatctgcctcccatttttggagatattgctctgatttaaatttgtcatggtgtttctgagcagcgttgtaaagaaacttgttttagaatattcagtcatggatgttatcttgaatgttcatagactccccagaaaagaagaaaaagtagacacaagatttctgtcatccttttacagggtattgtgatcatccagcttggggtatgagggataacggacctgtgtgtcttaatttccagaataccattccatttcaatgagtcttctgcacaagttgtggtctcagggattcactgtcttcatttgtaattgatcaaaatgaaaccatctccaggattcctcagtgggtcaggatctgttatttattaggcccgcatatccattctaccctgctttcatgattatagaaccagtaatttttattgatagttggctgtgactatctagaataaggactgcagttatttctccaaggtgttgtcatgtgacataacttatggcaagtaggatgtaagtgaatattttggcaattctggaaacctcttaaaacaaactagcttaatatattaatatttgagaaatctgggtgaagggtaaccagaattatttactattcttccaagttctgtataagtctgagtgctcattccattctgatgccagaatggtaaaattcatgattggtttagagcaaggccacagtatcaggcttacatccatattatatgacagagaaattaacttttattatattttatccactttaatttggggcagttttactattttactcacaaccaaatttaatcttaaacgctacaactagattgtcacatgtaaaaagtaataaccatcattatatcttttatgttctgtaattccaaagcacggatctgtagagaacagagtgtctatcccatgcatgttgtcatgtacttatcccacaccctattgaaatcacagtacccataagggagacattttttttcttcaagaatatgtatttctgccacatctatgattctccagaatgagatgacagaaaatgctaaactattgttaaatgactatatgtagttccacttctggatggtagatgggggggctctgcaaactcattttctaataaaactggcaaaaaaaaatgta

SEQ ID NO: 203806 - DNA, 509 bp, Homo sapiens
  Payload ID: 20195
  Gene Name: zinc finger protein 780B
  ENST ID: ENST00000593605
  CDS Start-End: 282-509
gtcctaggaagaaatcggtggctgcgggaggtcttcgtggactgggactcgaacctgaccgacccggcagtgcggtgagggaagttgtggccatggagggtgctttcaaacttagtctgcgctccaagaaaagcctggagtctcacgcttgccgtatccttctccagtcgtattattatccaaaagaaggaccgagaggaggatgagagcgttattgttgcacacttaagtcaagggggagaagcccgaggaagattgaccaattttgtaattctagaaacatggtccatggatcagtgacattcagggatgtggccattgacttctctcaggaggagtgggagtgcctgcagcctgatcagaggaccttgtacagggatgtgatgttggagaactacagccacctgatatcactgggaagttccatttctaagccagatgtgattacattactagagcaagagaaagagccctggattgttgtaagtaaagaaacaagcagatggtat

SEQ ID NO: 203807 - DNA, 401 bp, Homo sapiens
  Payload ID: 20195
  Gene Name: zinc finger protein 780B
  ENST ID: ENST00000598845
  CDS Start-End: 102-365
ggctgcgggaggtcttcgtggactgggactcgaacctgaccgacccggcagtgcgggggagaagcccgaggaagattgaccaattttgtaattctagaaacatggtccatggatcagtgacattcagggatgtggccattgacttctctcaggaggagtgggagtgcctgcagcctgatcagaggaccttgtacagggatgtgatgttggagaactacagccacctgatatcactggcaggaagttccatttctaagccagatgtgattacattactagagcaagagaaagagccctggattgttatttggagtcaaaatatggacctgagaaaatatctccagaaaatgatatttttgaaataaatttacccaaacatgttataaagcaaataagtaaaa

SEQ ID NO: 203808 - DNA, 393 bp, Homo sapiens
  Payload ID: 20195
  Gene Name: zinc finger protein 780B
  ENST ID: ENST00000595995
  CDS Start-End: 66-393
ggggttgacgacctagctgggggagaagcccgaggaagattgaccaattttgtaattctagaaacatggtccatggatcagtgacattcagggatgtggccattgacttctctcaggaggagtgggagtgcctgcagcctgatcagaggaccttgtacagggatgtgatgttggagaactacagccacctgatatcactgggaagttccatttctaagccagatgtgattacattactagagcaagagaaagagccctggattgttgtaagtaaagaaacaagcagatggtatccagatttggagtcaaaatatggacctgagaaaatatctccagaaaatgatatttttgaaataaatttacccaaacatgttataaagcaaataagtaaaa

SEQ ID NO: 203809 - DNA, 8664 bp, Homo sapiens
  Payload ID: 20195
  Gene Name: zinc finger protein 780B
  Uniprot ID: Q9Y6R6
  ENST ID: ENST00000617676
  CDS Start-End: 66-2567
ggggttgacgacctagctgggggagaagcccgaggaagattgaccaattttgtaattctagaaacatggtccatggatcagtgacattcagggatgtggccattgacttctctcaggaggagtgggagtgcctgcagcctgatcagaggaccttgtacagggatgtgatgttggagaactacagccacctgatatcactgggaagttccatttctaagccagatgtgattacattactagagcaagagaaagagccctggattgttgtaagtaaagaaacaagcagatggtatccagatttggagtcaaaatatggacctgagaaaatatctccagaaaatgatatttttgaaataaatttacccaaacatgttataaagcaaataagtaaaacacttggcctcgaggccttttattttagaaatgactcagaatatagaagtagatttgagggacgacagggacatcaagaaggatatatcaaccagaagatcatcagctatgaagaaatgcctgcttatactcatgcttctcctattcataatacacataaaccatatgaatgtaaggaatgtgggaaatactttagttgtggttcaaatcttattcagcatcagagtattcatactggagagaaaccctataaatgcaaagaatgtgggaaagcctttcaacttcacatacaacttactcgacatcagaaatttcatactggtgagaaaacttttgaatgtaaggaatgtggaaaagcctttaatcttcccacccagcttaatcgccataagaacattcacacagttaagaaactgtttgaatgtaaggaatgtgggaagtcttttaatcgtagctcaaaccttactcagcatcaaagtattcatgctggtgtaaaaccatatcaatgtaaggagtgtgggaaagcctttaatcgtggttcaaatcttattcagcatcaaaaaattcattccaatgagaaaccctttgtatgtagggaatgtgagatggcctttcgatatcattaccaactcattgaacattgccgaattcatactggcgagaaaccctttgaatgtaaagaatgcagaaaggcctttactcttctgacaaagcttgttcgacatcagaagattcatatgggtgagaagccctttgaatgcagggaatgcgggaaggcctttagtctcctcaatcagcttaatcgccataagaatattcacacaggtgaaaaaccatttgaatgtaaagaatgtgggaagtcctttaatcgtagttcaaaccttattcaacaccagagtattcatgctgatgtaaaaccatatgaatgtaaggagtgtgggaaaggctttaatcgtggtgcaaatcttattcagcatcaaaaaattcattccaatgagaaaccctttgtatgtagggaatgtgagatggcctttcgatatcattaccaacttattcaacattgccaaattcatactggtgggaaaccctttgaatgtaaagaatgtggaaaggcctttagtcttctgacacagcttgctcgacataagaacattcatactggtgagaaaccatttgaatgtaaagactgtgggaaggccttcaatcgtggctcgaaccttgttcaacatcagagtattcacactggtgagaagccctatgaatgtaaggagtgtgggaaggcttttagacttcacctacaactttctcaacatgagaaaactcatacaggtgagaaaccctttgaatgtaaggaatgtgggaaattctttcgtcgtggttcaaatcttaatcaacatcgaagtattcataccggaaagaaaccctttgaatgtaaggaatgtgggaaagcctttcgacttcatatgcaccttattcgacatcagaaatttcatactggtgagaagccctttgaatgtaaggaatgtggcaaggccttcagtcttcacacccagcttaatcaccataagaacattcacacaggtgagaagccatttaaatgtaaagaatgtgggaagtcctttaatcgtgtctcaaaccttgttcaacatcagagtattcatgctggtgtaaaaccatatgaatgtaaggagtgtgggaaaggctttagtcgtgtttcaaaccttattcagcatcagaaaactcattccagtgcgaaaccctttgtatgtaaggagtgtaggaagacctttagatatcattaccagcttactgaacattaccgaattcatactggtgagaaaccctttgaatgtaaagaatgcggaaaggcctttggtcttctgacacagcttgctcaacatcagatcattcatactggtgagaagccatttaaatgtaaggagtgtgggaaggcctttaatcgtggctcaaaccttgttcaacctcagagtattcatactggtgagaaaccctatgaatgtaaggagtgtgggaaggcttttagacttcacctacaactttctctgcatcaaaaacttgtacaggtgagaaaccctttgaatgtaagaaatgtgggacagccttcagacatcagtagcaacttactgaacatcagaaaattcatacttgggtgaaaacctttgaatgtaaggaatgtgggaaggcctttcaatatcattaccaatttcatggacattatagatttcatattcgtgagaacccttatgaatgtcaaggatgtgggaaatgctttaccagtggtagaaaccttagagtacatcagagaattcatactggtgagaaaccatatcaatgtgaagaatgtgggaaagcctttagtcatagttcaaacctgttaaacatgttaaaattcatactgatgagaaaccctatgaatgtaaggaatgtgaaaaggcctttagcagtaattatgatcttactgtacatctgagaatccgtactgctgagaaaccctgtgagtgtaaagaatgtggaaaacttttggatttagcttagtctttactgcacatcaaagaattcatactggtatgaaccgtatgaatgtaaagaatgtggaaagacctttacttgtagctcgagccttgttcaacatgttaaaattcatactggtgagcaaccctgtgaatgtaaaggatgtgggaagacctttagacttagttcagtcctttctgcacatcacagaattcatactggcatgaaaccctatgaatgtaaagaatgtgagcaaacccttactgtgaatgatctgcttacgcaacatcagaaaattcattatagttagaagttttatgaatataaggagtgtagacaagccttcactgtgtatgaaaaatttactcaacaccagagaattcatattgatgagaaatcctgtgaacataaaagaatgtgtgaagaactttcatcgtggcctgggatttgctcaacatcagagtattcatactgctgagaactcctttgagtgtaaagaatgtgggatattttatagccacactaaatgccttagagttcagagaagataattttggtgagaaagttactgatgtgaggaatgtagagtagctgccatgttcacagtttactgcccgtgaaatattttactggatacaggcgtaccttgcttaattgtgcattgcagttactgcattttatacacactgaaggtttgcagcaaccttgcagtgaataagtctatcagcaccattttccaaacagcatatgcacatttcatgtctttgtgtcacactttgctagttttcataatatttcaaactttttcattgttaaatctgttatggtgatctgtgaccagtgttttttgattactagtgtaattgttactagtgtaattgtttggggataccacaaatcctgcccataaaagatggtgaacctagttgataattgttgtgggttttgaaagaatagtaaaatatatacacatatcccccccacctagattcaaaattgttaacaatttgccacatttattttttgtatatttgttgtaccattgagaataagttttagaccattgagaataagttttagatatcatgacactttactccttgttacatcagcatgtgtgttacccaaacataaagacaatatcatataaccatagtaccataattacccttaaggaaaatattcataattctgtaatatcattccatcttcagatttcttccttggcctgcaaaccatcttttacagctattcattttctctttttttttttttttttttgagatggagtctcgctctgtcgcccagactggagtgcagtggtgcgatctgggctcactgcaagctctgcctcctgggttcacgccattctcccgcctcagcctcctgagtagctgggactagaggcacccgccaccatgcccagctaattttttgtatttttagtagagacagggtttcactctgttagccaggatggtctcgatctcctgacctcgtgatccacccgccttggcctcccaaagtgctgggattacaggcatgagccagcatgcctggcctacagctattcattttctaaggagagtccattgcagattctgcattgcatttggttatctctctttagtgtattgtagcatggaaaccccatgaaagtatgctctcaaattatggtgggtatcagaatcccctgtggaacttagtaaacctacagaagtgtagccctagtttataagcctgggcctctgttttttattatttctccaggttttgtgtctgtgataccaaccagagttagagagccactggtctagaacatttctcattttaaaaaaatgacattgaattttgagtagcccagaaatgttgttggctatgtgtttagatttctttctttatagtgtcatttagccttgttcttggttgtattttctttacaagggaaagtaagtccagaggctttcttaggtctagattaaacgttttggggaagaatactttgtaggttatttctatgtcatattgtactgtcagaaaacatttaagtacaggtccttgcattagtgaaactaaggatgatcatttgggtaagctggtaaccgccgtaagtccattgtaaagatttagtttgtagtgggtaagtaatctatggagagacgttgtcatctctgaaaagttatagtcacgtgtacttaagccctggattgaatacaaaatgaaaattgaaatagactattgagaaatgaatgccattaaagcgtcaacataattcaacttgtgtgatatggctgacactgtactcagtacaaaactggcaccctttggattgtatagggagccaagattgtccggaacctcttttttgttcagcatttatcaccagcacctataccatggctggtacatgagctgttgataaaaatttgaaaaaatattaaccctttaaatcaagctgtaaaacatgataccattaagccgggagcagtggcctcatgcctgtaatcccagcactttgggaggccaaggtgggcagatcacctgaggtcaggagtttgagaccaacttggccaacatggcaaaactccatctctcctaaaaataaaaaaattagctggacatggtggtgcattcctgtaatcccagctacttgggaggctgaggcaggagaatcactcgaaattggaaggtggaggtggcagtgagccaagatcgtgccactgcactccagcctgggcgacaaagtgagacttcatctcaaaaaaaccccaaaacaaaacatgataccgatgtggcatcatgaattagattaaattttttttaagattaagaataatcctttgtgattttattccattgtgttgaaaaatctataaagtgataatttatattgatagctttcttctttttatgaatataccctggtcagatgattattctttcaatagactacttaattctatcttttaccatttaattgcatctataatcataagtaaagttataattttccaagtatttttcaggtattgatattgcaatgatgttatacaacttataaaacaagattatataaaacttggctttcaaatcttatgttcctattttttatttccagtttcatcttttttctatccattctcttgaactttcttctttgaaatcagcagagtccctgggtattaacctagcacaactcctttctgggtcattgcacatcccggtagtatcattaagagttgtcagaaagatccctggcagcctttcggtgaaactctatcatcatgcaatcatggcagtactatgttggaagtcagagtccctttgcaaacataataaaacactttaatatatttgttaaagttacaaaccaagtatgtacaaatttaaaaatcacggccaggcacggtggctcacgcctgtaatccccaacttaaaatggtttgacttataattttcagctttataatagtacaaaagtgatatgctgctatagtttggatatttatcccctccaaatctcatattgaagtttgatcccaatgttggaggtggggcctaatgggaggtgtgtgggtcatgggagaagatccctcatgaataaattaatgtcctctctggattggggggtgaattatcactctgttagttcctatgagagctggttgtacaaaagagcctggcacctccttcctcaccctcttgcttcctctcttgccatgtgatgtctgcatacactgccccctttcatctgccatgagtggaagcagcctgaggcccttaccagaagcagatgttgcaccatgattcttgtaaatcctacagaacactgagccaaataaacctctttctttattaataacccaacctcagacattcctttatagcaacacaaaactaagacatactcagtcagagtatgctccttgacttaaaatggggctatatctagataaacccattgttaaattgaaaatattgtagaccataaatgcacatatggtgtatgatgttttcaatttatgatgggtttatttggacataactccccgtaagttgagaagcacctgtagtaattattattatttatgctcaaattgacataatgtggccagtaggaatccatttacattttttttttactacttatttttttcttttgatgttttaaaggaatattgttttcaggccgtaagaggatgtttaagactgaccctgtttgttggttcatgtcccccatgcctcttgtcctgagtcatggaatcaactcatgatttaataccctcttatcttagggagtcctggttccttttagaggaaaaaagaattagagaccaaaaaatctggctgctgtgagtgcacatggcagttacaggtatggaaaaaaagatgctgcttttgttagaattcttttaatagtttcagagttgaaaatgtcatcctaaggtcagaagttccctctgaattttctcaacttacatttctatgatctgctcttgtttgcatttggtattttattgaattatgttttatgtatggtgatagctgagaagtttatctccttttaaggcctggctgaaatgatacattaatctgcctcccatttttggagatattgctctgatttaaatttgtcatggtgtttctgagcagcgttgtaaagaaacttgttttagaatattcagtcatggatgttatcttgaatgttcatagactccccagaaaagaagaaaaagtagacacaagatttctgtcatccttttacagggtattgtgatcatccagcttggggtatgagggataacggacctgtgtgtcttaatttccagaataccattccatttcaatgagtcttctgcacaagttgtggtctcagggattcactgtcttcatttgtaattgatcaaaatgaaaccatctccaggattcctcagtgggtcaggatctgttatttattaggcccgcatatccattctaccctgctttcatgattatagaaccagtaatttttattgatagttggctgtgactatctagaataaggactgcagttatttctccaaggtgttgtcatgtgacataacttatggcaagtaggatgtaagtgaatattttggcaattctggaaacctcttaaaacaaactagcttaatatattaatatttgagaaatctgggtgaagggtaaccagaattatttactattcttccaagttctgtataagtctgagtgctcattccattctgatgccagaatggtaaaattcatgattggtttagagcaaggccacagtatcaggcttacatccatattatatgacagagaaattaacttttattatattttatccactttaatttggggcagttttactattttactcacaaccaaatttaatcttaaacgctacaactagattgtcacatgtaaaaagtaataaccatcattatatcttttatgttctgtaattccaaagcacggatctgtagagaacagagtgtctatcccatgcatgttgtcatgtacttatcccacaccctattgaaatcacagtacccataagggagacattttttttcttcaagaatatgtatttctgccacatctatgattctccagaatgagatgacagaaaatgctaaactattgttaaatgactatatgtagttccacttctggatggtagatgggggggctctgcaaactcattttctaataaaactggcaaaaaaaaatgta

SEQ ID NO: 203810 - DNA, 3538 bp, Homo sapiens; identical to SEQ ID NO: 203804
  Payload ID: 20195
  Gene Name: Zinc finger protein 780B
  ENST ID: ENST00000630970
  CDS Start-End: 703-2760

SEQ ID NO: 203811 - DNA, 393 bp, Homo sapiens; identical to SEQ ID NO: 203808
  Payload ID: 20195
  Gene Name: Zinc finger protein 780B
  ENST ID: ENST00000626348
  CDS Start-End: 66-393

SEQ ID NO: 203812 - DNA, 401 bp, Homo sapiens; identical to SEQ ID NO: 203807
  Payload ID: 20195
  Gene Name: Zinc finger protein 780B
  ENST ID: ENST00000628151
  CDS Start-End: 102-365

SEQ ID NO: 203813 - DNA, 509 bp, Homo sapiens; identical to SEQ ID NO: 203806
  Payload ID: 20195
  Gene Name: Zinc finger protein 780B
  ENST ID: ENST00000627835
  CDS Start-End: 282-509

SEQ ID NO: 203814 - DNA, 8664 bp, Homo sapiens; identical to SEQ ID NO: 203809
  Payload ID: 20195
  Gene Name: Zinc finger protein 780B
  ENST ID: ENST00000627167
  CDS Start-End: 66-2567

SEQ ID NO: 203815 - DNA, 8665 bp, Homo sapiens; identical to SEQ ID NO: 203805
  Payload ID: 20195
  Gene Name: Zinc finger protein 780B
  ENST ID: ENST00000625684
  CDS Start-End: 67-2568

SEQ ID NO: 203816 - DNA, 3147 bp, Homo sapiens
  Payload ID: 20196
  Gene Name: zinc finger protein 781
  Uniprot ID: Q8N8C0
  ENST ID: ENST00000358582
  CDS Start-End: 750-1733
ccagcccacaaacgcggcggaaccggttgcggggaggttgcttgaattctctcagctgcgccccctgacctagtagtcgctggcacaagctgcgcccggagacgtgggagcgttctcttgttttccgagtgcgcggactcatcgggtcacagtttatgcttttatgacgcgggaacacaacagatttgagaagcctcggattaaggaataatttatgaagctccgttgactaccgtggagagatcataatttggggttcaagattccagtctgtgtttttccagaggtgccctgaggagcagggaagcatggctattgtggatgtaaaagccatgttcaagatatgctgtctagatatgagaccaaggagttaactcttaagaatggcacttttgaaaaggaatcattaaaatggaaaataatagaaagtgtcagaagttcttgccttgaggaatcttttttgggaaatgattggaaatgcaaaggactctttgagagacaacaggaaactacagaggaatatttcaggcatgtaactgtgccatttgaaaaaatatccgaattcatccagcctacatattttcttctaaatcaaataattcatactggaaagaaactctatgaacaaaaaaaaaaatgagaaaatgttactcaacagggaagaattcatatcagtgacaagcttgacgaaatgtgtgggaacacctctgtattttgcacaaatcatatgaaacatcagacaaattttaatgcaaagaaatgcaatgtatttaaagaatgtggcagagactgcttgtaactttcaactaactcaatatcaaataagtcatgctaatcagaaaccctatgaatgtcagatatgtggaaagccctttagaaagcgtgcccaccttacccaacataatcgaattcacactggtgggaaaccatatgaatgcaaagaatgtgggaaagtgtttatctgttgttcaacattgattcaacataagagaactcacactagtgagaaaccctatgaatgtctggaatgtagaaagacgtttaggcggagtgcacatcttattcgacatcaaagaattcatactggtgagaaaccttataaatgtaagcaatgttggaaggcctttgcttctgtttctgatttaatagacatcggaaaattcacactgatgagagactttacgaatgtacagaatgtgggaaggcatttaacaatcgctcaactcttattcagcatcagagaattcacactggtgagaagtcctttgaatgtaaggaatgtggcaaagcattcaataattgctcaacacttactcaacaccagagaactcatactaatgagaaatcttatgaatgtcaggaatgtaaaaaggcttttaggcaaagtgcacatcttactcaacatcaaagaattcatactggtgagaaaccatatgagtgtaagtaatgtgggaaggctttcacttgtgtttctgattttaatagacatcagagaattcacactggtgaaaaaccctatgaatgtaaagaatgtggtagagcttttaacaattgttcagctcttattcaacaccagagaattcacactggtgagaaggcttatgaatataagcagtgtgggaaggtttttgtctcctgtccaacacttgttcaacatcagagaacacatactaatgaaaaaccttatgaatgtcagtaatgcaagaaggccttcaagcataatgcacatctaatgagacatcagagaattcacagtggggagaaaccctatgaatgtaatgaatgtgggaatgccttcatttgtttttttgattttaatagacatcagagaattcacaaaggagagaaaccctatcagtgtaaagaatgtgggaaggtttttaataattatccaactcttactcaacatcaaagaattcataccagtgtgaaaccctatgaatgtaaggaatgtgtaaagacctttacttggctttcaaacttgaataaacatcagacaattcacactggtgacaaaccctatgaatgtaaagattgtaaaaaagcttttctttgttattcaacatttattcaacactatagaactcatactaatgagaaacctatgaatgtcaggaatgcagcaaggcctttaagcagagagcccatcttagtcaacatcaaaatattcatactggtgagaaaccctatgagtttaaggaatgtgggaaggcctttgcttgtttcctaccttaatagaaatcagagaattcacactagtgagaaaccgtatcagtgtaaaaaatgtagaaaatcctttattgattgttcaactcttaacaccagagaattcacactggtgagaaaccctttgaatgtcaggaatgtaggaaggcctttaggcagagggcgcatcttactcaacatcaaagaattcctactggtgagaaaccctatgaatgtaatgaatgtgagaaggcctcttcttgtctttcataggtgaaaaagcaccagagaatacatacatgaagggacaaatcttatgtatttgaatagcgtctttttatttaacaatccttatctaacatcaccaaattcacattgcagagaaacttcagaaatataagaaatgtgggaaacacttttacctgtccctcagctatactttttcataacagaatttgtacaggtgagaagcctaatgaaagcccgatatgtgtaaagatctactctcacaatatactcaacattatataatgtatagtgtgattaatataggaaatccttgattttgaaattatcaattatggaatagcaaacaatttgtaagtgaagaaaatccagtgactgtaaatttttttacctcataattcacaatttattaagcatcagaatttatatggaaaaaatagaatatcaattattaataaaaacattaccactaaaattttatttgacttatagagaatagcatatagagaataatcatgttgactttgtgaatgtagaaaagcttttatctattacacgaatctttttcagcatcattatactttcaccagtttccacgtctgttttattaccaagtaatttaaactgtatacttcagattacaaatttcttacattgtgataaggttattgtgaagattaaatgagtttatccaaa

SEQ ID NO: 203817 - DNA, 2148 bp, Homo sapiens
  Payload ID: 20196
  Gene Name: zinc finger protein 781
  Uniprot ID: Q8N8C0
  ENST ID: ENST00000590008
  CDS Start-End: 854-1837
ccggttgcggggaggttgcttgaattctctcagctgcgccccctgacctagtagtcgctggcacaagctgcgcccggagacgtgggagcgttctcttgttttccgagtgcgcggactcatcgggtcacagtttatgcttttatgacgcgggaacacaacagatttgagaagcctcggattaaggaataatttatgaagctccgttgactaccgtggagagatcataatttggggttcaagattccagtctgtgtttttccagaggtgccctgaggagcagggaagcatggctattgtggatgtaaaagccatgttcaaggattggtgacattcagggatgtggctatagatttctctaagggagagtgggaatgcctgggccctgctcagagagacttgtacagagatgtcatgttggagaactacagcaactttgtgtcaccggatatgctgtctagatatgagaccaaggagttaactcttaagaatggcacttttgaaaaggaatcattaaaatggaaaataatagaaagtgtcagaagttcttgccttgaggaatcttttttgggaaatgattggaaatgcaaaggactctttgagagacaacaggaaactacagaggaatatttcaggcatgtaactgtgccatttgaaaaaatatccgaattcatccagcctacatattttcttctaaatcaaataattcatactggaaagaaactctatgaacaaaaaaaaaaatgagaaaatgttactcaacagggaagaattcatatcagtgacaagcttgacgaaatgtgtgggaacacctctgtattttgcacaaatcatatgaaacatcagacaaattttaatgcaaagaaatgcaatgtatttaaagaatgtggcagagactgcttgtaactttcaactaactcaatatcaaataagtcatgctaatcagaaaccctatgaatgtcagatatgtggaaagccctttagaaagcgtgcccaccttacccaacataatcgaattcacactggtgggaaaccatatgaatgcaaagaatgtgggaaagtgtttatctgttgttcaacattgattcaacataagagaactcacactagtgagaaaccctatgaatgtctggaatgtagaaagacgtttaggcggagtgcacatcttattcgacatcaaagaattcatactggtgagaaaccttataaatgtaagcaatgttggaaggcctttgcttctgtttctgatttaatagacatcggaaaattcacactgatgagagactttacgaatgtacagaatgtgggaaggcatttaacaatcgctcaactcttattcagcatcagagaattcacactggtgagaagtcctttgaatgtaaggaatgtggcaaagcattcaataattgctcaacacttactcaacaccagagaactcatactaatgagaaatcttatgaatgtcaggaatgtaaaaaggcttttaggcaaagtgcacatcttactcaacatcaaagaattcatactggtgagaaaccatatgagtgtaagtaatgtgggaaggctttcacttgtgtttctgattttaatagacatcagagaattcacactggtgaaaaaccctatgaatgtaaagaatgtggtagagcttttaacaattgttcagctcttattcaacaccagagaattcacactggtgagaaggcttatgaatataagcagtgtgggaaggtttttgtctcctgtccaacacttgttcaacatcagagaacacatactaatgaaaaaccttatgaatgtcagtaatgcaagaaggccttcaagcataatgcacatctaatgagacatcagagaattcacagtggggagaaaccctatgaatgtaatgaatgtgggaatgccttcatttgtttttttgattttaatagacatcagagaattcacaaaggagagaaaccctatcagtgtaaagaatgtgggaaggtttttaataattatccaactcttactcaacatcaaagaattcataccagtgtgaaaccctatgaatgtaaggaatgtgtaaagacctttacttggctttcaaacttgaataaacatcagacaattcacactggtgacaaaccctatgaatgtaaagattgtaaaaaa

SEQ ID NO: 203818 - DNA, 932 bp, Homo sapiens
  Payload ID: 20197
  Gene Name: zinc finger protein 782
  ENST ID: ENST00000478850
  CDS Start-End: 318-932
ccgccccctgtgtcagtggatgcgaccgggcgggccctcggccttcccggccgctggagagggacttcggccgctggctcccggggcggctgaggctgagcgttggtccggagcaggtgccgggtgcgggccgcggtgtgcgggaccggagcccggcgcgagcggcggcgggggtggggaaagcgcatttgtaacgcgggcgacaacgtgcccgaaatccccggacggtgggtctgcatcgagaccccgagctctggagctggaaaaacccggctgaggctttacagttctctatactctcccaagagccacagaaaatgaacacatttcaggcatcagtgtcattccaggacgtgactgtggaattcagccaggaggagtggcagcacatgggccctgttgagaggaccctgtacagagatgtgatgctggagaactacagccacctcgtctcagtgggctactgctttacaaaaccagaactgatcttcacattggaacaaggagaagatccatggttattagagaaagagaaaggatttctaagcaggaactccccagaagactcccaacctgatgaaatctcagagaagagcccagaaaatcaaggcaaacatttgttgcaagttttattcaccaataaattattgactacagagcaagaaatttcaggaaaaccacataatcgagacataaacatttttcgtgcaagaatgatgccttgtaaatgtgacattgcggggtctgcttgccaggggctcagcctgatggccccacactgtcagtattcaaaagaaaaggctcatgagcgtaatgtttgtgacaaatggctcatcagtattaaggatggcagaactaacactcaagagaaatctttcgcttatagtaaaattgtgaaaaccctccatcataaggaggaagttattcaacat

SEQ ID NO: 203819 - DNA, 2355 bp, Homo sapiens
  Payload ID: 20197
  Gene Name: zinc finger protein 782
  ENST ID: ENST00000289032
  CDS Start-End: 1-2065
gtttataaacgttgaccaaagtgccagaactcgtgggcgctgtgtctgtggcaagaccccgagctgtggagaccgaaagagctgcataaattccagctttattacctgctactgctttacaaaaccagaactgatcttcacattggaacaaggagaagatccatggttattagagaaagagaaaggatttctaagcaggaactccccagaagactcccaacctgatgaaatctcagagaagagcccagaaaatcaaggcaaacatttgttgcaagttttattcaccaataaattattgactacagagcaagaaatttcaggaaaaccacataatcgagacataaacatttttcgtgcaagaatgatgccttgtaaatgtgacattgcggggtctgcttgccaggggctcagcctgatggccccacactgtcagtattcaaaagaaaaggctcatgagcgtaatgtttgtgacaaatggctcatcagtattaaggatggcagaactaacactcaagagaaatctttcgcttatagtaaaattgtgaaaaccctccatcataaggaggaagttattcaacatcagacaattcagactctggggcaagattttgaatataatgaaagtagaaaagcttttcttgaaaaggctgcccttgttacatctaacagtacccacccaaaaggaaaatcttacaatttcaataaatttggggaaaacaaatatgataaatcaacctttattattcctcagaacatgaatccagagaagagtcactatgagtttaatgatactggaaattgtttctgtagaatcactcacaaaactctcacaggagggaaatccttcagccaaaagtcacacattagagaacatcatagagttcatataggggtgaaaccctttgaatatggaaaaagtttcaaccgtaattcaaccctcccagtgcatcagagaactcatgcaacagataaatactctgattatcacccatgtacagagacattcagctaccagtcaactttcagtgtacatcagaaggttcacataagggcaaaaccctatgagtataatgaatgtgggaaatcctgctctatgaattcacacttgatttggcctcagaaaagtcacacaggggagaaaccctatgaatgtcctgagtgcgggaaagccttcagtgagaagtcacgcctaagaaaacatcagagaactcacacgggagagaaaccatacaaatgtgatggatgtgataaagctttcagtgcaaagtcaggcctaagaatacaccagagaacccacacaggggagaaaccattcgaatgtcatgaatgtgggaaatcttttaactataagtcaatcctcatagtgcatcagagaactcacacaggggagaaaccttttgaatgtaatgaatgcgggaaatctttcagccatatgtcaggcctaaggaatcaccgaagaactcacacaggggaaagaccatataaatgtgatgaatgtgggaaagctttcaaactgaagtcaggcctgaggaaacatcatagaacacacacaggggagaagccctacaaatgtaatcagtgtggaaaagctttcggtcagaaatcacaactcagaggacatcatagaattcacacaggggaaaaaccctataaatgtaatcattgtggggaagctttcagtcagaaatcaaacctcagagtacatcacagaactcatactggggagaaaccctatcaatgtgaggagtgtggaaaaacattcaggcagaaatcaaatctcagagggcatcagagaactcacactggggagaagccctatgaatgtaatgaatgtggaaaagctttcagtgagaagtcagtcctaagaaaacatcagcgaactcacaccggggagaaaccatataattgtaatcagtgtggggaagctttcagtcagaaatccaatctcagagtacatcagagaactcacacaggggagaaaccctataaatgtgataaatgtgggagaactttcagtcaaaaatcaagccttagagaacatcagaaagcccacccaggggattaaatgtatgcatataaagaatacgaaaaaactctgagctggaaatcaaacctcacaatacataaatgaacacacaggagagaactgttaacatagtgagcactggaatttcctctacaatttcagcctccaccaaatatcaaagaatagaagataaattgttgaaatctattttatatgggcattctttcagccagagcccagtcttctatggatatacagaactcacacagcaaagaaaccctataaacataatgaatatggaaaatactcttgcgaactcactcctcaga

SEQ ID NO: 203820 - DNA, 4213 bp, Homo sapiens
  Payload ID: 20197
  Gene Name: zinc finger protein 782
  Uniprot ID: Q6ZMW2
  ENST ID: ENST00000481138
  CDS Start-End: 663-2762
tcgagactcccgggaagcggtttgggaagctcgggggtcggctcggaaagtagagggggcgcagctggggcgggaggacagcgtttgtgcccggaagcgggagaggaagcgggaagtttgtgggatccccgccccctgtgtcagtggatgcgaccgggcgggccctcggccttcccggccgctggagagggacttcggccgctggctcccggggcggctgaggctgagcgttggtccggagcaggtgccgggtgcgggccgcggtgtgcgggaccggagcccggcgcgagcggcggcgggggtggggaaagcgcatttgtaacgcgggcgacaacgtgcccgaaatccccggacggtgggtctgcatcgagaccccgagctctggagctggaaaaacccggatgccatactgctgttaacatatgtgacactggagactttgtccctacctcatagaatcccatgcatgatgatacatgaagggttttccgtggctatctacttctgattcttttgaaagctttaaagacattgggcatgaaaggttcagtgagtttccggggatccctcgtttgtggtagagccaggaggaaaacagttccgttcattctttcacagctgaggctttacagttctctatactctcccaagagccacagaaaatgaacacatttcaggcatcagtgtcattccaggacgtgactgtggaattcagccaggaggagtggcagcacatgggccctgttgagaggaccctgtacagagatgtgatgctggagaactacagccacctcgtctcagtgggctactgctttacaaaaccagaactgatcttcacattggaacaaggagaagatccatggttattagagaaagagaaaggatttctaagcaggaactccccagaagactcccaacctgatgaaatctcagagaagagcccagaaaatcaaggcaaacatttgttgcaagttttattcaccaataaattattgactacagagcaagaaatttcaggaaaaccacataatcgagacataaacatttttcgtgcaagaatgatgccttgtaaatgtgacattgcggggtctgcttgccaggggctcagcctgatggccccacactgtcagtattcaaaagaaaaggctcatgagcgtaatgtttgtgacaaatggctcatcagtattaaggatggcagaactaacactcaagagaaatctttcgcttatagtaaaattgtgaaaaccctccatcataaggaggaagttattcaacatcagacaattcagactctggggcaagattttgaatataatgaaagtagaaaagcttttcttgaaaaggctgcccttgttacatctaacagtacccacccaaaaggaaaatcttacaatttcaataaatttggggaaaacaaatatgataaatcaacctttattattcctcagaacatgaatccagagaagagtcactatgagtttaatgatactggaaattgtttctgtagaatcactcacaaaactctcacaggagggaaatccttcagccaaaagtcacacattagagaacatcatagagttcatataggggtgaaaccctttgaatatggaaaaagtttcaaccgtaattcaaccctcccagtgcatcagagaactcatgcaacagataaatactctgattatcacccatgtacagagacattcagctaccagtcaactttcagtgtacatcagaaggttcacataagggcaaaaccctatgagtataatgaatgtgggaaatcctgctctatgaattcacacttgatttggcctcagaaaagtcacacaggggagaaaccctatgaatgtcctgagtgcgggaaagccttcagtgagaagtcacgcctaagaaaacatcagagaactcacacgggagagaaaccatacaaatgtgatggatgtgataaagctttcagtgcaaagtcaggcctaagaatacaccagagaacccacacaggggagaaaccattcgaatgtcatgaatgtgggaaatcttttaactataagtcaatcctcatagtgcatcagagaactcacacaggggagaaaccttttgaatgtaatgaatgcgggaaatctttcagccatatgtcaggcctaaggaatcaccgaagaactcacacaggggaaagaccatataaatgtgatgaatgtgggaaagctttcaaactgaagtcaggcctgaggaaacatcatagaacacacacaggggagaagccctacaaatgtaatcagtgtggaaaagctttcggtcagaaatcacaactcagaggacatcatagaattcacacaggggaaaaaccctataaatgtaatcattgtggggaagctttcagtcagaaatcaaacctcagagtacatcacagaactcatactggggagaaaccctatcaatgtgaggagtgtggaaaaacattcaggcagaaatcaaatctcagagggcatcagagaactcacactggggagaagccctatgaatgtaatgaatgtggaaaagctttcagtgagaagtcagtcctaagaaaacatcagcgaactcacaccggggagaaaccatataattgtaatcagtgtggggaagctttcagtcagaaatccaatctcagagtacatcagagaactcacacaggggagaaaccctataaatgtgataaatgtgggagaactttcagtcaaaaatcaagccttagagaacatcagaaagcccacccaggggattaaatgtatgcatataaagaatacgaaaaaactctgagctggaaatcaaacctcacaatacataaatgaacacacaggagagaactgttaacatagtgagcactggaatttcctctacaatttcagcctccaccaaatatcaaagaatagaagataaattgttgaaatctattttatatgggcattctttcagccagagcccagtcttctatggatatacagaactcacacagcaaagaaaccctataaacataatgaatatggaaaatactcttgcgaactcactcctcagaaaactcacgctgcagaaaagctctgagaaagtaataaaaatgtgaaaactttgtgccaacaatcaaaactcattcaccatcagagaaatcacacaatgacaaaagctagaatataataagtgtgtgataaactttaatgaaaagtcagtacagcagaaaatacattcaagatagagacctcatagtatattaaaacaaacaagaaatgaagttaatggatgtgggaaattcttctgccatgtcaaccctcattttaacctacacagaggtaatccctatatgtcgtataataactattgaaatgttcactagtaatcattttcacttctccctcatgccacacctggcctaaatttctcaaccactctctcatctaaacggggtcatattgttaccctctagctagtggaatatggggtcagtgacaggtcttaaatacatcagtcaaattctcaatattttcttctatccctcattagaatggaatggaggaaaaccttgggactcaggctctgatgatggaaagtacaagatggtaggaacccgggtcagagaaggatcctgtggcatggagttttctcctccctgtacacagttggacttcttgcagtgaggaaataaatgtgttccctgctgaacttctaaaggtttgggtatacttgatactgacagaaactcaacaaccctcacataataaaacttaggagtatgatttttcaggacatctgaactcagtgtatgtcagaaaagtcacataggacaaatctcggacagcatcctgaatgaccatggcttttatccccaaagtcttcctcatcagacaggtaatatcataagaaatctgacattttaacaaatataggaaattcttcacacacacagacacacactcacacatacacacccaaagtctcattaaatatatgataatttagttttgaatgtgtaaaagttttcaacaaattatcatattttatatcagagcttgttacaaggagaaaatctatcaatttgagaaaggtaagtaatagcctttatctagatattgctttatcagaactgttgtttcacatataatatcaaaacttttaatgaaatataagacattcactataataaaaagcttaaaaagaacaaaaaataaactgcataaactgaaaa

SEQ ID NO: 203821 - DNA, 698 bp, Homo sapiens
  Payload ID: 20197
  Gene Name: zinc finger protein 782
  ENST ID: ENST00000498811
  CDS Start-End: 24-158
agtgcgaaccttggggaaagcgcatgcccgcggcggcagaggagagcccgtttataaacgttgaccaaagtgccagaactcgtgggcgctgtgtctgtggcaagaccccgagctgtggagaccgaaagagctgcataaattccagctttattacctgatctcactttgtcactcaggttggagtgcagtggcacaatcacagttcattgcagcctcaacctcctgggctcaggctgcctggagttgggagaggagcaatacaacacccctgtagccaccaccactgggacagcactgggtcagacctgaagccggcacagcgctgtgactgcccaagacccccactgtaacaacaacccagctgccacctatttcactcaaggccccagggctctccaattagcagaatcccatgcatgatgatacatgaagggttttccgtggctatctacttctgattcttttgaaagctttaaagacattgggcatgaaaggttcagtgagtttccggggatccctcgtttgtggtagagccaggaggaaaacagttccgttcattctttcacagctgaggctttacagttctctatactctcccaagagccacagaaaatgaacacatttcaggcatcagtgtcattccaggacgtgactgtggaattcagccaggaggagtggcagcacatgggccctgttga

SEQ ID NO: 203822 - DNA, 3296 bp, Homo sapiens
  Payload ID: 20197
  Gene Name: zinc finger protein 782
  Uniprot ID: Q6ZMW2
  ENST ID: ENST00000535338
  CDS Start-End: 265-2364
cagatgccatactgctgttaacatatgtgacactggagactttgtccctacctcatagaatcccatgcatgatgatacatgaagggttttccgtggctatctacttctgattcttttgaaagctttaaagacattgggcatgaaaggttcagtgagtttccggggatccctcgtttgtggtagagccaggaggaaaacagttccgttcattctttcacagctgaggctttacagttctctatactctcccaagagccacagaaaatgaacacatttcaggcatcagtgtcattccaggacgtgactgtggaattcagccaggaggagtggcagcacatgggccctgttgagaggaccctgtacagagatgtgatgctggagaactacagccacctcgtctcagtgggctactgctttacaaaaccagaactgatcttcacattggaacaaggagaagatccatggttattagagaaagagaaaggatttctaagcaggaactccccagaagactcccaacctgatgaaatctcagagaagagcccagaaaatcaaggcaaacatttgttgcaagttttattcaccaataaattattgactacagagcaagaaatttcaggaaaaccacataatcgagacataaacatttttcgtgcaagaatgatgccttgtaaatgtgacattgcggggtctgcttgccaggggctcagcctgatggccccacactgtcagtattcaaaagaaaaggctcatgagcgtaatgtttgtgacaaatggctcatcagtattaaggatggcagaactaacactcaagagaaatctttcgcttatagtaaaattgtgaaaaccctccatcataaggaggaagttattcaacatcagacaattcagactctggggcaagattttgaatataatgaaagtagaaaagcttttcttgaaaaggctgcccttgttacatctaacagtacccacccaaaaggaaaatcttacaatttcaataaatttggggaaaacaaatatgataaatcaacctttattattcctcagaacatgaatccagagaagagtcactatgagtttaatgatactggaaattgtttctgtagaatcactcacaaaactctcacaggagggaaatccttcagccaaaagtcacacattagagaacatcatagagttcatataggggtgaaaccctttgaatatggaaaaagtttcaaccgtaattcaaccctcccagtgcatcagagaactcatgcaacagataaatactctgattatcacccatgtacagagacattcagctaccagtcaactttcagtgtacatcagaaggttcacataagggcaaaaccctatgagtataatgaatgtgggaaatcctgctctatgaattcacacttgatttggcctcagaaaagtcacacaggggagaaaccctatgaatgtcctgagtgcgggaaagccttcagtgagaagtcacgcctaagaaaacatcagagaactcacacgggagagaaaccatacaaatgtgatggatgtgataaagctttcagtgcaaagtcaggcctaagaatacaccagagaacccacacaggggagaaaccattcgaatgtcatgaatgtgggaaatcttttaactataagtcaatcctcatagtgcatcagagaactcacacaggggagaaaccttttgaatgtaatgaatgcgggaaatctttcagccatatgtcaggcctaaggaatcaccgaagaactcacacaggggaaagaccatataaatgtgatgaatgtgggaaagctttcaaactgaagtcaggcctgaggaaacatcatagaacacacacaggggagaagccctacaaatgtaatcagtgtggaaaagctttcggtcagaaatcacaactcagaggacatcatagaattcacacaggggaaaaaccctataaatgtaatcattgtggggaagctttcagtcagaaatcaaacctcagagtacatcacagaactcatactggggagaaaccctatcaatgtgaggagtgtggaaaaacattcaggcagaaatcaaatctcagagggcatcagagaactcacactggggagaagccctatgaatgtaatgaatgtggaaaagctttcagtgagaagtcagtcctaagaaaacatcagcgaactcacaccggggagaaaccatataattgtaatcagtgtggggaagctttcagtcagaaatccaatctcagagtacatcagagaactcacacaggggagaaaccctataaatgtgataaatgtgggagaactttcagtcaaaaatcaagccttagagaacatcagaaagcccacccaggggattaaatgtatgcatataaagaatacgaaaaaactctgagctggaaatcaaacctcacaatacataaatgaacacacaggagagaactgttaacatagtgagcactggaatttcctctacaatttcagcctccaccaaatatcaaagaatagaagataaattgttgaaatctattttatatgggcattctttcagccagagcccagtcttctatggatatacagaactcacacagcaaagaaaccctataaacataatgaatatggaaaatactcttgcgaactcactcctcagaaaactcacgctgcagaaaagctctgagaaagtaataaaaatgtgaaaactttgtgccaacaatcaaaactcattcaccatcagagaaatcacacaatgacaaaagctagaatataataagtgtgtgataaactttaatgaaaagtcagtacagcagaaaatacattcaagatagagacctcatagtatattaaaacaaacaagaaatgaagttaatggatgtgggaaattcttctgccatgtcaaccctcattttaacctacacagaggtaatccctatatgtcgtataataactattgaaatgttcactagtaatcattttcacttctccctcatgccacacctggcctaaatttctcaaccactctctcatctaaacggggtcatattgttaccctctagctagtggaatatggggtcagtgacaggtcttaaatacatcagtcaaattctcaatattttcttctatccctcattagaatggaatggaggaaaaccttgggactcaggctctgatgatggaaagtacaagatggtaggaacccgggtcagagaaggatcctgtggcatggagttttctcctccctgtacacagttggacttcttgcagtgaggaaataaatgtgttccctgctgaacttc

SEQ ID NO: 203823 - DNA, 2021 bp, Homo sapiens
  Payload ID: 20198
  Gene Name: zinc finger protein 784
  Uniprot ID: Q8NCA9
  ENST ID: ENST00000325351
  CDS Start-End: 41-1012
agagcgaacattggccttgggggcggggcttgggcacaagatggccgctgcgcgcccagaggcccagagtcggagctcaccgactccggagtcgcgatcccaggagccactggacctggtcctggtgcctgatgactgccggcctggcacacccccgagtgacctcatcgagatccaggtggtgaaggtgacggacaccacgctggtccctgagcccccggagccaggttctttccactgtgccttgtgccctgctgccttccggctggtttccgagctgctgttccacgaacatggccacttggctggggccgagggaggcgggcagggtggggacccgagccggtgccacgtgtgcggccacagctgcccgggccccgccagcctgcgcgcgcactacagcttgcacacgggggagcggccctaccgctgcgcgctctgcccccgcgccttcaaggccttggcgcccctgctccggcaccagcaccggcacggggtggagccgggcacctctcggaggcctccggacacagcggccgttgcagaacagaggcccggggtggccccggagagggcggaggtggtgatggcggcggcggcggcgggcgcagcggtggggaagccttttgcctgcaggttctgcgccaagcccttccgccgctcctcagacatgcgagaccacgagcgcgtgcacactggcgagcggccataccattgcggcatctgcggcaagggcttcacccagtcctcggtgcttagcggccacgcccgcatccacactggcgagcgcccgttccgctgcacgctctgcgaccgcaccttcaacaactcctccaacttccgcaagcaccagcgcacccacttccacgggccggggccggggctgggagactctggaggccagctgggctcgtcggcggctgaggggtcggggagcgggtgtggggtaggggaccctgcggaggaggggcggggggagaccgcgaaggtgaaggtggaggccgaccagtaggctgcagaccagggacatgggttagttaaggcggaggtacgaggccgacccggggagggggacggggtggggaaacggaggcaggggacagaagaggggagattgggggagagatgacagctgcagggatggttgtgagccgctagtgatggagagcagagggagagggccaggctccagactcccacacgcccacacagcacctctgccaggcctaggagaggacaggtgcagctcttgcagctctgcgggtgtgcggccaaaggcaaggcccacgggctggatgtcacttccccgactgtctcttggttggcttgtccttgtgcaagacccagcctgtcacgacagagcctgggcacttcagaggaggagccaggatcgaatggaaggggggaattggggtccaccatagtcttctgctctggtcctccacgggtggaccaggatggagtctcctgcctacctcactgcattgcactggacctgggatgcctatccaccctctggcagaagacactcaccaggttatctgtgaagagactctgggatcccatcacctcaaagccagagggtccccaagtcaccgctgagagcacttgagcctcaaggatgtaagcctgaccataggatcttgactccaacagcggcaacccccacccccattgtggtccgtccttaacccatccactcttcttcggaggcaactgagaacacataaagcaagcagctacctagcatccccctcctaaagctttagactcagagcccagggtcccccacaagcctcaaggtagcctcaggtttctctaatttcctccactcccagttcgaagcaaacagcttactgcctagtccccgccaatcccaagggcgggctggctgatggcagcatggtgggctggcctgggtgtggagtgaaagagtcactgtggtgggggcgagaggaggacttgggagctggaggtgtgacaccttcagttctgttcctattaaaggaccttctgaaggg

SEQ ID NO: 203824 - DNA, 1559 bp, Homo sapiens
  Payload ID: 20198
  Gene Name: zinc finger protein 784
  ENST ID: ENST00000591479
  CDS Start-End: 6-134
acaagatggccgctgcgcgcccagaggcccagagtcggagctcaccgactccggagtcgcgatcccaggagccactggacctggtgcgggcaaggaaggggcctgggcgtggggctcgaggtcctggtgcctgatgactgccggcctggcacacccccgagtgacctcatcgagatccaggtggtgaaggtgacggacaccacgctggtccctgagcccccggagccaggttctttccactgtgccttgtgccctgctgccttccggctggtttccgagctgctgttccacgaacatggccacttggctggggccgagggaggcgggcagggtggggacccgagccggtgccacgtgtgcggccacagctgcccgggccccgccagcctgcgcgcgcactacagcttgcacacgggggagcggccctaccgctgcgcgctctgcccccgcgccttcaaggccttggcgcccctgctccggcaccagcaccggcacggggtggagccgggcacctctcggaggcctccggacacagcggccgttgcagaacagaggcccggggtggccccggagagggcggaggtggtgatggcggcggcggcggcgggcgcagcggtggggaagccttttgcctgcaggttctgcgccaagcccttccgccgctcctcagacatgcgagaccacgagcgcgtgcacactggcgagcggccataccattgcggcatctgcggcaagggcttcacccagtcctcggtgcttagcggccacgcccgcatccacactggcgagcgcccgttccgctgcacgctctgcgaccgcaccttcaacaactcctccaacttccgcaagcaccagcgcacccacttccacgggccggggccggggctgggagactctggaggccagctgggctcgtcggcggctgaggggtcggggagcgggtgtggggtaggggaccctgcggaggaggggcggggggagaccgcgaaggtgaaggtggaggccgaccagtaggctgcagaccagggacatgggttagttaaggcggaggtacgaggccgacccggggagggggacggggtggggaaacggaggcaggggacagaagaggggagattgggggagagatgacagctgcagggatggttgtgagccgctagtgatggagagcagagggagagggccaggctccagactcccacacgcccacacagcacctctgccaggcctaggagaggacaggtgcagctcttgcagctctgcgggtgtgcggccaaaggcaaggcccacgggctggatgtcacttccccgactgtctcttggttggcttgtccttgtgcaagacccagcctgtcacgacagagcctgggcacttcagaggaggagccaggatcgaatggaaggggggaattggggtccaccatagtcttctgctctggtcctccacgggtggaccaggatggagtctcctgcctacctcactgcattgcactggacctgggatgcctatccaccctctggcagaagacactcaccaggttatctgtgaagagactctg

SEQ ID NO: 203825 - DNA, 3282 bp, Homo sapiens
  Payload ID: 20199
  Gene Name: zinc finger protein 785
  Uniprot ID: A8K8V0
  ENST ID: ENST00000395216
  CDS Start-End: 161-1378
gtaaaggcagagaggaaaggcgaggggtgttgacgccaggaaggttccatcttggttaagggcaggagtcccttacggacttgtctgaggaaagacaggaaagcgccagcatctccaccttccccggaagcctccctttgccaggcagaaagggtttcccatggggccgcccctggcgccgcgcccggcccacgtacccggggaggccgggccccggaggacgagggaaagcaggccgggcgccgtgagcttcgcggacgtggccgtgtacttctctcccgaggagtgggaatgcctgcggccagcgcagagggccctgtaccgggacgtgatgcgggagaccttcggccacctgggcgcgctgggattttcagttcccaaacccgcttttatctcgtgggtggaaggagaagtggaggcgtggagcccggaggcccaggatcccgacggtgagagctctgcagctttcagcaggggccaaggacaggaagcaggatccagggatgggaatgaggagaaggaaaggctgaagaagtgtccaaaacaaaaagaggtggcgcatgaagtggctgtcaaggagtggtggcccagcgtcgcctgcccagagttctgcaaccctaggcagagccccatgaatccctggctcaaggacactctgacccgaagactgccccactcttgcccagactgtggccgcaacttcagctacccttccctcctggccagccaccagcgggtccactccggggagcggcccttctcctgcggccagtgtcaggcgcgtttctcccagcgcaggtacctgctccagcatcagttcatccacaccggcgagaagccctacccctgccccgactgcgggcgccgcttccgccagaggggttccctggctatccacaggcgggctcacaccggggagaagccttacgcgtgctcagactgcaagagtcgcttcacttacccctacctgctggccatccaccagcgcaagcacacgggcgagaagccctacagctgccccgattgcagcctccgtttcgcctacacctccctgctggccatccacaggcgcatacacaccggcgagaagccctacccctgtcctgactgcggccgccgcttcacctattcttccctcctcctcagtcaccggcgcattcactccgacagccggcccttcccctgcgtggagtgtgggaaaggcttcaagcgcaagaccgccctggaagcccatcggtggatccaccgctcctgcagcgagaggcgcgcgtggcagcaggccgtggtggggcgttcagagcccatccctgttttgggaggcaaggatcccccagttcacttccggcactttccagatatatttcaagagtgtgggtgatggcgttcacacaaactggtcagcgtttccctggagaggaagaggcaaggtttgtgtatttgggggataaggaaaggaagtgggcgtttgaggaaaacaaagttctgccttaggtaaaaagcagaggtaggggcacagagggctgtggggaggaggcaggaatctgaaaaggtgcctgggggttgaccccattttctgaagctccagcacacagggccccgtgttcacgtcccatccttcactgaaaaccattcacctaactggcttttccttcatgattgttctctcccttgtagctctctgctttttggcctgtatctctcctactcctctgagatggggtcccctacattccagtgcctattaaaggagcctgcacccactctggaccccccagaatagaggggatacctcaggcctgtccctcggctggtggggggggcggagctcatcccaggattcttttcttttttttgagatggagtcatgctctgtcgcccaggctggagtgcagtggcgtgatctcggctcactgcaacctctgcctcctgggttcaagccattctctgcctcagccttcccattagctgggattacaggcatgcgccaccaggcccagctaatttttgtgctgttagtagagacggggttccaccatcttggccaggctggtcttgaattcctgacctcgtgatccacccgcctcggcgtctcaaagtgctgggattacaagcgtgagccaccgacccctgccgaggattctgccttttaccaatgcaggtgaaacatctggcaaggagacacctggagtgtaggtgttccttggtcttgaagacctagaggtggccatagagaggacagtggcctcaggtggggaactccccccccactctcattctgcaagtgcacaaactatcaaacatagcggactctggaactgggccaactcttcactgtatgcattagtgattgcagtgtttttttcttcttcagatatttgcatgttccctggattttgtattttttgataaagatatattcttgggccacagtagctggagatataatgccggaggattcttttttttttttttttttttgagacagagtctgtctctattgcctgggctggagtgcagtggcccaagctacgctcactgcaagctccacctcctgggttcacaccattctcctgcttcagtctcccgagtagctggaattacaagcacccgccaccacgcccaactaatattttgtatttttagtagagacgggggtttcaccgtgttagccaggatggtctcgatctcctgacttcgtgatcctcccgcctcggcctcccaaagtgctgggattacaggcgtgagccactgcacccagcctctttttttttttgagatggagtttcgctcttgttgcccaggctagagtgcaatggcatgatcttggctcactgcaacctccgcctcctaggttcaagcgattctcctgccccagcctcttgagtagctgggattacaggcacccacgaccatgcctggctaattgcatttttactagagacaggtttcaccatgttggccaggctggtctccaattcctgacctcaggtgatccacccgacttggcctcccaaagttctgggattacattttttttttaaagaaagaataaattaattgtgattaaagttgaaatcaaggcatagtctttccagtctaatttttactgtaatgcttgtatgtcaacagttatgaaggccaggcgcggtggctcacgcctgtaatcctagcagtttgggaggctgaggagggtggatcacttaaggtcaagagttcaagaccagcctggccaatatggtgaaaccccatctctactaaaaataccaaaaaaaaaaaaaaaaa

SEQ ID NO: 203826 - DNA, 2867 bp, Homo sapiens
  Payload ID: 20199
  Gene Name: zinc finger protein 785
  Uniprot ID: A8K8V0
  ENST ID: ENST00000470110
  CDS Start-End: 159-1331
aaaggcagagaggaaaggcgaggggtgttgacgccaggaaggttccatcttggttaagggcaggagtcccttacggacttgtctgaggaaagacaggaaagcgccagcatctccaccttccccggaagcctccctttgccaggcagaaagggtttcccatggggccgcccctggcgccgcgcccggcccacgtacccggggaggccgggccccggaggacgagggaaagcaggccgggcgccgtgagcttcgcggacgtggccgtgtacttctctcccgaggagtgggaatgcctgcggccagcgcagagggccctgtaccgggacgtgatgcgggagaccttcggccacctgggcgcgctgggattttcagttcccaaacccgcttttatctcgtgggtggaaggagaagtggaggcgtggagcccggaggcccaggatcccgacggatccagggatgggaatgaggagaaggaaaggctgaagaagtgtccaaaacaaaaagaggtggcgcatgaagtggctgtcaaggagtggtggcccagcgtcgcctgcccagagttctgcaaccctaggcagagccccatgaatccctggctcaaggacactctgacccgaagactgccccactcttgcccagactgtggccgcaacttcagctacccttccctcctggccagccaccagcgggtccactccggggagcggcccttctcctgcggccagtgtcaggcgcgtttctcccagcgcaggtacctgctccagcatcagttcatccacaccggcgagaagccctacccctgccccgactgcgggcgccgcttccgccagaggggttccctggctatccacaggcgggctcacaccggggagaagccttacgcgtgctcagactgcaagagtcgcttcacttacccctacctgctggccatccaccagcgcaagcacacgggcgagaagccctacagctgccccgattgcagcctccgtttcgcctacacctccctgctggccatccacaggcgcatacacaccggcgagaagccctacccctgtcctgactgcggccgccgcttcacctattcttccctcctcctcagtcaccggcgcattcactccgacagccggcccttcccctgcgtggagtgtgggaaaggcttcaagcgcaagaccgccctggaagcccatcggtggatccaccgctcctgcagcgagaggcgcgcgtggcagcaggccgtggtggggcgttcagagcccatccctgttttgggaggcaaggatcccccagttcacttccggcactttccagatatatttcaagagtgtgggtgatggcgttcacacaaactggtcagcgtttccctggagaggaagaggcaagatctgctagccctacttttgaagaggaaacttttgaaggaatgaacaaaagaggtaggtgggactaagcatttctgcattccaggactggtggtcagtgactcaaatatctctttgaaaagactgcttctttgaatccttgggttccaagataattaatgggaactggtgccgggcacggtggctcacacctgtgatcccagcactgtgggaggctgaggctggttaatcacttgaggtcaggagtttgagaccagctgggcaatatagtgaaaccccatctctaccaaaaaattagccaggcgtggtggcacatgcctgtagtcccagctactcaggaggctaaggcaagaggatcacttgagcctgggagacagaggttgcagtaagctgagatggctccattgcactccagcctgggctacaaagcaggactctgtctcaaaacaaaaacagatacaaaaactgggaacggggtgttatctttacttcaccacatagcctctcctgaattggtggacctggattcctagcttggctcagtccccactggctgtgtggcctttagcatcacctagattctacaaataacatttttctctatttgttttacacatgtcaatctgcctatccatccctctatccattcatttatccattttattaatgtatttcaaagtaagttgcagacatcattacatttcacttctaaacacttcagcatacagctgagttttatgcaagaaacttaagctctcagctgggtacagtggctcacacctgtaatcccagcactttgggaggctgaggcaggaggattgcatgagattgggagtttgagacgagcctggaaaacagcaagacctcatttctactaaaaattttaaaaattagccgagcatggtgggggagggtgaagaaggaggatagcttgagcccaggagtttgaggctatagtgagctatgatggcgccacttcagtctgagtaacagcaagacactattaaaaaaaaaaaagagccaggcgcagtggctcacacctgtaatcccagcactttggtaggccaaggtgggcagatcacctgaggtcaggagtttgagaccagcctgacgaacatggagaaaccctgtctctactaaaaaaaaagaaatacaaaattagccaggcatggtggcacatgcctgtaatcacagctactcgggaggctgaggcaggagaatcgtttgaccccaggaggcggaggttgcagtgagccaagatcgtgccattgcactccagcctgggcaacaagagtggaactctgtttcaaaaaagaaagaaagaaattcagctcccacttaaagttcagttgtactctgttattgacaagtaaagtcgattgaagcccagtcatctcctgtatgttgtgtgacttctcataattatctgatcaagagtcttgaagaaacatttacaatttgatgggcaataaaataatttgaaagcaa

SEQ ID NO: 203827 - DNA, 499 bp, Homo sapiens
  Payload ID: 20199
  Gene Name: zinc finger protein 785
  ENST ID: ENST00000562128
  CDS Start-End: 1-245
ccctcctcctcagtcaccggcgcattcactccgacagccggcccttcccctgcgtggagtgtgggaaaggcttcaagcgcaagaccgccctggaagcccatcggtggatccaccgctcctgcagcgagaggcgcgcgtggcagcaggccgtggtggggcgttcagagcccatccctgttttgggaggcaaggatcccccagttcacttccggcactttccagatatatttcaagagtgtgggtgatggcgttcacacaaactggtcagcgtttccctggagaggaagaggcaagatctgctagccctacttttgaagaggaaacttttgaaggaatgaacaaaagagtattcaccacatggagtgcagtgaggcagttccagaactcaaggtaataatgtaagcatattaataatatttaattattaacaattaataattaatcaattaataacatatgcatatgagatcagcaggagtcacactaaaagccaaaaagc

SEQ ID NO: 203828 - DNA, 566 bp, Homo sapiens
  Payload ID: 20199
  Gene Name: zinc finger protein 785
  ENST ID: ENST00000567773
  CDS Start-End: 1-210
tctcccgaggagtgggaatgcctgcggccagcgcagagggccctgtaccgggacgtgatgcgggagaccttcggccacctgggcgcgctgggtgaggccgggccctccggccgggacccccagattttcagttcccaaacccgcttttatctcgtgggtggaaggagaagtggaggcgtggagcccggaggcccaggatcccgacggtgagagctctgcagctttcagcaggggccaaggacaggaagcaggatccagggatgggaatgaggagaaggaaaggctgaagaagtgtccaaaacaaaaagaggtggcgcatgaagtggctgtcaaggagtggtggcccagcgtcgcctgcccagagttctgcaaccctaggcagagccccatgaatccctggctcaaggacactctgacccgaagactgccccactcttgcccagactgtggccgcaacttcagctacccttccctcctggccagccaccagcgggtccactccggggagcggcccttctcctgcggccagtgtcaggcgcgtttctcccagcgcaggtacctgctcc

SEQ ID NO: 203829 - DNA, 3144 bp, Homo sapiens
  Payload ID: 20200
  Gene Name: zinc finger protein 786
  ENST ID: ENST00000316286
  CDS Start-End: 274-2364
gctgcgtttgggggccacccgggctgtgcgtgggagtcgggttggggcggagcggaggggagtcagtgcgcagcagggcaggttcctgcggagccgccggagacggtcgggtttgccagggccgggcgggaccgcggggaccatggcggagccgcctcggatgatggacttccaaaaccagaactaatatcctggattgaacacgggggagagcccttcaggaaatggagagaatcacagaaatcaggaaacataatttgctcctctgttgatatgcattttgatccaggttttgaggaacagctgttttggggaagccagcaggctatgaattcaggaaaaactaaaagccatttccaattagatcctgaaagccagtgttcctttggatcctttgtttccttcaggcctgaccaaggcatcaccctcgggagcccacagagacacgacgccagggctcctccaccactagcctgcggccccagtgaatctaccctaaaagaaggaatcccaggtcccagaaatctggatcttcctggtttgtgggacgtccccgcctgggagagcacccagcacccttggcctgtctgcggggaaagctgttgggagaacaaccatttagtaatgcaccagagaggccactcaaaggaccggacacgtagggcctgggagaaattcaacaagagggcggagacgcagatgccgtggagcagccctcgggtacagaggcacttccggtgtggcgtgtgcggtaagagcttccgccggaagctgtgtctgctgcgccatctggcggcccacacggggaggggccccttccggaacgctgacggtgaaatgtgcttccgacacgagctgacccatcccagccaccgcctcccgcagcagggggagaagcctgcccagtgcaccccatgcggcaagcgctccctcccagtggacagcacgcaggctcgccggtgccagcacagccgggaggggccggcctcttggagagaaggccgcggggcctccagcagtgtgcactcgggacagaaaccaggctcgcgcctgccccaggaggggaacagccaccaggaaggggacacggaggcgctgcagcatggcgcagaggggccctgctcctgctcggagtgtggcgagcgctcccctatgagcgccaggctcgccagcccctgcagggcgcatactggagaaaagcccttccagtgtgcgcattgcaccaagcgcttccgcctgcgccgcctgctgcaggtccaccagcacgcgcacggtggggagagaccgttctcctgcaggaagtgtggcaagggcttcgccaagcagtgtaaactcacggagcacattcgagtccacagcggagagaagcctttccggtgtgccaagtgtggcaggaacttccgtcagaggggacagctgctgcggcaccagcggctgcacacggacgagaagccctttcagtgcccagagtgtgggctgagcttccgcctggagagcatgctgagagcccaccggctccggcacggtggggagaggccgttctcctgtagcgagtgtggcagaggcttcacccaccagtgcaagctccgtgagcacctgagagtgcacagcggggagaggcccttccagtgcctgaagtgcgacaagcgcttccgcctgaagggcatcctgaaggcccaccagcacacgcacagcaaggagaggccgttctcgtgcggggagtgtggcaagggcttcaccagacaatccaagctcacggagcacttgcgcgtgcacagcggggagagacccttccagtgcccagagtgcaacaggagcttccgcctgaaggggcagctgctcagccatcagcgcctgcacacgggagagaggcccttccagtgtccggagtgcgacaagcgctatcgcgtgaaggccgacatgaaggcccaccagctgctgcacagcggggagatgcctttctcctgtgagtgcggcaagggctttgtgaaacactcaaagctcatcgagcacatcagaacgcacacgggagagaagccttttcagtgtcccaagtgtgacaagagtttccgcctgaaggcgcagctgctcagccatcagggcctgcacacaggggagaggccttttcactgccctgagtgtgacaagaacttccgggaaaggggacacatgctgaggcaccagcgcatccacaggcccgagaggccctttgcctgtggcgattgtgggaagggcttcatttacaagtctaagcttgcggagcacatcagagtacacacaaaatcctgtcctgctccaaatgaactggacattaagaaaaggctcagccaactgtttgcaatgatagaggccgattggagttgaggcagagtgggacatccaaagcgttgagcaggattggtattgcccaggaatccacagcaacagtagccagacccgctggtagacgggttttaggagcaggtatccttctttgagcaagagtgtcatgcaagttaggaatatgaagaaccacaaaggattttctcttcagaagcatcaccaattatatttctttcttttttttttttttttccaagatggagttttgctctgtcacccaggctggagtgcagtggcgtgatcccagctatattggaaaagacagcattataaaacaaggacataattttatgaaaaaggaggcatctgcaaacgaaaacaatttctacgaggttatatgtgattgttaacatttttaagaaaaggtgcacacagaaatccagataagatgtgattacctttgtgcatttgtataaaaatatatgtgtgtaattataaggaagttctgacattttaaaaagtaattgttataaaagtaaatttaggccaggcacagtggttcatgcctgtaatcccagcacttgggaggccgtggcaggaggatcacgagccaaggagtttgagaccagcttgggcaacatggcaaaaccctgtctctactaaaaatacaaaaattagccaggcatggtggtacacaccagtagtcccagctactcctgaagctgaggtgggaggatcgcctgagcccagggaggtcaaggctgcagtgagcaatgatggtgccactgcactccagtatggatgacatagtatgacactgtc

SEQ ID NO: 203830 - DNA, 2792 bp, Homo sapiens
  Payload ID: 20200
  Gene Name: zinc finger protein 786
  ENST ID: ENST00000451334
  CDS Start-End: 231-1286
ggggcggagcggaggggagtcagtgcgcagcagggcaggttcctgcggagccgccggagacggtcgggtttgccagggccgggcgggaccgcggggaccatggcggagccgcctcggatgatggacttccaaaaccagaactaatatcctggattgaacacgggggagagcccttcaggaaatggagagaatcacagaaatcaggaaacataatttgctcctctgttgatatgcattttgatccaggttttgaggaacagctgttttggggaagccagcaggctatgaattcaggaaaaactaaaagccatttccaattagatcctgaaagccagtgttcctttggatcctttgtttccttcaggcctgaccaaggcatcaccctcgggagcccacagagacacgacgccagggctcctccaccactagcctgcggccccagtgaatctaccctaaaagaaggaatcccaggtcccagaaatctggatcttcctggtttgtgggacgtccccgcctgggagagcacccagcacccttggcctgtctgcggggaaagctgttgggagaacaaccatttagtaatgcaccagagaggccactcaaaggaccggacacgtagggcctgggagaaattcaacaagagggcggagacgcagatgccgtggagcagccctcgggtacagaggcacttccggtgtggcgtgtgcggtaagagcttccgccggaagctgtgtctgctgcgccatctggcggcccacacggggaggggccccttccggaacgctgacggtgaaatgtgcttccgacacgagctgacccatcccagccaccgcctcccgcagcagggggagaagcctgcccagtgcaccccatgcggcaagcgctccctcccagtggacagcacgcaggctcgccggtgccagcacagccgggaggggccggcctcttggagagaaggccgcggggcctccagcagtgtgcactcgggacagaaaccaggctcgcgcctgccccaggaggggaacagccaccaggaaggggacacggaggcgctgcagcatggcgcagaggggccctgctcctgctcggagtgtggcgagcgctcccctatgagcgccaggctcgccagcccctgcagggcgcatactggagaaaagcccttccagtgtgcgcattgcaccaagcgcttccgcctgcgccgcctgctgcaggtccaccagcacgcgcacggtggggagaccgttctcctgcaggaagtgtggcaagggcttcgccaagcagtgtaaactcacggagcacattcgagtccacagcggagagaagcctttccggtgtgccaagtgtggcaggaacttccgtcagaggggacagctgctgcggcaccagcggctgcacacggacgagaagccctttcagtgcccagagtgtgggctgagcttccgcctggagagcatgctgagagcccaccggctccggcacggtggggagaggccgttctcctgtagcgagtgtggcagaggcttcacccaccagtgcaagctccgtgagcacctgagagtgcacagcggggagaggcccttccagtgcctgaagtgcgacaagcgcttccgcctgaagggcatcctgaaggcccaccagcacacgcacagcaaggagaggccgttctcgtgcggggagtgtggcaagggcttcaccagacaatccaagctcacggagcacttgcgcgtgcacagcggggagagacccttccagtgcccagagtgcaacaggagcttccgcctgaaggggcagctgctcagccatcagcgcctgcacacgggagagaggcccttccagtgtccggagtgcgacaagcgctatcgcgtgaaggccgacatgaaggcccaccagctgctgcacagcggggagatgcctttctcctgtgagtgcggcaagggctttgtgaaacactcaaagctcatcgagcacatcagaacgcacacgggagagaagccttttcagtgtcccaagtgtgacaagagtttccgcctgaaggcgcagctgctcagccatcagggcctgcacacaggggagaggccttttcactgccctgagtgtgacaagaacttccgggaaaggggacacatgctgaggcaccagcgcatccacaggcccgagaggccctttgcctgtggcgattgtgggaagggcttcatttacaagtctaagcttgcggagcacatcagagtacacacaaaatcctgtcctgctccaaatgaactggacattaagaaaaggctcagccaactgtttgcaatgatagaggccgattggagttgaggcagagtgggacatccaaagcgttgagcaggattggtattgcccaggaatccacagcaacagtagccagacccgctggtagacgggttttaggagcaggtatccttctttgagcaagagtgtcatgcaagttaggaatatgaagaaccacaaaggattttctcttcagaagcatcaccaattatatttctttcttttttttttttttttccaagatggagttttgctctgtcacccaggctggagtgcagtggcgtgatcccagctatattggaaaagacagcattataaaacaaggacataattttatgaaaaaggaggcatctgcaaacgaaaacaatttctacgaggttatatgtgattgttaacatttttaagaaaaggtgcacacagaaatccagataagatgtgattacctttgtgcatttgtataaaaatatatgtgtgtaattataaggaagttctgacatttt

SEQ ID NO: 203831 - DNA, 2874 bp, Homo sapiens
  Payload ID: 20200
  Gene Name: zinc finger protein 786
  Uniprot ID: Q8N393
  ENST ID: ENST00000491431
  CDS Start-End: 66-2414
gcaggttcctgcggagccgccggagacggtcgggtttgccagggccgggcgggaccgcggggaccatggcggagccgcctcggctacctctgacttttgaggatgttgctatttatttctccgagcaagaatggcaggatctagaggcatggcagaaggaactttacaagcatgtgatgagaagcaattatgagactctcgtctctctagatgatggacttccaaaaccagaactaatatcctggattgaacacgggggagagcccttcaggaaatggagagaatcacagaaatcaggaaacataatttgctcctctgttgatatgcattttgatccaggttttgaggaacagctgttttggggaagccagcaggctatgaattcaggaaaaactaaaagccatttccaattagatcctgaaagccagtgttcctttggatcctttgtttccttcaggcctgaccaaggcatcaccctcgggagcccacagagacacgacgccagggctcctccaccactagcctgcggccccagtgaatctaccctaaaagaaggaatcccaggtcccagaaatctggatcttcctggtttgtgggacgtccccgcctgggagagcacccagcacccttggcctgtctgcggggaaagctgttgggagaacaaccatttagtaatgcaccagagaggccactcaaaggaccggacacgtagggcctgggagaaattcaacaagagggcggagacgcagatgccgtggagcagccctcgggtacagaggcacttccggtgtggcgtgtgcggtaagagcttccgccggaagctgtgtctgctgcgccatctggcggcccacacggggaggggccccttccggaacgctgacggtgaaatgtgcttccgacacgagctgacccatcccagccaccgcctcccgcagcagggggagaagcctgcccagtgcaccccatgcggcaagcgctccctcccagtggacagcacgcaggctcgccggtgccagcacagccgggaggggccggcctcttggagagaaggccgcggggcctccagcagtgtgcactcgggacagaaaccaggctcgcgcctgccccaggaggggaacagccaccaggaaggggacacggaggcgctgcagcatggcgcagaggggccctgctcctgctcggagtgtggcgagcgctcccctatgagcgccaggctcgccagcccctgcagggcgcatactggagaaaagcccttccagtgtgcgcattgcaccaagcgcttccgcctgcgccgcctgctgcaggtccaccagcacgcgcacggtggggagagaccgttctcctgcaggaagtgtggcaagggcttcgccaagcagtgtaaactcacggagcacattcgagtccacagcggagagaagcctttccggtgtgccaagtgtggcaggaacttccgtcagaggggacagctgctgcggcaccagcggctgcacacggacgagaagccctttcagtgcccagagtgtgggctgagcttccgcctggagagcatgctgagagcccaccggctccggcacggtggggagaggccgttctcctgtagcgagtgtggcagaggcttcacccaccagtgcaagctccgtgagcacctgagagtgcacagcggggagaggcccttccagtgcctgaagtgcgacaagcgcttccgcctgaagggcatcctgaaggcccaccagcacacgcacagcaaggagaggccgttctcgtgcggggagtgtggcaagggcttcaccagacaatccaagctcacggagcacttgcgcgtgcacagcggggagagacccttccagtgcccagagtgcaacaggagcttccgcctgaaggggcagctgctcagccatcagcgcctgcacacgggagagaggcccttccagtgtccggagtgcgacaagcgctatcgcgtgaaggccgacatgaaggcccaccagctgctgcacagcggggagatgcctttctcctgtgagtgcggcaagggctttgtgaaacactcaaagctcatcgagcacatcagaacgcacacgggagagaagccttttcagtgtcccaagtgtgacaagagtttccgcctgaaggcgcagctgctcagccatcagggcctgcacacaggggagaggccttttcactgccctgagtgtgacaagaacttccgggaaaggggacacatgctgaggcaccagcgcatccacaggcccgagaggccctttgcctgtggcgattgtgggaagggcttcatttacaagtctaagcttgcggagcacatcagagtacacacaaaatcctgtcctgctccaaatgaactggacattaagaaaaggctcagccaactgtttgcaatgatagaggccgattggagttgaggcagagtgggacatccaaagcgttgagcaggattggtattgcccaggaatccacagcaacagtagccagacccgctggtagacgggttttaggagcaggtatccttctttgagcaagagtgtcatgcaagttaggaatatgaagaaccacaaaggattttctcttcagaagcatcaccaattatatttctttcttttttttttttttttccaagatggagttttgctctgtcacccaggctggagtgcagtggcgtgatcccagctatattggaaaagacagcattataaaacaaggacataattttatgaaaaaggaggcatctgcaaacgaaaacaatttctacgaggttatatgtgattgttaacatttttaagaaaaggtgcacacagaaatccagataagatgtgattacctttgtgcatttgtataaaaatatatgtgtgtaattataaggaa

SEQ ID NO: 203832 - DNA, 1657 bp, Homo sapiens
  Payload ID: 20201
  Gene Name: zinc finger protein 787
  ENST ID: ENST00000587279
  CDS Start-End: 90-470
gccgctgccgccgctgccaccatccgcgaggcaggagagaggaggaggagtgcggcgcggcggccccgggaccaaggagggacccagacatggagctgcgggaagaagcctggtctccggggccgctggattctgaggaccagcagatggccagtcacgagaacccaggtgagcagccagaggccttcccagccgaccccgctgcctcccacctgaccctggcttcctttgcctctgggtgggaggaaaccccccttccctgttttcccctcttggggccctgggaccacccgaccctggcctcccctcccgccctgggccttgcactcctggctgtagagggagggctagtgttgtggctccaagtttcctttctgctggatgatcttggggacccctgggggccaccttctctgcctgacttcctctgtccttgcccctccagcctgggcagcacccccgtctgttgagggtgcccccttcctctccccacagccccgcctccacatcctggaccctctgctatgattccaggcgggcctgtggccctccctggcaggaaactccttacaccaggggtggcccaggagcgcagggaacccgcaggctgatgccgacttttcagggaaagctcaggagtgcagggaacccgcaggctgacgcagacttttcagggaaagttgtcagtttgggtttttatgtgaaatccttcactttttggacattggcaatgtgttttgtttgtttaataaagcattattggggttgagcaaaactcatttgtgggctacgtggggcccaggtttgcttgcgaaggccccatggtgacctcactgtggcccctgacacctcatggcctccctcccctccacggaggccgcctccctgcctcagacctgaggaataaggtgcggcagcttctctccttgctgtgtctgcatgtcaggccccaggtcccaggcccacgctggccccacgctggccggggctcagcagaccttttctgcagagagccagagaggaaatactgttcatcttgcaggctgcgggcctcacagataccacgcagccacagtccacacggaaatgcgtgggcacacttgatgcagaaaggccggcagagcttgccagctcaggctggcatagctgagtcgtcccatacaaagaccggggtgaagtttgggatcgattttgtaaagcacctcagcccctttttgagtgatttctgagatctgtggatggagcatgaacagaagctccctgtgggcggggctgtggcagccttggtcccggggtagaaactatgatgggggttttgagtgcgttgccaggaccgcatgcccagggggcccacaccccggccccaggctgccccgcgtctcagtgggtggttgccatcccgcaccgccacagccctcgagggctgcccctgccttctccctcgcatacatccttggccttcgaaccttttcgaaaattaattctgtggaaatctcaagtgtgtggacgcagtgtgatgaatccctcttcctgcgccagcgattcgcggcactgctggtccctttctgcccactgtggttctctttccacagcgttttagagaaaatatccatcacatcattttgtctgtaaattctccaacatgtaaggactcctt

SEQ ID NO: 203833 - DNA, 386 bp, Homo sapiens
  Payload ID: 20201
  Gene Name: zinc finger protein 787
  ENST ID: ENST00000586787
  CDS Start-End: 268-386
aactggcggtggttgtagcccttgagggtccttgagtccttcctgcggctgtgtgaggccttggctggcccctgcagtggggagcggccaggctagctccaggccagttctcggtgtcctggggtaggtgctgtgtgccttgtctgccgggcgctgtgcctgtcacgccggggtctgcaggctgcctccctgcagggccctcggtgcagcctggcaccccataaactctgtccttctgtctcatccccttctaacagggacccagacatggagctgcgggaagaagcctggtctccggggccgctggattctgaggaccagcagatggccagtcacgagaacccagtggacatcctcatcatggatgatgacgacgtccccagctg

SEQ ID NO: 203834 - DNA, 1925 bp, Homo sapiens
  Payload ID: 20201
  Gene Name: zinc finger protein 787
  ENST ID: ENST00000610935
  CDS Start-End: 120-1268
gcccgtccccctgaccccagggtctgagtcgccgctgccgccgctgccaccatccgcgaggcaggagagaggaggaggagtgcggcgcggcggccccgggaccaaggagggacccagacatggagctgcgggaagaagcctggtctccggggccgctggattctgaggaccagcagatggccagtcacgagaacccagtggacatcctcatcatggatgatgacgacgtccccagctggcctcccaccaagctgtccccgccccagtctgcgcccccagccggcccgcctccccggccgcggccgcccgccccctacatctgcaacgagtgtggcaagagctttagccactggtccaagctgacgcggcaccagcgcacgcacaccggcgagcggcccaacgcctgcgccgactgcggcaagaccttctcgcagagctcgcacctggtgcagcaccggcgcatccacacgggcgagaagccctacgcctgcttggagtgcggcaagcgcttcagctggagctccaacctcatgcagcaccagcgcatccacacgggcgagaagccctacacctgccccgactgcggccgcagcttcactcagagcaagagcctggccaagcaccggcgctcgcacagcggcctcaagcccttcgtgtgcccgcgctgcggccgcggcttcagccagcccaagagcctcgcgcgtcacctgcggctgcacccggagctgtcggggcctggcgtggcggccaaggtgctggcggctagcgtccggcgggccaaggggcccgaagaggcggtggcggcggacggcgagatcgccatccccgtgggcgatggcgagggcatcatcgtggtgggcgcgccgggcgagggggccgcggccgcggcagccatggcgggcgcgggggcaaaggccgcggggccccggtcgcggcgcgccccggcccccaagccgtacgtgtgtctggagtgcgggaagggcttcgggcacggggccgggctcctggcgcaccagcgggcccagcacggggacgggctcggggcggcggggggcgaggagccggcccacatctgcgtggagtgcggggagggcttcgtgcagggcgccgcgctccggagacacaagaagatccacgcggtgggcgcgccctcggtctgcagcagctgcggacagagctactaccgcgcgggcggggaggaggaggacgacgacgacgaggccgcgggcgggcggtgccccgagtgccgcggtggggagggccggtaggggaggggcccgggggggggggcgggcagggcccctcgggcttggcgggagcgacgacgtgcaagaccaagagacccagggagaagcggacggggtgcgatggaccccgcggcatccccggctccccgccctcctctgtccctgcgccgtccgtgggggggcactggggcgtattagggcccgttcacttctccgcctcgagactctgccccctcagcctggcccgcccttcctaagttatcggcctgcgagccggagagacaatggagagaactgcagaggccgagtggcgaccaggccccaagcggaaggccattttccctgctcttcctcagttgtccggggcgggggtggggggtgctgcgaggaatggagaaaccaggccctttagaggatcccagagagggaagagaaccaggggcccttttctcttttagaattttcttttaatcagcccaccttttgactccccgcccgccccaatccattatttttttctgccttccgggtcccatccttagagctcgagtcgttccttcccctcctggattccgggtagcagaggcagcgccgcaggaggcgggtgcccgtttgtcccaggcctgggcgtggtggaggaaggggtgctggaacaataaacggcactatccaaatgtc

SEQ ID NO: 203835 - DNA, 1654 bp, Homo sapiens
  Payload ID: 20202
  Gene Name: zinc finger protein 789
  Uniprot ID: Q5FWF6
  ENST ID: ENST00000331410
  CDS Start-End: 271-1548
agaggggccgctggctgggacgcttcgctcggcgcgcgcaggtggagccagcgagaggctctgaggctgccagagtggttgtgtctgttcctccggtaaggggtgattcgccgaggggcgcggaccagacagacctcgggtcaggcccgggaaccccgagaggagagcccagcccctggtggaggcggcttggcggagattcggagccgtcagcagctcagccagacgtccaggatcccaccccttgcaaaagaccaggccgtggaagccatgttcccaccagccagggggaaggagctgctctcgtttgaggatgtggcgatgtacttcaccagagaggagtggggccacctcaactggggtcagaaggacctctaccgagatgtgatgttggagaactacaggaacatggtcttgctgggatttcagtttcccaaacctgagatgatctgtcagctggagaactgggacgagcagtggatcctggatctaccgagaactgggaataggaaggcttccggtagtgcttgcccaggttctgaagccagacacaagatgaaaaagctaactccaaaacagaaattttctgaagatttagagtcatataagatatcagtggtaatgcaggaatcagctgagaaactttcagaaaagttacataagtgtaaagaatttgtggacagttgcaggcttactttccctactagtggtgatgaatacagcaggggcttccttcaaaaccttaaccttattcaagatcagaatgcgcaaacaaggtggaagcagggcagatatgatgaggatggcaaacccttcaatcaaagatctttgcttttggggcatgagcgaattctcacaagagcaaagtcttatgaatgcagtgaatgtggaaaagtcattaggcgtaaggcatggtttgatcaacatcaaagaattcactttttagagaatccttttgagtgtaaggtctgtgggcaagccttcagacagcggtcagctcttacggtccataaacagtgtcacctgcaaaacaagccatacagatgtcatgactgtggaaagtgttttcggcagctcgcgtatcttgttgaacataagaggattcacaccaaagaaaaaccttataaatgtagcaaatgtgaaaaaacgtttagtcagaattcaacccttattcgacatcaggtgatccatagtggagaaaaacgccataaatgccttgagtgtggaaaagcctttggccggcattcaacccttctatgtcatcaacagattcacagtaaaccgaacacccataaatgcagtgaatgtggacagtcctttggtaggaatgtggatctcattcagcatcaaagaatccatacaaaggaggaattctttcaatgtggagaatgtgggaaaacgtttagttttaagaggaatctttttcgacatcaggtcattcacactggaagccaaccctaccaatgtgtcatatgtggaaaatctttcaagtggcacacaagctttattaagcaccagggcactcacaaaggacagatatccacatgatgttaattggaaagcagtcattggagaactagaacttataaacctctacttcaagtgtgtatcacgtaattgtttccatgaaaagcaataaatgtaacaaagggtt

SEQ ID NO: 203836 - DNA, 510 bp, Homo sapiens
  Payload ID: 20202
  Gene Name: zinc finger protein 789
  Uniprot ID: Q5FWF6
  ENST ID: ENST00000379724
  CDS Start-End: 200-388
agagtggttgtgtctgttcctccggtaaggggtgattcgccgaggggcgcggaccagacagacctcgggtcaggcccgggaaccccgagaggagagcccagcccctggtggaggcggcttggcggagattcggagccgtcagcagctcagccagacgtccaggatcccaccccttgcaaaagaccaggccgtggaagccatgttcccaccagccagggggaaggagctgctctcgtttgaggatgtggcgatgtacttcaccagagaggagtggggccacctcaactggggtcagaaggacctctaccgagatgtgatgttggagaactacaggaacatggtcttgctggtttatttccagtttgatgctgcaataccactgtgctgaacgtctctggcacattcatcttggttgcaattgtactttaggctatatttctaagagcgaaatgaccacagccaaaggtatgaacattgttcaggctttcaataaagactgccagatattta

SEQ ID NO: 203837 - DNA, 842 bp, Homo sapiens
  Payload ID: 20202
  Gene Name: zinc finger protein 789
  ENST ID: ENST00000447047
  CDS Start-End: 305-472
cagagtggttgtgtctgttcctccggtaaggggtgattcgccgaggggcgcggaccagacagacctcgggtcaggcccgggaaccccgagaggagagcccagcccctggtggaggcggcttggcggagattcggagccgtcagcagctcagccagacgtccaggatcccaccccttgcaaaagaccaggccgtggaagccatgttcccaccagccagggggaaggtgcgggaatgcagatggctgagtaggtcagattgaggacatggcagcgcagctctggtaaaagagtgacactctggataatggagctgctctcgtttgaggatgtggcgatgtacttcaccagagaggagtggggccacctcaactggggtcagaaggacctctaccgagatgtgatgttggagaactacaggaacatggtcttgctggtttatttccagtttgatgctgcaataccactgtgctgaacgtctctggcacattcatcttggttgcaattgtactttaggctatatttctaagagtgaaatgaccacagccaaaggatttcagtttcccaaacctgagatgatctgtcagctggagaactgggacgagcagtggatcctggatctaccgagaactgggaataggaaggcttccggtagtgcttgcccaggttctgaagccagacacaagatgaaaaagctaactccaaaacagaaattttctgaagatttagagtcatataagatatcagtggtaatgcaggaatcagctgagaaactttcagaaaagttacataagtgtaaagaatttgtggacagttgcaggcttactttccctactagtggtgat

SEQ ID NO: 203838 - DNA, 1055 bp, Homo sapiens
  Payload ID: 20202
  Gene Name: zinc finger protein 789
  ENST ID: ENST00000448667
  CDS Start-End: 326-682
agcgagaggctctgaggctgccagagtggttgtgtctgttcctccggtaaggggtgattcgccgaggggcgcggaccagacagacctcgggtcaggcccgggaaccccgagaggagagcccagcccctggtggaggcggcttggcggagattcggagccgtcagcagctcagccagacgtccaggatcccaccccttgcaaaagaccaggccgtggaagccatgttcccaccagccagggggaaggtgcgggaatgcagatggctgagtaggtcagattgaggacatggcagcgcagctctggtaaaagagtgacactctggataatggagctgctctcgtttgaggatgtggcgatgtacttcaccagagaggagtggggccacctcaactggggtcagaaggacctctaccgagatgtgatgttggagaactacaggaacatggtcttgctgggatttcagtttcccaaacctgagatgatctgtcagctggagaactgggacgagcagtggatcctggatctaccgagaactgggaataggaaggcttccggtagtgcttgcccagctgctcctgtttttcacatccaaggtttctcctccatggcactactgacgttttgggctgacgaattctttggggacaggatggggcatgtcctgtgcattttaggatgttgagtagcagccctggcctgcatccactagatgccagttgaacctccccaggttctgaagccagacacaagatgaaaaagctaactccaaaacagaaattttctgaagatttagagtcatataagatatcagtggtaatgcaggaatcagctgagaaactttcagaaaagttacataagtgtaaagaatttgtggacagttgcaggcttactttccctactagtggtgatgaatacagcaggggcttccttcaaaaccttaaccttattcaagatcagaatgcgcaaacaaggtggaagcagggcagatatgatgaggatggcaaacccttcaatcaaagatctttgcttttggggcatgagcgaattctcacaag

SEQ ID NO: 203839 - DNA, 2994 bp, Homo sapiens
  Payload ID: 20202
  Gene Name: zinc finger protein 789
  ENST ID: ENST00000483089
  CDS Start-End: 326-496
agcgagaggctctgaggctgccagagtggttgtgtctgttcctccggtaaggggtgattcgccgaggggcgcggaccagacagacctcgggtcaggcccgggaaccccgagaggagagcccagcccctggtggaggcggcttggcggagattcggagccgtcagcagctcagccagacgtccaggatcccaccccttgcaaaagaccaggccgtggaagccatgttcccaccagccagggggaaggtgcgggaatgcagatggctgagtaggtcagattgaggacatggcagcgcagctctggtaaaagagtgacactctggataatggagctgctctcgtttgaggatgtggcgatgtacttcaccagagaggagtggggccacctcaactggggtcagaaggacctctaccgagatgtgatgttggagaactacaggaacatggtcttgctgggtaggacacggcttgaagattgggctttgtctgtgttctgagtgtctgtgcaagcccttagtcccttatctgcaattccagaatcagaaaaagcggtgaaaaccgaaaggtttttttataactcgtgtggctacaagccctgaccagacatcaccacagtgaaacctgacttcatcctataggaaaccatttattgtctttatttttccaacttggtgtgcatatctgtatacccaacttcagaaataacagtgtaggccaggtgcggtggctcacacctgtaatcccagcactttgggattccgaggcgggtggatcacatgaggtcagtagtttgagaccagcctggccaatatggtgaaacccagctctacttaagatgcgaaaattagcctggtgtggtggtgcacgcttgtagtcccagttacttgggaggctgaggcaggagaatcgcttgaacccgggaggcagaggttgcattgagccgagatcatgccgctgcattccagcctgggtgacagagcgagactccgtctcaaaacaaaacaaaacaacaacaaaaataacagtgtatttgagggcaccactccaaaccctactggggatgatacgttatgtaaaatatttacaccaggtcacctttctgaaatgggaaaaattctgactcctgaaacacatctggtcctaagggtttcacataagggactggggacagtgaatagtcgtgttgtgttagggctcagaccgagacacttcatgcattcttcactctcacctcgtgttcctcatctgtaagacctccaggagttgagaattatggtagatttacattccaaaggctcacttcttatgctcttgaaagtctttttctttcttttctctggaaatgggtaacttcttggtgtgtaacattagtgggtgctcaggaaatgattttcaaccaacttcatttctgaaccttcactgcttccattcttttcaggagcctaccctgtcctagtccactgtagtctcccactgtgggagttgccttgctaaatagttttctttccggggtcacatgtttaacccttgcactgacactcttagcacagagtcttgaccacctctgtgggactgtccacccacctctggatttttataattttaattttccctttaaaagcattacaggagcatacataagtacatggaaggcatagaaaaggaggagaagaggaaagtgttcatgggtaacactgttaatattttggaaggtttcctgccagtctttttttcctatgcctttacaaaagtagctgagcatattctatgtgcaatcctgtaatctgttttaaatgtaacattattgtatcagcatttccccacataatcagtaaacgagcataatataattccattgtgtggtccataaaaatatttcattgttttcccatgtggggacattgagcttgcctttgtttgttcgttggtttgcttgtgtatttataatgtttgaatagatgtttgagtataaatctttgcatgaatttttgatcatttcccaagatactttcccaaaatcagaattttgaagttaaatgagatggcactttaatctttattgattactgaatgattcttcaacaaactttgtactgttttgcatatccaatagtaacattttagagtgcttctttttttttttgagacagagtttcgctcttgttgcccaggcaggagtacaatggcaggatctcagctcaccacaacctctgcctccccggttcaagtgattctcctgcctcagactcctgagtagctgggattacaggcatgtgccaccacacctagctaattttgtatttttagtagagacggggtttcgccatgttggtcaggctggtctcaaactcccgatctcgggtgacccgcccacctcagcctcccaaagtgctgggattacaggtgtgagccactgcacccagctgagagtgcttctttactatatcactgccttcttttatggattttactagttctaaaaataattttcattacagaaattttggaaaatacatcagtaaatagagtagataataaaaatcacctgcaggcctactttccagaagtaactcttgttattaacattttggtttactttttcccagtccgtctatgtgtctattacagggaaagaatcccttatccaaaatgctggggaccaaaagtgttttggatttcggatttttcttttttggattttggaatactcataaatatataataagataatttgaggatctgacaagaaattcacttatgtttcatatacaccttagacatgtagcttcttcaagctacgcttgatttaattgttcccttttgatattcagtttatttccagtttgatgctgcaataccactgtgctgaacgtctctggcacattcatcttggttgcaattgtactttaggctatatttctaagagcgaaatgaccacagccaaaggtatgaacattgttcaggctttcaataaagactgccagatatttacaaa

SEQ ID NO: 203840 - DNA, 556 bp, Homo sapiens
  Payload ID: 20202
  Gene Name: zinc finger protein 789
  ENST ID: ENST00000493485
  CDS Start-End: 323-493
gagaggctctgaggctgccagagtggttgtgtctgttcctccggtaaggggtgattcgccgaggggcgcggaccagacagacctcgggtcaggcccgggaaccccgagaggagagcccagcccctggtggaggcggcttggcggagattcggagccgtcagcagctcagccagacgtccaggatcccaccccttgcaaaagaccaggccgtggaagccatgttcccaccagccagggggaaggtgcgggaatgcagatggctgagtaggtcagattgaggacatggcagcgcagctctggtaaaagagtgacactctggataatggagctgctctcgtttgaggatgtggcgatgtacttcaccagagaggagtggggccacctcaactggggtcagaaggacctctaccgagatgtgatgttggagaactacaggaacatggtcttgctggatgctgcaatttcacagcagttccttccttcgcgcctgtaaaacagtggcaacagtaactcttctcctgcctgcccatcaactttgtaaactgcgcggggcgta

SEQ ID NO: 203841 - DNA, 2078 bp, Homo sapiens
  Payload ID: 20203
  Gene Name: zinc finger protein 79
  Uniprot ID: Q15937
  ENST ID: ENST00000342483
  CDS Start-End: 407-1903
aatcaggcgcgtccctctggcgctggagccaggacctggcgttgggcggtacttggacagcggttcttgagctctcgcggttgccggtagattgttgccagttgccagttgccagtcgtttttcggaaagctggcagcggctttttcaccgggttctgcttgaggccgagccaaagagtggctgtgactcgggagacggagtggaacacccggctgggcaggcccggacagctcccgcgacccagcaccgcaggatcagaccgtgcctctgcggggagaggctggagaggaagagtccggcctgggagccgtcagagcagccctgcagaacggggtgggggctgctgtagatagacccttacgcccagagaactgctgggaggctgtggcgcgaggcgggactcaaatgctggaggaaggagtactgccttccccaggccctgcccttccccaagaggaaaacacaggagaggaaggaatggctgctggtctcctcacagctgggccccggggatccacattcttcagcagtgtgacggtagcttttgcacaggaaaggtggaggtgcctcgtgtctactccacgggacaggttcaaggaggggataccaggaaagtccaggagccttgtcctactaggacttccagtttcccagcctggcatgaactcccagttggaacaaagggaaggcgcatggatgctggagggcgaagacctgcgaagtccctctccaggctggaagattatatctggatcaccaccagagcaagccctttctgaagcttcattccaagacccatgtgtagagatgccccctggggattcagaccacgggaccagtgaccttgagaagagcttcaatctgagaccagtcctctctccgcaacagagagtgcccgtggaagcgagacctcgcaaatgtgagacacacaccgagagcttcaagaactcggaaatcctgaaacctcacagagcaaaaccatatgcatgtaatgaatgtggcaaagccttcagttactgttcttccctttctcagcatcagaagagccacactggagagaagccctatgagtgcagtgaatgtgggaaggccttcagccagagctcatctctcattcagcaccagaggattcacactggagagaagccttacaagtgcagtgaatgtggaagagccttcagccagaacgccaacctcaccaaacaccagcgaacccacaccggagagaagccctacagatgcagcgagtgtgagaaagccttcagtgactgctcagctcttgttcagcatcagagaattcataccggagagaagccctacgaatgcagcgactgtgggaaggccttccgtcacagtgcaaacctcacgaaccatcagaggactcacaccggggagaagccctacaagtgcagcgagtgtgggaaggccttcagttactgcgcagcgttcattcagcaccagaggattcacaccggggagaagccctacagatgtgccgcgtgtgggaaggccttcagccagagtgcaaacctcacaaaccatcagaggactcacactggggagaaaccctacaagtgcagcgagtgtgggaaggccttcagccagagtaccaatctcataatccaccaaaagacccacaccggggagaagccatataaatgtaatgaatgtgggaaattcttcagtgagagctcagccctcattcggcatcatataatccacaccggagaaaaaccttatgagtgtaatgagtgtggtaaagcgtttaaccagagctcatcccttagtcagcatcagagaatccacacaggcgtgaaaccctacgaatgcagcgagtgtgggaaggccttccggtgcagctctgccttcgttagacatcagagactccacgccggagagtaactaggaacatggtagaagtggagagagtcccggacatgccgactcaggacaggtgggtgaggatctgagaaatgctaaaggcttgaaagcatctgaagacatctaacttagagtctgcagcccagagccacatgcaaaacaccttcaataaacagccactatttcacatgctgta

SEQ ID NO: 203842 - DNA, 2194 bp, Homo sapiens
  Payload ID: 20203
  Gene Name: zinc finger protein 79
  ENST ID: ENST00000543471
  CDS Start-End: 596-2020
gtggcgccaatcaggcgcgtccctctggcgctggagccaggacctggcgttgggcggtacttggacagcggttcttgagctctcgcggttgccggtagattgttgccagttgccagttgccagtcgtttttcggaaagctggcagcggctttttcaccgggttctgcttgaggccgagccaaagagtggctgtgactcgggagacggagtggaacacccggctgggcaggcccggacagctcccgcgacccagcaccgcaggatcagaccgtgcctctgcggggagaggctggagaggaagagtccggcctgggagccgtcagagcagccctgcagaacggggtgggggctgctgtagatagacccttacgcccagagaactgctgggaggctgtggcgcgaggcgggactcaaatgctggaggaaggagatgagaaaaatgagacttagagaggttacgtgatttgcacactgctgctgagtggtggatcatggatacttgagagtctgtgaacactctaatgcctccctacatctgatactgccttccccaggccctgcccttccccaagaggaaaacacaggagaggaaggaatggctgctggtctcctcacagctgggccccggggatccacattcttcagcagtgtgacggtagcttttgcacaggaaaggtggaggtgcctcgtgtctactccacgggacaggttcaaggaggggataccaggaaagtccaggagccttgtcctactaggacttccagtttcccagcctggcatgaactcccagttggaacaaagggaaggcgcatggatgctggagggcgaagacctgcgaagtccctctccaggctggaagattatatctggatcaccaccagagcaagccctttctgaagcttcattccaagacccatgtgtagagatgccccctggggattcagaccacgggaccagtgaccttgagaagagcttcaatctgagaccagtcctctctccgcaacagagagtgcccgtggaagcgagacctcgcaaatgtgagacacacaccgagagcttcaagaactcggaaatcctgaaacctcacagagcaaaaccatatgcatgtaatgaatgtggcaaagccttcagttactgttcttccctttctcagcatcagaagagccacactggagagaagccctatgagtgcagtgaatgtgggaaggccttcagccagagctcatctctcattcagcaccagaggattcacactggagagaagccttacaagtgcagtgaatgtggaagagccttcagccagaacgccaacctcaccaaacaccagcgaacccacaccggagagaagccctacagatgcagcgagtgtgagaaagccttcagtgactgctcagctcttgttcagcatcagagaattcataccggagagaagccctacgaatgcagcgactgtgggaaggccttccgtcacagtgcaaacctcacgaaccatcagaggactcacaccggggagaagccctacaagtgcagcgagtgtgggaaggccttcagttactgcgcagcgttcattcagcaccagaggattcacaccggggagaagccctacagatgtgccgcgtgtgggaaggccttcagccagagtgcaaacctcacaaaccatcagaggactcacactggggagaaaccctacaagtgcagcgagtgtgggaaggccttcagccagagtaccaatctcataatccaccaaaagacccacaccggggagaagccatataaatgtaatgaatgtgggaaattcttcagtgagagctcagccctcattcggcatcatataatccacaccggagaaaaaccttatgagtgtaatgagtgtggtaaagcgtttaaccagagctcatcccttagtcagcatcagagaatccacacaggcgtgaaaccctacgaatgcagcgagtgtgggaaggccttccggtgcagctctgccttcgttagacatcagagactccacgccggagagtaactaggaacatggtagaagtggagagagtcccggacatgccgactcaggacaggtgggtgaggatctgagaaatgctaaaggcttgaaagcatctgaagacatctaacttagagtctgcagcccagagccacatgcaaaacaccttcaataaacagccactatttcacatgctgt

SEQ ID NO: 203843 - DNA, 2192 bp, Homo sapiens
  Payload ID: 20203
  Gene Name: zinc finger protein 79
  ENST ID: ENST00000612342
  CDS Start-End: 594-2018
gtggcgccaatcaggcgcgtccctctggcgctggagccaggacctggcgttgggcggtacttggacagcggttcttgagctctcgcggttgccggtagattgttgccagttgccagttgccagtcgtttttcggaaagctggcagcggctttttcaccgggttctgcttgaggccgagccaaagagtggctgtgactcgggagacggagtggaacacccggctgggcaggcccggacagctcccgcgacccagcaccgcaggatcagaccgtgcctctgcggggagaggctggagaggaagagtccggcctgggagccgtcagagcagccctgcagaacggggtgggggctgctgtagatagacccttacgcccagagaactgctgggaggctgtggcgcgaggcgggactcaaatgctggaggaaggaggtgaggagtggtagagggagcgattgtcaagagatcggctgctgcttcgtttgcccacgactgccgctgtgtgagccgaatcagaactctctttatctctcctacagtactgccttccccaggccctgcccttccccaagaggaaaacacaggagaggaaggaatggctgctggtctcctcacagctgggccccggggatccacattcttcagcagtgtgacggtagcttttgcacaggaaaggtggaggtgcctcgtgtctactccacgggacaggttcaaggaggggataccaggaaagtccaggagccttgtcctactaggacttccagtttcccagcctggcatgaactcccagttggaacaaagggaaggcgcatggatgctggagggcgaagacctgcgaagtccctctccaggctggaagattatatctggatcaccaccagagcaagccctttctgaagcttcattccaagacccatgtgtagagatgccccctggggattcagaccacgggaccagtgaccttgagaagagcttcaatctgagaccagtcctctctccgcaacagagagtgcccgtggaagcgagacctcgcaaatgtgagacacacaccgagagcttcaagaactcggaaatcctgaaacctcacagagcaaaaccatatgcatgtaatgaatgtggcaaagccttcagttactgttcttccctttctcagcatcagaagagccacactggagagaagccctatgagtgcagtgaatgtgggaaggccttcagccagagctcatctctcattcagcaccagaggattcacactggagagaagccttacaagtgcagtgaatgtggaagagccttcagccagaacgccaacctcaccaaacaccagcgaacccacaccggagagaagccctacagatgcagcgagtgtgagaaagccttcagtgactgctcagctcttgttcagcatcagagaattcataccggagagaagccctacgaatgcagcgactgtgggaaggccttccgtcacagtgcaaacctcacgaaccatcagaggactcacaccggggagaagccctacaagtgcagcgagtgtgggaaggccttcagttactgcgcagcgttcattcagcaccagaggattcacaccggggagaagccctacagatgtgccgcgtgtgggaaggccttcagccagagtgcaaacctcacaaaccatcagaggactcacactggggagaaaccctacaagtgcagcgagtgtgggaaggccttcagccagagtaccaatctcataatccaccaaaagacccacaccggggagaagccatataaatgtaatgaatgtgggaaattcttcagtgagagctcagccctcattcggcatcatataatccacaccggagaaaaaccttatgagtgtaatgagtgtggtaaagcgtttaaccagagctcatcccttagtcagcatcagagaatccacacaggcgtgaaaccctacgaatgcagcgagtgtgggaaggccttccggtgcagctctgccttcgttagacatcagagactccacgccggagagtaactaggaacatggtagaagtggagagagtcccggacatgccgactcaggacaggtgggtgaggatctgagaaatgctaaaggcttgaaagcatctgaagacatctaacttagagtctgcagcccagagccacatgcaaaacaccttcaataaacagccactatttcacatgctgt

SEQ ID NO: 203844 - DNA, 1969 bp, Homo sapiens
  Payload ID: 20203
  Gene Name: zinc finger protein 79
  ENST ID: ENST00000617266
  CDS Start-End: 701-1795
gtggcgccaatcaggcgcgtccctctggcgctggagccaggacctggcgttgggcggtacttggacagcggttcttgagctctcgcggttgccggtagattgttgccagttgccagttgccagtcgtttttcggaaagctggcagcggctttttcaccgggttctgcttgaggccgagccaaagagtggctgtgactcgggagacggagtggaacacccggctgggcaggcccggacagctcccgcgacccagcaccgcaggatcagaccgtgcctctgcggggagaggctggagaggaagagtccggcctgggagccgtcagagcagccctgcagaacggggtgggggctgctgtagatagacccttacgcccagagaactgctgggaggctgtggcgcgaggcgggactcaaatgctggaggaaggaggtgaggagtggtagagggagcgattgtcaagagatcggctgctgcttcgtttgcccacgactgccgctgtgtgagccgaatcagaactctctttatctctcctacagtactgccttccccaggccctgcccttccccaagaggaaaacacaggagaggaaggaatggctgctggtctcctcacagctgggccccgggctggaagattatatctggatcaccaccagagcaagccctttctgaagcttcattccaagacccatgtgtagagatgccccctggggattcagaccacgggaccagtgaccttgagaagagcttcaatctgagaccagtcctctctccgcaacagagagtgcccgtggaagcgagacctcgcaaatgtgagacacacaccgagagcttcaagaactcggaaatcctgaaacctcacagagcaaaaccatatgcatgtaatgaatgtggcaaagccttcagttactgttcttccctttctcagcatcagaagagccacactggagagaagccctatgagtgcagtgaatgtgggaaggccttcagccagagctcatctctcattcagcaccagaggattcacactggagagaagccttacaagtgcagtgaatgtggaagagccttcagccagaacgccaacctcaccaaacaccagcgaacccacaccggagagaagccctacagatgcagcgagtgtgagaaagccttcagtgactgctcagctcttgttcagcatcagagaattcataccggagagaagccctacgaatgcagcgactgtgggaaggccttccgtcacagtgcaaacctcacgaaccatcagaggactcacaccggggagaagccctacaagtgcagcgagtgtgggaaggccttcagttactgcgcagcgttcattcagcaccagaggattcacaccggggagaagccctacagatgtgccgcgtgtgggaaggccttcagccagagtgcaaacctcacaaaccatcagaggactcacactggggagaaaccctacaagtgcagcgagtgtgggaaggccttcagccagagtaccaatctcataatccaccaaaagacccacaccggggagaagccatataaatgtaatgaatgtgggaaattcttcagtgagagctcagccctcattcggcatcatataatccacaccggagaaaaaccttatgagtgtaatgagtgtggtaaagcgtttaaccagagctcatcccttagtcagcatcagagaatccacacaggcgtgaaaccctacgaatgcagcgagtgtgggaaggccttccggtgcagctctgccttcgttagacatcagagactccacgccggagagtaactaggaacatggtagaagtggagagagtcccggacatgccgactcaggacaggtgggtgaggatctgagaaatgctaaaggcttgaaagcatctgaagacatctaacttagagtctgcagcccagagccacatgcaaaacaccttcaataaacagccactatttcacatgctgt

SEQ ID NO: 203845 - DNA, 3037 bp, Homo sapiens
  Payload ID: 20204
  Gene Name: zinc finger protein 790
  Uniprot ID: Q6PG37
  ENST ID: ENST00000356725
  CDS Start-End: 122-2032
aatagaaagatcgcggaaccttccaccatcaagggaccgcagggccggctctgctttcccagcacgctgcctcaccaagaaagaatccagagaaggactggtggacttggaatgttaagtcatggcccatttgatgatgttcagggatgtggctgtagatttctctcaggaggagtgggagtgcctggacctggaacagagggatttatatagagatgtgatgttggagaactacagcaacatggtctcactgggtttttgcatttatcagccagaagcgttctctttattggagaaagggaaagagccctggaagattttgagggatgagacaagaggaccttgcccagacatgcagtcgaggtgtcagaccaagaagttattaccaaaaaatggcatttttgagagagaaatagcccaattggaaataatgagaatttgtaaaaaccacagccttgactgtttatgttttagaggtgactgggaaggcaacactcagtttcaaacacttcaagataatcaagaggaatgcttcaagcaggtgatacgcacctgtgaaaaaaggcccacttttaaccagcatacagtgtttaatctacaccagagacttaatacaggagacaaactgaatgaatttaaagaactggggaaagcctttatttctggttcagatcatactcaacatcagttaattcacacaagtgagaaattctgtggagataaagaatgtgggaatacctttcttcctgattcagaagttattcaatatcagacagttcacactgttaagaaaacatatgaatgtaaagaatgtgggaagtcttttagtttacgttcgagtcttactggtcataagagaattcataccggtgagaaaccttttaaatgtaaggattgtgggaaagcctttagatttcattcacaacttagtgtccataagcgaattcatactggtgagaaatcttatgaatgtaaggaatgtgggaaggcctttagttgtggctcagatcttactcgacatcagagaattcatactggtgaaaaaccctatgaatgtaatgaatgtagaaaggcctttagtcagcgatcacatcttattaaacatcagagaattcacactggtgaaaaaccttatgaatgtaaggagtgtgggaaagcttttactcgtggatcacacctaactcagcatcagagaattcatactggtgagaaatctcatgagtgtaaggaatgtggaaaagcctttattcgtggttcaaatcttgctcaacatcagaatgttcatgttggtaggaaaccttataaatgtgagaaatgtgggaaagcctatatttggagctcacaccttgctcgacatcagcgaattcatactggcaggaaaccttatgaatgtaagcaatgcgggaagacttttacttgggcttcgtatcttgctcaacatgagaaaattcacaatgagaggaaatcctatgaatgtaaggaatgtggaaagacctttcttcatggctcagagtttaatcgacatcagaaaattcatactggtgagagaaactatgaatgtaaggaatgtggaaagaccttttttcgtggttcagaacttaatcgacaccagaaaattcatactggaaagaggccatatgaatgtgaagaatgtggaaaagcctttctctggggttcacaacttactcgacatcagagaatgcatactggtgaggaaccttacgtatgtaaagaatgtgggaaatcttttatctggggttcacagcttacacgacataagaaaattcatactgatgcagaaccttatggatgcaagaaaagtagccacatctttagtcaccattcatattttactgaacaaaaaattcataatagtgcaaatctctgtgaatggacagactatgggaacacctttagtcatgagtcaaactttgctcaacaccagaatatttacacttttgagaaatcctatgaatttaaagattttgagaaagcattttcttcaagctctcacttcatttcactcttgtgaaatattatataaaagtgtaggaagggctttattcatgactcattaattgatgtcatttatttttttctcttgaggaacaccacaaatgtaagtaatattggaaggcattttaacagagcacacatccagcagcagcagcagcagcagcagcagagaattcatcatgcaatcaatataggaaagaaattactgatcagttatcaattgcagaatatcagggtaaaattttatgagatagcatgaattctttttgaatcattctcaaaacattctcatcagagatgttgcataaagaatttatatataatttggccaagcatggtggctcacacctgttatcctagcactttgggaaacagaggtgggtggatcacctgaggtcaggggttcgagaccagcctgaccaacatggtgaaaccctgtctctactaaatatacaaaaattagccgggcgtggtagcacacgcctgtagtcccagctactcgggaggccgaggcatgagaattccttgaacctgggaggtggaggttgcagtgagccaagatcacatcactgcactccagcctgggtgatagaacaagactccatctcaaaaacaaaaacccacaagaatttatatataattcattttggaaatctttcatcattagcaaaattctgttgtatttccacaaaaatcatgtaattaatctagaaaagccttgaactatgtcatacaatttatttggcatgtcttgtttcaatacatcctgcctctattttttttttttggaaagtatcttaaatctatgtctgtttaatcgtattcattagattataagggttgaatgatttgagatttacatgacttagtgactgtcatttgtattggtattaagccattttatgagaggaggacttttaagactataatgattatagacaaatatgtcatctctatttatgtcttactgaacatcagaatgttaattctgaaaaaaaatcagtaaaatacaatgaagaaa

SEQ ID NO: 203846 - DNA, 538 bp, Homo sapiens
  Payload ID: 20204
  Gene Name: zinc finger protein 790
  ENST ID: ENST00000525288
  CDS Start-End: 132-538
acacgacgttgacaggcgctgtgtgtgaccctaatggactatttaaatgtgactgtatctctgctttcccagcacgctgcctcaccaagaaagaatccagagaaggactggtggacttggaatgttaagtcatggcccatttgatgatgttcagggatgtggctgtagatttctctcaggaggagtgggagtgcctggacctggaacagagggatttatatagagatgtgatgttggagaactacagcaacatggtctcactgggtttttgcatttatcagccagaagcgttctctttattggagaaagggaaagagccctggaagattttgagggatgagacaagaggaccttgcccagacatgcagtcgaggtgtcagaccaagaagttattaccaaaaaatggcatttttgagagagaaatagcccaattggaaataatgagaatttgtaaaaaccacagccttgactgtttatgttttagaggtgactgggaaggcaacactcagtttcaaacacttcaagataatcaagagga

SEQ ID NO: 203847 - DNA, 578 bp, Homo sapiens
  Payload ID: 20204
  Gene Name: zinc finger protein 790
  ENST ID: ENST00000527645
  CDS Start-End: 430-578
atgactgcgtcgcgttgtgcgtgaccacgttcgtaaaggtggtgatagcagccgctatggggccaaaaacaaagaattgagctttgcgttgagtgacaggcatagtccttcgtgaatgtgtggggagcagtttttgtgctggcccgtagctggattggagtgggggcaacctagaaggaggggagaagaatgggacacagtgtagacaacatagttcaagagtttctccgtaaattagagcagagaaatggagcagcaggttggggtagagggctggggaagacggctggggaacaaccacccatcaacatgttgttggaaatgagccacgagaggggggaaaagtccaggcaaggctctgctttcccagcacgctgcctcaccaagaaagaatccagagaaggactggtggacttggaatgttaagtcatggcccatttgatgatgttcagggatgtggctgtagatttctctcaggaggagtgggagtgcctggacctggaacagagggatttatatagagatgtgatgttggagaactacagcaacatggtctcactgggtttttgcatttatca

SEQ ID NO: 203848 - DNA, 922 bp, Homo sapiens
  Payload ID: 20204
  Gene Name: zinc finger protein 790
  ENST ID: ENST00000528994
  CDS Start-End: 386-922
gacatactggaccgcagggtctcctgggaaacgtagtccaagcctcgccggggatagatgggcccaactaaagtgtgctgcgttctctgggtcctgaggcggcagtctggccgcagtgaccagactaactgtgccccggaggctgcttggaattccacttaacgctggaagcacgcagacgctcttgaggcgggcagctgcgtagcgtgtggaggagccgggagagcgcaccccaatgtggcacctgagcgtctgggaccgaaccagcatggggagtcggaaggggacaaatccgcgatcccagtcatgcatctctgctttcccagcacgctgcctcaccaagaaagaatccagagaaggactggtggacttggaatgttaagtcatggcccatttgatgatgttcagggatgtggctgtagatttctctcaggaggagtgggagtgcctggacctggaacagagggatttatatagagatgtgatgttggagaactacagcaacatggtctcactgggtttttgcatttatcagccagaagcgttctctttattggagaaagggaaagagccctggaagattttgagggatgagacaagaggaccttgcccagacatgcagtcgaggtgtcagaccaagaagttattaccaaaaaatggcatttttgagagagaaatagcccaattggaaataatgagaatttgtaaaaaccacagccttgactgtttatgttttagaggtgactgggaaggcaacactcagtttcaaacacttcaagataatcaagaggaatgcttcaagcaggtgatacgcacctgtgaaaaaaggcccacttttaaccagcatacagtgtttaatctacaccagagacttaatacaggagacaaactgaatgaatttaaagaactggggaaagccttt

SEQ ID NO: 203849 - DNA, 581 bp, Homo sapiens
  Payload ID: 20204
  Gene Name: zinc finger protein 790
  ENST ID: ENST00000586323
  CDS Start-End: 162-581
agaaagcgacaggttgccgaaagctacagcccagccatcccgattcccctggcgcggactctggcaccaacaaaactatctctttgagctctgctttcccagcacgctgcctcaccaagaaagaatccagagaaggactggtggacttggaatgttaagtcatggcccatttgatgatgttcagggatgtggctgtagatttctctcaggaggagtgggagtgcctggacctggaacagagggatttatatagagatgtgatgttggagaactacagcaacatggtctcactgggtttttgcatttatcagccagaagcgttctctttattggagaaagggaaagagccctggaagattttgagggatgagacaagaggaccttgcccagacatgcagtcgaggtgtcagaccaagaagttattaccaaaaaatggcatttttgagagagaaatagcccaattggaaataatgagaatttgtaaaaaccacagccttgactgtttatgttttagaggtgactgggaaggcaacactcagtttcaaacacttcaagataatcaagaggaatgcttcaagcag

SEQ ID NO: 203850 - DNA, 2451 bp, Homo sapiens
  Payload ID: 20204
  Gene Name: zinc finger protein 790
  Uniprot ID: Q6PG37
  ENST ID: ENST00000615484
  CDS Start-End: 430-2340
atgactgcgtcgcgttgtgcgtgaccacgttcgtaaaggtggtgatagcagccgctatggggccaaaaacaaagaattgagctttgcgttgagtgacaggcatagtccttcgtgaatgtgtggggagcagtttttgtgctggcccgtagctggattggagtgggggcaacctagaaggaggggagaagaatgggacacagtgtagacaacatagttcaagagtttctccgtaaattagagcagagaaatggagcagcaggttggggtagagggctggggaagacggctggggaacaaccacccatcaacatgttgttggaaatgagccacgagaggggggaaaagtccaggcaaggctctgctttcccagcacgctgcctcaccaagaaagaatccagagaaggactggtggacttggaatgttaagtcatggcccatttgatgatgttcagggatgtggctgtagatttctctcaggaggagtgggagtgcctggacctggaacagagggatttatatagagatgtgatgttggagaactacagcaacatggtctcactgggtttttgcatttatcagccagaagcgttctctttattggagaaagggaaagagccctggaagattttgagggatgagacaagaggaccttgcccagacatgcagtcgaggtgtcagaccaagaagttattaccaaaaaatggcatttttgagagagaaatagcccaattggaaataatgagaatttgtaaaaaccacagccttgactgtttatgttttagaggtgactgggaaggcaacactcagtttcaaacacttcaagataatcaagaggaatgcttcaagcaggtgatacgcacctgtgaaaaaaggcccacttttaaccagcatacagtgtttaatctacaccagagacttaatacaggagacaaactgaatgaatttaaagaactggggaaagcctttatttctggttcagatcatactcaacatcagttaattcacacaagtgagaaattctgtggagataaagaatgtgggaatacctttcttcctgattcagaagttattcaatatcagacagttcacactgttaagaaaacatatgaatgtaaagaatgtgggaagtcttttagtttacgttcgagtcttactggtcataagagaattcataccggtgagaaaccttttaaatgtaaggattgtgggaaagcctttagatttcattcacaacttagtgtccataagcgaattcatactggtgagaaatcttatgaatgtaaggaatgtgggaaggcctttagttgtggctcagatcttactcgacatcagagaattcatactggtgaaaaaccctatgaatgtaatgaatgtagaaaggcctttagtcagcgatcacatcttattaaacatcagagaattcacactggtgaaaaaccttatgaatgtaaggagtgtgggaaagcttttactcgtggatcacacctaactcagcatcagagaattcatactggtgagaaatctcatgagtgtaaggaatgtggaaaagcctttattcgtggttcaaatcttgctcaacatcagaatgttcatgttggtaggaaaccttataaatgtgagaaatgtgggaaagcctatatttggagctcacaccttgctcgacatcagcgaattcatactggcaggaaaccttatgaatgtaagcaatgcgggaagacttttacttgggcttcgtatcttgctcaacatgagaaaattcacaatgagaggaaatcctatgaatgtaaggaatgtggaaagacctttcttcatggctcagagtttaatcgacatcagaaaattcatactggtgagagaaactatgaatgtaaggaatgtggaaagaccttttttcgtggttcagaacttaatcgacaccagaaaattcatactggaaagaggccatatgaatgtgaagaatgtggaaaagcctttctctggggttcacaacttactcgacatcagagaatgcatactggtgaggaaccttacgtatgtaaagaatgtgggaaatcttttatctggggttcacagcttacacgacataagaaaattcatactgatgcagaaccttatggatgcaagaaaagtagccacatctttagtcaccattcatattttactgaacaaaaaattcataatagtgcaaatctctgtgaatggacagactatgggaacacctttagtcatgagtcaaactttgctcaacaccagaatatttacacttttgagaaatcctatgaatttaaagattttgagaaagcattttcttcaagctctcacttcatttcactcttgtgaaatattatataaaagtgtaggaagggctttattcatgactcattaattgatgtcatttatttttttctcttgaggaacaccacaaatgtaagtaatattggaaggcatttt

SEQ ID NO: 203851 - DNA, 2183 bp, Homo sapiens
  Payload ID: 20204
  Gene Name: zinc finger protein 790
  Uniprot ID: Q6PG37
  ENST ID: ENST00000613249
  CDS Start-End: 162-2072
agaaagcgacaggttgccgaaagctacagcccagccatcccgattcccctggcgcggactctggcaccaacaaaactatctctttgagctctgctttcccagcacgctgcctcaccaagaaagaatccagagaaggactggtggacttggaatgttaagtcatggcccatttgatgatgttcagggatgtggctgtagatttctctcaggaggagtgggagtgcctggacctggaacagagggatttatatagagatgtgatgttggagaactacagcaacatggtctcactgggtttttgcatttatcagccagaagcgttctctttattggagaaagggaaagagccctggaagattttgagggatgagacaagaggaccttgcccagacatgcagtcgaggtgtcagaccaagaagttattaccaaaaaatggcatttttgagagagaaatagcccaattggaaataatgagaatttgtaaaaaccacagccttgactgtttatgttttagaggtgactgggaaggcaacactcagtttcaaacacttcaagataatcaagaggaatgcttcaagcaggtgatacgcacctgtgaaaaaaggcccacttttaaccagcatacagtgtttaatctacaccagagacttaatacaggagacaaactgaatgaatttaaagaactggggaaagcctttatttctggttcagatcatactcaacatcagttaattcacacaagtgagaaattctgtggagataaagaatgtgggaatacctttcttcctgattcagaagttattcaatatcagacagttcacactgttaagaaaacatatgaatgtaaagaatgtgggaagtcttttagtttacgttcgagtcttactggtcataagagaattcataccggtgagaaaccttttaaatgtaaggattgtgggaaagcctttagatttcattcacaacttagtgtccataagcgaattcatactggtgagaaatcttatgaatgtaaggaatgtgggaaggcctttagttgtggctcagatcttactcgacatcagagaattcatactggtgaaaaaccctatgaatgtaatgaatgtagaaaggcctttagtcagcgatcacatcttattaaacatcagagaattcacactggtgaaaaaccttatgaatgtaaggagtgtgggaaagcttttactcgtggatcacacctaactcagcatcagagaattcatactggtgagaaatctcatgagtgtaaggaatgtggaaaagcctttattcgtggttcaaatcttgctcaacatcagaatgttcatgttggtaggaaaccttataaatgtgagaaatgtgggaaagcctatatttggagctcacaccttgctcgacatcagcgaattcatactggcaggaaaccttatgaatgtaagcaatgcgggaagacttttacttgggcttcgtatcttgctcaacatgagaaaattcacaatgagaggaaatcctatgaatgtaaggaatgtggaaagacctttcttcatggctcagagtttaatcgacatcagaaaattcatactggtgagagaaactatgaatgtaaggaatgtggaaagaccttttttcgtggttcagaacttaatcgacaccagaaaattcatactggaaagaggccatatgaatgtgaagaatgtggaaaagcctttctctggggttcacaacttactcgacatcagagaatgcatactggtgaggaaccttacgtatgtaaagaatgtgggaaatcttttatctggggttcacagcttacacgacataagaaaattcatactgatgcagaaccttatggatgcaagaaaagtagccacatctttagtcaccattcatattttactgaacaaaaaattcataatagtgcaaatctctgtgaatggacagactatgggaacacctttagtcatgagtcaaactttgctcaacaccagaatatttacacttttgagaaatcctatgaatttaaagattttgagaaagcattttcttcaagctctcacttcatttcactcttgtgaaatattatataaaagtgtaggaagggctttattcatgactcattaattgatgtcatttatttttttctcttgaggaacaccacaaatgtaagtaatattggaaggcatttt

SEQ ID NO: 203852 - DNA, 2361 bp, Homo sapiens
  Payload ID: 20204
  Gene Name: zinc finger protein 790
  Uniprot ID: Q6PG37
  ENST ID: ENST00000614179
  CDS Start-End: 340-2250
gccggggatagatgggcccaactaaagtgtgctgcgttctctgggtcctgaggcggcagtctggccgcagtgaccagactaactgtgccccggaggctgcttggaattccacttaacgctggaagcacgcagacgctcttgaggcgggcagctgcgtagcgtgtggaggagccgggagagcgcaccccaatgtggcacctgagcgtctgggaccgaaccagcatggggagtcggaaggggacaaatccgcgatcccagtcatgcatctctgctttcccagcacgctgcctcaccaagaaagaatccagagaaggactggtggacttggaatgttaagtcatggcccatttgatgatgttcagggatgtggctgtagatttctctcaggaggagtgggagtgcctggacctggaacagagggatttatatagagatgtgatgttggagaactacagcaacatggtctcactgggtttttgcatttatcagccagaagcgttctctttattggagaaagggaaagagccctggaagattttgagggatgagacaagaggaccttgcccagacatgcagtcgaggtgtcagaccaagaagttattaccaaaaaatggcatttttgagagagaaatagcccaattggaaataatgagaatttgtaaaaaccacagccttgactgtttatgttttagaggtgactgggaaggcaacactcagtttcaaacacttcaagataatcaagaggaatgcttcaagcaggtgatacgcacctgtgaaaaaaggcccacttttaaccagcatacagtgtttaatctacaccagagacttaatacaggagacaaactgaatgaatttaaagaactggggaaagcctttatttctggttcagatcatactcaacatcagttaattcacacaagtgagaaattctgtggagataaagaatgtgggaatacctttcttcctgattcagaagttattcaatatcagacagttcacactgttaagaaaacatatgaatgtaaagaatgtgggaagtcttttagtttacgttcgagtcttactggtcataagagaattcataccggtgagaaaccttttaaatgtaaggattgtgggaaagcctttagatttcattcacaacttagtgtccataagcgaattcatactggtgagaaatcttatgaatgtaaggaatgtgggaaggcctttagttgtggctcagatcttactcgacatcagagaattcatactggtgaaaaaccctatgaatgtaatgaatgtagaaaggcctttagtcagcgatcacatcttattaaacatcagagaattcacactggtgaaaaaccttatgaatgtaaggagtgtgggaaagcttttactcgtggatcacacctaactcagcatcagagaattcatactggtgagaaatctcatgagtgtaaggaatgtggaaaagcctttattcgtggttcaaatcttgctcaacatcagaatgttcatgttggtaggaaaccttataaatgtgagaaatgtgggaaagcctatatttggagctcacaccttgctcgacatcagcgaattcatactggcaggaaaccttatgaatgtaagcaatgcgggaagacttttacttgggcttcgtatcttgctcaacatgagaaaattcacaatgagaggaaatcctatgaatgtaaggaatgtggaaagacctttcttcatggctcagagtttaatcgacatcagaaaattcatactggtgagagaaactatgaatgtaaggaatgtggaaagaccttttttcgtggttcagaacttaatcgacaccagaaaattcatactggaaagaggccatatgaatgtgaagaatgtggaaaagcctttctctggggttcacaacttactcgacatcagagaatgcatactggtgaggaaccttacgtatgtaaagaatgtgggaaatcttttatctggggttcacagcttacacgacataagaaaattcatactgatgcagaaccttatggatgcaagaaaagtagccacatctttagtcaccattcatattttactgaacaaaaaattcataatagtgcaaatctctgtgaatggacagactatgggaacacctttagtcatgagtcaaactttgctcaacaccagaatatttacacttttgagaaatcctatgaatttaaagattttgagaaagcattttcttcaagctctcacttcatttcactcttgtgaaatattatataaaagtgtaggaagggctttattcatgactcattaattgatgtcatttatttttttctcttgaggaacaccacaaatgtaagtaatattggaaggcatttt

SEQ ID NO: 203853 - DNA, 4554 bp, Homo sapiens
  Payload ID: 20205
  Gene Name: zinc finger protein 791
  Uniprot ID: Q3KP31
  ENST ID: ENST00000343325
  CDS Start-End: 163-1893
gcaaatgcgtgctacgtcactgtgcgatcgggttgtgcttagcttggggtctcctggccccttgacgcgtcaggttgctgtacccctgcatcggatgcgctgtaccctgcgctggctccgtgaaccttagggacaacaccgggacacccgcgaggccggaaaatggactcagtggcttttgaggatgtgtctgtgagcttcagccaggaggagtgggctctgctggctccttcacagaagaaactctacagagatgtgatgcaggaaacattcaagaacctggcatctataggggaaaaatgggaagacccgaatgttgaagatcaacacaaaaaccaaggacgaaatctaagaagccatacgggagagagactctgtgaaggtaaagaaggtagtcaatgtgcagaaaacttcagtcccaatctcagtgtgacgaagaagactgccggagtaaaaccatatgagtgtactatctgtggaaaagccttcatgcgtctctcatcccttactagacacatgaggtctcacactggatacgagctatttgagaagccatataaatgtaaggagtgtgagaaagcctttagttatctcaaatcctttcaaagacatgaaaggagtcacactggagaaaaaccctataaatgtaaacaatgtggaaaaaccttcatatatcaccagccctttcaaagacatgagcggactcacattggagaaaaaccctatgaatgtaagcaatgtggaaaagctcttagttgttccagttcgcttcgagttcatgaaaggattcacactggagaaaagccctatgaatgtaaacaatgtgggaaagccttcagttgttccagttctattcgagtacacgaaagaactcacactggagagaaaccctatgcatgtaaggaatgtgggaaagccttcatttcccacacaagtgttctaacacacatgataacacacaacggagatagaccttataaatgcaaagaatgtggaaaggcattcatttttcccagttttttacgagtacatgaaagaattcacactggagagaaaccctataaatgtaaacaatgtggtaaagccttcagatgttccacctccattcaaattcatgaaagaattcatactggagagaagccctataaatgtaaagaatgtgggaaatctttcagtgcacgcccagcctttcgagtacacgtgagagtgcatactggagagaaaccctataagtgtaaagaatgtgggaaagcctttagtagaatcagttactttcgaatacatgaaaggactcacactggagagaaaccctacgaatgtaaaaaatgtgggaaaactttcaattatcctctagatttgaaaatccacaagagaaatcacactggagaaaaaccctatgagtgtaaggaatgtgcaaaaaccttcatttctcttgagaactttcgaagacacatgatcacccacactggagacggaccttataaatgtagggactgtgggaaggtgttcatttttcctagtgcgttacgaacacatgaaagaactcacactggagagaaaccctatgaatgtaaacaatgtggaaaagcctttagttgttctagttacattcggatacataaaagaactcacactggggagaaaccttatgaatgtaaggaatgcgggaaggcctttatttatcccacaagctttcaaggacacatgagaatgcatactggagagaaaccctataaatgtaaagaatgtgggaaggcctttagtcttcacagttcctttcaaagacatacaagaattcacaattatgagaaacctcttgaatgtaagcaatgtggaaaagccttcagtgtgtccacatccttaaaaaaacatatgagaatgcacaatcgatagaaactctataaatgtgagaaataggagaaagttttcaattctaacagatgctttcaaagttgtgaaaattcccactgaagagagaaatcctgtcaatgtaagtaatatagaaagcgagatacaagatgattcatgtatagtcaggtaccacataatcatgtttcagtcagcaatggaccatataggttggtagccccataagattatataacacctaaaacatttctatcaaccgcaatttagtagcagtagtaacaccatagtgcagcacattatttaagtgtttatggtgctggtgtaaacgtgctgcactttcagttgtataaaagtacaagacagcggccggggacggtggctcacgcctgtaatcccagcactttgggaggccaaggcgggcggatcacgaggccaggagatcaagaccatcctggctaacacggtaaaaccccatctctactaaaaatacaaacaattagccgggcgtggtggtgggcgcctgtagtcccagctacttgggaggctgaggcaggagaatggcataaacccaggaggccgagctgacagtgagctgagatccggccaacagagcgagactctgtctcaaaaaaaaaaaaaaaaaaaaagtacaacacagctgggcatggtcacacctgtgatcccaacactgggagactaaggcagtaggattgcttgatgccaggactactctggtcaacctagtgagaccctgtctctacaaaaaataaaaacattttctaagtgtggtagcacaccctgtagtcccatctacatgggaggctgaggcaggaggattgcctgagcccaggagttcaaggctacagtgaaccaagatcacgtgatggcagtccagcatgggtgacagtgagactgtatcaaaaaaaaaaaaaaaaaattggctgggcacagtggctcatacctgtaatcccagcactttgggaggctgaggtgggagaatcagttgaggtcaggagttcaagaccagcctggtcaacatgatgaaaccctgtctccattagaaatacgaaaattagctgggcgttctggtgtgcctgtagtcccagctacttgggaggccaaagcaggagaatcgcttgaacccgggaggtggagattgcagtgagctgagatctaccactacactccagcctgggtgacagagcgagactccgtctcgaaaaaaaaaaaattacagcacagatgtgcaatatatacttgataataaatggctaagttactggtttatatatttacaatcctgttttagaatgtattcctgtgtttttttaacagtaagacagtctcaggcaggtccttaaggagatattcccggaaaaactttgttatgataggcgatgacggctccatgtgcaggactgcccctgaacgtattctggcgggacaaaacatggaggcagaagacaatgatattgatgatcctcaccccgtgtagtcctacactaatgtgtgtttgtgtcttagttagtctttaacaaaaatagtttaaaaaaatttaatagaaaaagcttatagaatatggacataaaatatttttgtacagctgtacaatgtgttttaagctaaattattacaaagtttttaaaaataagtttataaagaaaataatgtacagtaagttaaggtttattcattattgaggaaaaaatgtttttatgaatgtagtgtagtccaagtgtacagtgtttataaattctccattagtgtacagtaacatcctgggccttcgcattcactcaccactcaactgactcacccagagcaacttctagtcctgcaagctatgttcatggagtgtcctatgcaggtgcatccttttttatcttttatactgcatgtttactctgtgtattttctgtgtttagactcataaatacttaacattttgttacaatttcctacagtgttcagtacaacaacatgttgtatggtttatagcctagtagcaatagactgtaccatatagtctagatgtgttgtagctataccatctagatttgtgtaagttcactttgtgatgtttgtaccatgaggaaatcacctacaacacgtttctcagaacatatacccatgattaagcaatctctgcctgtaaaatgctccagaaaattcacaccatgatataaattcatcacacacgatataaaagttaaggcaaggcatggtggctcatgcctgtaatcccagcactttgggaggccaaggcaggcagatcacctgaggtcaggagttcgagaccagcctggccaagacggtgaaaccccatctctactaaaaatacaaaaattacctgagcgtggtggcatgcacctgtaattccagctacttgggaggctgaagcaggagaatcatttgaacctgggaggtggaggctgcagtgagctgagattgtgccactacactccagcctgggcaacagagcaagactccatcccacacaccaaaaaaaagttaaaaattttttatcactggctcattcttcaagtacatctctggactatgaattgtaacttaactacttttccaagaagtcttggaagtgagataattctgtaagtactctttaagcagtggtcaaaagtttaaaaggttgtgttttctcattaaatcagttagtaaaacttt

SEQ ID NO: 203854 - DNA, 6412 bp, Homo sapiens
  Payload ID: 20205
  Gene Name: zinc finger protein 791
  ENST ID: ENST00000446165
  CDS Start-End: 163-372
gcaaatgcgtgctacgtcactgtgcgatcgggttgtgcttagcttggggtctcctggccccttgacgcgtcaggttgctgtacccctgcatcggatgcgctgtaccctgcgctggctccgtgaaccttagggacaacaccgggacacccgcgaggccggaaaatggactcagtggcttttgaggatgtgtctgtgagcttcagccaggaggagtgggctctgctggctccttcacagaagaaactctacagagatgtgatgcaggaaacattcaagaacctggcatctatagaagccatacgggagagagactctgtgaaggtaaagaaggtagtcaatgtgcagaaaacttcagtcccaatctcagtgtgacgaagaagactgccggagtaaaaccatatgagtgtactatctgtggaaaagccttcatgcgtctctcatcccttactagacacatgaggtctcacactggatacgagctatttgagaagccatataaatgtaaggagtgtgagaaagcctttagttatctcaaatcctttcaaagacatgaaaggagtcacactggagaaaaaccctataaatgtaaacaatgtggaaaaaccttcatatatcaccagccctttcaaagacatgagcggactcacattggagaaaaaccctatgaatgtaagcaatgtggaaaagctcttagttgttccagttcgcttcgagttcatgaaaggattcacactggagaaaagccctatgaatgtaaacaatgtgggaaagccttcagttgttccagttctattcgagtacacgaaagaactcacactggagagaaaccctatgcatgtaaggaatgtgggaaagccttcatttcccacacaagtgttctaacacacatgataacacacaacggagatagaccttataaatgcaaagaatgtggaaaggcattcatttttcccagttttttacgagtacatgaaagaattcacactggagagaaaccctataaatgtaaacaatgtggtaaagccttcagatgttccacctccattcaaattcatgaaagaattcatactggagagaagccctataaatgtaaagaatgtgggaaatctttcagtgcacgcccagcctttcgagtacacgtgagagtgcatactggagagaaaccctataagtgtaaagaatgtgggaaagcctttagtagaatcagttactttcgaatacatgaaaggactcacactggagagaaaccctacgaatgtaaaaaatgtgggaaaactttcaattatcctctagatttgaaaatccacaagagaaatcacactggagaaaaaccctatgagtgtaaggaatgtgcaaaaaccttcatttctcttgagaactttcgaagacacatgatcacccacactggagacggaccttataaatgtagggactgtgggaaggtgttcatttttcctagtgcgttacgaacacatgaaagaactcacactggagagaaaccctatgaatgtaaacaatgtggaaaagcctttagttgttctagttacattcggatacataaaagaactcacactggggagaaaccttatgaatgtaaggaatgcgggaaggcctttatttatcccacaagctttcaaggacacatgagaatgcatactggagagaaaccctataaatgtaaagaatgtgggaaggcctttagtcttcacagttcctttcaaagacatacaagaattcacaattatgagaaacctcttgaatgtaagcaatgtggaaaagccttcagtgtgtccacatccttaaaaaaacatatgagaatgcacaatcgatagaaactctataaatgtgagaaataggagaaagttttcaattctaacagatgctttcaaagttgtgaaaattcccactgaagagagaaatcctgtcaatgtaagtaatatagaaagcgagatacaagatgattcatgtatagtcaggtaccacataatcatgtttcagtcagcaatggaccatataggttggtagccccataagattatataacacctaaaacatttctatcaaccgcaatttagtagcagtagtaacaccatagtgcagcacattatttaagtgtttatggtgctggtgtaaacgtgctgcactttcagttgtataaaagtacaagacagcggccggggacggtggctcacgcctgtaatcccagcactttgggaggccaaggcgggcggatcacgaggccaggagatcaagaccatcctggctaacacggtaaaaccccatctctactaaaaatacaaacaattagccgggcgtggtggtgggcgcctgtagtcccagctacttgggaggctgaggcaggagaatggcataaacccaggaggccgagctgacagtgagctgagatccggccaacagagcgagactctgtctcaaaaaaaaaaaaaaaaaaaaagtacaacacagctgggcatggtcacacctgtgatcccaacactgggagactaaggcagtaggattgcttgatgccaggactactctggtcaacctagtgagaccctgtctctacaaaaaataaaaacattttctaagtgtggtagcacaccctgtagtcccatctacatgggaggctgaggcaggaggattgcctgagcccaggagttcaaggctacagtgaaccaagatcacgtgatggcagtccagcatgggtgacagtgagactgtatcaaaaaaaaaaaaaaaaaattggctgggcacagtggctcatacctgtaatcccagcactttgggaggctgaggtgggagaatcagttgaggtcaggagttcaagaccagcctggtcaacatgatgaaaccctgtctccattagaaatacgaaaattagctgggcgttctggtgtgcctgtagtcccagctacttgggaggccaaagcaggagaatcgcttgaacccgggaggtggagattgcagtgagctgagatctaccactacactccagcctgggtgacagagcgagactccgtctcgaaaaaaaaaaaattacagcacagatgtgcaatatatacttgataataaatggctaagttactggtttatatatttacaatcctgttttagaatgtattcctgtgtttttttaacagtaagacagtctcaggcaggtccttaaggagatattcccggaaaaactttgttatgataggcgatgacggctccatgtgcaggactgcccctgaacgtattctggcgggacaaaacatggaggcagaagacaatgatattgatgatcctcaccccgtgtagtcctacactaatgtgtgtttgtgtcttagttagtctttaacaaaaatagtttaaaaaaatttaatagaaaaagcttatagaatatggacataaaatatttttgtacagctgtacaatgtgttttaagctaaattattacaaagtttttaaaaataagtttataaagaaaataatgtacagtaagttaaggtttattcattattgaggaaaaaatgtttttatgaatgtagtgtagtccaagtgtacagtgtttataaattctccattagtgtacagtaacatcctgggccttcgcattcactcaccactcaactgactcacccagagcaacttctagtcctgcaagctatgttcatggagtgtcctatgcaggtgcatccttttttatcttttatactgcatgtttactctgtgtattttctgtgtttagactcataaatacttaacattttgttacaatttcctacagtgttcagtacaacaacatgttgtatggtttatagcctagtagcaatagactgtaccatatagtctagatgtgttgtagctataccatctagatttgtgtaagttcactttgtgatgtttgtaccatgaggaaatcacctacaacacgtttctcagaacatatacccatgattaagcaatctctgcctgtaaaatgctccagaaaattcacaccatgatataaattcatcacacacgatataaaagttaaggcaaggcatggtggctcatgcctgtaatcccagcactttgggaggccaaggcaggcagatcacctgaggtcaggagttcgagaccagcctggccaagacggtgaaaccccatctctactaaaaatacaaaaattacctgagcgtggtggcatgcacctgtaattccagctacttgggaggctgaagcaggagaatcatttgaacctgggaggtggaggctgcagtgagctgagattgtgccactacactccagcctgggcaacagagcaagactccatcccacacaccaaaaaaaagttaaaaattttttatcactggctcattcttcaagtacatctctggactatgaattgtaacttaactacttttccaagaagtcttggaagtgagataattctgtaagtactctttaagcagtggtcaaaagtttaaaaggttgtgttttctcattaaatcagttagtaaaacttttctctttctcttgatgtcttgattcatgagtaaactgaagtgtattttttttttttcgagacggagtcttgctctgttgcccaggctggagttcagcggtgtgatctcggctcactgcaagctccgcctcccgggtccacgccattctcctgcctcagcctccccagtagctgggactgcaggcgcccgccaccatgcccagctaattttttttgtatttttagtagagatggggtttcaccgtgttaagccaggatggtctcaatctcctgacctcgtgattcgaccgcctcagcctcccaaagtgctgggattacaagcttgagccaccgcacccggcctgaagtgtattttttttttcttttaaagaccagtgttagtagaagtgtatttttaatatacaattagttttaatttgtgtatagtttttcagttgttctctgaataaagagattgttgaatactgacacactgtaactaggatttttcctactggcctcatgtggaaggtggtgcatatattacccattatatatttatttcaccttttccgaaaaactgctttttaaatttcttggccagacacggtggctcactcctttgtaattccagcactttgggaaaccaaggcaagcagatcacttgaggtcaggagttcgagaccaacctggccaacatggtgaaatcccatctctactaaaaatacaaaaattagctgggcatgttggagggcacctgtaatctcagctacttgggaggctgaggcaggagaaatgcttgaacctggaagtcagaggttgcagtgagccaagatcacaccactgcactccagcctggacaacagaacgagactccatatcaaaaaaattaaattaaaatataataaatttcttgccgggcgcagtggctcacacctgtaatcccagcactttgggaggccgaggtgggcggatcacgaagtcaggagattgagaccatcctggctaatacagtgaaaccccgtctctactataaatacaaaaaattagctgggcatggtggcgggcgtctgtagtcccagctactcaggagtctgaggcaggagaatggtgtgaacccgggaggcggagcttgcagtgagccgagatcgtgccactgcaatccagcctgggcagcagaacgagactccatctcaaataaataaataaataaaatgaatttcagctagaagagccttattccattttcctttttattaaacatctggcataagttggtaagtatgtgaagtttatcatatattcttatgcgaattattattttcgccttttttttataattctgtctgggatttgaatagtagagtttgaattcaggaaggacacctgtgataggacaataaaatctagagctggacgtggccctcctgctacctgtcgacacaggtaaatttcctagaatctgttccctttatagatccatgttgaaattcacttatagcctcacttgcatgagatttgccaggcagaagtgaagaagacattagtcaggtattggaaccccaccatacagggagacagcctgcttcctgctcattttcctggttattttctctgccaatcaaaagtatcctgaaaacaccctgagctgcttgacttccattctcaaagagatgtgttggtttccacagttgtctccacaagctccgcatcaaagatccacgtacagtttggattttccttctagccttcatgtgtggcccaagcatctatttcagactgtcatggttggcattgttctctgaggttctgtcttccctttgtgtttctatgagctttaatttgtatggttcttgttctgttaatgccactagggactatgtattcctgattccaccatgacagctacagtaaaacagtaaaaaaaaaaaaaaacaacta

SEQ ID NO: 203855 - DNA, 704 bp, Homo sapiens
  Payload ID: 20205
  Gene Name: zinc finger protein 791
  ENST ID: ENST00000598225
  CDS Start-End: 164-271
aaatgcgtgctacgtcactgtgcgatcgggttgtgcttagcttggggtctcctggccccttgacgcgtcaggttgctgtacccctgcatcggatgcgctgtaccctgcgctggctccgtgaaccttagggacaacaccgggacacccgcgaggccggaaaatgatggggtctggctgtgttgctcaggctgatcttgaactcctgggctcaagcgatcctccaccctcagcatcccaaagtgctaggattccaggactcagtggcttttgaggatgtgtctgtgagcttcagccaggaggagtgggctctgctggctccttcacagaagaaactctacagagatgtgatgcaggaaacattcaagaacctggcatctataggggaaaaatgggaagacccgaatgttgaagatcaacacaaaaaccaaggacgaaatctaagaagccatacgggagagagactctgtgaaggtaaagaaggtagtcaatgtgcagaaaacttcagtcccaatctcagtgtgacgaagaagactgccggagtaaaaccatatgagtgtactatctgtggaaaagccttcatgcgtctctcatcccttactagacacatgaggtctcacactggatacgagctatttgagaagccatataaatgtaaggagtgtgagaaagcctttagttatctcaaatcctttcaaagacatgaa

SEQ ID NO: 203856 - DNA, 576 bp, Homo sapiens
  Payload ID: 20205
  Gene Name: zinc finger protein 791
  ENST ID: ENST00000600752
  CDS Start-End: 327-576
gcttagcttggggtctcctggccccttgacgcgtcaggttgctgtacccctgcatcggatgcgctgtaccctgcgctggctccgtgaaccttagggacaacaccgggacacccgcgaggccggaaaatggggaaaaatgggaagacccgaatgttgaagatcaacacaaaaaccaaggacgaaatctaagaagccatacgggagagagactctgtgaaggtaaagaaggtagtcaatgtgcagaaaacttcagtcccaatctcagtgtgacgaagaagactgccggagtaaaaccatatgagtgtactatctgtggaaaagccttcatgcgtctctcatcccttactagacacatgaggtctcacactggatacgagctatttgagaagccatataaatgtaaggagtgtgagaaagcctttagttatctcaaatcctttcaaagacatgaaaggagtcacactggagaaaaaccctataaatgtaaacaatgtggaaaaaccttcatatatcaccagccctttcaaagacatgagcggactcacattggagaaaaaccctatgaatgtaagcaat

SEQ ID NO: 203857 - DNA, 576 bp, Homo sapiens
  Payload ID: 20205
  Gene Name: zinc finger protein 791
  ENST ID: ENST00000597691
  CDS Start-End: 161-295
aaatgcgtgctacgtcactgtgcgatcgggttgtgcttagcttggggtctcctggccccttgacgcgtcaggttgctgtacccctgcatcggatgcgctgtaccctgcgctggctccgtgaaccttagggacaacaccgggacacccgcgaggccggaaaatgatggggtctggctgtgttgctcaggctgatcttgaactcctgggctcaagcgatcctccaccctcagcatcccaaagtgctaggattccaggcatgagctactattaccggcccaacattctcattttctgaaagcaatagactcagtggcttttgaggatgtgtctgtgagcttcagccaggaggagtgggctctgctggctccttcacagaagaaactctacagagatgtgatgcaggaaacattcaagaacctggcatctataggggaaaaatgggaagacccgaatgttgaagatcaacacaaaaaccaaggacgaaatctaagaagccatacgggagagagactctgtgaaggtaaagaaggtagtcaatgtgcagaaaacttcagtcccaatctcagtgtgacgaag

SEQ ID NO: 203858 - DNA, 3888 bp, Homo sapiens
  Payload ID: 20206
  Gene Name: zinc finger protein 792
  Uniprot ID: Q3KQV3
  ENST ID: ENST00000404801
  CDS Start-End: 388-2286
cggggaggctgagtccccaggagctggggaccccgagttgggggcggggcggctggggctacgcccgtgaagctgccccgccggctttcccggaccgcgagggggacagtgaggccgggaccccctccgcgcctttgcaccagccgtgaccccttgcaacgggggtacccagcggagctgcgcgctctcggcgcccccggagcctgcgccccgggccccttgcgcattttgcacgggggagactgaggctaggagtgcgaccctcagcccggggtcacacctcgtctggggcacggccaggtgggtggtagcctcagcctgcgagaccccctacccccgccccgtggtttcccgcaccgtggggccctgctctgaccacagactccgatggcagcggcggcgctgcgggaccccgcgcagggctgcgtgacctttgaggacgtgaccatttacttctcccaggaggagtgggtgctcctcgatgaggctcagagactcctgtactgcgatgtgatgctggaaaactttgcacttatagcctcgctgggacttatatctttcaggtcccacatcgtttcccagttggagatggggaaagagccctgggtgcctgacagtgtggatatgacatcagccatggccagaggggcttatggcaggcctggctctgatttttgccatggaacagagggcaaggacttaccttctgagcataacgtttctgtagaaggagtggcacaggacaggagtcccgaggcaactctgtgcccccagaagacctgcccctgtgacatatgtggcctacgtttgaaagacattttgcatttggctgaacaccagacaacacatcccaggcagaaaccatttgtgtgtgaggcatatgtgaaaggctctgagttcagtgcaaaccttccccggaaacaggtgcagcagaacgtacacaaccctatcagaacggaggagggccaggcttcccctgtaaagacctgcagagaccacacatcagatcagctttccacctgcagggagggtgggaaggactttgtggccacagcagggtttctgcagtgtgaggtcactcccagcgatggggagccgcacgaggccaccgaaggtgtggtggattttcacattgcactaaggcataacaagtgctgtgaatctggggatgccttcaataacaaatccactcttgttcagcaccagagaatccacagcagagaaaggccttatgaatgcagcaaatgtggaatcttcttcacttacgccgctgacctcactcaacaccagaaagttcacaatagaggaaaaccgtatgagtgctgtgaatgtggaaaattcttcagccagcactccagccttgttaaacatcgcagggttcacaccggtgaaagccctcacgtgtgtggtgactgtgggaaattcttcagccgaagctccaacctcattcagcataagagggttcacactggtgaaaagccatatgagtgcagcgactgtgggaagttcttcagccagcgttccaacctcattcatcataagagggttcatacgggcagaagtgcccatgagtgcagtgaatgtgggaaatctttcaactgcaactccagcctaattaaacattggagagttcacactggagaaagaccttacaagtgtaacgaatgtgggaaattcttcagccacattgccagcctcattcaacatcagatagttcacactggcgagcggcctcacgggtgtggtgagtgtgggaaagccttcagccgaagctctgacctcatgaaacatcagcgagttcacactggtgagcggccttatgaatgcaatgaatgtgggaagttatttagccagagctccagcctcaatagccatcggagacttcacactggtgaacggccttaccagtgcagtgaatgtgggaaattctttaaccaaagctccagcctcaataaccaccggagacttcacaccggcgagcggccttatgagtgcagcgaatgtgggaaaaccttcaggcagaggtccaatctgaggcagcacctgaaagttcacaaaccagacaggccttacgaatgcagcgaatgtgggaaagccttcaaccaaaggcctaccctcattcggcatcagaagattcacatcagagaaaggagcatggagaatgtgctccttccctgttcacagcacacaccagagataagctctgagaacagaccttatcagggcgctgtcaactacaagttgaaacttgttcatccaagtacccaccctggggaggttccctaggaatgctagctgtgttggaagctttctggagacaagttacattctcttactgtagagtttatcagcgttttttcactgctggggttgtgatagaagccatgtcagcaccacacactgcagctctccaaagagtgtgtccaccactccactgtgctcagggaaggcagacctctcctctctctttccaatccctaaagggaattaggagtagtctgaagccttgggaagatgtcattcccgccctgtatggctggtttagccatggacatgaccagcttttggctgtgaagacctgagcagggttttgccaacagcttgttctagagaaggtttccctttttctgggacattgttggtctcatgttatgcctgtgaaggatttgtccagccttcatgttactctacacaacaacttatctcctgtgtattgccctggttcatgtgatgataatggccttatgataaagccgcctttagtcttccatgttctgatcactgtgtggggtggttcaagagcagagttaagatctaccaaactgaaggggtctccagattatcttggaggggacaggaggatggcagagaaacaactgtcaatccagatttgacctcatttgcattgccaccaaggcctcctaggaaaaattgtaggaatttatgggtataatattgtggtctgaatggcgtgaatttttatcccgaggagggggcagttgtgacaacctccagtgcatgtgggaacagcatgaattgggtcccttattcccagggggtgccccatattccccaatactgtaaagcagatgctgtttagcacctgccaaggagccatatgccctgaagttcagcattaggcaggtatctcttaactgtaagacataccaggcccagctgggaccataatttgtacagaaacactggatgtgattaatagggagtaggcgagattatagcaaaccagcagaaatggaactctgctaaatgtgcatccgtgaatgctcccttgaatgtggctgtgcaggattcagggtttgcagaaattctcaggacctcagacctctgtcctatgactaatgttactggcagagcaaataatctaaaggttttggttttgtggattaccatctccgtgctgtgcatctgaaggccagtgctgtgctggcaggaaaatagggactgagaaaaagcagatcctatactatagggactgtagtatctatgacgtagccagccattctttgctcccaaggcaagaagaaagagatgacagagtcaatatagggttgccaaatcggattttctaaaatgagtaggaagttggatttttatgtgcaacagtttcttttaatgctttgttgatatgtgattgtcatgcaataattattcatatttggtaagttttgtacatatattatgtacactcagggaaccaataccataatcatgataatgaacgtatccatcacctgcaaagctacctcatgcccctttacattccctccttgccttccctaggaaaccgttgatttacattttttactttagatttgtttgccttttctagaattaacacaattggaatcataaagtatttatactctc

SEQ ID NO: 203859 - DNA, 2567 bp, Homo sapiens
  Payload ID: 20206
  Gene Name: zinc finger protein 792
  ENST ID: ENST00000605484
  CDS Start-End: 388-2085
tccctcctctccctgagctgcccccacacctgctgcctgaagccttgcagggaagctccaggcatgaggggtcttgcggttagctgtgtgactacctctgactcggccattccctcctgggtgattatccagatctgacagttctgtggtttagattctgtgcctttcctcttgctaatatttcctaagcctgactgtgccaggaattccaatcactgatgtggttactgcttgccgtgaccacccaatgtccctgtgtcatacggagcttcctgtcttgtagtctatcatggggtagttcaactgggcaggtgctggccactgacccactctgtctttcccttaggacttatatctttcaggtcccacatcgtttcccagttggagatggggaaagagccctgggtgcctgacagtgtggatatgacatcagccatggccagaggggcttatggcaggcctggctctgatttttgccatggaacagagggcaaggacttaccttctgagcataacgtttctgtagaaggagtggcacaggacaggagtcccgaggcaactctgtgcccccagaagacctgcccctgtgacatatgtggcctacgtttgaaagacattttgcatttggctgaacaccagacaacacatcccaggcagaaaccatttgtgtgtgaggcatatgtgaaaggctctgagttcagtgcaaaccttccccggaaacaggtgcagcagaacgtacacaaccctatcagaacggaggagggccaggcttcccctgtaaagacctgcagagaccacacatcagatcagctttccacctgcagggagggtgggaaggactttgtggccacagcagggtttctgcagtgtgaggtcactcccagcgatggggagccgcacgaggccaccgaaggtgtggtggattttcacattgcactaaggcataacaagtgctgtgaatctggggatgccttcaataacaaatccactcttgttcagcaccagagaatccacagcagagaaaggccttatgaatgcagcaaatgtggaatcttcttcacttacgccgctgacctcactcaacaccagaaagttcacaatagaggaaaaccgtatgagtgctgtgaatgtggaaaattcttcagccagcactccagccttgttaaacatcgcagggttcacaccggtgaaagccctcacgtgtgtggtgactgtgggaaattcttcagccgaagctccaacctcattcagcataagagggttcacactggtgaaaagccatatgagtgcagcgactgtgggaagttcttcagccagcgttccaacctcattcatcataagagggttcatacgggcagaagtgcccatgagtgcagtgaatgtgggaaatctttcaactgcaactccagcctaattaaacattggagagttcacactggagaaagaccttacaagtgtaacgaatgtgggaaattcttcagccacattgccagcctcattcaacatcagatagttcacactggcgagcggcctcacgggtgtggtgagtgtgggaaagccttcagccgaagctctgacctcatgaaacatcagcgagttcacactggtgagcggccttatgaatgcaatgaatgtgggaagttatttagccagagctccagcctcaatagccatcggagacttcacactggtgaacggccttaccagtgcagtgaatgtgggaaattctttaaccaaagctccagcctcaataaccaccggagacttcacaccggcgagcggccttatgagtgcagcgaatgtgggaaaaccttcaggcagaggtccaatctgaggcagcacctgaaagttcacaaaccagacaggccttacgaatgcagcgaatgtgggaaagccttcaaccaaaggcctaccctcattcggcatcagaagattcacatcagagaaaggagcatggagaatgtgctccttccctgttcacagcacacaccagagataagctctgagaacagaccttatcagggcgctgtcaactacaagttgaaacttgttcatccaagtacccaccctggggaggttccctaggaatgctagctgtgttggaagctttctggagacaagttacattctcttactgtagagtttatcagcgttttttcactgctggggttgtgatagaagccatgtcagcaccacacactgcagctctccaaagagtgtgtccaccactccactgtgctcagggaaggcagacctctcctctctctttccaatccctaaagggaattaggagtagtctgaagccttgggaagatgtcattcccgccctgtatggctggtttagccatggacatgaccagcttttggctgtgaagacctgagcagggttttgccaacagcttgttctagagaaggtttccctttttctgggacattgttggtctcatgttatgcctgtgaaggatttgtccagccttcatgttactctacacaacaacttatctcctgtgtattgccctggttcatgtgatgataatggccttatgataaagccgcctttagtcttc

SEQ ID NO: 203860 - DNA, 6712 bp, Homo sapiens
  Payload ID: 20207
  Gene Name: zinc finger protein 793
  Uniprot ID: Q6ZN11
  ENST ID: ENST00000445217
  CDS Start-End: 36-1256
tacaggtgtcagatctttttcaagaacagcagaaaatgatcgaataccagatacctgtgtcattcaaagatgtggttgtgggcttcacccaagaggagtggcaccggctgagtcctgctcagagggccctgtaccgggatgtgatgctggaaacctatagcaacctcgtctcagtgggttatgaaggcaccaaaccagatgtgatcctcagactggagcaggaagaagcaccatggattggtgaggcagcatgcccgggctgccactgttgggaagacatctggcgagttaatatccagaggaaaagacggcaagacatgcttttgaggccaggcgcagccataagcaagaaaacattgcccaaggagaaaagctgtgaatataataagtttgggaaaatatcacttctgagcactgatcttttttcttcaatccagagccctagtaactggaacccttgtggaaagaatttgaaccataatttagacttgattggttttaagagaaactgtgcaaaaaagcaagatgagtgttatgcttatgggaaattgcttcagcgtataaatcatggtagacgacctaatggagaaaagccccggggttgcagtcactgtgagaaagctttcacccagaacccggcacttatgtataaaccagcagtaagtgattctctcttgtacaaacggaagagggttccacctacagaaaaaccccacgtctgtagtgagtgtgggaaagccttctgctacaagtctgaattcattaggcatcagagaagtcacactggggagaagccttatggctgcactgactgtgggaaagccttttcacataagtcaaccctcatcaaacaccagagaattcacactggggtaagaccctttgaatgttttttttgtgggaaagcctttacccagaagtcacaccgcacagaacatcagagaacacacacaggagagagaccctttgtctgcagtgaatgcgggaaatcgtttggtgagaagtcatacctcaatgtacatcgaaaaatgcacacaggagaaagaccgtatcgttgcagagaatgtggaaaatccttcagccagaagtcatgcctcaataaacattggagaactcacacaggagagaagccctatgggtgcaatgaatgtgggaaagctttctaccagaagccaaacctcagcagacatcagaaaattcatgctcggaagaatgcctacaggaatgaaaacttaataattgtgggaaatacttgagcaaaatatctggtttcatggtatgtagggaattttttttttttttttttgagttggaatctcactttgtcacccaggctggagtgcagtggcgcgatctcggcttactgcaagctctgcctcccgggttcacgccattctcctgcctcagcctcccgagtagctgggactacaggtgcccaccaccatgcccggctaattttttttttgtatttttagtagagacggggtttcaccgtgttagccaggatggtctcgatctcctgaccttgtgatctgcccgccttgtcctcccaaagtgctgggattacaggcgtgagccaccgcgcctggccggtatgtagggaatttatccttaggagaaatcttatcattttaatgaatttgaacagtgtgtttttattttatttatttatttattttgagttgtattctctgtttcccaggctggagtgcaatggcactatctcggctcactgtaacctcagcctcccaggttcaagcagttctcctgcctcagcctcccaagtagctgggattacaggcacctgccaccacgcctggctaatttttgtatttttagtagagatggggtttcaccatgttggtcaggctggtctctttggctaggctggtctcgaactcctgacctcgtgataccccccaaccccccgcccttggcctcccaaagtgttgggattacaggcatgagccaacgcgcccaaccgacagtgttgtatcataatggaaatcatgatctaattgtgatacaaacttttctagaaaatactttctcaaacataagcatggacaccctggcatgtaaacgtttaaaaatgtattaaatggaataacagcagaatacaaaatatctgtgaagagacttaaaggcatactctggtatattccacagtgagccatacaatcagcattatttgtattttggagttgtaaatgtgaaattaacataaaatgtgaatatcagacacatgtcacacaacatatagaatgccattcagaaaacttttccactttaaatatcatcattgtcttttgatgtcttaacaatacaaaaaaataacaacaacatggcccactattgttaaaagaactttattataccagctacatttttccacctttttgtaatacatgtaaatggctatagaggttgttactgtcctctgcagaaataataaagcagtgtttttaaatgtatttggataatttggccaaaaattttactaaaatgtagttatttatattaaaaatgcaagctaaggaatagtttaagaacctgatactgggtaaatgaaacactgtaaactatttgacaaaatgtagtgtcaccctggtgtacagtacactgttcatattttcttagtcttgcttaaaatatcttgtagcaaattagtagcattgctacactattctagatacactattctatatacaggttgtataactcagaaatgtttcatgcgtagaccactgaaggagaatttcttttctctctatccctctgcaaattaattcaagaatattcatttttttcatataaatttccttgcaagtgtcctagacactaaatcccaaggttttaattatttcaatgtttggaaagaagtctgcttccctgagttgctatgtcatccatattagaaaataaatggccatgtggaatctacatttttcaagatttccctccatgtaagactgcctgatccagaatgagaaaggagacataaccacagatatcaatatgattttttaagtgataaaaagatacctcatacaactctaatcaacatattttttaaaaagaggaggtggatgcttttctaataaacttaagttatgaaaactgcaataagaagtagaaaacttggtaggatagttaacattgaaaaactcaaaaaagctattaaagatctataatgggaaaatgctccaggctcagaagagttcatgcttagttctatcttttaaagaaagagtaataccagtgttatttattatatggatgtaatacaatccatgaactgtactcatttattttattaagtcagaataaattttaacaccaaaatcaaatacagatagttgaaaaaagaaaacttctgctgggtgcggtggctcacgcctgtaatcccaacactttgggaggccgaggcaggtggatcatgaggtcagaagttcgagatggtgaaaccccatctctactaaaaatacaaaaattagccgggtgtggtggcacacacctgtagtcccagctacttgggaggttgaggcatgaggcaggagaattgcttgtacccaggaggtagaggttgcggtgagccaagatcgtgccatccagcctgggtgacaagagcgaaactccgtcaaaaaaaaaaaaaaaaaaagaaaacttcagaccagtcttactcatgaatatagaaacaaaaattatagttaaaatactagcaaatagaattcagccatatacccaaagagtgacatagtaagagtcatcccaagaatgccaaaccagttcagttaataggaaatgcatcaatcaaattaacagtttaaaggagaagaatcatatgaactctcaacagatactgagaaggcatttcatagaatgtgttaatttacattgtaatagatgggaaccacttaaagcggtttttcttaaaaaaaattttttttaacccaaaccccaaagcatatattatgccaaagccattttttaaaatcaggaattcaatattggcttagagattccagtgaaggcaataaaaagaaatgaattggtataaacagcagaaaaggtaaaactatccatttttactgatgatatggttgtacaccaataaatgaaaagactattttttgagttaacttttctaagaagacagggtaccaaaatcaagagctgttctccatactgacaagaaaacataatttatatgtacttcttttggaattacactaaatctcaatgattttttgacaatcattgaaaaaaatatatgaaaaaaatcataccatgtataaaaacatcacatgtacccaataaatatatacaacaattatatatctataataattaaaaatttttaaaatgccatgctagataccagaagataacatgaagccattctaatgaaattaatattgtattggcaaaggaacaggtaaatacatcattagaacacagtagaaaattcagaaatagacttcgatatatatgaactttttcatatgtgaaaaaggtgaaatctgaaaccacaggggaaaagagtagtttacttaaaaagaattctggaacagaaccttttaatcttaaaggaagaaaatttggattaacagcacaaaaataaattctgggtggctttaagacgtaaaattttaaagcaacagaattcttaaaagaaaatcaaaggagcctatgtgtacaatctaggagttgggagatattaactttaccaacacaggacactcagaagctatttagaaataagcagttgaaggctgggtgcagtggctcatgcctgtaatcccaacactttgggaggctgaggcaggaggatcacctgaggttaggagttcaagactagtctggtcaacatggtgaaaccccatctccactaaaaatacaaaaattagctgggtgtggtggcacatgcctgtagtcccagctacttgggaggctgaggcaggagaatcacttgaacctggaaggcaggggttgaagtgagctgagattgcaccactgcactccagcctgggcaacagagcaagactccatctcagaaaaaaagaaaaagaaaaaaaaaaggaaacaaacatttgactacgtagaatcttttggtacaatcttttgggtgacaaaagatgccatcagcaaactcaagagataatagattgtggggaaatatttgtaaagctgatcagagagaaggcattcatgaaatggacaggaaaaaaacccaatagcaaaatgtggcaaagaatatgagttgacagttgtgagaagagcaaatctaagtggccaatggacctgtccaaaaatgtttatcctcagtagtcactgggggatgcagatttaaagttaaaatcaaataacactgtgtaacagcatttttagctatcagaacaaaagatgttacacactgctggtggagaaataaattttgaaaaacaatgcaaattactgttttggaaagaaatctggtaatatttaggctgggcgtggtggctcacacctgtaatcctagcactttgggaggccgaggcaggcaaattgtctgaggtcgggagttcgagaacagcctggccagcatggtgaaaccccgtctctactaaaaatacaaaaattagctgggcatggtggcaggcacctgtgatcccagctactcgggaggctgaggcaggagaatcacttgaacccaggaggcagaggttgcagtgagccaagatcgcgccattgcactccaacctgggcaacagagcaaaaagattccatctcaaaagaaaagaaaagaaatctgttaatattattaaaatatttatgtcactttggagaatcttcccttagaagtaaaagctccaatacataaaagacagatgaacatgtgaacatggacatttattgtaaaaattgttcttaatggcaaaaaaacccccaaaaccaaagcaaacactagaatcaaagtaaatacccatcaactgggaaattgtagaaaggaaaaaactatagtgtatccattccatagaatgttaatatagccattaaggtggacaaattaaaactatgctagtggacttgagtggaattccacaatgttctcttgagtgaaaaatgcaaggtagatattaagtatgttaaatatgactccatttttttaaatcattaacaaaatgtctctaggtgtttgtcagcaataaacggtatctatatatgtttatttgattttatgtgcatgaagaaaagtatagaagagtatgcattgacttggagggaggtgggtaatgcaggtaggttatgggggagtcaggggtgtagggaaaaggaaaaccaaaaaagaaaaatacataaatgactgaatcacgggtgataccacaaatgtgtgagttagtaaatttggctggggatgggggagctagaattttgctaatttgtggggatgttcatggtatatattgtaaaaagggaaaatttcataataatgtatacgattctatttttaaaaaaagtaaaaactcctgtgtgtgtatatatgcatgtggatgtttatatgaacatagaaaagtgtagaagaatacacacgaaggtgttaacattcattggttaccttggtggagaagggtaataagttttctgaatacctttgcattgtcttgttcacatatattgcttttgtaatttgaaaaacaaaataaagggggaaaacatttcaaactgaatg

SEQ ID NO: 203861 - DNA, 4073 bp, Homo sapiens
  Payload ID: 20207
  Gene Name: zinc finger protein 793
  ENST ID: ENST00000542455
  CDS Start-End: 750-1667
tacaggtgtcagatctttttcaagaacagcagaaaatgatcgaataccagatacctgtgtcattcaaagatgtggttgtgggcttcacccaagaggagtggcaccggctgagtcctgctcagagggccctgtaccgggatgtgatgctggaaacctatagcaacctcgtctcagtgggttatgaaggcaccaaaccagatgtgatcctcagactggagcaggaagaagcaccatggattggtgaggcagcatgcccgggctgccactgttgggggatcagcaaactgtggcctaccgattggccacctgctttgtgaataaagttttattagaacacaaccacattcttacgtttacatgttgtctatattttcatggtatggcgggagagttgagtcattgtgacggagaccatatggcccacaaagcctttactttctgactccttaagaataagtttgccaacctctgctctgtaatatcctattttctttgaaattattggtctctatactctatgatatattgaattccatttgtgccagtgttcagaatcctctttactcatagaacactcttccctgcgtttgtgctttgggttatggttcatgttctctatttgtgtgctgtgcactctttaaattttgagagcatttcttaagtagtatgaagtttcataaggatgattcactgtactttctccagaagacatctggcgagttaatatccagaggaaaagacggcaagacatgcttttgaggccaggcgcagccataagcaagaaaacattgcccaaggagaaaagctgtgaatataataagtttgggaaaatatcacttctgagcactgatcttttttcttcaatccagagccctagtaactggaacccttgtggaaagaatttgaaccataatttagacttgattggttttaagagaaactgtgcaaaaaagcaagatgagtgttatgcttatgggaaattgcttcagcgtataaatcatggtagacgacctaatggagaaaagccccggggttgcagtcactgtgagaaagctttcacccagaacccggcacttatgtataaaccagcagtaagtgattctctcttgtacaaacggaagagggttccacctacagaaaaaccccacgtctgtagtgagtgtgggaaagccttctgctacaagtctgaattcattaggcatcagagaagtcacactggggagaagccttatggctgcactgactgtgggaaagccttttcacataagtcaaccctcatcaaacaccagagaattcacactggggtaagaccctttgaatgtttttttgtgggaaagcctttacccagaagtcacaccgcacagaacatcagagaacacacacaggagagagaccctttgtctgcagtgaatgcgggaaatcgtttggtgagaagtcatacctcaatgtacatcgaaaaatgcacacaggagaaagaccgtatcgttgcagagaatgtggaaaatccttcagccagaagtcatgcctcaataaacattggagaactcacacaggagagaagccctatgggtgcaatgaatgtgggaaagctttctaccagaagccaaacctcagcagacatcagaaaattcatgctcggaagaatgcctacaggaatgaaaacttaataattgtgggaaatacttgagcaaaatatctggtttcatggtatgtagggaattttttttttttttttttgagttggaatctcactttgtcacccaggctggagtgcagtggcgcgatctcggcttactgcaagctctgcctcccgggttcacgccattctcctgcctcagcctcccgagtagctgggactacaggtgcccaccaccatgcccggctaattttttttttgtatttttagtagagacggggtttcaccgtgttagccaggatggtctcgatctcctgaccttgtgatctgcccgccttgtcctcccaaagtgctgggattacaggcgtgagccaccgcgcctggccggtatgtagggaatttatccttaggagaaatcttatcattttaatgaatttgaacagtgtgtttttattttatttatttatttattttgagttgtattctctgtttcccaggctggagtgcaatggcactatctcggctcactgtaacctcagcctcccaggttcaagcagttctcctgcctcagcctcccaagtagctgggattacaggcacctgccaccacgcctggctaatttttgtatttttagtagagatggggtttcaccatgttggtcaggctggtctctttggctaggctggtctcgaactcctgacctcgtgataccccccaaccccccgcccttggcctcccaaagtgttgggattacaggcatgagccaacgcgcccaaccgacagtgttgtatcataatggaaatcatgatctaattgtgatacaaacttttctagaaaatactttctcaaacataagcatggacaccctggcatgtaaacgtttaaaaatgtattaaatggaataacagcagaatacaaaatatctgtgaagagacttaaaggcatactctggtatattccacagtgagccatacaatcagcattatttgtattttggagttgtaaatgtgaaattaacataaaatgtgaatatcagacacatgtcacacaacatatagaatgccattcagaaaacttttccactttaaatatcatcattgtcttttgatgtcttaacaatacaaaaaaataacaacaacatggcccactattgttaaaagaactttattataccagctacatttttccacctttttgtaatacatgtaaatggctatagaggttgttactgtcctctgcagaaataataaagcagtgtttttaaatgtatttggataatttggccaaaaattttactaaaatgtagttatttatattaaaaatgcaagctaaggaatagtttaagaacctgatactgggtaaatgaaacactgtaaactatttgacaaaatgtagtgtcaccctggtgtacagtacactgttcatattttcttagtcttgcttaaaatatcttgtagcaaattagtagcattgctacactattctagatacactattctatatacaggttgtataactcagaaatgtttcatgcgtagaccactgaaggagaatttcttttctctctatccctctgcaaattaattcaagaatattcatttttttcatataaatttccttgcaagtgtcctagacactaaatcccaaggttttaattatttcaatgtttggaaagaagtctgcttccctgagttgctatgtcatccatattagaaaataaatggccatgtggaatctacatttttcaagatttccctccatgtaagactgcctgatccagaatgagaaaggagacataaccacagatatcaatatgattttttaagtgataaaaagatacctcatacaactctaatcaacatattttttaaaaagaggaggtggatgcttttctaataaacttaagttatgaaaactgcaataagaagtagaaaacttggtaggatagttaacattgaaaaactcaaaaaagctattaaagatctataatgggaaaatgctccaggctcagaagagttcatgcttagttctatcttttaaagaaagagtaataccagtgttatttattatatggatgtaatacaatccatgaactgtactcatttattttattaagtcagaataaattttaacaccaaaatcaaatacagatagttgaaaaaagaaaacttctgctgggtgcggtggctcacgcctgtaatcccaacactttgggaggccgaggcaggtggatcatgaggtcagaagttcgagatggtgaaaccccatctctactaaaaatacaaaaattagccgggtgtggtggcacacacctgtagtcccagctacttgggaggttgaggcatgaggcaggagaattgcttgtacccaggaggtagaggttgcggtgagccaagatcgtgccatccagcctgggtgacaagagcgaaactccgtc

SEQ ID NO: 203862 - DNA, 409 bp, Homo sapiens
  Payload ID: 20207
  Gene Name: zinc finger protein 793
  ENST ID: ENST00000587490
  CDS Start-End: 1-251
tgtcattcaaagatgtggttgtgggcttcacccaagaggagtggcaccggctgagtcctgctcagagggccctgtaccgggatgtgatgctggaaacctatagcaacctcgtctcagtgggttatgaaggcaccaaaccagatgtgatcctcagactggagcaggaagaagcaccatggattggtgaggcagcatgcccgggctgccactgttgggccttgaaagtcctccgagagcttcagccacgttaatgactcttcaacctccatgcaaccccaccgcccatatctgagtgtttttctcggctctacttgattgcacctctgcccttatgtgcttggtccatctctctttctccagaatctttcccatgcaggtattcttacaaataaaagcttctatgattctc

SEQ ID NO: 203863 - DNA, 1240 bp, Homo sapiens
  Payload ID: 20207
  Gene Name: zinc finger protein 793
  ENST ID: ENST00000586187
  CDS Start-End: 1-179
gttatgaaggcaccaaaccagatgtgatcctcagactggagcaggaagaagcaccatggattggtgaggcagcatgcccgggctgccactgttgggtggctgtacctttttatattacaaccagtaatgcacaagggttccagtttcttcacaacctcgccatccatcatttgttataatcatgtgccacataatgatgttttggtcaatgagggaccacatatacagtagtggtcccataagattatagcagagctgaaaattttctttttataaaattgtatttattattattattttttttccaacttttatggagctgaaaagtttatactgcctaatgacattttgatgatcctggcactgtgtgtacctaggctaatgtgtttgtgtcttagtttttaacaaaaaagtctggaggctgaggcaagagaattgcttgatctgccctattaattgcaattttcacagttaactagtactatttttatttaaataatattacctgggaagcggaggttgcagtgagttaagatcacgccactgcactccagcctgggcgagagagtgagactctgtctcaaaataaaataaaattaaattaaaataaaaaaattaaaaaaatttttaagtagaagattatagaataaggatataaagaaaatatttgtgtacagctatacaatgtgtttgaagctaatttattacaagagagtcaaaacatttttaaaaattaaaaggtttataaagaaattatagtaagctaaggttaatttattaccgacaaaaaaattcaaataaatttagtgtagcctaagcatacagtacatataaagtctacagtagtatacagtactgccctagccttcacattcactcaccgctcagtcactgactcacccggagtaacttccagtcttgcaagctccatccacgacagcagtgctgagaagcaggagcccctgagcttggagacgcaggaagagccctgggaggcccagatcaaagggaggcagtcagctcatggagccgaggaatgttctgctgacacccaccccgagggtatccgtccagaatcaaatcagaagagcaatcccgagtgcccacctcacggtctgaagcacctcctcctacacccggacccaaacacgaggtcggctcaaggaggcactgaggtcacgacagtcagggtcctgcgctgcttgtcgcatgcagtctccttccccgaaccgccgcctgc

SEQ ID NO: 203864 - DNA, 3869 bp, Homo sapiens
  Payload ID: 20207
  Gene Name: zinc finger protein 793
  ENST ID: ENST00000587986
  CDS Start-End: 505-900
ggcacggtctctgaagaagatggattgggagtgtgtgggaatcaataaatgcgagttctgtgaaatgtcttgattttcagggtgcatggggctctttctggcaaaggtaatgacatacgcatctgtgccagcatcccaagagtgaggctggtttctggaaatccattctgactctgtgacagcggggatggatgtgaccttgcccgtggttagaaaacaaatttactgagttctctgggtgccctgcagacctttggatcctgccaccttgctggacgggagggctctctagctcctgccagcccttagagccacaggaccttggtcacaacatctacagaaggccctgcagctaagtgatctaatccaggatcatatgctgcctttaggtgacacatccctttagtctcctttaatcaggagcagtttctcagtgttcatcttccatgaagtcgacatttttgaagagtataggtgtcagatctttttcaagaacagcagaaaatgatcgaataccagatacctgtgtcattcaaagatgtggttgtgggcttcacccaagaggagtggcaccggctgagtcctgctcagagggccctgtaccgggatgtgatgctggaaacctatagcaacctcgtctcagtgggttatgaaggcaccaaaccagatgtgatcctcagactggagcaggaagaagcaccatggattggtgaggcagcatgcccgggctgccactgttggggtaagtgtgataaatctagcaaaaggggtactgaaggaggctggcacctttggaattttgttcagcattcttctcttaaaagccttgaaagtcctccgagagcttcagccacgttaatgactcttcaacctccatgcaaccccaccgcccatatctgagtgtttttctcggctctacttgattgcacctctgcccttatgtgcttggtccatctctctttctccagaatctttcccatgcaggtattcttacaaataaaagcttctatgattctcctgttcctgcttcctattctctgttgtgacaaactttccagataaaatgcttcagagctacctgctttccctaatttctgcactcaaatttaaatcactcccatagacagatgactgtgggatcagagaagaggaagcagtgaattccatgttggggtggggaggtgtgaaggaaatggctgagctgggcccatcttaaccactgctgattaaccctcagactcactgcccctctcccttcagctctgtaagacattccagcaatatccattgtaccctgagggctgatggatggcccactcttagggatgcctctgaacttctgcttctggcgctctctggagtgtgttcctccattaaactgtgctcttcagctgtcctgagactgtggtatcccggttatcagttgccctcctcttcttttcttctcctcttctgaaaatttcgtaactgcaaattccacaagaatgtatctagtcagcctcccgtttttccagctactctgttactatctatttccctggctcaaacccagcattttccttccaaggaacaattgcattttctgttttccataacttggttctctttccagtggtgtaatcctctcaaagaactcacccattctgagagtacatgattctcacaaccagcccttttgccatgttgggcccttttttcccccttgcactgcccacccccgcatttaaccagtctgtggattacactacaggtgtgcacttaccctgttctttgtgtgtcaaaaactaaaatcatctttatttgtccttgctacccctgccacacacacactcacactcacacacacacacacacacgcacacacacacaccacttcatcttgcttattattccagggctttgctaccgtgtggtcattttgaatcttctgcctttaccactcactctaactgttccattcatatgtgtggttttgttgattttttttcttctgagaaatggctttaaatcttcctctctgctttttttttttctttttgagacagtgtctcactctgtcacccaggctggagtgcagtggcatgatcatggctcactgcagccttgacctcctgggctcaagcgatcctcccacctcttaacctcccgagtaactgggattatattcacgtgctaccacacctggctaattttcattttttttgtagagaaggggttttgcagtgccgctcaggctggtctcaaactcctgggctcaagcagtccacctgctttggcttcccaaagtgctggatttactggcatgagccaccatgcccagtccttctccacttttttttgttgttattgttcagatgaagtcttgttctgtcacccaggctggaatgcagtggtgccatctcagctcactgcaacctccgcctcctgggtttaagcaattctctgcctcagcctccggagtagctgggattacaggcacgtgccaccacccccagctaatttttgtatttttagtagagatggggtttcaccatcttggccaggctggtcttgatctcctgacctcgtgatccacccgccttagcctcccaaagtgctgggattactggcgtgagccactgcacccagccccacttttaattttccactgatatctcctaaaatgagacccagattatctcatgactgaatgtctttaagtgaggggttattaattatttttgtgccatggacttcttaggcattcttttgaaggctatagacctcacttctatgtataaaaatataataacgttcataagattataaaataaatgactaaagtacagtaattatcaaaataagctagaaaatagttatcaaaaaaaaatttttttttttttagatggagtttcactctgtcgcccaggccggagtgcaatggcatgatctcagctcactgcagcctcctcctcctgggttcaagcgattctcctgcctcagcctcccgagtagctgggactacaggtgtgtgccaccacgcccagcttattttctatttttagtagagactgggtttcatcatgttggtcaggctagtcttgaactcctgacgtcagatgatccacctgcctcggcctcccaaaatgctgggattacaggcgtgagccaccgcgcccagcttcaaaatattttcaaaatgtgcaatataatagtagatgtactttttcatttatacgttaatgaggcctagcatcaggtctaataactgtcatgatctcaaagaagagatgattataaacataataatgtgacatgaaaataacaatattcacaaactagtatcaagtcacaggaaccactaataccactgtgttttgttgcttatattcatattcaaaggaaatgttcaattgtagttggaactcagtgaaaacaaaaatgtaatttcttttctatcaaagttcacaagccccctgttttctgccaagttaagaactcttgcttaagtcctagttagctttgttgattttattttttaatctgtttcaccttagagtgctttaccgtttatattgtaactaactagcccaacatgatattcccttggatgactgctataccagtgcttgttaagctccaaggtgtttggaatcaccggggcatcttgttgaaatgcagagtctgattaagtaggtctggggcggtgccttagattctgcacatctaacaagctccaagtaaggccaaaattgccacttgaagacccacatgctggatagcaaggtactgtataacatttaaccttctttcttctgtaacagggatcagcaaactgtggcctaccgattggccacctgctttgtgaataaagttttattagaacacaa

SEQ ID NO: 203865 - DNA, 1915 bp, Homo sapiens
  Payload ID: 20207
  Gene Name: zinc finger protein 793
  ENST ID: ENST00000589319
  CDS Start-End: 416-832
ggctctttctggcaaaggtaatgacatacgcatctgtgccagcatcccaagagtgaggctggtttctggaaatccattctgactctgtgacagcggggatggatgtgaccttgcccgtggttagaaaacaaatttactgagttctctgggtgccctgcagacctttggatcctgccaccttgctggacgggagggctctctagctcctgccagcccttagagccacaggaccttggtcacaacatctacagaaggccctgcagctaagtgatctaatccaggatcatatgctgcctttaggtgacacatccctttagtctcctttaatcaggagcagtttctcagtgttcatcttccatgaagtcgacatttttgaagagtataggtgtcagatctttttcaagaacagcagaaaatgatcgaataccagatacctgtgtcattcaaagatgtggttgtgggcttcacccaagaggagtggcaccggctgagtcctgctcagagggccctgtaccgggatgtgatgctggaaacctatagcaacctcgtctcagtgggttatgaaggcaccaaaccagatgtgatcctcagactggagcaggaagaagcaccatggattggtgaggcagcatgcccgggctgccactgttgggaagacatctggcgagttaatatccagaggaaaagacggcaagacatgcttttgaggccaggcgcagccataagcaagaaaacattgcccaaggagaaaagctgtgaatataataagtttgggaaaatatcacttctgagcactgatcttttttcttcaatccagagccctacatggtgaaaccccgtctctactaaaaatacaaaaattagctgggcatggtggcaggcacctgtgatcccagctactcgggaggctgaggcaggagaatcacttgaacccaggaggcagaggttgcagtgagccaagatcgcgccattgcactccaacctgggcaacagagcaaaaagattccatctcaaaagaaaagaaaagaaatctgttaatattattaaaatatttatgtcactttggagaatcttcccttagaagtaaaagctccaatacataaaagacagatgaacatgtgaacatggacatttattgtaaaaattgttcttaatggcaaaaaaacccccaaaaccaaagcaaacactagaatcaaagtaaatacccatcaactgggaaattgtagaaaggaaaaaactatagtgtatccattccatagaatgttaatatagccattaaggtggacaaattaaaactatgctagtggacttgagtggaattccacaatgttctcttgagtgaaaaatgcaaggtagatattaagtatgttaaatatgactccatttttttaaatcattaacaaaatgtctctaggtgtttgtcagcaataaacggtatctatatatgtttatttgattttatgtgcatgaagaaaagtatagaagagtatgcattgacttggagggaggtgggtaatgcaggtaggttatgggggagtcaggggtgtagggaaaaggaaaaccaaaaaagaaaaatacataaatgactgaatcacgggtgataccacaaatgtgtgagttagtaaatttggctggggatgggggagctagaattttgctaatttgtggggatgttcatggtatatattgtaaaaagggaaaatttcataataatgtatacgattctatttttaaaaaaagtaaaaactcctgtgtgtgtatatatgcatgtggatgtttatatgaacatagaaaagtgtagaagaatacacacgaaggtgttaacattcattggttaccttggtggagaagggtaataagttttctgaatacctttgcattgtcttgttcacatatattgcttttgtaatttgaa

SEQ ID NO: 203866 - DNA, 4549 bp, Homo sapiens
  Payload ID: 20207
  Gene Name: zinc finger protein 793
  ENST ID: ENST00000588578
  CDS Start-End: 487-768
aactgaagggttaagagattcggcgtctgagcctcgcggggcctcagtggtggcggacagaggtttgcgggagctctttctggcaaaggtaatgacatacgcatctgtgccagcatcccaagagtgaggctggtttctggaaatccattctgactctgtgacagcggggatggatgtgaccttgcccgtggttagaaaacaaatttactgagttctctgggtgccctgcagacctttggatcctgccaccttgctggacgggagggctctctagctcctgccagcccttagagccacaggaccttggtcacaacatctacagaaggccctgcagctaagtgatctaatccaggatcatatgctgcctttaggtgacacatccctttagtctcctttaatcaggagcagtttctcagtgttcatcttccatgaagtcgacatttttgaagagtataggtgtcagatctttttcaagaacagcagaaaatgatcgaataccagatacctgtgtcattcaaagatgtggttgtgggcttcacccaagaggagtggcaccggctgagtcctgctcagagggccctgtaccgggatgtgatgctggaaacctatagcaacctcgtctcagtgggttatgaaggcaccaaaccagatgtgatcctcagactggagcaggaagaagcaccatggattggtgaggcagcatgcccgggctgccactgttgggggatcagcaaactgtggcctaccgattggccacctgctttgtgaataaagttttattagaacacaaccacattcttacgtttacatgttgtctatattttcatggtatggcgggagagttgagtcattgtgacggagaccatatggcccacaaagcctttactttctgactccttaagaataagtttgccaacctctgctctgtaatatcctattttctttgaaattattggtctctatactctatgatatattgaattccatttgtgccagtgttcagaatcctctttactcatagaacactcttccctgcgtttgtgctttgggttatggttcatgttctctatttgtgtgctgtgcactctttaaattttgagagcatttcttaagtagtatgaagtttcataaggatgattcactgtactttctccagaagacatctggcgagttaatatccagaggaaaagacggcaagacatgcttttgaggccaggcgcagccataagcaagaaaacattgcccaaggagaaaagctgtgaatataataagtttgggaaaatatcacttctgagcactgatcttttttcttcaatccagagccctagtaactggaacccttgtggaaagaatttgaaccataatttagacttgattggttttaagagaaactgtgcaaaaaagcaagatgagtgttatgcttatgggaaattgcttcagcgtataaatcatggtagacgacctaatggagaaaagccccggggttgcagtcactgtgagaaagctttcacccagaacccggcacttatgtataaaccagcagtaagtgattctctcttgtacaaacggaagagggttccacctacagaaaaaccccacgtctgtagtgagtgtgggaaagccttctgctacaagtctgaattcattaggcatcagagaagtcacactggggagaagccttatggctgcactgactgtgggaaagccttttcacataagtcaaccctcatcaaacaccagagaattcacactggggtaagaccctttgaatgttttttttgtgggaaagcctttacccagaagtcacaccgcacagaacatcagagaacacacacaggagagagaccctttgtctgcagtgaatgcgggaaatcgtttggtgagaagtcatacctcaatgtacatcgaaaaatgcacacaggagaaagaccgtatcgttgcagagaatgtggaaaatccttcagccagaagtcatgcctcaataaacattggagaactcacacaggagagaagccctatgggtgcaatgaatgtgggaaagctttctaccagaagccaaacctcagcagacatcagaaaattcatgctcggaagaatgcctacaggaatgaaaacttaataattgtgggaaatacttgagcaaaatatctggtttcatggtatgtagggaattttttttttttttttttgagttggaatctcactttgtcacccaggctggagtgcagtggcgcgatctcggcttactgcaagctctgcctcccgggttcacgccattctcctgcctcagcctcccgagtagctgggactacaggtgcccaccaccatgcccggctaattttttttttgtatttttagtagagacggggtttcaccgtgttagccaggatggtctcgatctcctgaccttgtgatctgcccgccttgtcctcccaaagtgctgggattacaggcgtgagccaccgcgcctggccggtatgtagggaatttatccttaggagaaatcttatcattttaatgaatttgaacagtgtgtttttattttatttatttatttattttgagttgtattctctgtttcccaggctggagtgcaatggcactatctcggctcactgtaacctcagcctcccaggttcaagcagttctcctgcctcagcctcccaagtagctgggattacaggcacctgccaccacgcctggctaatttttgtatttttagtagagatggggtttcaccatgttggtcaggctggtctctttggctaggctggtctcgaactcctgacctcgtgataccccccaaccccccgcccttggcctcccaaagtgttgggattacaggcatgagccaacgcgcccaaccgacagtgttgtatcataatggaaatcatgatctaattgtgatacaaacttttctagaaaatactttctcaaacataagcatggacaccctggcatgtaaacgtttaaaaatgtattaaatggaataacagcagaatacaaaatatctgtgaagagacttaaaggcatactctggtatattccacagtgagccatacaatcagcattatttgtattttggagttgtaaatgtgaaattaacataaaatgtgaatatcagacacatgtcacacaacatatagaatgccattcagaaaacttttccactttaaatatcatcattgtcttttgatgtcttaacaatacaaaaaaataacaacaacatggcccactattgttaaaagaactttattataccagctacatttttccacctttttgtaatacatgtaaatggctatagaggttgttactgtcctctgcagaaataataaagcagtgtttttaaatgtatttggataatttggccaaaaattttactaaaatgtagttatttatattaaaaatgcaagctaaggaatagtttaagaacctgatactgggtaaatgaaacactgtaaactatttgacaaaatgtagtgtcaccctggtgtacagtacactgttcatattttcttagtcttgcttaaaatatcttgtagcaaattagtagcattgctacactattctagatacactattctatatacaggttgtataactcagaaatgtttcatgcgtagaccactgaaggagaatttcttttctctctatccctctgcaaattaattcaagaatattcatttttttcatataaatttccttgcaagtgtcctagacactaaatcccaaggttttaattatttcaatgtttggaaagaagtctgcttccctgagttgctatgtcatccatattagaaaataaatggccatgtggaatctacatttttcaagatttccctccatgtaagactgcctgatccagaatgagaaaggagacataaccacagatatcaatatgattttttaagtgataaaaagatacctcatacaactctaatcaacatattttttaaaaagaggaggtggatgcttttctaataaacttaagttatgaaaactgcaataagaagtagaaaacttggtaggatagttaacattgaaaaactcaaaaaagctattaaagatctataatgggaaaatgctccaggctcagaagagttcatgcttagttctatcttttaaagaaagagtaataccagtgttatttattatatggatgtaatacaatccatgaactgtactcatttattttattaagtcagaataaattttaacaccaaaatcaaatacagatagttgaaaaaagaaaacttctgctgggtgcggtggctcacgcctgtaatcccaacactttgggaggccgaggcaggtggatcatgaggtcagaagttcgagatggtgaaaccccatctctactaaaaatacaaaaattagccgggtgtggtggcacacacctgtagtcccagctacttgggaggttgaggcatgaggcaggagaattgcttgtacccaggaggtagaggttgcggtgagccaagatcgtgccatccagcctgggtgacaagagcgaaactccgtcaaaaaaaaaaaaaaaaaaagaaaa

SEQ ID NO: 203867 - DNA, 625 bp, Homo sapiens
  Payload ID: 20207
  Gene Name: zinc finger protein 793
  ENST ID: ENST00000586138
  CDS Start-End: 465-625
aatgacaagggaactgaagggttaagagattcggcgtctgagcctcgcggggcctcagtggtggcggacagaggtttgcgggagtcagtggcacggtctctgaagaagatggattgggagtgtgtgggaatcaataaatgcgagttctgtgaaatgtcttgattttcagggtgcatggggctctttctggcaaaggtaatgacatacgcatctgtgccagcatcccaagagtgaggctggtttctggaaatccattctgactctgtgacagcggggatggatgtgaccttgcccgtggttagaaaacaaatttactgagatctaatccaggatcatatgctgcctttaggtgacacatccctttagtctcctttaatcaggagcagtttctcagtgttcatcttccatgaagtcgacatttttgaagagtataggtgtcagatctttttcaagaacagcagaaaatgatcgaataccagatacctgtgtcattcaaagatgtggttgtgggcttcacccaagaggagtggcaccggctgagtcctgctcagagggccctgtaccgggatgtgatgctggaaacctatagcaacctcgtctcagtgggttatgaaggcaccaaacc

SEQ ID NO: 203868 - DNA, 1488 bp, Homo sapiens
  Payload ID: 20207
  Gene Name: zinc finger protein 793
  Uniprot ID: Q6ZN11
  ENST ID: ENST00000587143
  CDS Start-End: 236-1456
aggacgaccaatttcagattcagggcgcggatgcagcataaatgggaaggcacggtttgagaaacggctctttctggcaaaggtaatgacatacgcatctgtgccagcatcccaagagtgaggctggtttctggaaatccattctgactctgtgacagcggggatggatgtgaccttgcccgtggttagaaaacaaatttactgagtgtcagatctttttcaagaacagcagaaaatgatcgaataccagatacctgtgtcattcaaagatgtggttgtgggcttcacccaagaggagtggcaccggctgagtcctgctcagagggccctgtaccgggatgtgatgctggaaacctatagcaacctcgtctcagtgggttatgaaggcaccaaaccagatgtgatcctcagactggagcaggaagaagcaccatggattggtgaggcagcatgcccgggctgccactgttgggaagacatctggcgagttaatatccagaggaaaagacggcaagacatgcttttgaggccaggcgcagccataagcaagaaaacattgcccaaggagaaaagctgtgaatataataagtttgggaaaatatcacttctgagcactgatcttttttcttcaatccagagccctagtaactggaacccttgtggaaagaatttgaaccataatttagacttgattggttttaagagaaactgtgcaaaaaagcaagatgagtgttatgcttatgggaaattgcttcagcgtataaatcatggtagacgacctaatggagaaaagccccggggttgcagtcactgtgagaaagctttcacccagaacccggcacttatgtataaaccagcagtaagtgattctctcttgtacaaacggaagagggttccacctacagaaaaaccccacgtctgtagtgagtgtgggaaagccttctgctacaagtctgaattcattaggcatcagagaagtcacactggggagaagccttatggctgcactgactgtgggaaagccttttcacataagtcaaccctcatcaaacaccagagaattcacactggggtaagaccctttgaatgttttttttgtgggaaagcctttacccagaagtcacaccgcacagaacatcagagaacacacacaggagagagaccctttgtctgcagtgaatgcgggaaatcgtttggtgagaagtcatacctcaatgtacatcgaaaaatgcacacaggagaaagaccgtatcgttgcagagaatgtggaaaatccttcagccagaagtcatgcctcaataaacattggagaactcacacaggagagaagccctatgggtgcaatgaatgtgggaaagctttctaccagaagccaaacctcagcagacatcagaaaattcatgctcggaagaatgcctacaggaatgaaaacttaataattgtgggaaatacttgagcaaaatatctggtttcatggtatgtagggaa

SEQ ID NO: 203869 - DNA, 1525 bp, Homo sapiens
  Payload ID: 20207
  Gene Name: zinc finger protein 793
  ENST ID: ENST00000627814
  CDS Start-End: 443-1525
attcaggatgggacgaccttataccgcggctctttctggcaaaggtaatgacatacgcatctgtgccagcatcccaagagtgaggctggtttctggaaatccattctgactctgtgacagcggggatggatgtgaccttgcccgtggttagaaaacaaatttactgagttctctgggtgccctgcagacctttggatcctgccaccttgctggacgggagggctctctagctcctgccagcccttagagccacaggaccttggtcacaacatctacagaaggccctgcagctaagtgatctaatccaggatcatatgctgcctttaggtgacacatccctttagtctcctttaatcaggagcagtttctcagtgttcatcttccatgaagtcgacatttttgaagagtataggtgtcagatctttttcaagaacagcagaaaatgatcgaataccagatacctgtgtcattcaaagatgtggttgtgggcttcacccaagaggagtggcaccggctgagtcctgctcagagggccctgtaccgggatgtgatgctggaaacctatagcaacctcgtctcagtgggttatgaaggcaccaaaccagatgtgatcctcagactggagcaggaagaagcaccatggattggtgaggcagcatgcccgggctgccactgttgggaagacatctggcgagttaatatccagaggaaaagacggcaagacatgcttttgaggccaggcgcagccataagcaagaaaacattgcccaaggagaaaagctgtgaatataataagtttgggaaaatatcacttctgagcactgatcttttttcttcaatccagagccctagtaactggaacccttgtggaaagaatttgaaccataatttagacttgattggttttaagagaaactgtgcaaaaaagcaagatgagtgttatgcttatgggaaattgcttcagcgtataaatcatggtagacgacctaatggagaaaagccccggggttgcagtcactgtgagaaagctttcacccagaacccggcacttatgtataaaccagcagtaagtgattctctcttgtacaaacggaagagggttccacctacagaaaaaccccacgtctgtagtgagtgtgggaaagccttctgctacaagtctgaattcattaggcatcagagaagtcacactggggagaagccttatggctgcactgactgtgggaaagccttttcacataagtcaaccctcatcaaacaccagagaattcacactggggtaagaccctttgaatgttttttttgtgggaaagcctttacccagaagtcacaccgcacagaacatcagagaacacacacaggagagagaccctttgtctgcagtgaatgcgggaaatcgtttggtgagaagtcatacctcaatgtacatcgaaaaatgcacacaggagaaagaccgtatcgttgcagagaatgtggaaaatccttcagccagaagtcatgcctcaataaacattggagaactcac

SEQ ID NO: 203870 - DNA, 2583 bp, Homo sapiens
  Payload ID: 20208
  Gene Name: zinc finger protein 799
  Uniprot ID: Q96GE5
  ENST ID: ENST00000430385
  CDS Start-End: 202-2133
gtcaatcaggcgcgcttcccagaggagtgtgtggttgaaaaagcccgcggcgtcttctccacccacctgcgctgggcgctcggtgctcggctctgtagctaagagacgacctggaagttccgtggcagcctgtgtcccgcgggaacccgcattggcagcgggagccgtccggaggacctgggacaccgcggaagtcgggaaatggcctcagtggctttagaggatgtggctgtgaacttcacccgagaagagtgggctttgctgggtccttgtcagaagaatctctacaaagatgtgatgcaggaaaccatcaggaacctggattgtgtaggaatgaaatggaaagaccagaacattgaagatcaatatagatatcccaggaaaaatctaagatgtcgtatgttagagagatttgttgaaagtaaagatggaactcaatgtggagaaacatctagccagattcaagatagtattgtgaccaagaacactcttcctggagtaggtccatatgaaagccgtatgagtggagaagtcatcatgggtcattcatcccttaattgttacatcagagttggtgctgggcacaaaccatatgagtatcatgaatgtggagagaagccagatacgcataaacaacgtgggaaagccttcagttaccacaactcacttcaaacacatgagaggcttcacactggaaagaaaccatataattgtaaagaatgtgggaagtccttcagttctttgggaaaccttcaaagacacatggcagtgcagcgtggagatggaccttataaatgtaagttgtgtgggaaagcgtttttttggcccagtttattacatatgcatgagagaacgcacactggagagaaaccatatgaatgtaagcagtgttctaaagccttttctttttacagttcctatctaagacatgaaagaacacatactggggagaaactgtatgaatgtaaacagtgttctaaagccttccctgattacagttcttgtctaagacatgaaagaactcacactggaaagaaaccctatacatgtaaacaatgtgggaaagccttcagtgcttccacttcccttcgaagacacgaaacaactcacactgatgagaaaccctatgcatgtcagcaatgtgggaaagcgtttcatcatctgggaagctttcaaagacacatggtaatgcacacgagagatggacctcataagtgtaagatatgtggaaaaggctttgattgtcctagttcactgaaaagtcatgaaagaactcacactggagagaaactctatgaatgcaagcagtgtgggaaagcgttatctcatagctcaagctttcgaagacacatgacaatgcacactggagatggacctcacaaatgcaagatatgtgggaaagcctttgtttatcccagtgtatttcaaaggcatgaaaagactcacactgcagagaaaccctataaatgtaaacaatgtggcaaagcctaccgtatttccagttctcttcgaaggcatgaaacaactcatactggagagaaaccctataaatgcaaatgtgggaaagcctttattgatttctattcctttcaaaatcacaaaacaactcatgctggagagaagccatatgagtgtaaggaatgtgggaaagcattcagttgtttccaatacctttctcaacatagaaggactcacacaggagagaaaccttatgagtgtaacacatgtaagaaagccttcagtcattttggtaacttaaaagtacatgaaagaattcactctggagagaagccgtatgaatgtaaggaatgtgggaaagcattctcttggctcacttgctttctacgacatgaaagaattcacatgagagagaaaccctatgagtgtcaacaatgtggtaaagccttcactcattcccgttttcttcaaggacatgaaaaaactcatactggagagaacccgtatgaatgtaaggaatgtgggaaagcatttgcttctctcagttccttgcatagacataaaaagactcactggaaaaaaactcacactggagagaacccgtatggatgtaaggaatgtgggaaagcatttgcttctctcagttccttgcatagacataaaaagactcactagcattctctctaaatgtatggaatgtgggaaagcatttattaattttatttcatttcagatacttgtacgaaacacattggagatagaccctgtgaatgtaagcacttggtaaaaccttaagtaatttcagtttctttccagtacagtcatcccttgatacctgctgggtattggttccagcactccgtgagccatgtccagtcccttttataaaatgacatatttgtatgtaacttacccacatcctcttgtatactctcaattatgtctagattacttaaaatacctcatgcattgtaaaagctatgcaaatagttgttctattgtattgtttagggactcatgataaggaaaagagtctatgtattttcagtatagatgcagtaattgtcagcctatcaacatagtatagtcagccagaacattaaagtttctttgtttcaactctca

SEQ ID NO: 203871 - DNA, 3036 bp, Homo sapiens
  Payload ID: 20208
  Gene Name: zinc finger protein 799
  ENST ID: ENST00000419318
  CDS Start-End: 751-2586
aagggctactccgggatctacggacccgggttcccctggcgtaggtcggccctcggccgcagggtggggctgggcatgcagccgggaccccgggcgtcctgtcccgttcctgcgcggcgactgcggccccggcgccctctctgggcagctccgcgcccgcagcctcgcgtctcccgagattgtgcggctgtaagcaacacaggttcgcggcccgactcactgcaccgagacgctgagggctgcagcagaaacagtttaatagccagagaggggaggacaccccagatccgcctccctgagggatttggggtctggacgggggcggctgggtgtagggtcgttggttggtggggaagtgaggggtgaatcctgggacaggaggtgaagaaaccgcattctgctgaatgggctccctcgttgggacttcaacctgattggcgccagcctttgctgggattcaggatctgagaactccggcgactcttgagcagttctcagagatcttatccccaggcacaatggggaagccggcggtcagcgtctgctgtgacctgactctcagggaggcggccccttgaggcagcggggctgagggcacctggttaatatctaactgcaatctcgcctccagcctggctcgcagttcctgtgaacccggcctcagtggctttagaggatgtggctgtgaacttcacccgagaagagtgggctttgctgggtccttgtcagaagaatctctacaaagatgtgatgcaggaaaccatcaggaacctggattgtgtaggaatgaaatggaaagaccagaacattgaagatcaatatagatatcccaggaaaaatctaagatgtcgtatgttagagagatttgttgaaagtaaagatggaactcaatgtggagaaacatctagccagattcaagatagtattgtgaccaagaacactcttcctggagtaggtccatatgaaagccgtatgagtggagaagtcatcatgggtcattcatcccttaattgttacatcagagttggtgctgggcacaaaccatatgagtatcatgaatgtggagagaagccagatacgcataaacaacgtgggaaagccttcagttaccacaactcacttcaaacacatgagaggcttcacactggaaagaaaccatataattgtaaagaatgtgggaagtccttcagttctttgggaaaccttcaaagacacatggcagtgcagcgtggagatggaccttataaatgtaagttgtgtgggaaagcgtttttttggcccagtttattacatatgcatgagagaacgcacactggagagaaaccatatgaatgtaagcagtgttctaaagccttttctttttacagttcctatctaagacatgaaagaacacatactggggagaaactgtatgaatgtaaacagtgttctaaagccttccctgattacagttcttgtctaagacatgaaagaactcacactggaaagaaaccctatacatgtaaacaatgtgggaaagccttcagtgcttccacttcccttcgaagacacgaaacaactcacactgatgagaaaccctatgcatgtcagcaatgtgggaaagcgtttcatcatctgggaagctttcaaagacacatggtaatgcacacgagagatggacctcataagtgtaagatatgtggaaaaggctttgattgtcctagttcactgaaaagtcatgaaagaactcacactggagagaaactctatgaatgcaagcagtgtgggaaagcgttatctcatagctcaagctttcgaagacacatgacaatgcacactggagatggacctcacaaatgcaagatatgtgggaaagcctttgtttatcccagtgtatttcaaaggcatgaaaagactcacactgcagagaaaccctataaatgtaaacaatgtggcaaagcctaccgtatttccagttctcttcgaaggcatgaaacaactcatactggagagaaaccctataaatgcaaatgtgggaaagcctttattgatttctattcctttcaaaatcacaaaacaactcatgctggagagaagccatatgagtgtaaggaatgtgggaaagcattcagttgtttccaatacctttctcaacatagaaggactcacacaggagagaaaccttatgagtgtaacacatgtaagaaagccttcagtcattttggtaacttaaaagtacatgaaagaattcactctggagagaagccgtatgaatgtaaggaatgtgggaaagcattctcttggctcacttgctttctacgacatgaaagaattcacatgagagagaaaccctatgagtgtcaacaatgtggtaaagccttcactcattcccgttttcttcaaggacatgaaaaaactcatactggagagaacccgtatgaatgtaaggaatgtgggaaagcatttgcttctctcagttccttgcatagacataaaaagactcactggaaaaaaactcacactggagagaacccgtatggatgtaaggaatgtgggaaagcatttgcttctctcagttccttgcatagacataaaaagactcactagcattctctctaaatgtatggaatgtgggaaagcatttattaattttatttcatttcagatacttgtacgaaacacattggagatagaccctgtgaatgtaagcacttggtaaaaccttaagtaatttcagtttctttccagtacagtcatcccttgatacctgctgggtattggttccagcactccgtgagccatgtccagtcccttttataaaatgacatatttgtatgtaacttacccacatcctcttgtatactctcaattatgtctagattacttaaaatacctcatgcattgtaaaagctatgcaaatagttgttctattgtattgtttagggactcatgataaggaaaagagtctatgtattttcagtatagatgcagtaattgtcagcctatcaacatagtatagtcagccagaacattaaagtttctttgtttcaactctca

SEQ ID NO: 203872 - DNA, 576 bp, Homo sapiens
  Payload ID: 20208
  Gene Name: zinc finger protein 799
  ENST ID: ENST00000595766
  CDS Start-End: 199-474
aatcaggcgcgcttcccagaggagtgtgtggttgaaaaagcccgcggcgtcttctccacccacctgcgctgggcgctcggtgctcggctctgtagctaagagacgacctggaagttccgtggcagcctgtgtcccgcgggaacccgcattggcagcgggagccgtccggaggacctgggacaccgcggaagtcgggaaatgcgtctcactctgttgtccaggctggagtgcagtggcacgatctcagctcactgcaacctccgcctcctgcgttcaagcgattctcctgcctcagcctcccgagtagctgggactacaggcctcagtggctttagaggatgtggctgtgaacttcacccgagaagagtgggctttgctgggtccttgtcagaagaatctctacaaagatgtgatgcaggaaaccatcaggaacctggattgtgtaggaatgaaatggaaagaccagaacattgaagatcaatatagatatcccaggaaaaatctaagatgtcgtatgttagagagatttgttgaaagtaaagatggaactcaatgtggagaaacatctagccagat

SEQ ID NO: 203873 - DNA, 9128 bp, Homo sapiens
  Payload ID: 20209
  Gene Name: zinc finger protein 8
  Uniprot ID: P17098
  ENST ID: ENST00000621650
  CDS Start-End: 132-1859
agttgtagtcgccgcgtcgccggtgcggccgccattgtccggcgttcggcgagtcgggtggtccctttggctggagtgcctctctggtctggggatcacctcaggcgctgtccttcactgggcgatccagcatggaccccgaggacgaaggggtagcgggagtgatgtctgtggggccgccggcggcccggcttcaggaaccagtgaccttccgggatgtggctgtggactttacccaggaggaatgggggcagctggaccctacccagaggatcctctaccgtgacgtgatgctggagacctttggtcacctgctctccataggtcctgagcttccgaagcctgaagtcatctcccagctggagcaagggaccgagctatgggtggctgagagaggaaccacccagggctgccatccagcctgggagcctcgatctgaaagccaagcatcacgcaaggaagagggcctgcctgaagaggagccatcccatgtcacgggaagggaaggattcccgacagatgctccttatcccaccacgttagggaaagacagggagtgtcagagccagagtctggcactcaaggagcagaataacttgaagcagttggaatttggcctcaaggaagcaccagttcaagatcaaggctacaaaactctcagactcagggaaaactgcgtcctgagttcaagcccaaatccattcccagagatctctagaggggagtatttgtatacttacgactcacagattacagactcagaacataactccagcttagtcagtcagcagacaggctccccaggaaaacagcccggtgaaaacagtgactgtcacagagattccagtcaggccattccaattacggaactcacaaaaagccaggtgcaggacaaaccctacaaatgtactgactgtgggaagtcgtttaaccataacgcacacctcaccgtgcacaagaggattcatacgggagaaagaccttatatgtgcaaggagtgtgggaaagccttcagccagaactcctccctcgtccagcatgagcgcatccacactggagacaagccctacaagtgtgccgaatgtgggaagtctttctgccatagtacacaccttaccgtccatcggaggattcacactggggagaagccctatgagtgtcaggactgtgggagggccttcaaccagaactcctccctggggcggcacaagaggacacacactggggagaagccatacacctgcagtgtgtgtgggaaatccttctctcggaccacttgccttttcctgcacctgagaactcacaccgaggagaggccctacgagtgtaaccactgcgggaagggcttcaggcacagctcatccctggcccagcaccagcggaagcacgcgggggagaagccctttgagtgccgccagaggctgatctttgagcagacgccagctctcacaaagcatgaatggacagaagccctgggctgtgacccacctttgagtcaagatgagaggactcaccgaagcgacagacccttcaaatgtaatcagtgtgggaagtgtttcattcagagctctcacctcatccggcaccagataactcacaccagagaggagcagccccatgggcgaagccggcggcgtgaacaatcctcgagcaggaactcacacctggttcagcatcaacacccgaactccagaaagagctctgcaggcggagcaaaggcagggcagccggaaagcagagccctggctttgtttgacatccaaaaaatcatgcaagagaaaaaccctgtgcacgttattggggtggaagagccttctgtgggtgcttccatgttatttgacatcagagaatccacataggagagaaactttgctgatgacttttaaccacaagtaaaaaatgtggtaagtccacatagtgtactcatggaaggaggggctgggggtagaaatgtcatgggtgacttctgactttctaaggaaatgatgcttcccaagcacccgaggttggttggtcccaaatctatcaaactcagtgccctctttagcgacatattttgtgacattccttccattacaccacagtgagttcacaggtaatataacctacccacctgtgtaatgtcaaaaaaaatcaatatgcggccccattttgtaaaggatcattaaaatgaaagtaatttatggtagagtaaattgtagagtaacgtgtactgacttggtgcagtatttctccttgtcactgtgggcccaattttgccaggagacctagggcaatagcctgttgcttgtggactggtagagggtatgatgttgaccatggcaatactgtgaggggccttcccatgtggaacgtgaccttccaaagtagtgactaactcttggaaaagtttttaacaacataatatgctattgcatttctgggaaattctgggtaaattccaagcatgcagcaattagtttgtgcttatgtgtgaagtccagttaggttctcagttcataccctgaaaactgcttattccacatctgttgatgtggtccactgggggcagttctgttcctcaccatcttggcagcatgcatggctcctgcccacatttcaaccacacccccaacccaattacgtgaccagcccccacgaaatttcacagcattccgtgcaggggagtgtcacagctcctcttgaaaaacatctggtgttgctatgagccagaagttcttttttttgttttttgtctgagatggagtctcgctccgtcacccaggctggagtgcaatggcgcagtctgctcaccacaacctccgcctcccaggttaaagcaattctcctgccttagtcccccgagtagctgggattacacgcacctgccaccacgcccagctaatttttgtatttttggtagaaatggggtgttggccaggctgatctcaaactcctgacctcgtgatccacccacctcggcctcccaaagtgctgggtttacaggcatgagccactatgcccagctgagccagaggttcttaactggtggtgcttttgcctccagggcacatttggtgacatctagggacatttttggttgctgtgcctggaggaagggtgccgccgtcatgtagtgggtagaggccagggacgctgctcaacatcctttagtgcccgggacagctcctcaacaaaggattctctagctcaaatgtcaatagtgccaaggtggagaagccacctgggtataaacccagcccagaaatgtagctgacatttttaaaacttgcagccagctgtggtggctcacgcttgtgatcccagcactgtgggaggctgaggagggcggatcctttgaggtcaggagtttgagactagcctgggcccatggcgaaaccccatctctactaaaaatacacaaattagccaagtgtggtgacatgcgcctgtaattctagctacctgggggaggctgaggcacgagaatcgcttgaacctgggaggcagaggtttcagtgaaccgagattgcaccactgcactccagcctgggtgacagagcaagactctgtctcagaaaaaaaaaagaaaagaaaaaaaaccttcaaattgattaatcagggctggactagactagaaatcatataagcttgattttaacagatggcatcattagctagtttatacatgatgtactttttagtacatcctttacggttttgcagcattcataattgatgtgaaataaggaagataatcctttttttttttttgagacagagtctcactcttttgcccaggctggagtcagtgttgtaatcactgctcacttggcagcctcgacctcctgggctcaagtgatcctcccaccccagcctcccaagtagctgggaccacaggcatgtgccaccattcctgattttttttattttttgcagagacagggtctcactgtgttgcctaggctggtctcgaaccttggcgtcccaaagtgttgagattataggcatgagccactgtgcccagccacttatttttctgagtaacctttaaggatgtattgtggacattttcaaacatgagtcatatatttttgctggtactcccatctacctccccaccattctccttccctggatatatatataaccatgtttgtccactgggacaaaaccattttcacaatcatactaagctgtcatttcacatttttgctgtgcactgatagtgtgaaagcaatggcaggtaaaactgctgagcctgagttcaaagcagggcagtagccctgaggttggttgttcatattcttctccactgggaaatgcagtaaagaaaaagaaaagctaatttcacttaatttcttttcttttcttttttttttttttcttttgagacggagtctcgctctgtcgcccaggctggagtgcaatggcgtgatctcggctcactgcaacctccacctccacggttcacgccattctcctgcctcagcctcccgagtagctgggactacaggtgtgcgccatcttgcccagctacttttttgtatttttagtagagatggggtttcaccatgttagacaggatggtgtcgatcttctgacctcataatccgcccacctcggcctcccaaagtgctgggattacaggcatgagccactgcgcctggccctctttttctttttgagatggagtattgctctgtcgcccaggctggagtgcagtggcacaatcttggctcactgcaacctccgcctcccgggttcaagcagttctcatgcttcagccctctaagtagctgggatgacaggtgtgcgctaccacacccggctaatttttgtatttttagtagagatggggttttaccatgttggccaggctggtctcaaactcatgacctcaagtaatctgcccgcctcagtctcccaaaatgctggcattacaggcatgagccaccgtgcctggcctactttcactgaatttctgtgatgaaacgggaaaaattaattttgttaaatctcaagtagaactatattgtcattatcacatctaaacagatatcatcaaatacctagtgttcagatgttctgggttgcctcataaattttgttttctatttgtttcatagtaatcataatctaaacaagatccacacagtgcatttggttggaatttttcttttttctttttcttttttttttttgtgatggagacttgctctgtcacgtggttcactgcaacctcccaggttcaagcaattctcctgcctcagccgcccctgtagctgggactgcaggcatgcaccaccacactcagcagatttcttaattgtttgtagagatggggttttactacattgcctaggccagtttcaaactgggctcaagcgatcctcccaccttggccatccaaagtgctaggattacaggtgtgagccaatgcaccctgccaaacagcaattttttttttttttgagacagagtctcgctgtgtcacccaggctggagtgcagtggtgcgatctcggctcactgcaagctccgcctcccaggttcatgccattctcctgcctcagcctcccgagtagctgggactacaggcgcccgccaccacgcccggcaaattttttgcgtttttagtagagacggggtttcaccctgttagccaggatggtctcaatctcctgacctcgtgatccacctgcctcggcctcccaaagtgctggggttacaggagtgagccaccgcgcctggccccaaaacagcaatttgaataaccatgttggaatggttgagcattggaacgcattagcatcagaacttcccgtgtcaggccaggcgcggtggctcacgcctgtaatcccagcactttcggaggccgagatgggcagatcacgaggtcaggagatcgagaccagcctggctaacacggtgaaaccctgtctctactaaaaatacaaaaaattagcctggcgtggtggcgggcgcctgtagtcccagctactcgggaggctgaggcgggagaatggcgtgaacctgggaggcagagcttgcagtgagctgagatagtgcctctgcactccagcctgggtgacagagctagactccatctcgaaaaaaataaaagaacttcccgtgtccgtttttgctttttggatgctgggagtgtcacaactcagctatccaatcaaggcagagctggcctccaggatgccagagccagagctttgtggttcatctctagaggttcaacaggaccctgtggatggcccaagttcgtttctctgcacttacctcttcggggttgtcctcaaaacgttgccgtgtcagctctcacttttcacagcaactctggcctcctaccttggactgcgccacttctgtctccttagataacctccattcgcatagctaaatgctgcaccctccgacactgccacaataatagttctgtgagttagtaccattttatagataggcaaaatttggcacaggacaaaagttagtggtaactagaacaaaagtaaccagcccaagctaggaagtggtggagttagaatttgatgtcagcacccagctgaccatggcttaaacagatgaggctttgttcaaaggctgtcttttcagtggctcagctgtgtcacagtcgatgttttctgcaatctctcaacctttccattgtggtcatgaggagactcctatggctccagccattgcatccacagtgaagactgaaagaagggggaatgggcaggccaacacttaccgctgatggtgtttaaaggaaaaacattcccagaagcctgcagcacatgccccccttagtctcactggccacagatgggtcagggggccacccctaataacaacggggcttagaaacctcgtatttacctttctaacctctgtggtggagacaggtgggagagaaaagtcctgggaagtggatgatggaggcagctagccgtagctgctgcttttctcttcaagctcttgggagaattgcttgtgctccctattcccttggtggatgatggaggcagctagccgtatctgctgcttttctccttcaagctcttgggagaatcgcttgtgctccctattcccttggtggcagctcacacctcagacctgctgtccgcccccactgcttcacagaacccactgcaaccactgtccaaggtactacctctggtgtcgtctctcttcatccccaggactgtgaagcctgctaacctctttgcagagctccatctccttgcattgtggggttccttctaactcttcagggacttctcaacctcccgtcacccttcctaaatgctggggtcctagagtccaccttgtgctccacgccctccccaggtgtcatctacatccctagctttgtgctgctcaccaccaaatcagtctggtgcttctgagatttgggcttcagacccaaacaactgctgtgtgctactgggcaactccccgaggtgtgccgaaagctccccaaacccagcctaccccaaacaaaactcattttccacccagactagtctctgcttccctgatccctttcctggaggctgtttccacttgccatcccatcatggaagccagaaaaccagtcttcttgacctctccccttccccactccatggagttagaggtcctgttgattttgccatgtaaacatttcggatttgcttacttcatccccactgccaccaacagtgcaggatggccctaagaggagaagtaatgtgctaccaagtggcccagccagagtgtgaaccaaacagtctggtaccaaaaccctattctggatcattcctcctttctgctccaccagcagtttggggcacaggcttgggaatccagacaggaaagctcctcccctctgaagcagtgggaccaaaaatgacagcatggttctagacagctctggaagtcaggcctgtgattgcctcattccctccaccttggcccccaaaatggccagtcctgaaggggtcacagttgatacttctctgagggggcatggggttggctgaggttatagcagccccacagggtggtaagctgggatgaagcaatcaactggaactcaacaagccttgagttctcaaagggggtgtgggaaggttcttatacatcttctatgaagggcagtttatcagtcactaaattacaaatacataaaccctttgtctcaccaaacctgctgggaatgaatcctacatatatatttatatgtgtgcaggctacatggttttcattatgctattgattttaaaagtaaaaatttggaaagaacctccatgtccaccatggggaactggctaagtcatttatggtggaatggtgatcataaaaattcattaaaaatgaagactctatatacagcttgaatattccttatcgaaatgcttgggaccagaagtgtttcagatctttgcatattttctgtttctcatttcagttcacattttctaagcatgatattcctactgatttccttgtagatattttgaaacagataagaaactcctccgtggaaattactgttaactagggaaaagacatgtttttttctgttcataaaagtaatgcgagttctttgtagcaaaacttggaaaatgcataaaagtaaaaaaaaaatgaaaacttgtgtaaaattcctcatactttagccatccatagatggtccttaccattaggattttactaattttccttgcagctttttcttaaaatatacacgtgtgtctacacatacatagtgtacactaaattttacatacacacagaggaatatatatgtgtatagttatcttgtgtttagaaatttggaatcccttctagttgtcttgtaacatgtgcttactctattttgaggattttctctatgaatttcatgtagctctttaaattaactttcaggaggattgtaacaatgtgctctccacccagtattttaccagccttgagttttctcaaagggggcattggaggggttcttatacatttacagtgggaatgtgaattgatacaacttctgtggagggcagtttatcagccactatctaaattacacatacataaaccctttgtctaagcaaacttgctgggaataaatcctacacatatatttgtatgtgtgca

SEQ ID NO: 203874 - DNA, 2555 bp, Homo sapiens
  Payload ID: 20210
  Gene Name: zinc finger protein 80
  Uniprot ID: P51504
  ENST ID: ENST00000308095
  CDS Start-End: 505-1326
gccggagccagcagtggcaacccgctggggtccctttccacactgtggaagctttgttctttcgctctttgcaataaatcttgctacttctcactctttgggtccacactgcttttaccagctgtaacactcaccgcaaacgtctgcagcttcactcctgaagccagcgagaccacgagcccaccgggaggaacgaacaactccagacgcgccgccttaagccttaagagctgtaacactcaccacgaaggtctgcagcttcactcctgagccagcgagaccacgaacccgccagaaggaagaaactccgaacacatccgaacatcagaaggaacaaactctagacgcgccaccttaagagctgtaacactcaccacaagggtccgcggcttcattcttgaagtcagtgagaccaagaacccaccaattccggacacagttggaaatgcagaagggcacttgagtttggctgcagtctcccacacggagaccttctggaggaagatgagccctaaacgcgatgggttggggacaggtgatggtctgcactcacaggttttacaggagcaggtctccacaggagacaatctccatgaatgtgactcccagggaccaagtaaagacactttggttcgtgaggggaagacctacaaatgcaaggaatgtgggagcgtgtttaacaaaaacagcctccttgttcgacatcagcagattcacactggggtgaagccttatgaatgccaggagtgtggaaaagcctttcctgaaaaggtcgacttcgttcgacccatgaggattcacacaggggagaagccctgtaagtgcgtggagtgcgggaaggtcttcaaccgcaggtcgcacctcctgtgctaccgccagattcacactggagagaagccctatgagtgcagcgagtgtggaaagaccttcagctatcactctgtcttcatccagcatcgtgtgacccacactggagaaaaactctttgggtgcaaagaatgtggaaaaaccttttactacaactcttccttaacccggcacatgaagattcacactggagagaagccctgcaagtgcagtgagtgcgggaagaccttcacctaccgctctgttttcttccgacatagtatgacccacactgcaggaaagccctacgagtgcaaagaatgtgggaaaggtttttactacagctattccctcactcgacatacaaggagtcacactggagagaaaccttatgagtgccttgaacatagaaaggactttggctaccactctgcttttgcccaacagagtaagatccactctggaggaaaaaacctttgagtgcaaatgatgtgggaatttgtgggttttctttttttttttttctttgatacatagagagccacactgaggagaagcactctgaattcagtggcagtaggaaagctgtgacctgcagctcatcctcacttggcattgaagaattccttccagagataaactctatgagatatgtgggaaggccttttgcaagtgggcccacatcagtcaacgtcagagaacttaaactgcgaaaagacattttgacaaaaactagtgaagaaaatcttttggccacaggaaatatcttcctcagcatctgagaatttttccaggagggagacctgttggttattgtgcacttaaaagaaccacccacacctctctccatagtttatatcactaagccacttcaggattttttttttttaagtaagaagggaactgtaaaagagaaaaaaagaaattcatgcatagcttctgtcagacttctctgaaagccatgcctatcaaaatttgaattcagttcttcattttgcagatggctgaaagggacgagagaatgatggtgaagctgtgttgctttcccaggtgagccttgattatttcctctgtgctttctcagcttctttggccttctgtaagaggggcttctccaagagcatgtcactagttttctagaagttaaacaagagctaagacaaacaaaacaaaacacagcttatctaatctaatgagaaactcagaaaaaaatgttttgatgaatacaatgtattaaaatataaaacatgtagatcctttgacatgttaattcaattctagaaatcctcagaaatgtttttatattatgcagagatgtgcgtgcaaagaataatcgctgcagttttgtttttatgtgtgaaacgttgagaacaatctaaatgtttatcagttggaagtaagttatggtacatctgttctatgaaatactgtgaaacaataaggtatctctgtatgtactgatatcaaaacatctctaagatacagtatttagtaaaagagaaagtttcaggaaataaaactacatctagaagtataagcataaaactgttaatagtggttttctgcaggaaatgggatggaccagggttatatgcaatgttcagtttttacttttatacttaagtattgtttatgtttgaaaaataaaaagcatttattgtttttgcaataaatgtttaaaatatttcaataaagatagcatgttagaa

SEQ ID NO: 203875 - DNA, 2471 bp, Homo sapiens
  Payload ID: 20210
  Gene Name: zinc finger protein 80
  Uniprot ID: P51504
  ENST ID: ENST00000482457
  CDS Start-End: 28-849
tcccacacggagaccttctggaggaagatgagccctaaacgcgatgggttggggacaggtgatggtctgcactcacaggttttacaggagcaggtctccacaggagacaatctccatgaatgtgactcccagggaccaagtaaagacactttggttcgtgaggggaagacctacaaatgcaaggaatgtgggagcgtgtttaacaaaaacagcctccttgttcgacatcagcagattcacactggggtgaagccttatgaatgccaggagtgtggaaaagcctttcctgaaaaggtcgacttcgttcgacccatgaggattcacacaggggagaagccctgtaagtgcgtggagtgcgggaaggtcttcaaccgcaggtcgcacctcctgtgctaccgccagattcacactggagagaagccctatgagtgcagcgagtgtggaaagaccttcagctatcactctgtcttcatccagcatcgtgtgacccacactggagaaaaactctttgggtgcaaagaatgtggaaaaaccttttactacaactcttccttaacccggcacatgaagattcacactggagagaagccctgcaagtgcagtgagtgcgggaagaccttcacctaccgctctgttttcttccgacatagtatgacccacactgcaggaaagccctacgagtgcaaagaatgtgggaaaggtttttactacagctattccctcactcgacatacaaggagtcacactggagagaaaccttatgagtgccttgaacatagaaaggactttggctaccactctgcttttgcccaacagagtaagatccactctggaggaaaaaacctttgagtgcaaatgatgtgggaatttgtgggttttctttttttttttttctttgatacatagagagccacactgaggagaagcactctgaattcagtggcagtaggaaagctgtgacctgcagctcatcctcacttggcattgaagaattccttccagagataaactctatgagatatgtgggaaggccttttgcaagtgggcccacatcagtcaacgtcagagaacttaaactgcgaaaagacattttgacaaaaactagtgaagaaaatcttttggccacaggaaatatcttcctcagcatctgagaatttttccaggagggagacctgttggttattgtgcacttaaaagaaccacccacacctctctccatagtttatatcactaagccacttcaggattttttttttttaagtaagaagggaactgtaaaagagaaaaaaagaaattcatgcatagcttctgtcagacttctctgaaagccatgcctatcaaaatttgaattcagttcttcattttgcagatggctgaaaggtacaaaggccttgcctcgttatttgtcctttatatgtattcactcctgtctacaggagaattgtcctctgtaaagattaactctgtaaagatttattgaatgcattctttgttctaaaacattgtactcctgaggaatgtaagtctttgtgagaaatatgaacgcttaagtaatggaatatgtgaaacttgtaagaacgtagaatataaaaatactgccatataaaatcctttcatatctgaggaggtaagtaaccacattgaatgggcatattttgctacatcatttaagactacttaaggctttaatttaacaaaaaacaattcttcatgtggttttgaacacccagtgctcaatatacttgtttgttttgatttattttctcagggacgagagaatgatggtgaagctgtgttgctttcccaggtgagccttgattatttcctctgtgctttctcagcttctttggccttctgtaagaggggcttctccaagagcatgtcactagttttctagaagttaaacaagagctaagacaaacaaaacaaaacacagcttatctaatctaatgagaaactcagaaaaaaatgttttgatgaatacaatgtattaaaatataaaacatgtagatcctttgacatgttaattcaattctagaaatcctcagaaatgtttttatattatgcagagatgtgcgtgcaaagaataatcgctgcagttttgtttttatgtgtgaaacgttgagaacaatctaaatgtttatcagttggaagtaagttatggtacatctgttctatgaaatactgtgaaacaataaggtatctctgtatgtactgatatcaaaacatctctaagatacagtatttagtaaaagagaaagtttcaggaaataaaactacatctagaagtataagcataaaactgttaatagtggttttctgcaggaaatgggatggaccagggttatatgcaatgttcagtttttacttttatacttaagtattgtttatgtttgaaaaataaaaagcatttattgtttttgcaataaatgtttaaaatatttcaataaagatagcatgttagaataaaa

SEQ ID NO: 203876 - DNA, 2216 bp, Homo sapiens
  Payload ID: 20210
  Gene Name: zinc finger protein 80
  Uniprot ID: P51504
  ENST ID: ENST00000619534
  CDS Start-End: 505-1326
gccggagccagcagtggcaacccgctggggtccctttccacactgtggaagctttgttctttcgctctttgcaataaatcttgctacttctcactctttgggtccacactgcttttaccagctgtaacactcaccgcaaacgtctgcagcttcactcctgaagccagcgagaccacgagcccaccgggaggaacgaacaactccagacgcgccgccttaagccttaagagctgtaacactcaccacgaaggtctgcagcttcactcctgagccagcgagaccacgaacccgccagaaggaagaaactccgaacacatccgaacatcagaaggaacaaactctagacgcgccaccttaagagctgtaacactcaccacaagggtccgcggcttcattcttgaagtcagtgagaccaagaacccaccaattccggacacagttggaaatgcagaagggcacttgagtttggctgcagtctcccacacggagaccttctggaggaagatgagccctaaacgcgatgggttggggacaggtgatggtctgcactcacaggttttacaggagcaggtctccacaggagacaatctccatgaatgtgactcccagggaccaagtaaagacactttggttcgtgaggggaagacctacaaatgcaaggaatgtgggagcgtgtttaacaaaaacagcctccttgttcgacatcagcagattcacactggggtgaagccttatgaatgccaggagtgtggaaaagcctttcctgaaaaggtcgacttcgttcgacccatgaggattcacacaggggagaagccctgtaagtgcgtggagtgcgggaaggtcttcaaccgcaggtcgcacctcctgtgctaccgccagattcacactggagagaagccctatgagtgcagcgagtgtggaaagaccttcagctatcactctgtcttcatccagcatcgtgtgacccacactggagaaaaactctttgggtgcaaagaatgtggaaaaaccttttactacaactcttccttaacccggcacatgaagattcacactggagagaagccctgcaagtgcagtgagtgcgggaagaccttcacctaccgctctgttttcttccgacatagtatgacccacactgcaggaaagccctacgagtgcaaagaatgtgggaaaggtttttactacagctattccctcactcgacatacaaggagtcacactggagagaaaccttatgagtgccttgaacatagaaaggactttggctaccactctgcttttgcccaacagagtaagatccactctggaggaaaaaacctttgagtgcaaatgatgtgggaatttgtgggttttctttttttttttttctttgatacatagagagccacactgaggagaagcactctgaattcagtggcagtaggaaagctgtgacctgcagctcatcctcacttggcattgaagaattccttccagagataaactctatgagatatgtgggaaggccttttgcaagtgggcccacatcagtcaacgtcagagaacttaaactgcgaaaagacattttgacaaaaactagtgaagaaaatcttttggccacaggaaatatcttcctcagcatctgagaatttttccaggagggagacctgttggttattgtgcacttaaaagaaccacccacacctctctccatagtttatatcactaagccacttcaggattttttttttttaagtaagaagggaactgtaaaagagaaaaaaagaaattcatgcatagcttctgtcagacttctctgaaagccatgcctatcaaaatttgaattcagttcttcattttgcagatggctgaaagggacgagagaatgatggtgaagctgtgttgctttcccaggtgagccttgattatttcctctgtgctttctcagcttctttggccttctgtaagaggggcttctccaagagcatgtcactagttttctagaagttaaacaagagctaagacaaacaaaacaaaacacagcttatctaatctaatgagaaactcagaaaaaaatgttttgatgaatacaatgtattaaaatataaaacatgtagatcctttgacatgttaattcaattctagaaatcctcagaaatgtttttatattatgcagagatgtgcgtgcaaagaataatcgctgcagttttgtttttatgtgtgaaacgttgaga

SEQ ID NO: 203877 - DNA, 4203 bp, Homo sapiens
  Payload ID: 20211
  Gene Name: zinc finger protein 800
  Uniprot ID: Q2TB10
  ENST ID: ENST00000265827
  CDS Start-End: 694-2688
tgtcgctgccggagagtctctgcttcccccttcctacgcgctccgcggcggtagctcgggctctccggaggagggggcgacagagtaaaagagaggctgacttaataaagtttcctgaaacaacaactaccaccgaaaaggcccaaggttgggggagacccccatttttctccgcccctctcctaaagcctgagggaccgttgcaggtggagcggcgctggtgggacccgggttgcggcggcagccgttgccccggcgagggaagcctcaggtcctgcccgctccggttccggctccttcggtggtggcggcggcagctgctgccgggcggttcctcctgtcaactgcctccgcccgcgcgcctcccgcctagccacacagcgcggaggacgccgtgagccgccgccgcagtcgtctcggcccgcggagggacgtggtgagctgtggcgcttccgcgtcagcgccggcggggactctttgggagcgcgtcgggcccgagtccgggttcccccgcgtggtcagcggaggctgcgccaggtggggcccgcagccgcctcccacgccaggctgtccccgcggccgcccggcctgccttccttccttccgcccgcccgccggcccgccctaagagttgaccacgccgcaatgaagagcttcttacagtgaaagcaaagtaggtcgagtccactgaaaatgcctttaagggacaaatactgtcagactgaccaccatcatcacggatgctgtgaaccagtttatatcctggaacctggagatcctcctttgttacagcaaccactacagacatccaaatctggtattcaacaaataattgagtgctttcgatcaggaactaaacaacttaagcatattttattaaaagatgtggacactatttttgaatgtaagttatgccgcagtctcttcagaggattaccaaatttaattacccataaaaaattctactgcccaccaagtctccagatggatgacaaccttcctgatgtaaatgataaacaaagccaagccataaatgatctcctagaagccatatatccaagtgtggacaaacgagaatatattattaagctagaacccatagaaactaatcaaaatgcagtatttcaatatatttcgaggactgataatcctattgaagtcacagagtcaagcagtactcctgaacaaaccgaagttcagatacaggaaactagcactgaacagtcaaaaacagtaccggttacagatacagaggtggaaactgtagagccccctcctgttgagattgttacagatgaagttgcacctacatctgatgaacaacctcaggagtcgcaggctgacttggaaacttctgacaattctgattttggtcaccagttgatatgttgtctttgtagaaaagaattcaattctagacgaggtgttcgccgtcacattcgaaaagtacacaagaaaaagatggaagaactaaaaaagtacattgaaacacgaaagaatccaaaccaatcctctaaaggacgcagtaagaatgttctagttccattaagtaggagttgtccagtatgttgtaaatcatttgctacaaaagcgaatgtaaggaggcattttgatgaagttcatagaggactaaggagggattcaattactcctgatatagcaacaaagcctgggcaacctttgttcctggattctatttctcctaaaaaatcttttaagactcgaaaacaaaagtcttcttcaaaggctgaatacaatttaactgcatgcaaatgcctcctttgcaagaggaaatatagttcacaaataatgcttaaaagacatatgcaaattgtccacaagataactctttctggaacaaactctaaaagagaaaaaggccctaataatactgccaacagttcagaaataaaagttaaagttgaaccagcagattctgtagaatcttcacccccttccattacccattctccacagaatgaattaaagggaacaaatcattcaaatgaaaaaaagaacacaccggcagcacagaaaaataaagttaaacaagactctgaaagccctaaatcaactagtccgtcggctgcaggtggccagcaaaaaaccagaaaaccaaaactttcagctggctttgactttaagcaactttactgtaaactttgtaaacgtcagtttacttccaaacagaacttgactaaacacatcgagttgcacacagatggaaataacatttatgttaaattctacaagtgtcctctttgcacttatgaaactcgtcggaaacgtgatgtgatacgacatataactgtggttcataaaaagtcatctcgttatcttgggaaaataacagccagtttagagatcagagctataaaaaagcctattgattttgttctaaataaagtggcaaaaagaggcccttcgagggatgaagcaaaacatagtgattcaaaacatgatggcacttctaactctcctagtaaaaagtatgaagtagctgacgtcggtattgaagtaaaagtcacaaaaaacttttctcttcacagatgcaataaatgtggaaaggcatttgccaaaaagacttaccttgaacatcataagaaaactcataaggcaaatgcttccaattcacctgaaggaaacaaaaccaaaggccgaagtacaagatctaaggctcttgtctgataacttcaagtgatgtacgaaaaggtttggagttcatttttgtggaaagactttaaattggtgttagaaccactaaacatcttcaaatggtactatgaggaaaaaaagaaaaacatttttctaaatattcaactataactgctgttttctgactaaaataaccatctaaccacttgtttctaaggcactgcctattccagcactttcaagtagctgtgatattacatgttgtcatcacagtccatcagctatccacccttgaccttgtgcatttggtcgacagtttctacaaaaatgttacaaattttgttttctaaacaatttgttgattaagtgatcaacaacctgaagaaaatatcaatttttaattgacaaagactttatatcttagtgattttagttttgtttctctttatttggcaacattttcatctgaattgtatagatatatgattttctagtgagtgtatgttaggaacaaaagacaaaatagtatcaacacattataaatatttagcttactaaatatttgtaattatttttacatccatttatttctagcttgttctccagcacttcagtgtttgaaagtttcatcctaaaatatatactacaggaaagctgcagttcattttcatgcatggatcattacatttttcacttgtaaatgtaggtttttatgaaaattaaacattcccctatttttctttaaattttatacaaagcactttaatgatagatgcaaccttatttttcagttcctatttttttaaagaccacacatttactaatgttaatatgaaggtaataaatagcttactgatattttatggatgcagacaatccatgcacaaccacttcttatgatactagtttatttccttaaatattgctacaaaaggaagatgcgggtgtaagccctgatttttttttctcccaagaaaaatcttaaaggaccactttagataatatttgattcctactgtaaaatttagaaaatgatgaattcttgtccatttttgtaatcaagattttaggaaaaacagaagtacatctatctttatgaaattttgggcaggtttttgtgtatcaatattttgtacttttagggaatattttattttttagttatttgtgtcaaattataattataaaaggtacagcagaaaatataccatgtttttatataggttcacacctgtacttaggagggaccctgtccatctatatactttttgtataaaattttaaaatgttaaagatccacaaggtcttaataaaatgattctatagctagaaaaacatttaccttcccagtgctttgcactaaaatatactgtgaaaggaaactagaaagactgtaactattgctggaaatgttctatattgaatgtacatgctcttgttggaaaaatgtactatatgtgatggaaataaaccagaatcgaagttatttcagctaaatgtgcttcagcaaaggtgcattggttgaaacttaaatgttttattatcaaa

SEQ ID NO: 203878 - DNA, 2375 bp, Homo sapiens
  Payload ID: 20211
  Gene Name: zinc finger protein 800
  Uniprot ID: Q2TB10
  ENST ID: ENST00000393312
  CDS Start-End: 167-2161
cggttcctcctgtcaactgcctccgcccgcgcgcctcccgcctagccacacagcgcggaggacgccgtgagccgccgccgcagtcgtctcggcccgcggagggacgtgccacgccgcaatgaagagcttcttacagtgaaagcaaagtaggtcgagtccactgaaaatgcctttaagggacaaatactgtcagactgaccaccatcatcacggatgctgtgaaccagtttatatcctggaacctggagatcctcctttgttacagcaaccactacagacatccaaatctggtattcaacaaataattgagtgctttcgatcaggaactaaacaacttaagcatattttattaaaagatgtggacactatttttgaatgtaagttatgccgcagtctcttcagaggattaccaaatttaattacccataaaaaattctactgcccaccaagtctccagatggatgacaaccttcctgatgtaaatgataaacaaagccaagccataaatgatctcctagaagccatatatccaagtgtggacaaacgagaatatattattaagctagaacccatagaaactaatcaaaatgcagtatttcaatatatttcgaggactgataatcctattgaagtcacagagtcaagcagtactcctgaacaaaccgaagttcagatacaggaaactagcactgaacagtcaaaaacagtaccggttacagatacagaggtggaaactgtagagccccctcctgttgagattgttacagatgaagttgcacctacatctgatgaacaacctcaggagtcgcaggctgacttggaaacttctgacaattctgattttggtcaccagttgatatgttgtctttgtagaaaagaattcaattctagacgaggtgttcgccgtcacattcgaaaagtacacaagaaaaagatggaagaactaaaaaagtacattgaaacacgaaagaatccaaaccaatcctctaaaggacgcagtaagaatgttctagttccattaagtaggagttgtccagtatgttgtaaatcatttgctacaaaagcgaatgtaaggaggcattttgatgaagttcatagaggactaaggagggattcaattactcctgatatagcaacaaagcctgggcaacctttgttcctggattctatttctcctaaaaaatcttttaagactcgaaaacaaaagtcttcttcaaaggctgaatacaatttaactgcatgcaaatgcctcctttgcaagaggaaatatagttcacaaataatgcttaaaagacatatgcaaattgtccacaagataactctttctggaacaaactctaaaagagaaaaaggccctaataatactgccaacagttcagaaataaaagttaaagttgaaccagcagattctgtagaatcttcacccccttccattacccattctccacagaatgaattaaagggaacaaatcattcaaatgaaaaaaagaacacaccggcagcacagaaaaataaagttaaacaagactctgaaagccctaaatcaactagtccgtcggctgcaggtggccagcaaaaaaccagaaaaccaaaactttcagctggctttgactttaagcaactttactgtaaactttgtaaacgtcagtttacttccaaacagaacttgactaaacacatcgagttgcacacagatggaaataacatttatgttaaattctacaagtgtcctctttgcacttatgaaactcgtcggaaacgtgatgtgatacgacatataactgtggttcataaaaagtcatctcgttatcttgggaaaataacagccagtttagagatcagagctataaaaaagcctattgattttgttctaaataaagtggcaaaaagaggcccttcgagggatgaagcaaaacatagtgattcaaaacatgatggcacttctaactctcctagtaaaaagtatgaagtagctgacgtcggtattgaagtaaaagtcacaaaaaacttttctcttcacagatgcaataaatgtggaaaggcatttgccaaaaagacttaccttgaacatcataagaaaactcataaggcaaatgcttccaattcacctgaaggaaacaaaaccaaaggccgaagtacaagatctaaggctcttgtctgataacttcaagtgatgtacgaaaaggtttggagttcatttttgtggaaagactttaaattggtgttagaaccactaaacatcttcaaatggtactatgaggaaaaaaagaaaaacatttttctaaatattcaactataactgctgttttctgactaaaataaccatctaaccacttgtttctaaggcactgcctattccagcactttcaagtagc

SEQ ID NO: 203879 - DNA, 4358 bp, Homo sapiens
  Payload ID: 20211
  Gene Name: zinc finger protein 800
  Uniprot ID: Q2TB10
  ENST ID: ENST00000393313
  CDS Start-End: 593-2587
cgctgccggagagtctctgcttcccccttcctacgcgctccgcggcggtagctcgggctctccggaggagggggcgacagagtaaaagagaggctgacttaataaagtttcctgaaacaacaactaccaccgaaaaggcccaaggttgggggagacccccatttttctccgcccctctcctaaagcctgagggaccgttgcaggtggagcggcgctggtgggacccgggttgcggcggcagccgttgccccggcgagggaagcctcaggtcctgcccgctccggttccggctccttcggtggtggcggcggcagctgctgccgggcggttcctcctgtcaactgcctccgcccgcgcgcctcccgcctagccacacagcgcggaggacgccgtgagccgccgccgcagtcgtctcggcccgcggagggacgtggtgagctgtggcgcttccgcgtcagcgccggcggggactctttgggagcgcgtcgggcccgagtccgggttcccccgcgtggtcagcggaggctgcgccagccacgccgcaatgaagagcttcttacagtgaaagcaaagtaggtcgagtccactgaaaatgcctttaagggacaaatactgtcagactgaccaccatcatcacggatgctgtgaaccagtttatatcctggaacctggagatcctcctttgttacagcaaccactacagacatccaaatctggtattcaacaaataattgagtgctttcgatcaggaactaaacaacttaagcatattttattaaaagatgtggacactatttttgaatgtaagttatgccgcagtctcttcagaggattaccaaatttaattacccataaaaaattctactgcccaccaagtctccagatggatgacaaccttcctgatgtaaatgataaacaaagccaagccataaatgatctcctagaagccatatatccaagtgtggacaaacgagaatatattattaagctagaacccatagaaactaatcaaaatgcagtatttcaatatatttcgaggactgataatcctattgaagtcacagagtcaagcagtactcctgaacaaaccgaagttcagatacaggaaactagcactgaacagtcaaaaacagtaccggttacagatacagaggtggaaactgtagagccccctcctgttgagattgttacagatgaagttgcacctacatctgatgaacaacctcaggagtcgcaggctgacttggaaacttctgacaattctgattttggtcaccagttgatatgttgtctttgtagaaaagaattcaattctagacgaggtgttcgccgtcacattcgaaaagtacacaagaaaaagatggaagaactaaaaaagtacattgaaacacgaaagaatccaaaccaatcctctaaaggacgcagtaagaatgttctagttccattaagtaggagttgtccagtatgttgtaaatcatttgctacaaaagcgaatgtaaggaggcattttgatgaagttcatagaggactaaggagggattcaattactcctgatatagcaacaaagcctgggcaacctttgttcctggattctatttctcctaaaaaatcttttaagactcgaaaacaaaagtcttcttcaaaggctgaatacaatttaactgcatgcaaatgcctcctttgcaagaggaaatatagttcacaaataatgcttaaaagacatatgcaaattgtccacaagataactctttctggaacaaactctaaaagagaaaaaggccctaataatactgccaacagttcagaaataaaagttaaagttgaaccagcagattctgtagaatcttcacccccttccattacccattctccacagaatgaattaaagggaacaaatcattcaaatgaaaaaaagaacacaccggcagcacagaaaaataaagttaaacaagactctgaaagccctaaatcaactagtccgtcggctgcaggtggccagcaaaaaaccagaaaaccaaaactttcagctggctttgactttaagcaactttactgtaaactttgtaaacgtcagtttacttccaaacagaacttgactaaacacatcgagttgcacacagatggaaataacatttatgttaaattctacaagtgtcctctttgcacttatgaaactcgtcggaaacgtgatgtgatacgacatataactgtggttcataaaaagtcatctcgttatcttgggaaaataacagccagtttagagatcagagctataaaaaagcctattgattttgttctaaataaagtggcaaaaagaggcccttcgagggatgaagcaaaacatagtgattcaaaacatgatggcacttctaactctcctagtaaaaagtatgaagtagctgacgtcggtattgaagtaaaagtcacaaaaaacttttctcttcacagatgcaataaatgtggaaaggcatttgccaaaaagacttaccttgaacatcataagaaaactcataaggcaaatgcttccaattcacctgaaggaaacaaaaccaaaggccgaagtacaagatctaaggctcttgtctgataacttcaagtgatgtacgaaaaggtttggagttcatttttgtggaaagactttaaattggtgttagaaccactaaacatcttcaaatggtactatgaggaaaaaaagaaaaacatttttctaaatattcaactataactgctgttttctgactaaaataaccatctaaccacttgtttctaaggcactgcctattccagcactttcaagtagctgtgatattacatgttgtcatcacagtccatcagctatccacccttgaccttgtgcatttggtcgacagtttctacaaaaatgttacaaattttgttttctaaacaatttgttgattaagtgatcaacaacctgaagaaaatatcaatttttaattgacaaagactttatatcttagtgattttagttttgtttctctttatttggcaacattttcatctgaattgtatagatatatgattttctagtgagtgtatgttaggaacaaaagacaaaatagtatcaacacattataaatatttagcttactaaatatttgtaattatttttacatccatttatttctagcttgttctccagcacttcagtgtttgaaagtttcatcctaaaatatatactacaggaaagctgcagttcattttcatgcatggatcattacatttttcacttgtaaatgtaggtttttatgaaaattaaacattcccctatttttctttaaattttatacaaagcactttaatgatagatgcaaccttatttttcagttcctatttttttaaagaccacacatttactaatgttaatatgaaggtaataaatagcttactgatattttatggatgcagacaatccatgcacaaccacttcttatgatactagtttatttccttaaatattgctacaaaaggaagatgcgggtgtaagccctgatttttttttctcccaagaaaaatcttaaaggaccactttagataatatttgattcctactgtaaaatttagaaaatgatgaattcttgtccatttttgtaatcaagattttaggaaaaacagaagtacatctatctttatgaaattttgggcaggtttttgtgtatcaatattttgtacttttagggaatattttattttttagttatttgtgtcaaattataattataaaaggtacagcagaaaatataccatgtttttatataggttcacacctgtacttaggagggaccctgtccatctatatactttttgtataaaattttaaaatgttaaagatccacaaggtcttaataaaatgattctatagctagaaaaacatttaccttcccagtgctttgcactaaaatatactgtgaaaggaaactagaaagactgtaactattgctggaaatgttctatattgaatgtacatgctcttgttggaaaaatgtactatatgtgatggaaataaaccagaatcgaagttatttcagctaaatgtgcttcagcaaaggtgcattggttgaaacttaaatgttttattatcaaatttaaacttattcagtgactatgagcagctacacttgaattatattctgatagttttatttctaagaaatagagtaataatttctctttaatttaaaaacagatttactttcccacatattgaaaatttgtacttatagatctaactttaataactaatagtataatatatttagggaactaaatgtgtaggtggtatttcatttataagccatcttcattagttgcacattattaaacctatatgtttgactttt

SEQ ID NO: 203880 - DNA, 410 bp, Homo sapiens
  Payload ID: 20211
  Gene Name: zinc finger protein 800
  ENST ID: ENST00000439506
  CDS Start-End: 115-410
tcaagcaagccacctgaaaaagatcacaagctgaaaaaagataaggtgtatgtaaaccacgccgcaatgaagagcttcttacagtgaaagcaaagtaggtcgagtccactgaaaatgcctttaagggacaaatactgtcagactgaccaccatcatcacggatgctgtgaaccagtttatatcctggaacctggagatcctcctttgttacagcaaccactacagacatccaaatctggtattcaacaaataattgagtgctttcgatcaggaactaaacaacttaagcatattttattaaaagatgtggacactatttttgaatgtaagttatgccgcagtctcttcagaggattaccaaatttaattacccataaaaaattctactgcccaccaagtctccagatgga

SEQ ID NO: 203881 - DNA, 502 bp, Homo sapiens
  Payload ID: 20211
  Gene Name: zinc finger protein 800
  ENST ID: ENST00000436992
  CDS Start-End: 113-502
cggccgcccggcctgccttccttccttccgcccgcccgccggcccgccctaagaccacgccgcaatgaagagcttcttacagtgaaagcaaagtaggtcgagtccactgaaaatgcctttaagggacaaatactgtcagactgaccaccatcatcacggatgctgtgaaccagtttatatcctggaacctggagatcctcctttgttacagcaaccactacagacatccaaatctggtattcaacaaataattgagtgctttcgatcaggaactaaacaacttaagcatattttattaaaagatgtggacactatttttgaatgtaagttatgccgcagtctcttcagaggattaccaaatttaattacccataaaaaattctactgcccaccaagtctccagatggatgacaaccttcctgatgtaaatgataaacaaagccaagccataaatgatctcctagaagccatatatccaagtgtggacaaacgagaatatatt

SEQ ID NO: 203882 - DNA, 955 bp, Homo sapiens
  Payload ID: 20211
  Gene Name: zinc finger protein 800
  ENST ID: ENST00000434602
  CDS Start-End: 230-955
gtccggggtcagtcagtcgctccctgtcgctgccggagagtctctgcttcccccttcctacgcgctccgcggcggtagctcgggctctccggaggagggggcgacagagtaaaagagaggctgacttaataaagtttcctgaaacaacaactaccaccgaaaaggcccaagccacgccgcaatgaagagcttcttacagtgaaagcaaagtaggtcgagtccactgaaaatgcctttaagggacaaatactgtcagactgaccaccatcatcacggatgctgtgaaccagtttatatcctggaacctggagatcctcctttgttacagcaaccactacagacatccaaatctggtattcaacaaataattgagtgctttcgatcaggaactaaacaacttaagcatattttattaaaagatgtggacactatttttgaatgtaagttatgccgcagtctcttcagaggattaccaaatttaattacccataaaaaattctactgcccaccaagtctccagatggatgacaaccttcctgatgtaaatgataaacaaagccaagccataaatgatctcctagaagccatatatccaagtgtggacaaacgagaatatattattaagctagaacccatagaaactaatcaaaatgcagtatttcaatatatttcgaggactgataatcctattgaagtcacagagtcaagcagtactcctgaacaaaccgaagttcagatacaggaaactagcactgaacagtcaaaaacagtaccggttacagatacagaggtggaaactgtagagccccctcctgttgagattgttacagatgaagttgcacctacatctgatgaacaacctcaggagtcgcaggctgacttggaaacttctgacaattctgattttggtcaccagttgatatgttgtctttgtagaaaagaattcaattctaga

SEQ ID NO: 203883 - DNA, 2099 bp, Homo sapiens
  Payload ID: 20211
  Gene Name: zinc finger protein 800
  ENST ID: ENST00000619291
  CDS Start-End: 694-1704
tgtcgctgccggagagtctctgcttcccccttcctacgcgctccgcggcggtagctcgggctctccggaggagggggcgacagagtaaaagagaggctgacttaataaagtttcctgaaacaacaactaccaccgaaaaggcccaaggttgggggagacccccatttttctccgcccctctcctaaagcctgagggaccgttgcaggtggagcggcgctggtgggacccgggttgcggcggcagccgttgccccggcgagggaagcctcaggtcctgcccgctccggttccggctccttcggtggtggcggcggcagctgctgccgggcggttcctcctgtcaactgcctccgcccgcgcgcctcccgcctagccacacagcgcggaggacgccgtgagccgccgccgcagtcgtctcggcccgcggagggacgtggtgagctgtggcgcttccgcgtcagcgccggcggggactctttgggagcgcgtcgggcccgagtccgggttcccccgcgtggtcagcggaggctgcgccaggtggggcccgcagccgcctcccacgccaggctgtccccgcggccgcccggcctgccttccttccttccgcccgcccgccggcccgccctaagagttgaccacgccgcaatgaagagcttcttacagtgaaagcaaagtaggtcgagtccactgaaaatgcctttaagggacaaatactgtcagactgaccaccatcatcacggatgctgtgaaccagtttatatcctggaacctggagatcctcctttgttacagcaaccactacagacatccaaatctggtattcaacaaataattgagtgctttcgatcaggaactaaacaacttaagcatattttattaaaagatgtggacactatttttgaatgtaagttatgccgcagtctcttcagaggattaccaaatttaattacccataaaaaattctactgcccaccaagtctccagatggatgacaaccttcctgatgtaaatgataaacaaagccaagccataaatgatctcctagaagccatatatccaagtgtggacaaacgagaatatattattaagctagaacccatagaaactaatcaaaatgcagtatttcaatatatttcgaggactgataatcctattgaagtcacagagtcaagcagtactcctgaacaaaccgaagttcagatacaggaaactagcactgaacagtcaaaaacagtaccggttacagatacagaggtggaaactgtagagccccctcctgttgagattgttacagatgaagttgcacctacatctgatgaacaacctcaggagtcgcaggctgacttggaaacttctgacaattctgattttggtcaccagttgatatgttgtctttgtagaaaagaattcaattctagacgaggtgttcgccgtcacattcgaaaagtacacaagaaaaagatggaagaactaaaaaagtacattgaaacacgaaagaatccaaaccaatcctctaaaggacgcagtaagaatgttctagttccattaagtaggagttgtccagtatgttgtaaatcatttgctacaaaagcgaatgtaaggaggcattttgatgaagttcatagaggactaaggagggattcaattactcctgatatagcaacaaagcctgggcaacctttgttcctggattctatttcttaaaaaatcttttaagactcgaaaacaaaagtcttcttcaaaggctgaatacaatttaactgcatgcaaatgcctcctttgcaagaggaaatatagttcacaaataatgcttaaaagacatatgcaaattgtccacaagataactctttctggaacaaactctaaaagagaaaaaggccctaataatactgccaacagttcagaaataaaagttaaagttgaaccagcagattctgtagaatcttcacccccttccattacccattctccacagaatgaattaaagggaacaaatcattcaaatgaaaaaaagaacacaccggcagcacagaaaaataaagttaaacaagactctgaaagccctaaatcaactagtccgtcggctgcaggtggccagc

SEQ ID NO: 203884 - DNA, 4690 bp, Homo sapiens
  Payload ID: 20212
  Gene Name: zinc finger protein 804A
  Uniprot ID: Q7Z570
  ENST ID: ENST00000302277
  CDS Start-End: 595-4224
ggccgcgggtcccggcggcggggtgggcgggggaggcagcgggtgacagatgtactcctctgacagctctcagtatcagcccagtggctccctgccattggctcagtgcaatggaccggcaacgccgctcactataataacactcatgcctgccagcagcagcaactccgagtgcaggcgccgagcgcgggggatgctgccgccgccgccgcttctgctgccgcgcgggcggctcccgcagccccgctccgcccggccaccgcgcgggcactgactcccgctcggttccgtttcgccggcccggccccctcctaggctggaatcctcccgcggggctcgtcgtcccgacgcgaatctgaggagaaacaggagcgagagactgaggggagagcgcggcgagcatgcggaggcgggggagcctcggcgctcaccacagaggggtgcagtgagccagtctccagaggacgtgccgggggtggctgcgtgccctcgtggcgggttcccagcccaccgtcgccggccccggcgcgctgcggctgtgggcgcggggtgcgtggaagcggcggctgcggcggaggaggcggcggctgccccatggagtgttactacattgtcatcagctccacgcatctcagcaacggacactttcgcaacatcaagggagttttccggggccctctcagcaagaacgggaacaaaactctggactatgctgagaaggaaaataccatagcaaaagctctggaagatctgaaggcaaatttttactgtgaactctgtgacaagcagtactataagcaccaggagtttgacaatcacattaattcatatgaccatgctcacaagcagaggctcaaggaactgaaacaaagggaatttgctcgaaatgtagcatctaaatccaggaaagatgaaagaaaacaggaaaaggcactccaacgcctgcacaagctggctgagctaagaaaggaaactgtatgtgctcctggaagtggccccatgttcaaatcaacaactgttactgtgagagaaaactgtaatgaaatttcccaacgagttgttgtggattcagttaataaccagcaagatttcaaatatactttgattcatagtgaagagaatactaaagatgctaccactgttgctgaagatccagaaagtgcaaataattatacagcaaaaaataaccaagttggggatcaagcccaggggattcacagacacaaaatcggcttttcttttgcatttccaaagaaagcgtccgtgaagctagagtcctcagctgcagccttctctgaatacagtgatgatgcctcagtgggaaaaggatttagcagaaaaagtagatttgtccccagtgcttgtcatcttcaacaatcttcaccaacagatgtgcttttgagttctgaggagaaaactaactcttttcatccaccagaggcaatgtgcagagacaaagaaactgttcaaactcaagagataaaagaagtctctagtgaaaaagatgcattattattaccttcattttgcaagtttcaacttcagttatcttctgatgcagataattgtcaaaattcagtcccattagcagatcaaataccactagagagtgttgttattaatgaagacatacctgttagtggtaacagttttgagttgttaggaaataaatccacagttcttgacatgtctaatgattgcatatctgtgcaagctaccacagaggaaaatgttaagcataacgaggcatccacaactgaggttgaaaataaaaatggtcccgagacattggccccttcaaatactgaagaggttaacataactatacataagaaaacaaatttctgcaaaagacaatgtgagccatttgtacctgtccttaacaaacacagatctacagttcttcagtggccatcagaaatgctggtttatacaactacgaaaccatcaatttcctatagctgtaatcctctatgttttgacttcaagtctactaaagtaaataataatctagataaaaataagccagacttaaaagatctttgttctcagcagaagcaggaagacatttgcatgggaccactttcagattacaaggatgtatctacagaaggactcactgattatgaaattggaagtagcaaaaataaatgcagccaagtcactcctcttttggctgatgatattctctccagtagttgtgattctggaaaaaatgagaacacaggtcagaggtataaaaacatttcctgtaagatcagagaaacagaaaagtataattttactaaaagtcaaataaaacaggacactctagatgaaaaatacaacaaaataaggttgaaagagacccatgaatactggttccataaaagtagaagaaagaaaaaaagaaaaaagttatgtcagcatcatcatatggagaaaaccaaagaatcagaaactcgctgcaaaatggaagcagagaatagttacactgaaaatgctgggaaatatctattggaaccaatttcagaaaagcagtatttagctgcagagcaattattagactcacatcagttacttgataaaaggcccaaatcagaatccatatccttaagtgacaatgaagaaatgtgtaaaacatggaatactgaatacaacacttatgatactatcagttctaaaaaccactgtaaaaagaacacaatacttttaaatggacaatcaaatgcaacaatgatacattctgggaaacataatttaacatattctagaacttactgttgttggaaaaccaaaatgtcaagctgtagtcaggatcacagaagcttagttcttcaaaatgatatgaaacacatgagtcagaatcaggctgttaaaagaggttacaattctgtcatgaatgaatcagaaagattctatcgaaaacgtagacaacattcacattcttattcttcagatgaaagtttaaatcgacagaatcatttaccagaagaatttttgaggccaccaagtacttcagttgctccctgcaagcctaaaaagaaacggaggcgaaaaagaggcagattccaccccggatttgaaactttagaactcaaagaaaatacagattatcccgtgaaagacaattcttccttaaatcctctggataggttaataagtgaagacaaaaaagagaaaatgaaaccacaagaagttgcaaaaatcgaaaggaactcagaacaaacaaaccaattaagaaacaaactgtctttccaccctaacaatctccttccttctgaaaccaatggtgaaactgagcatttagaaatggagaccacttctggtgaattgtcagatgtttccaatgatcccaccacatctgtctgtgtagctagtgccccaacaaaagaagcaattgacaataccctgcttgaacacaaagaaagaagtgagaatataaatcttaatgaaaagcaaattccttttcaggtgcctaatattgaaaggaactttagacagtcacagcctaaatcctatctttgccattatgaactggctgaggcccttccacaaggaaagatgaatgagacaccaactgagtggctgcgttataattcaggaatccttaacacacaaccaccattaccattcaaagaagcacatgtcagtggtcatacttttgtaacagctgagcaaatcctggctccattagctttaccagagcaagcattattgatcccactagaaaaccatgacaaattcaaaaatgtaccatgtgaggtctaccagcacattctgcagccaaacatgctggccaacaaggttaaatttacctttcctccagctgccctcccaccccctagcacacctctgcagcctttgcctttgcagcagtccttatgttctacctctgtaaccactatccatcacactgttttgcagcagcacgctgcagctgctgcagctgcagctgcagccgcagctgcaggaacctttaaagtgcttcagccacaccaacagtttctttcccaaatcccagctctcaccagaacctcattacctcagctctcagtaggaccagtaggaccgaggctttgtcctgggaaccagccaacttttgttgctcctcctcagatgccaatcattccagcttccgttcttcatcctagccatctggctttcccatctttaccccatgcactctttccttcactgctttccccacaccctactgtcatccctttgcaacctctcttctagtcatcaccataatgggaaaaaaatactcttgtgaaaactattgctatatgcgttaagtgttcatctatgtgggtacatggctatttaactggtggaaataaactggccgatacatggcgtcattggtttgaaatcatttactgtaagtgcaatgatgcaaataaatccctaagtttctgatatataatattattaaagcactgaatagtttgaaaatcaatacaatatatgctatatattaaaatgatgtcttaagagtatgtataatgtacataaaatatatttatagtactctaatttatgttgtaaagtatgctcccttggtttttcttaatctttgtgtatttgcacctatttaatgtttagacaaagctgatggcactatgttttgtatcatgttccttgaaactgtaaattcagtgaaaaatatctcttgcaataaatttttgttaactatttaagtaaa

SEQ ID NO: 203885 - DNA, 3986 bp, Homo sapiens
  Payload ID: 20212
  Gene Name: zinc finger protein 804A
  ENST ID: ENST00000613975
  CDS Start-End: 149-3523
tcaggactatgctgagaaggaaaataccatagcaaaagctctggaagatctgaaggcaaatttttactgtgaactctgtgacaagcagtactataagcaccaggagtttgacaatcacattaattcatatgaccatgctcacaagcagaggctcaaggaactgaaacaaagggaatttgctcgaaatgtagcatctaaatccaggaaagatgaaagaaaacaggaaaaggcactccaacgcctgcacaagctggctgagctaagaaaggaaactgtatgtgctcctggaagtggccccatgttcaaatcaacaactgttactgtgagagaaaactgtaatgaaatttcccaacgagttgttgtggattcagttaataaccagcaagatttcaaatatactttgattcatagtgaagagaatactaaagatgctaccactgttgctgaagatccagaaagtgcaaataattatacagcaaaaaataaccaagttggggatcaagcccaggggattcacagacacaaaatcggcttttcttttgcatttccaaagaaagcgtccgtgaagctagagtcctcagctgcagccttctctgaatacagtgatgatgcctcagtgggaaaaggatttagcagaaaaagtagatttgtccccagtgcttgtcatcttcaacaatcttcaccaacagatgtgcttttgagttctgaggagaaaactaactcttttcatccaccagaggcaatgtgcagagacaaagaaactgttcaaactcaagagataaaagaagtctctagtgaaaaagatgcattattattaccttcattttgcaagtttcaacttcagttatcttctgatgcagataattgtcaaaattcagtcccattagcagatcaaataccactagagagtgttgttattaatgaagacatacctgttagtggtaacagttttgagttgttaggaaataaatccacagttcttgacatgtctaatgattgcatatctgtgcaagctaccacagaggaaaatgttaagcataacgaggcatccacaactgaggttgaaaataaaaatggtcccgagacattggccccttcaaatactgaagaggttaacataactatacataagaaaacaaatttctgcaaaagacaatgtgagccatttgtacctgtccttaacaaacacagatctacagttcttcagtggccatcagaaatgctggtttatacaactacgaaaccatcaatttcctatagctgtaatcctctatgttttgacttcaagtctactaaagtaaataataatctagataaaaataagccagacttaaaagatctttgttctcagcagaagcaggaagacatttgcatgggaccactttcagattacaaggatgtatctacagaaggactcactgattatgaaattggaagtagcaaaaataaatgcagccaagtcactcctcttttggctgatgatattctctccagtagttgtgattctggaaaaaatgagaacacaggtcagaggtataaaaacatttcctgtaagatcagagaaacagaaaagtataattttactaaaagtcaaataaaacaggacactctagatgaaaaatacaacaaaataaggttgaaagagacccatgaatactggttccataaaagtagaagaaagaaaaaaagaaaaaagttatgtcagcatcatcatatggagaaaaccaaagaatcagaaactcgctgcaaaatggaagcagagaatagttacactgaaaatgctgggaaatatctattggaaccaatttcagaaaagcagtatttagctgcagagcaattattagactcacatcagttacttgataaaaggcccaaatcagaatccatatccttaagtgacaatgaagaaatgtgtaaaacatggaatactgaatacaacacttatgatactatcagttctaaaaaccactgtaaaaagaacacaatacttttaaatggacaatcaaatgcaacaatgatacattctgggaaacataatttaacatattctagaacttactgttgttggaaaaccaaaatgtcaagctgtagtcaggatcacagaagcttagttcttcaaaatgatatgaaacacatgagtcagaatcaggctgttaaaagaggttacaattctgtcatgaatgaatcagaaagattctatcgaaaacgtagacaacattcacattcttattcttcagatgaaagtttaaatcgacagaatcatttaccagaagaatttttgaggccaccaagtacttcagttgctccctgcaagcctaaaaagaaacggaggcgaaaaagaggcagattccaccccggatttgaaactttagaactcaaagaaaatacagattatcccgtgaaagacaattcttccttaaatcctctggataggttaataagtgaagacaaaaaagagaaaatgaaaccacaagaagttgcaaaaatcgaaaggaactcagaacaaacaaaccaattaagaaacaaactgtctttccaccctaacaatctccttccttctgaaaccaatggtgaaactgagcatttagaaatggagaccacttctggtgaattgtcagatgtttccaatgatcccaccacatctgtctgtgtagctagtgccccaacaaaagaagcaattgacaataccctgcttgaacacaaagaaagaagtgagaatataaatcttaatgaaaagcaaattccttttcaggtgcctaatattgaaaggaactttagacagtcacagcctaaatcctatctttgccattatgaactggctgaggcccttccacaaggaaagatgaatgagacaccaactgagtggctgcgttataattcaggaatccttaacacacaaccaccattaccattcaaagaagcacatgtcagtggtcatacttttgtaacagctgagcaaatcctggctccattagctttaccagagcaagcattattgatcccactagaaaaccatgacaaattcaaaaatgtaccatgtgaggtctaccagcacattctgcagccaaacatgctggccaacaaggttaaatttacctttcctccagctgccctcccaccccctagcacacctctgcagcctttgcctttgcagcagtccttatgttctacctctgtaaccactatccatcacactgttttgcagcagcacgctgcagctgctgcagctgcagctgcagccgcagctgcaggaacctttaaagtgcttcagccacaccaacagtttctttcccaaatcccagctctcaccagaacctcattacctcagctctcagtaggaccagtaggaccgaggctttgtcctgggaaccagccaacttttgttgctcctcctcagatgccaatcattccagcttccgttcttcatcctagccatctggctttcccatctttaccccatgcactctttccttcactgctttccccacaccctactgtcatccctttgcaacctctcttctagtcatcaccataatgggaaaaaaatactcttgtgaaaactattgctatatgcgttaagtgttcatctatgtgggtacatggctatttaactggtggaaataaactggccgatacatggcgtcattggtttgaaatcatttactgtaagtgcaatgatgcaaataaatccctaagtttctgatatataatattattaaagcactgaatagtttgaaaatcaatacaatatatgctatatattaaaatgatgtcttaagagtatgtataatgtacataaaatatatttatagtactctaatttatgttgtaaagtatgctcccttggtttttcttaatctttgtgtatttgcacctatttaatgtttagacaaagctgatggcactatgttttgtatcatgttccttgaaactgtaaattcagtgaaaaatatctcttgcaataaatttttgttaactatttaagt

SEQ ID NO: 203886 - DNA, 4659 bp, Homo sapiens
  Payload ID: 20213
  Gene Name: zinc finger protein 804B
  Uniprot ID: A4D1E1
  ENST ID: ENST00000333190
  CDS Start-End: 610-4659
cccaactccctgtcctcaccccggcccgcccgtctcctcctccgccctctcccgactgcagcgggggcagcgctttggcgctcccaaggactccccgccactctccccacaaagcagcggcggtggcggcggctgctgctggatcttcacactgcagccagcagcccaggacgcccccggccggacgatgggtacccgcgcctgagcatcccccgggcaggcgccaggcgcgaaggcagggggcgggaggaaaggggcgggggaattcctgattccctggtggaccctggaagttgtccttaaataaatatatcgctggcccgcggttgagcagccacctcgtcagagcagcatgtggactggctcgccgggtcccctccgtgctctgtgctgtcgccgccgccgcctctgtcagagcagcagctgtcggcagcaggagccccgcacggggcgcggagcagggacgcgctgccaccgcctccccctgcgtcctgctggccgcgtcttctcgggaggtggtagtcgctgttgccgctgagaaacccgcccgctttccacggctggtcgcctggtgaggagttgagactctgcgcctccgcccggacccacatggcttgttacctggtcatcagttcgagacatctcagcaatgggcactaccggggcattaaaggagtcttcaggggacccctgtgcaagaacggatctccctctccggattttgcagaaaagaagtccacagcaaaggccctggaagatgtaaaggcaaacttttactgtgaattatgtgacaagcagtatcacaaacaccaggagtttgacaatcatattaattcttatgaccatgctcataagcagagactgaaagaattaaagcaacgggaatttgctcgaaatgtagcttctaagtcatggaaagatgagaaaaaacaagaaaaagcacttaaacgacttcatcagctggctgagttaaggcagcaatctgaatgtgtttctggaaatggaccagcatacaaagcccccagggtagccatagaaaagcaactccagcaaggaattttccccattaagaatggcagaaaggtatcatgcatgaagagtgctcttctccttaaaggaaaaaatctccccagaatcatatccgataaacagcggtccaccatgccaaatcgacaccaattacaatcagacaggcgttgtttgtttggaaatcaggtactgcaaacatcttcagatctcagcaatgcaaatcacagaacaggagtatcatttactttttccaaaaaagtgcacctaaaattagaatcttcagcatcagttttcagtgagaacacagaagaaacccatgattgtaacaagtcacccatttataaaacaaaacaaactgcagataagtgcaagtgctgcaggtttgcaaataaagatacacaccttaccaaggaaaaagaggtaaatatctcaccaagccatctggaaagtgttttacacaataccatctccataaactctaaaattttgcaagacaaacacgactctattgatgagacactagaagattcaattggcattcatgcttcattctctaaatctaacattcatctttcagatgtagattttactcctaccagcagagaaaaagaaactagaaatacattgaagaacactttagaaaattgtgttaatcacccatgccaagcaaatgcttccttcagcccaccaaacatttacaaccatagtgatgccaggatatctgaatgcctggatgagttttcatcactggagccaagtgaacaaaagagtacagtgcatctgaatccaaattccagaatagagaacagagaaaaatctttagataaaacagaaagagttagcaaaaatgttcaaagacttgtaaaagaagcatgtacccataatgtggcatctaaaccactaccttttctccacgttcaaagcaaggatggccacaccactcttcaatggcctacggaacttctgctctttacaaaaacagaaccctgtatctcttatggctgcaacccactgtattttgattttaagctttctcggaacacaaaggaagaccacaatctagaggacttaaaaacagaattgggtaagaagcccttggaattgaagactaaaagagagagccaagtctcaggtttaactgaagaccaacaaaaattgatccaagaagattatcaatatccgaaaccaaagacgatgatagctaatccggattgggaaaaattccagaggaaatataatttggactacagtgattctgagccaaataagagtgaatatactttcagtgcaaatgatttggaaatgaaaaatcctaaagtgcctctttacctcaacacatctctaaaggattgtgctggaaagaataatagtagtgagaacaaacttaaggaagcttcaagggcccattggcaaggctgcagaaaggcagttctaaatgatatagatgaggacctatcttttccttcctacatctctaggtttaaaaagcataaattgattccctgcagtcctcatttggaatttgaagatgaaagacaattcaactgcaagtccagtccttgtacagtagggggtcacagtgaccatgggaaagacttcagtgtaattttgaagagtaaccacatcagcatgaccagcaaggtttccggatgtggaaaccaaagatacaagagatactctccacagtcatgtttgagtagatattcttcctctttggacacatcccctagcagcatgtctagcttgagaagtacttgttcaagtcatagattcaatggtaatagcagaggtaatttgctctgcttccataaaagagaacaccactcagttgaaaggcacaaacggaaatgtctaaagcacaactgcttctacttgtctgatgatataacaaagagcagccaaatgcagtctgaaccacagaaagagaggaactgcaaattgtgggaatcatttaaaaatgaaaaatactcaaaacgtagatattgtcactgcagagaaagacaaaaactgggcaaaaatcaacaacaattttcagggctaaaatctacgagaatcatctattgtgattctaactcacagatttcctgtactggaagcagtaaaaaaccacctaattgccagggaactcagcacgacagattggactcttactcaatagagaaaatgtattacttgaataaaagcaagagaaatcaagagtctttgggcagccctcacatttgtgatctgggaaaagtcaggcccatgaagtgtaactccgggaatatcagctgccttctaaagaactgttccagtggcccttcagaaaccacagaatcaaacactgcagaaggagagaggacccctctaacagcaaaaatccttttagaaagagtacaagccaagaaatgtcaagaacaatcaagtaatgttgagatctcttcaaacagttgtaaaagtgaattagaggctccttcgcaagtcccatgcacaattcaacttgcaccatcaggctgtaacagacaagcattgcctttgtctgaaaaaatacagtatgcaagtgagagcagaaatgatcaagacagtgcaattccaaggactacggagaaagacaaaagcaaaagttcacacacaaataattttacaattttagcagacactgattgtgataaccatctttctaaaggtataattcacctagtaacagagtctcagtcactaaacataaaaagggatgcaacaacaaaagaacaatcaaaacctttaattagtgaaatccaaccttttattcaaagctgtgacccagtaccaaatgaattccctggtgcttttccgtctaataaatatactggtgtgactgattcaacagagacccaagaagaccaaataaatctagacttacaggatgtaagcatgcatataaatcatgtagagggaaatataaactcttactatgacagaactatgcagaaacctgacaaagtcgaagacggattagaaatgtgtcataaatctatctctccccctttaattcaacagcccataacattttctcctgacgaaatagataaatataagatcctacagctacaagcccagcagcatatgcagaagcaactcctatcaaagcatcttcgagttttgcctgctgcagggcctactgccttctctccggcctcaaccgtacagacagttccagttcaccagcacacttctatcaccaccatccaccacacgttcctgcagcattttgctgtttctgcttccttaagttctcatagcagtcacctccctattgctcatctacatcctctttcacaggcacatttcagtcctatttcattttcgactctgactccaaccattatccctgcacaccccactttcttagcaggtcatcccctgcatttagtagctgctacccccttccacccatctcacataacacttcagcctctgccccctacagcatttattcctacattgtttggtcctcacttaaatccagccacaacttctatcatccacttgaatcctttaatccaaccagtattccaaggtcaagatttttgccatcattcttgctctagccagatgcaacagctaaatgaagtgaaagaggccttaaatgtgtccacacacttgaactaa

SEQ ID NO: 203887 - DNA, 3968 bp, Homo sapiens
  Payload ID: 20213
  Gene Name: zinc finger protein 804B
  ENST ID: ENST00000611114
  CDS Start-End: 143-3943
ggattttgcagaaaagaagtccacagcaaaggccctggaagatgtaaaggcaaacttttactgtgaattatgtgacaagcagtatcacaaacaccaggagtttgacaatcatattaattcttatgaccatgctcataagcagagactgaaagaattaaagcaacgggaatttgctcgaaatgtagcttctaagtcatggaaagatgagaaaaaacaagaaaaagcacttaaacgacttcatcagctggctgagttaaggcagcaatctgaatgtgtttctggaaatggaccagcatacaaagcccccagggtagccatagaaaagcaactccagcaaggaattttccccattaagaatggcagaaaggtatcatgcatgaagagtgctcttctccttaaaggaaaaaatctccccagaatcatatccgataaacagcggtccaccatgccaaatcgacaccaattacaatcagacaggcgttgtttgtttggaaatcaggtactgcaaacatcttcagatctcagcaatgcaaatcacagaacaggagtatcatttactttttccaaaaaagtgcacctaaaattagaatcttcagcatcagttttcagtgagaacacagaagaaacccatgattgtaacaagtcacccatttataaaacaaaacaaactgcagataagtgcaagtgctgcaggtttgcaaataaagatacacaccttaccaaggaaaaagaggtaaatatctcaccaagccatctggaaagtgttttacacaataccatctccataaactctaaaattttgcaagacaaacacgactctattgatgagacactagaagattcaattggcattcatgcttcattctctaaatctaacattcatctttcagatgtagattttactcctaccagcagagaaaaagaaactagaaatacattgaagaacactttagaaaattgtgttaatcacccatgccaagcaaatgcttccttcagcccaccaaacatttacaaccatagtgatgccaggatatctgaatgcctggatgagttttcatcactggagccaagtgaacaaaagagtacagtgcatctgaatccaaattccagaatagagaacagagaaaaatctttagataaaacagaaagagttagcaaaaatgttcaaagacttgtaaaagaagcatgtacccataatgtggcatctaaaccactaccttttctccacgttcaaagcaaggatggccacaccactcttcaatggcctacggaacttctgctctttacaaaaacagaaccctgtatctcttatggctgcaacccactgtattttgattttaagctttctcggaacacaaaggaagaccacaatctagaggacttaaaaacagaattgggtaagaagcccttggaattgaagactaaaagagagagccaagtctcaggtttaactgaagaccaacaaaaattgatccaagaagattatcaatatccgaaaccaaagacgatgatagctaatccggattgggaaaaattccagaggaaatataatttggactacagtgattctgagccaaataagagtgaatatactttcagtgcaaatgatttggaaatgaaaaatcctaaagtgcctctttacctcaacacatctctaaaggattgtgctggaaagaataatagtagtgagaacaaacttaaggaagcttcaagggcccattggcaaggctgcagaaaggcagttctaaatgatatagatgaggacctatcttttccttcctacatctctaggtttaaaaagcataaattgattccctgcagtcctcatttggaatttgaagatgaaagacaattcaactgcaagtccagtccttgtacagtagggggtcacagtgaccatgggaaagacttcagtgtaattttgaagagtaaccacatcagcatgaccagcaaggtttccggatgtggaaaccaaagatacaagagatactctccacagtcatgtttgagtagatattcttcctctttggacacatcccctagcagcatgtctagcttgagaagtacttgttcaagtcatagattcaatggtaatagcagaggtaatttgctctgcttccataaaagagaacaccactcagttgaaaggcacaaacggaaatgtctaaagcacaactgcttctacttgtctgatgatataacaaagagcagccaaatgcagtctgaaccacagaaagagaggaactgcaaattgtgggaatcatttaaaaatgaaaaatactcaaaacgtagatattgtcactgcagagaaagacaaaaactgggcaaaaatcaacaacaattttcagggctaaaatctacgagaatcatctattgtgattctaactcacagatttcctgtactggaagcagtaaaaaaccacctaattgccagggaactcagcacgacagattggactcttactcaatagagaaaatgtattacttgaataaaagcaagagaaatcaagagtctttgggcagccctcacatttgtgatctgggaaaagtcaggcccatgaagtgtaactccgggaatatcagctgccttctaaagaactgttccagtggcccttcagaaaccacagaatcaaacactgcagaaggagagaggacccctctaacagcaaaaatccttttagaaagagtacaagccaagaaatgtcaagaacaatcaagtaatgttgagatctcttcaaacagttgtaaaagtgaattagaggctccttcgcaagtcccatgcacaattcaacttgcaccatcaggctgtaacagacaagcattgcctttgtctgaaaaaatacagtatgcaagtgagagcagaaatgatcaagacagtgcaattccaaggactacggagaaagacaaaagcaaaagttcacacacaaataattttacaattttagcagacactgattgtgataaccatctttctaaaggtataattcacctagtaacagagtctcagtcactaaacataaaaagggatgcaacaacaaaagaacaatcaaaacctttaattagtgaaatccaaccttttattcaaagctgtgacccagtaccaaatgaattccctggtgcttttccgtctaataaatatactggtgtgactgattcaacagagacccaagaagaccaaataaatctagacttacaggatgtaagcatgcatataaatcatgtagagggaaatataaactcttactatgacagaactatgcagaaacctgacaaagtcgaagacggattagaaatgtgtcataaatctatctctccccctttaattcaacagcccataacattttctcctgacgaaatagataaatataagatcctacagctacaagcccagcagcatatgcagaagcaactcctatcaaagcatcttcgagttttgcctgctgcagggcctactgccttctctccggcctcaaccgtacagacagttccagttcaccagcacacttctatcaccaccatccaccacacgttcctgcagcattttgctgtttctgcttccttaagttctcatagcagtcacctccctattgctcatctacatcctctttcacaggcacatttcagtcctatttcattttcgactctgactccaaccattatccctgcacaccccactttcttagcaggtcatcccctgcatttagtagctgctacccccttccacccatctcacataacacttcagcctctgccccctacagcatttattcctacattgtttggtcctcacttaaatccagccacaacttctatcatccacttgaatcctttaatccaaccagtattccaaggtcaagatttttgccatcattcttgctctagccagatgcaacagctaaatgaagtgaaagaggccttaaatgtgtccacacacttgaactaataagtgttaaagcccctcctgtgga

SEQ ID NO: 203888 - DNA, 2396 bp, Homo sapiens
  Payload ID: 20214
  Gene Name: zinc finger protein 805
  Uniprot ID: Q5CZA5
  ENST ID: ENST00000354309
  CDS Start-End: 480-1964
tggcggcgctggggaaatgagcaggtaggaggccgacagcgacctccgcgtctcggagcgaaccgtgagcctccccgtaacgagagagtttgactgtcagccaaggtcaccgggcccggcgcagggaaggggtggggctcggctgagcccgcgagacccgccctgctcgccgcagcccccgccccgctagggccacagggtcccggtatggcgatggctttgacggacccggcgcagggtgtcctgttcccagacctgagctgatctaccacctagagcatgggcaggagccatggaccaggaaggaagacctctcccaaggcacctgtccaggtgacaaaggaaaacccaagagcacagaacctaccacctgtgagctagccttgtctgaaggaatctctttttggggacaactaacacaaggagcttcaggggactcccagttggggcaacccaaggatcaggatgggttttcagaaatgcagggagaacgcttgagaccagggttagattcccaaaaggagaagcttcctggaaaaatgagccccaaacatgatggtttagggacagctgatagtgtgtgttcaaggattatacaggatcgagtctccttaggagatgatgtccatgactgtgactcacatggatcaggtaaaaatccagttattcaggaagaggaaaatatctttaaatgcaatgaatgtgaaaaagtgtttaacaagaaacgcctgcttgctcggcatgagaggattcactctggagtgaagccctatgaatgcacagagtgtggaaaaacctttagcaagagtacatacctcctgcagcaccacatggtccacactggggagaagccctataagtgcatggagtgtgggaaggcttttaatcggaagtcacaccttacccagcaccagcggattcacagtggagagaagccttataagtgcagtgaatgtggaaaggccttcacccaccgctccacttttgtcttgcataacaggagccacactggagaaaaaccctttgtgtgcaaagagtgtggcaaagcctttcgagataggccaggtttcattcgacactacatcatccacagtggtgagaatccctacgagtgcttcgaatgtggcaaggtcttcaaacacagatcatacctcatgtggcaccagcagactcataccggggagaagccctatgagtgcagtgaatgtgggaaggccttctgtgagagcgcagcgctgattcaccactatgtcatccacactggagagaagccctttgagtgcctcgagtgtgggaaggctttcaaccaccgatcctacctcaaaaggcaccagcggattcacactggggagaagccatatgtgtgtagtgaatgcggaaaggccttcacccactgctctactttcatcttgcataaaagggcccacactggagaaaaacctttcgagtgcaaagagtgtgggaaagcctttagcaatagggcagacctcattcgccacttcagcatccacactggagagaagccctatgagtgcatggagtgtggaaaggccttcaaccgcaggtcaggcctcacaaggcaccagcggattcatagtggagagaagccctatgaatgcatcgagtgtgggaaaacattttgctggagcacaaacctcattcgacactctatcatccacactggagagaagccgtatgagtgcagtgaatgtggaaaggccttcagtcgcagctcgtccctcactcagcatcaaaggatgcatactgggagaaatcctatcagtgtaacagatgtgggaagaccttttacaagtgggcagacctcagtcaacatccaagaacttttattggggaaaaactttttgaatgtcaccactgaggaaaatcttttgcaagaggaagcatcttacatggcatctgatcgtacataccaaagagaaaccccacaagtgtcttcactgtgagaaaaccttctgttgccaaatgtcatttgtcacctaaggagtcatattagaaaatcacgcagcttagagccttattctccatccgaattcatcctggaaaaacacccagtggttattacgcacttgggaaaacctttagctccatctttctcattagtttacagtgcaatgttatctcaggaatttttataaacagaaagaggtgacatagaaaagaaaatgaaatgcagacactgcttttatactgttgtcttgtatgtacatttctgtcctgtgtcaggaaagttagtaagggaaggtctggaaacttactcaatgtctttgttctacaacattgtctcttcttaagaagcattgtttttatgagaaataatgaagccttgagttatgaaatacttttatatttaaggattaaaagaaacatgaatgcgc

SEQ ID NO: 203889 - DNA, 1884 bp, Homo sapiens
  Payload ID: 20214
  Gene Name: zinc finger protein 805
  Uniprot ID: Q5CZA5
  ENST ID: ENST00000414468
  CDS Start-End: 1-1884
atggcgatggctttgacggacccggcgcaggtgtctgtgacctttgatgatgtggctgtgactttcacccaggaggagtggggccagctggacctagctcagcggaccctgtaccaggaggtgatgctggaaaactgtgggctcctggtatctctggggtgtcctgttcccagacctgagctgatctaccacctagagcatgggcaggagccatggaccaggaaggaagacctctcccaaggcacctgtccaggtgacaaaggaaaacccaagagcacagaacctaccacctgtgagctagccttgtctgaaggaatctctttttggggacaactaacacaaggagcttcaggggactcccagttggggcaacccaaggatcaggatgggttttcagaaatgcagggagaacgcttgagaccagggttagattcccaaaaggagaagcttcctggaaaaatgagccccaaacatgatggtttagggacagctgatagtgtgtgttcaaggattatacaggatcgagtctccttaggagatgatgtccatgactgtgactcacatggatcaggtaaaaatccagttattcaggaagaggaaaatatctttaaatgcaatgaatgtgaaaaagtgtttaacaagaaacgcctgcttgctcggcatgagaggattcactctggagtgaagccctatgaatgcacagagtgtggaaaaacctttagcaagagtacatacctcctgcagcaccacatggtccacactggggagaagccctataagtgcatggagtgtgggaaggcttttaatcggaagtcacaccttacccagcaccagcggattcacagtggagagaagccttataagtgcagtgaatgtggaaaggccttcacccaccgctccacttttgtcttgcataacaggagccacactggagaaaaaccctttgtgtgcaaagagtgtggcaaagcctttcgagataggccaggtttcattcgacactacatcatccacagtggtgagaatccctacgagtgcttcgaatgtggcaaggtcttcaaacacagatcatacctcatgtggcaccagcagactcataccggggagaagccctatgagtgcagtgaatgtgggaaggccttctgtgagagcgcagcgctgattcaccactatgtcatccacactggagagaagccctttgagtgcctcgagtgtgggaaggctttcaaccaccgatcctacctcaaaaggcaccagcggattcacactggggagaagccatatgtgtgtagtgaatgcggaaaggccttcacccactgctctactttcatcttgcataaaagggcccacactggagaaaaacctttcgagtgcaaagagtgtgggaaagcctttagcaatagggcagacctcattcgccacttcagcatccacactggagagaagccctatgagtgcatggagtgtggaaaggccttcaaccgcaggtcaggcctcacaaggcaccagcggattcatagtggagagaagccctatgaatgcatcgagtgtgggaaaacattttgctggagcacaaacctcattcgacactctatcatccacactggagagaagccgtatgagtgcagtgaatgtggaaaggccttcagtcgcagctcgtccctcactcagcatcaaaggatgcatactgggagaaatcctatcagtgtaacagatgtgggaagaccttttacaagtgggcagacctcagtcaacatccaagaacttttattggggaaaaactttttgaatgtcaccactgaggaaaatcttttgcaagaggaagcatcttacatggcatctgatcgtacataccaaagagaaaccccacaagtgtcttcactgtga

SEQ ID NO: 203890 - DNA, 3600 bp, Homo sapiens
  Payload ID: 20215
  Gene Name: zinc finger protein 808
  Uniprot ID: Q8N4W9
  ENST ID: ENST00000359798
  CDS Start-End: 181-2892
cgcggagattaacgcaaacccggaagcggatcgggtggagtgaaggtcacgtcgccatgatatctcttccaaatgcttgatgaaaaaggtggaagggtcacttgacccagggagttgaaggctgcagtgagccctgtttttgccaccacactccagcctgggattgatttctaaagactcatgttacgtgaggaagcagctcagaagaggaaaggaaaggagtcaggcatggctcttcctcagggacgcttgactttcagggatgtggctatagaattctcattggcagagtggaaattcctgaaccctgcacagagggctttgtacagggaagtgatgttggagaactacaggaacctggaggctgtggatatctcttccaaacacatgatgaaggaggtcttgtcaacagggcaaggcaatagagaagtgatccacacagggacattgcaaagacatcaaagttatcacattggagacttttgcttccaggaaattgagaaagaaattcataacattgagtttcagtgtcaagaagatgaaagaaatggccatgaagcacccacgacaaaaataaaaaagttgactggtagcacagaccaacatgatcacaggcatgctggaaacaagcctattaaagatcagcttggatcaagcttttattcacatctgcctgaactccacatatttcagatcaaaggtgaaattgctaatcaacttgagaagtctaccagtgatgcttcctcagtttcaacatcccaaagaatttcctgtaggccccaaatccatatttctaataactatgggaataatcccctgaattcttcattactcccacaaaaacaggaagtacacatgagagaaaaatctttcccatgtaatgagagtggcaaagcctttaattgtagctcactcttaaggaaacaccagataccccatttaggagacaaacaatataaatgtgatgtatgtggcaagctctttaatcacaagcaataccttgcatgccatcgtagatgtcacactggagagaaaccttacaagtgtaaagagtgtggaaagtccttcagttacaagtcatcccttacatgccatcatagacttcatactggagtaaaaccttacaagtgtaatgagtgtggcaaggtctttcgtcaaaattcagcccttgtaattcataaggcaattcatactggagagaaaccttacaagtgtaatgaatgtggcaaggcttttaatcaacaatcacacctttcacgccatcaaagacttcatactggagtgaaaccttacaaatgtaagatttgtgagaaggcttttgcgtgtcattcctatctggcaaaccatactagaattcatagtggagagaaaacatacaagtgtaatgagtgtggtaaggcttttaatcatcaatcaagccttgcacgtcatcatatacttcatactggagagaaaccttacaaatgtgaagaatgtgacaaagttttcagtcagaaatcaacccttgagagacataagagaattcatactggagagaaaccatacaaatgtaaggtttgtgatacagctttcacgtgtaattcacagctggcacgacatagaagaattcacactggagagaaaacttacaagtgtaatgagtgtcgcaagaccttcagccgcaggtcatcccttctatgccatcgtagacttcatagtggtgaaaaaccttacaagtgtaatcagtgtggcaataccttccgtcaccgggcatcccttgtataccatcgtagacttcacactctagagaaatcttacaaatgtacggtttgtaacaaggttttcatgcgtaattcagtcctggctgtacatactagaattcacactgcaaagaaaccttacaagtgtaatgaatgtgggaaagcttttaatcaacaatcacatctttcacgtcatcgtagacttcatactggagagaaaccttacaaatgtgaagcatgtgacaaagtttttggtcagaaatcagctcttgagtcacataagagaattcatactggagagaaaccatacagatgtcaggtttgtgacacagctttcacgtggaattcacagctggcacgacatacaagaattcacactggagaaaaaacttacaagtgtaatgagtgtgggaagaccttcagttacaagtcatcacttgtatggcatcgtagacttcatggtggagagaaatcttacaaatgtaaggtttgtgacaaggctttcgtgtgtcgttcctatgtggcaaaacatactagaattcacagtggaatgaaaccttacaagtgtaatgagtgcagcaagaccttcagtaacaggtcatcccttgtatgccatcgtagaattcatagtggtgagaaaccttacaagtgtagtgagtgcagcaagacgttcagtcagaaggcaacccttctatgccatcgtagacttcatagtggtgagaaaccttacaagtgtaacgactgtggcaataccttccgtcactggtcatcccttgtataccatcgtagacttcatactggagagaaatcttacaaatgtacggtttgtgacaaggctttcgtgcgtaattcatacctggcaagacatattagaattcacactgcagagaaaccttacaagtgtaatgaatgtggaaaggcttttaatgaacaatcacacctttcacgtcatcatagaattcatactggagagaaaccttacaaatgtgaagcatgtgacaaagttttcagtcgcaaatcacaccttaaaagacataggataattcatactggagagaaaccttacaagtgtaatgagtgtggcaaagcctttagtgaccggtcaacacttattcaccatcaggcaattcatggtatagggaaatttgattaatataatgattgtcacaaagtcttcagtaacactacaacaattgcaaatcattggagaatccatgatgaagagaaatcttctgagtgtaataaatgtggcatgtttttcagacattgttcatacattgcagttcattggcaacctcatactggagagaaaccttacaaatgtcatgattgaggcaaggtcttcagtcaagcttcatcctatgcaaaacaggagaattcatacaggagagaaacctcacaagtgtgatgattgtggcaaagcctttacttcacattcacacctcgttggacatcagagaatccatactggacagaaatcttgcaaatgtcatcagtgtggcaaggtcttcagtccgaggtcactccttgcagaacatgagaaaattcatttttgagataactgttcccaatgcagtgagtatagcaaaccatcaagcattaattgacattggagtcaattcagcattgacttgagtttgtgttgacttaacattgagttcaagccttaattgacattcaagtgtttatgttaagaggatggggccaggtgtggtggctcaggcctgtaatcccagcacgttggaagaccaaggcacataggtcacttgaggtcagaagtttgaaaccaccatggccaacagatgtcggccactttcgccatcctgttttttgtttcttattttcttatttatttatttat

SEQ ID NO: 203891 - DNA, 572 bp, Homo sapiens
  Payload ID: 20215
  Gene Name: zinc finger protein 808
  ENST ID: ENST00000461779
  CDS Start-End: 323-572
atggtgagttttgctctgtgttgcattaagtctccgcttcccaggtccccgccgcttctgtccctgggacgtggggtccccacagacctggaaattctcgcccgtcttccttcgcccagagcaaattgagacagcccagtgagaggccgggtgtcgcttcctttcgggtttaaagtcgtctggaggctggtcccgtcccggatatctcttccaaatgcttgatgaaaaaggtggaagggtcacttgacccagggagttgaaggctgcagtgagccctgtttttgccaccacactccagcctgggattgatttctaaagactcatgttacgtgaggaagcagctcagaagaggaaaggaaaggagtcaggcatggctcttcctcagggacgcttgactttcagggatgtggctatagaattctcattggcagagtggaaattcctgaaccctgcacagagggctttgtacagggaagtgatgttggagaactacaggaacctggaggctgtggatatctcttccaaacacatgatgaaggaggtcttgtcaacagggcaaggcaatagagaag

SEQ ID NO: 203892 - DNA, 553 bp, Homo sapiens
  Payload ID: 20215
  Gene Name: zinc finger protein 808
  ENST ID: ENST00000486474
  CDS Start-End: 246-553
aaacccggaagcggatcgggtggagtgaaggtcacgtcgccatgatatctcttccaaatgcttgatgaaaaaggtggaagggtcacttgacccagggagttgaaggctgcagtgagccctgtttttgccaccacactccagcctgggattgatttctaaagactcatgttacgtgaggaagcagctcagaagaggaaaggaaaggagtcaggcatggctcttcctcagatatctcttccaaacacatgatgaaggaggtcttgtcaacagggcaaggcaatagagaagtgatccacacagggacattgcaaagacatcaaagttatcacattggagacttttgcttccaggaaattgagaaagaaattcataacattgagtttcagtgtcaagaagatgaaagaaatggccatgaagcacccacgacaaaaataaaaaagttgactggtagcacagaccaacatgatcacaggcatgctggaaacaagcctattaaagatcagcttggatcaagcttttattcacatctgcctgaactccacatatttcagat

SEQ ID NO: 203893 - DNA, 601 bp, Homo sapiens
  Payload ID: 20215
  Gene Name: zinc finger protein 808
  ENST ID: ENST00000461321
  CDS Start-End: 82-601
ttcagtcctgggcgcgcaaaccccgaggcggatcgcgtggagtgaaggtcgtaccgcggcgcgattgatttctaaagactcatgttacgtgaggaagcagctcagaagaggaaaggaaaggagtcaggcatggctcttcctcagggacgcttgactttcagggatgtggctatagaattctcattggcagagtggaaattcctgaaccctgcacagagggctttgtacagggaagtgatgttggagaactacaggaacctggaggctgtggatatctcttccaaacacatgatgaaggaggtcttgtcaacagggcaaggcaatagagaagtgatccacacagggacattgcaaagacatcaaagttatcacattggagacttttgcttccaggaaattgagaaagaaattcataacattgagtttcagtgtcaagaagatgaaagaaatggccatgaagcacccacgacaaaaataaaaaagttgactggtagcacagaccaacatgatcacaggcatgctggaaacaagcctattaaagatcagcttggatcaagcttttattcacatctgcctgaactccacatatttcagatcaaag

SEQ ID NO: 203894 - DNA, 608 bp, Homo sapiens
  Payload ID: 20215
  Gene Name: zinc finger protein 808
  ENST ID: ENST00000465448
  CDS Start-End: 69-608
aacgcaaacccggaagcggatcgggtggagtgaaggtcacgtcgccatggattgatttctaaagactcatgttacgtgaggaagcagctcagaagaggaaaggaaaggagtcaggcatggctcttcctcagggacgcttgactttcagggatgtggctatagaattctcattggcagagtggaaattcctgaaccctgcacagagggctttgtacagggaagtgatgttggagaactacaggaacctggaggctgtggatatctcttccaaacacatgatgaaggaggtcttgtcaacagggcaaggcaatagagaagtgatccacacagggacattgcaaagacatcaaagttatcacattggagacttttgcttccaggaaattgagaaagaaattcataacattgagtttcagtgtcaagaagatgaaagaaatggccatgaagcacccacgacaaaaataaaaaagttgactggtagcacagaccaacatgatcacaggcatgctggaaacaagcctattaaagatcagcttggatcaagcttttattcacatctgcctgaactccacatatttcagatcaaaggtgaaattgctaatcaactt

SEQ ID NO: 203895 - DNA, 4233 bp, Homo sapiens
  Payload ID: 20215
  Gene Name: zinc finger protein 808
  Uniprot ID: Q8N4W9
  ENST ID: ENST00000487863
  CDS Start-End: 160-2664
gcgcggagattaacgcaaacccggaagcggatcgggtggagtgaaggtcacgtcgccatggattgatttctaaagactcatgttacgtgaggaagcagctcagaagaggaaaggaaaggagtcaggcatggctcttcctcagatatctcttccaaacacatgatgaaggaggtcttgtcaacagggcaaggcaatagagaagtgatccacacagggacattgcaaagacatcaaagttatcacattggagacttttgcttccaggaaattgagaaagaaattcataacattgagtttcagtgtcaagaagatgaaagaaatggccatgaagcacccacgacaaaaataaaaaagttgactggtagcacagaccaacatgatcacaggcatgctggaaacaagcctattaaagatcagcttggatcaagcttttattcacatctgcctgaactccacatatttcagatcaaaggtgaaattgctaatcaacttgagaagtctaccagtgatgcttcctcagtttcaacatcccaaagaatttcctgtaggccccaaatccatatttctaataactatgggaataatcccctgaattcttcattactcccacaaaaacaggaagtacacatgagagaaaaatctttcccatgtaatgagagtggcaaagcctttaattgtagctcactcttaaggaaacaccagataccccatttaggagacaaacaatataaatgtgatgtatgtggcaagctctttaatcacaagcaataccttgcatgccatcgtagatgtcacactggagagaaaccttacaagtgtaaagagtgtggaaagtccttcagttacaagtcatcccttacatgccatcatagacttcatactggagtaaaaccttacaagtgtaatgagtgtggcaaggtctttcgtcaaaattcagcccttgtaattcataaggcaattcatactggagagaaaccttacaagtgtaatgaatgtggcaaggcttttaatcaacaatcacacctttcacgccatcaaagacttcatactggagtgaaaccttacaaatgtaagatttgtgagaaggcttttgcgtgtcattcctatctggcaaaccatactagaattcatagtggagagaaaacatacaagtgtaatgagtgtggtaaggcttttaatcatcaatcaagccttgcacgtcatcatatacttcatactggagagaaaccttacaaatgtgaagaatgtgacaaagttttcagtcagaaatcaacccttgagagacataagagaattcatactggagagaaaccatacaaatgtaaggtttgtgatacagctttcacgtgtaattcacagctggcacgacatagaagaattcacactggagagaaaacttacaagtgtaatgagtgtcgcaagaccttcagccgcaggtcatcccttctatgccatcgtagacttcatagtggtgaaaaaccttacaagtgtaatcagtgtggcaataccttccgtcaccgggcatcccttgtataccatcgtagacttcacactctagagaaatcttacaaatgtacggtttgtaacaaggttttcatgcgtaattcagtcctggctgtacatactagaattcacactgcaaagaaaccttacaagtgtaatgaatgtgggaaagcttttaatcaacaatcacatctttcacgtcatcgtagacttcatactggagagaaaccttacaaatgtgaagcatgtgacaaagtttttggtcagaaatcagctcttgagtcacataagagaattcatactggagagaaaccatacagatgtcaggtttgtgacacagctttcacgtggaattcacagctggcacgacatacaagaattcacactggagaaaaaacttacaagtgtaatgagtgtgggaagaccttcagttacaagtcatcacttgtatggcatcgtagacttcatggtggagagaaatcttacaaatgtaaggtttgtgacaaggctttcgtgtgtcgttcctatgtggcaaaacatactagaattcacagtggaatgaaaccttacaagtgtaatgagtgcagcaagaccttcagtaacaggtcatcccttgtatgccatcgtagaattcatagtggtgagaaaccttacaagtgtagtgagtgcagcaagacgttcagtcagaaggcaacccttctatgccatcgtagacttcatagtggtgagaaaccttacaagtgtaacgactgtggcaataccttccgtcactggtcatcccttgtataccatcgtagacttcatactggagagaaatcttacaaatgtacggtttgtgacaaggctttcgtgcgtaattcatacctggcaagacatattagaattcacactgcagagaaaccttacaagtgtaatgaatgtggaaaggcttttaatgaacaatcacacctttcacgtcatcatagaattcatactggagagaaaccttacaaatgtgaagcatgtgacaaagttttcagtcgcaaatcacaccttaaaagacataggataattcatactggagagaaaccttacaagtgtaatgagtgtggcaaagcctttagtgaccggtcaacacttattcaccatcaggcaattcatggtatagggaaatttgattaatataatgattgtcacaaagtcttcagtaacactacaacaattgcaaatcattggagaatccatgatgaagagaaatcttctgagtgtaataaatgtggcatgtttttcagacattgttcatacattgcagttcattggcaacctcatactggagagaaaccttacaaatgtcatgattgaggcaaggtcttcagtcaagcttcatcctatgcaaaacaggagaattcatacaggagagaaacctcacaagtgtgatgattgtggcaaagcctttacttcacattcacacctcgttggacatcagagaatccatactggacagaaatcttgcaaatgtcatcagtgtggcaaggtcttcagtccgaggtcactccttgcagaacatgagaaaattcatttttgagataactgttcccaatgcagcttttcagtaagtggtatgcctgggaaacatggtgagacccccgtttctgcaaaaaatacaaaaattagctgggaatgatggcacatgcctgcagtatcaactactgtggagtctgcagtgggaggatggcttgagcctgggaggtcaagactatagtgagctgtaatcatgctactgcactccagcatggttgacagagcaagatgctgtctaaaaaagaatacttattgtaaagtttgggtacaggaataatgaagtcattgatagtttatgaacaggctatggagttgatgcccaaaagaaataaacagtttgtaaatgaataacttattttgagttgtgacaagacaatgttgaaagtgatgcatgaagcggcaggcagaccatccacatcagttttacagaaaaaaagttaatcttgttcgtgctgcagtgaagagaacagcaaacaggagaaacaatagtcaggaattcaataatagcctggttaacatgatgaaaccccgtctctactaaaaatacaaagattagctgggcacagtggtgggcacctgtaatcccagctactcaagaggctgaggcagaagaattgcttgaacccgggaggcggaagtttcgatgagccgggatcctgccgttgcactccagcctgggcaacaagagcaaacctctgtctaaaacaaacaaacaaaaaggtctagccccctctcctcctttgtctgccatcatggtgtgtgcttgactccacttcttgtcatgtcttctcacaagactttcaggattaagcggtttctggccaacaaccaaaagtaaaatcgtccgatttcccagtggattcgaatgaaaactggcaataaaatcaggtccaactttaaaaggagacattggagaagaaccaagctgggtctataaggaattgcacgtgagatggcacacatatttatgctgtgtgagcatcataatcacgttacttaagctgaaaatgtcactaccatctggagacttggacatgttttattgggaatatatttttttctctctgaatctgttatgaacgcattggttgggtgggttcagtaataaacatgtgagacctttcatttcaaaaaaaaaattttaatgacataatagattacctaaatttc

SEQ ID NO: 203896 - DNA, 1136 bp, Homo sapiens
  Payload ID: 20215
  Gene Name: zinc finger protein 808
  ENST ID: ENST00000611267
  CDS Start-End: 177-407
caaatgtgaagcatgtgacaaagttttcagtcgcaaatcacaccttaaaagacataggataattcatactgaagagaaatcttctgagtgtaataaatgtggcatgtttttcagacattgttcatacattgcagttcattggcaacctcatactggagagaaaccttacaaatgtcatgattgaggcaaggtcttcagtcaagcttcatcctatgcaaaacaggagaattcatacaggagagaaacctcacaagtgtgatgattgtggcaaagcctttacttcacattcacacctcgttggacatcagagaatccatactggacagaaatcttgcaaatgtcatcagtgtggcaaggtcttcagtccgaggtcactccttgcagaacatgagaaaattcatttttgagataactgttcccaatgcagtgagtatagcaaaccatcaagcattaattgacattggagtcaattcagcattgacttgagtttgtgttgacttaacattgagttcaagccttaattgacattcaagtgtttatgttaagaggatggggccaggtgtggtggctcaggcctgtaatcccagcacgttggaagaccaaggcacataggtcacttgaggtcagaagtttgaaaccaccatggccaacagatgtcggccactttcgccatcctgttttttgtttcttattttcttatttatttatttatttattttgagatggagtgtcactcttgttgcccagcctagagtgcaatgatgtgatctcagctcaccacaacctccgcctcccgggttcaagcgattcctctgcctcagcctccctagttgctgggattacaggcatgtgccaccacacccggctaattttttgtatttgtagtagagacggggtttctccatattaggctggtcttgaactcccaacctcaggtgatctgcccaccttggcatcccaaagtcctgggattacaggcatgagccaccgtacccggtcttgtttcttattttctattttttatttttttgagaggcaggagaatggcgggtgaacccaggaggtggagcttgcagtaagcccagatagcaccattgcaactccagcctgggagacagagtgagactccgtctatt

SEQ ID NO: 203897 - DNA, 610 bp, Homo sapiens
  Payload ID: 20216
  Gene Name: zinc finger protein 81
  ENST ID: ENST00000334937
  CDS Start-End: 345-554
gttgtcaggaggattcgacgttcagtgcccagggatgtggaggtgatggggggccggggaggagtctcactctgtcacccaggctggagtgcagtttgtgtgatctcaactcactgcaacctctgcctcctgggttcaagcgattctcctgcctcagcctcccgagtagctggaattacagagttcttggagtctctgcggagtccctgggccagatctcacagtgaaagctgcaggatcttccttctgaccccagcagtccccgttgagtccaccgatcccactggaattataaagttgtcagcaagaaagccccagggctgaagtccaagtccgtcgggaacatgccagctaacgaggacgctccccagccaggggaacatggcagtgcctgtgaggtatcagtgtcatttgaggatgtgactgtggacttcagtagagaggagtggcagcaactggactctactcaaagacgcctgtaccaggatgtaatgttggagaactacagccacctgctctcagtgggtaaggacaaccatcctgtgaagttgtgaggagcctgttatgggttaaattgtgcccccaaataaaatatgttgaagtcctaata

SEQ ID NO: 203898 - DNA, 7859 bp, Homo sapiens
  Payload ID: 20216
  Gene Name: zinc finger protein 81
  Uniprot ID: P51508
  ENST ID: ENST00000338637
  CDS Start-End: 250-2235
ggaagcggctgcggttctcgccggttctcagccggggtttgatagttgtcaggaggattcgacgttcagtgcccagggatgtggagagttcttggagtctctgcggagtccctgggccagatctcacagtgaaagctgcaggatcttccttctgaccccagcagtccccgttgagtccaccgatcccactggaattataaagttgtcagcaagaaagccccagggctgaagtccaagtccgtcgggaacatgccagctaacgaggacgctccccagccaggggaacatggcagtgcctgtgaggtatcagtgtcatttgaggatgtgactgtggacttcagtagagaggagtggcagcaactggactctactcaaagacgcctgtaccaggatgtaatgttggagaactacagccacctgctctcagtggggttcgaagttcctaaaccagaggtcatcttcaagttggagcaaggagaggggccatggacattggaaggggaagccccacatcagagctgttcagatgggaaatttggaattaagccttcccagaggagaatttctgggaaatctacatttcatagtgaaatggagggtgaagacacaagagatgattcattatactctattttagaagaattgtggcaagatgctgaacagataaagagatgtcaggaaaaacacaacaaacttctgagtcgcactactttcctcaataagaaaatattgaatacagagtgggattatgaatataaagactttggaaaatttgttcatccaagcccaaatctcattctttcacagaaaagaccccataaacgtgattcatttgggaagagttttaagcataatttagacttacatattcataataaaagcaatgcagcaaagaacctggataaaactattgggcatggtcaagtttttacccagaactcttcttatagtcaccacgaaaatacacatacaggagtgaagttctgtgaacgtaatcaatgtggaaaagtcctcagcctcaaacactcactcagtcaaaatgtgaaatttcccattggagagaaagcaaacacatgtactgaatttgggaagatcttcacccagaggtcacatttctttgctcctcaaaaaattcatactgtggaaaaacctcatgagcttagcaaatgtgtaaatgtttttacacagaagccactactcagtatatatctgagagttcatagagatgaaaaactctacatatgtactaaatgtgggaaggccttcatccagaattcagaattaattatgcatgagaaaactcatactagagagaaaccctataaatgcaatgaatgtgggaaatcatttttccaggtgtcatctctactcaggcatcagacaactcatactggagaaaaactctttgaatgcagtgaatgtggtaaaggcttctccctgaactcagccctcaatatacatcagaaaattcacactggagagagacatcacaaatgcagtgagtgtgggaaagcctttacccaaaaatcaacactcaggatgcatcagagaattcatacaggagagaggtcctatatctgtactcaatgtgggcaggccttcatccagaaggcacacttgattgcacatcaaagaattcatactggagagaagccttatgaatgcagtgactgtgggaaatctttcccttctaagtcacaactccagatgcataagagaattcatacaggagagaaaccctatatatgcactgaatgtgggaaggctttcaccaacaggtcaaatctcaatactcaccagaagtctcatactggagaaaagtcttatatatgtgctgaatgtgggaaggccttcaccgacaggtcaaatttcaataaacaccagaccattcacactggagagaaaccctatgtttgtgctgattgtgggagggccttcatccagaagtcagagttgattacacatcagagaattcatactacagagaagccttataaatgtcctgactgtgagaaatccttctccaagaaaccacatctcaaagtacatcaacgaattcacacaggggagaaaccatatatatgtgcagaatgtgggaaagccttcactgataggtcaaatttcaataaacatcagacaattcatactggagataaaccgtataaatgcagcgactgtggaaaggggttcacccagaaatcagttctcagtatgcatcgcaatattcatacatgaaagtaatcctgtttcttgaaaatgagagccttataaggctgacaaaagtcaggtctaactatatattataaaattcatccaagacagatcctatatgaatacattgtataaggaaaagcatcaggctatctcacttgagatggaaaaaaattattcagaagaaactctcttaaaaatgcattgaaggagagagaatttgcacagcctcatgaaatatagtaaaagtcatactgggaaaaatgttgtcagtttggtgtgttaggaaaagccttcctatagaaagtattataagttaaattgttaccaaattctttataggaaggagagtgcaaaattatgtaaatgatggtcaggtttactgtgttatattaagcaatttaaagtgataacaaaatgaaaggtagtgcagcaaaataatataactggtgagtagacctactttcagttccatagggtgtttgtggcagaacacagtgcagaacaggaggaatattacattttttttcaaatttagaataattatgtccatcaaatgtttcttactgaatatgtctatcaaatatgtttcttattgaatatttctatcaagtgaatccacaatttaaaagtcactttggttttatatatacacacatctgcagatataattttataagaacacacaaatataatcctgtcattcgtactggtttccatgacatagtatcttgttttctttcattgtggtacaatgcaaagtagccacagattcctcccatcccaagtagcgtctctttgtctactacttgactttgaacttggccacgtgactttctttggccaatggaaattagcaaagagaatcaataagaagcttgagaagtgtgcaaagcctgccttgaagcttaccctctcttgctgctctttgcaaacctgaagaatctcaaattgccctactcgggggtgaggagccaccacatggagcagtggtgagccagccttgctgaggccccttagaccaagtagcctgccaattgtcagaattgggagtgaggttttccaagacctctagccccagctgagccagcctagcccagaagagccataccagttattccagctgatttacagaattgtgagataaataaaatgatgatagttttaagcaacatgagttttggggttagtttgttgtacagaaaatgctaagtaatatttgaaagtatatgtttgggggagggggcatagtggaccaaaacgtgacaagtggcattggctttgggtctgagtggcacgtagaaactggaaaaacagtgaggaaaactgtttttcctcaaataacaaaggttggatagttggcaacccatgttatttagtagggaaagatacagaaaaacagtcatcaccatactctgtgggaagatagagaatggaccaaacgaactggtggatctggctaaggagatttgcagcagaatatgggaagtatcagtttgcttcttttagctgcatatgatacgatacagaaagagagaaatgaactaaagaaataactgtttctttggcaagcagaattcagaagaaatatggaaaagccaaggattgctgggttgaaaaataatgctttcacatcactagtctctccagctatctaactattcgcaaggtaaaaaatggcctcagggtaaagatcaaatcatggttgtgtctgtaagactctttattacagtgtgtgaaatagttcagttggtgcttaggagaccatctcagctaaacttaagggcttctaaaaatcttcatgacgttgtcccatagaagcctgacatactactcaaagtggagagagacctatcttaaaaagaattgctgatgtggcatttggggaaaggagtagatccaaaccagattcataggaaactcacaaagtttttaatagagttttactagtaaaactacctccaggttggacttccagggactgaaacagttcaaaatgaaaagtggcctctggattcccctccctaacttctatgaataggatacaagctgagaaagttactcagatgcaaacacggtccatttcttatggaaaatgaagggcatctcagagggaagacccaagaacaatatattaaaatgagctggggagccgttcccagggagaactgtgccctaatcaagaaacgtatctgcccctggagccaagggaaccgacaacatttgctctgtgggatttcagaatcgttatggaacagtgactgatatgtgcctcatggtcctcctctttttgaatgggagtgtctattacagttatcctgtacctatcccaccattgtatatattgggtgtatgttggggggcatgtaacttgtcatttagctcacaggtatctggatcaagaaactgaaaaactgtacccaaggaacctcagccacacctgaacctgatacagaagacttgagattctggattggagcttgatgccacaattttggatgagaaatttggaggtcctggaataggggtgaacacattttgcatggggtggtaatgtgaatactttgtgaccagaagacacactgtgttaggtagaaaaatgctacagatgtcttcatccctgtatatgtgtccttcttcagtctttatttctctttgtgtttcagttaggataatttctattgatctgtcttcaaattcactgatgttttttctctcaccctggctttgtcaagtctactgctgaacccattgaaggcattcttcaactcagttatgttttatttttatttgtaatatttccatttgattcttacaattttcatatatctgctgaaattccccatcttttcatgcatgttcatgttttcccctttaccctttgtcttagtcagtttgagctgctataataaagcaccatagacttggtggcttataaacaacagaaatttattcctcacagttctggagcctggaagtctgagatcagaatctagcaaggttaggtcttggtgacggccctcttcaaggttgcaaactgctcacttcttgcattttcccatgtctacagctagagaactctttgggatcccttttataagggcaccaatcccattcatgagttctccacccacattacctaactaccacccaaaggctccacctcctaataccatcacattgaggattaggattttaacatatgaattttgggggggatgcaatcattcagcccataataccctctaacatattaatcatagttatttttaactccctgtctgatagttccaactactaggtcaactgagtctaggtctgttgttgtcttctcttgctcttttgcatctaataatttttggctgaatgtcacagatgttgtatgtaggacagtagaaactgaggtaaatagtaattattcctggaaacagccatggttgcccttttgataggccattagcatggggagattgaatccatctaatcaggagttgggctgagtttgtgtttctttgttgccagtgttacctttgctgtaccatagacttaaaattcctctattgttatcttatgcttgaggtaggcactggtttgcccagagaatttttatttttcccagaccacacttgcctttaggcctgtaggcctttcctgtgtgcctgcatctcagggagggtctctctccatgttgttgcctctatgttagtagtagacaactgttattacttggttcttgctgacctggtgagttggggggcaggggttgtcttgggccagcctcagtttttgtcaggccatgaatccctgggtcttgagggtgggattttttagtgatcctgccctcttccactggtagaaggcctttaatgatctgggcccaggatgatttcctgcccttttatcatgggtggaatttttttttccatttccctcactctagtcacagtgaatctttaactgtgtcctgagggcaacagggtttgctgcacttcttttagtggcttaaggattttgttctgtaggggagtagggtttcattggagctttgtgccatttctatgttaacagcagcccccttgcaggcctaccccatggaggtaggctttctccagtcttcttccttgtccccgtgtttcttgagagcactcagtggatgactatggagaagagcctgcaagcagagaccaactacccttaggtctacagctctcatgagtctcccgcactcagcctttagcaattcattaaaaattcttgttgaattcttactgcttgtatagtggcctcatcttccttcctgctgtaccacagatggcccaggagaggcacttgtcttttattatatttcaagctagttggttgctctgtaatcttagctctctgatgggttcgagaaaacttatgtttttgcagattacccagctttgttcttgttataaagatgggagcagtgttctttccagatgtctacatgctaggcagaaactagaagtctggacagtctccatggtctcctactatcagaatatgtgcccttttcagtgtgactttgccacttcacccatcaagaggtagaatctatttcttcaacccctgcaactgagcttggctattttgttggccaatgggacattaacaagtatgatacaagcagaggcttgagaagtgcctgcacaatgaggcttgcccacttttgcagctctttggaatcctgaacccatgtgtggaaaagcctgaactgtgctgttggaaaatgagagcgatcacatggagcagtaatggagcaaagaccagccatcccagttgagataccctacaccaaccagattttcaactgctggacatatgaatgaagctatcctaggcatgcagtcttggtcaaggcaactttggctggcagtctctgagatgaccctgaatgatccccacctcctggtattctcactcttatataatcccctcctcttgagtttggactggaattagtgacttggttctagtgaatagaatgaggcagaggtaatgggatgtcatgttcaagattggttacaaaaagactgtggcttccattttgggtgcttgcttactctctcagatggctcatcataggggaaacctgctgctacatcatgagatagccctgtggaaaggtccacatgagtgaactttgaagcatatcctcccccagtttagcctttagatgaggaccacagccaaatagcttgactgtaagccagatagcttgactcatgagggaccttcagccagaggcatcttttgagccatacgaattcctgacccatagaaactgcaagacaataaatgttgttttaagttgctaaattttagggtaatttgttacacagtaataggttaataatacactggcccagattaggaaggttctgccatccatcccagccatcccaaacaactaccagaataatggattaaaacgttaactgttttaagtcactaagttttgggcagcatgataacaacccagcaaaaagctaactgatacattgattatttattgcatttcttcctccactattcttctctaacagatgaccaatactaataaactactgtgaacactttcatgttttaatctctgctctgtgctcataatcatatatagacat

SEQ ID NO: 203899 - DNA, 492 bp, Homo sapiens
  Payload ID: 20216
  Gene Name: zinc finger protein 81
  ENST ID: ENST00000376950
  CDS Start-End: 182-492
gtgcccagggatgtggagagttcttggagtctctgcggagtccctgggccagatctcacagtgaaagctgcaggatcttccttctgaccccagcagtccccgttgagtccaccgatcccactggaattataaagttgtcagcaagaaagccccagggctgaagtccaagtccgtcgggaacatgccagctaacgaggacgctccccagccaggggaacatggcagtgcctgtgaggtatcagtgtcatttgaggatgtgactgtggacttcagtagagaggagtggcagcaactggactctactcaaagacgcctgtaccaggatgtaatgttggagaactacagccacctgctctcagtggggttcgaagttcctaaaccagaggtcatcttcaagttggagcaaggagaggggccatggacattggaaggggaagccccacatcagagctgttcagggatttccacatatttcgtcacatccacagtaaa

SEQ ID NO: 203900 - DNA, 7933 bp, Homo sapiens
  Payload ID: 20216
  Gene Name: zinc finger protein 81
  Uniprot ID: P51508
  ENST ID: ENST00000376954
  CDS Start-End: 369-2354
ggaagcggctgcggttctcgccggttctcagccggggtttgatagttgtcaggaggattcgacgttcagtgcccagggatgtggagagtctcactctgtcacccaggctggagtgcagtttgtgtgatctcaactcactgcaacctctgcctcctgggttcaagcgattctcctgcctcagcctcccgagtagctggaattacagagttcttggagtctctgcggagtccctgggccagatctcacagtgaaagctgcaggatcttccttctgaccccagcagtccccgttgagtccaccgatcccactggaattataaagttgtcagcaagaaagccccagggctgaagtccaagtccgtcgggaacatgccagctaacgaggacgctccccagccaggggaacatggcagtgcctgtgaggtatcagtgtcatttgaggatgtgactgtggacttcagtagagaggagtggcagcaactggactctactcaaagacgcctgtaccaggatgtaatgttggagaactacagccacctgctctcagtggggttcgaagttcctaaaccagaggtcatcttcaagttggagcaaggagaggggccatggacattggaaggggaagccccacatcagagctgttcagatgggaaatttggaattaagccttcccagaggagaatttctgggaaatctacatttcatagtgaaatggagggtgaagacacaagagatgattcattatactctattttagaagaattgtggcaagatgctgaacagataaagagatgtcaggaaaaacacaacaaacttctgagtcgcactactttcctcaataagaaaatattgaatacagagtgggattatgaatataaagactttggaaaatttgttcatccaagcccaaatctcattctttcacagaaaagaccccataaacgtgattcatttgggaagagttttaagcataatttagacttacatattcataataaaagcaatgcagcaaagaacctggataaaactattgggcatggtcaagtttttacccagaactcttcttatagtcaccacgaaaatacacatacaggagtgaagttctgtgaacgtaatcaatgtggaaaagtcctcagcctcaaacactcactcagtcaaaatgtgaaatttcccattggagagaaagcaaacacatgtactgaatttgggaagatcttcacccagaggtcacatttctttgctcctcaaaaaattcatactgtggaaaaacctcatgagcttagcaaatgtgtaaatgtttttacacagaagccactactcagtatatatctgagagttcatagagatgaaaaactctacatatgtactaaatgtgggaaggccttcatccagaattcagaattaattatgcatgagaaaactcatactagagagaaaccctataaatgcaatgaatgtgggaaatcatttttccaggtgtcatctctactcaggcatcagacaactcatactggagaaaaactctttgaatgcagtgaatgtggtaaaggcttctccctgaactcagccctcaatatacatcagaaaattcacactggagagagacatcacaaatgcagtgagtgtgggaaagcctttacccaaaaatcaacactcaggatgcatcagagaattcatacaggagagaggtcctatatctgtactcaatgtgggcaggccttcatccagaaggcacacttgattgcacatcaaagaattcatactggagagaagccttatgaatgcagtgactgtgggaaatctttcccttctaagtcacaactccagatgcataagagaattcatacaggagagaaaccctatatatgcactgaatgtgggaaggctttcaccaacaggtcaaatctcaatactcaccagaagtctcatactggagaaaagtcttatatatgtgctgaatgtgggaaggccttcaccgacaggtcaaatttcaataaacaccagaccattcacactggagagaaaccctatgtttgtgctgattgtgggagggccttcatccagaagtcagagttgattacacatcagagaattcatactacagagaagccttataaatgtcctgactgtgagaaatccttctccaagaaaccacatctcaaagtacatcaacgaattcacacaggggagaaaccatatatatgtgcagaatgtgggaaagccttcactgataggtcaaatttcaataaacatcagacaattcatactggagataaaccgtataaatgcagcgactgtggaaaggggttcacccagaaatcagttctcagtatgcatcgcaatattcatacatgaaagtaatcctgtttcttgaaaatgagagccttataaggctgacaaaagtcaggtctaactatatattataaaattcatccaagacagatcctatatgaatacattgtataaggaaaagcatcaggctatctcacttgagatggaaaaaaattattcagaagaaactctcttaaaaatgcattgaaggagagagaatttgcacagcctcatgaaatatagtaaaagtcatactgggaaaaatgttgtcagtttggtgtgttaggaaaagccttcctatagaaagtattataagttaaattgttaccaaattctttataggaaggagagtgcaaaattatgtaaatgatggtcaggtttactgtgttatattaagcaatttaaagtgataacaaaatgaaaggtagtgcagcaaaataatataactggtgagtagacctactttcagttccatagggtgtttgtggcagaacacagtgcagaacaggaggaatattacattttttttcaaatttagaataattatgtccatcaaatgtttcttactgaatatgtctatcaaatatgtttcttattgaatatttctatcaagtgaatccacaatttaaaagtcactttggttttatatatacacacatctgcagatataattttataagaacacacaaatataatcctgtcattcgtactggtttccatgacatagtatcttgttttctttcattgtggtacaatgcaaagtagccacagattcctcccatcccaagtagcgtctctttgtctactacttgactttgaacttggccacgtgactttctttggccaatggaaattagcaaagagaatcaataagaagcttgagaagtgtgcaaagcctgccttgaagcttaccctctcttgctgctctttgcaaacctgaagaatctcaaattgccctactcgggggtgaggagccaccacatggagcagtggtgagccagccttgctgaggccccttagaccaagtagcctgccaattgtcagaattgggagtgaggttttccaagacctctagccccagctgagccagcctagcccagaagagccataccagttattccagctgatttacagaattgtgagataaataaaatgatgatagttttaagcaacatgagttttggggttagtttgttgtacagaaaatgctaagtaatatttgaaagtatatgtttgggggagggggcatagtggaccaaaacgtgacaagtggcattggctttgggtctgagtggcacgtagaaactggaaaaacagtgaggaaaactgtttttcctcaaataacaaaggttggatagttggcaacccatgttatttagtagggaaagatacagaaaaacagtcatcaccatactctgtgggaagatagagaatggaccaaacgaactggtggatctggctaaggagatttgcagcagaatatgggaagtatcagtttgcttcttttagctgcatatgatacgatacagaaagagagaaatgaactaaagaaataactgtttctttggcaagcagaattcagaagaaatatggaaaagccaaggattgctgggttgaaaaataatgctttcacatcactagtctctccagctatctaactattcgcaaggtaaaaaatggcctcagggtaaagatcaaatcatggttgtgtctgtaagactctttattacagtgtgtgaaatagttcagttggtgcttaggagaccatctcagctaaacttaagggcttctaaaaatcttcatgacgttgtcccatagaagcctgacatactactcaaagtggagagagacctatcttaaaaagaattgctgatgtggcatttggggaaaggagtagatccaaaccagattcataggaaactcacaaagtttttaatagagttttactagtaaaactacctccaggttggacttccagggactgaaacagttcaaaatgaaaagtggcctctggattcccctccctaacttctatgaataggatacaagctgagaaagttactcagatgcaaacacggtccatttcttatggaaaatgaagggcatctcagagggaagacccaagaacaatatattaaaatgagctggggagccgttcccagggagaactgtgccctaatcaagaaacgtatctgcccctggagccaagggaaccgacaacatttgctctgtgggatttcagaatcgttatggaacagtgactgatatgtgcctcatggtcctcctctttttgaatgggagtgtctattacagttatcctgtacctatcccaccattgtatatattgggtgtatgttggggggcatgtaacttgtcatttagctcacaggtatctggatcaagaaactgaaaaactgtacccaaggaacctcagccacacctgaacctgatacagaagacttgagattctggattggagcttgatgccacaattttggatgagaaatttggaggtcctggaataggggtgaacacattttgcatggggtggtaatgtgaatactttgtgaccagaagacacactgtgttaggtagaaaaatgctacagatgtcttcatccctgtatatgtgtccttcttcagtctttatttctctttgtgtttcagttaggataatttctattgatctgtcttcaaattcactgatgttttttctctcaccctggctttgtcaagtctactgctgaacccattgaaggcattcttcaactcagttatgttttatttttatttgtaatatttccatttgattcttacaattttcatatatctgctgaaattccccatcttttcatgcatgttcatgttttcccctttaccctttgtcttagtcagtttgagctgctataataaagcaccatagacttggtggcttataaacaacagaaatttattcctcacagttctggagcctggaagtctgagatcagaatctagcaaggttaggtcttggtgacggccctcttcaaggttgcaaactgctcacttcttgcattttcccatgtctacagctagagaactctttgggatcccttttataagggcaccaatcccattcatgagttctccacccacattacctaactaccacccaaaggctccacctcctaataccatcacattgaggattaggattttaacatatgaattttgggggggatgcaatcattcagcccataataccctctaacatattaatcatagttatttttaactccctgtctgatagttccaactactaggtcaactgagtctaggtctgttgttgtcttctcttgctcttttgcatctaataatttttggctgaatgtcacagatgttgtatgtaggacagtagaaactgaggtaaatagtaattattcctggaaacagccatggttgcccttttgataggccattagcatggggagattgaatccatctaatcaggagttgggctgagtttgtgtttctttgttgccagtgttacctttgctgtaccatagacttaaaattcctctattgttatcttatgcttgaggtaggcactggtttgcccagagaatttttatttttcccagaccacacttgcctttaggcctgtaggcctttcctgtgtgcctgcatctcagggagggtctctctccatgttgttgcctctatgttagtagtagacaactgttattacttggttcttgctgacctggtgagttggggggcaggggttgtcttgggccagcctcagtttttgtcaggccatgaatccctgggtcttgagggtgggattttttagtgatcctgccctcttccactggtagaaggcctttaatgatctgggcccaggatgatttcctgcccttttatcatgggtggaatttttttttccatttccctcactctagtcacagtgaatctttaactgtgtcctgagggcaacagggtttgctgcacttcttttagtggcttaaggattttgttctgtaggggagtagggtttcattggagctttgtgccatttctatgttaacagcagcccccttgcaggcctaccccatggaggtaggctttctccagtcttcttccttgtccccgtgtttcttgagagcactcagtggatgactatggagaagagcctgcaagcagagaccaactacccttaggtctacagctctcatgagtctcccgcactcagcctttagcaattcattaaaaattcttgttgaattcttactgcttgtatagtggcctcatcttccttcctgctgtaccacagatggcccaggagaggcacttgtcttttattatatttcaagctagttggttgctctgtaatcttagctctctgatgggttcgagaaaacttatgtttttgcagattacccagctttgttcttgttataaagatgggagcagtgttctttccagatgtctacatgctaggcagaaactagaagtctggacagtctccatggtctcctactatcagaatatgtgcccttttcagtgtgactttgccacttcacccatcaagaggtagaatctatttcttcaacccctgcaactgagcttggctattttgttggccaatgggacattaacaagtatgatacaagcagaggcttgagaagtgcctgcacaatgaggcttgcccacttttgcagctctttggaatcctgaacccatgtgtggaaaagcctgaactgtgctgttggaaaatgagagcgatcacatggagcagtaatggagcaaagaccagccatcccagttgagataccctacaccaaccagattttcaactgctggacatatgaatgaagctatcctaggcatgcagtcttggtcaaggcaactttggctggcagtctctgagatgaccctgaatgatccccacctcctggtattctcactcttatataatcccctcctcttgagtttggactggaattagtgacttggttctagtgaatagaatgaggcagaggtaatgggatgtcatgttcaagattggttacaaaaagactgtggcttccattttgggtgcttgcttactctctcagatggctcatcataggggaaacctgctgctacatcatgagatagccctgtggaaaggtccacatgagtgaactttgaagcatatcctcccccagtttagcctttagatgaggaccacagccaaatagcttgactgtaagccagatagcttgactcatgagggaccttcagccagaggcatcttttgagccatacgaattcctgacccatagaaactgcaagacaataaatgttgttttaagttgctaaattttagggtaatttgttacacagtaataggttaataatacactggcccagattaggaaggttctgccatccatcccagccatcccaaacaactaccagaataatggattaaaacgttaactgttttaagtcactaagttttgggcagcatgataacaacccagcaaaaagctaactgatacattgattatttattgcatttcttcctccactattcttctctaacagatgaccaatactaataaactactgtgaacactt

SEQ ID NO: 203901 - DNA, 2098 bp, Homo sapiens
  Payload ID: 20217
  Gene Name: zinc finger protein 812
  Uniprot ID: P0C7V5
  ENST ID: ENST00000457674
  CDS Start-End: 520-1884
gtcaaatacagaatgtgatgttccattccagccaatggaaaccggacgctgcagtagggtggacacgtcaggttataaatgaccctgtttcctttgtttagtgtactctagtggcaaaactgctggctagtgtacctgttctgccaaaagtaaaatgggcttactgaggaaattaaatttatgttcaagtgctatttctttatgcaccggggaacaagcatttctaacaacctggtcctacgtggctgaaactggatcccagaagccccgtccttcccgaagctcgtagcggaagtgacatcagcccgccgccactatcttttcccgcgctggctgcccacggtcagtgctgtttcacctttatcttggtggagtcgaccccggctgtggacttcaaataaccctgtacaaagaggaatggagattgcctctattcacctagattcataagttgccctgaggcaatcttggcatcaaggaagagagcattgaggcacaactgaccatcagcttcagagaatggcagtcactgatttgtcccatgggttttttcccagggaaccaatctgcccttttgaagaaaagacaaagataggaacgatggtggaggactacctggcaaattcttatcaggattcagtgacgtttgatgatgtggctgtggagttcaccccagaggagtgggctttactggacacaactgagaaatgcctctacagagatgtgatgttggagaactatgtgaacctggcctctgtggaagctacagtggatggaaactctgagaattgtggagaggtcttcagtgaatggttttgccttaaaacacacatgagagctcagaatggagggaacatctttgagggtaattgttatggaaaagacatcctcagtgtgcacaaggaagcctctattggacaggaactttccaaatttaatccatgtggaaaagtcttcaccttaactccagatcttgctgcacatcttggaattctcaatgcaagacaaccatacaaatgtaaggaatgtagaaaaggctttaagtattttgcaagccttgataatcacatgggaatccacattggagagaaattctgtgaatttcaggaatgtaggagagccatcactcattcctcacacctaaagcagtgtgtaacagttcatactggaaagaaatctaaaaagactaagaaacatgggaaatccttcactaatttttctcaactttctgcacatgtgaaaattcataaaggagagaagtcctttgaatgtaaagaatgtggaagatcctttagaaattcctcatcctttaatgttcacattcaaattcacactggaataaaaccacacaaatatacggaatgtgggaaagccttcactaggtcaactcaccttactcaacatgtaagaactcacactggaataaaaccctatgaatgtaaggaatgtggccaagccttcactcagtacacgggccttgctatacacatacgaaatcacactggagagaaacactatcagtgtaaggaatgtgggaaagccttcaatggatcctcaacccttactcaacataaaataattcacacaggagagaagccttatggatgtgttgaatgtgggaagaccttcattacttcttcctatcgtagtaaacatttgaaaactcaccatgaagaaaggccctttgtatgcaagatatgtgggaaagcatttctatattcctcaccccttaatgttcacctgcaaactcataccagagagaaagccctcatatgtaaagaatgtgggaaagcttttgctgtttcctcacacctaagtagacatgaaagaattcacactggggaggaaccctatgaatataagggtatgaatgttaccatttagctcattggttgccatctttaattagtggcagtgacactaaagatattcagatttgtcctaaatgccttttggaggttgtaatggctcatgaattggccttgggtgccatcacaagggtctgaaattaaacctacaggttctgaatacaacatcatggttgcctgagtctgggcatctgtgaagaagggtaatggatggtgaggtcagtactgca

SEQ ID NO: 203902 - DNA, 2011 bp, Homo sapiens
  Payload ID: 20217
  Gene Name: zinc finger protein 812
  Uniprot ID: P0C7V5
  ENST ID: ENST00000453792
  CDS Start-End: 647-2011
ctttgcttcttttaaaaagttctgacttggtagccaaccgggtcaaatacagaatgtgatgttccattccagccaatggaaaccggacgctgcagtagggtggacacgtcaggttataaatgaccctgtttcctttgtttagtgtactctagtggcaaaactgctggctagtgtacctgttctgccaaaagtaaaatgggcttactgaggaaattaaatttatgttcaagtgctatttctttatgcaccggggaacaagcatttctaacaacctggtcctacgtggctgaaactggatcccagaagccccgtccttcccgaagctcgtagcggaagtgacatcagcccgccgccactatcttttcccgcgctggctgcccacggtcagtgctgtttcacctttatcttggtggagtcgaccccggctgtggaaaaggatttctgccattctggtaaggttggctctggccccgcatcctcccgcgtcaggaacctggcgattccggagtgttcttggacttcaaataaccctgtacaaagaggaatggagattgcctctattcacctagattcataagttgccctgaggcaatcttggcatcaaggaagagagcattgaggcacaactgaccatcagcttcagagaatggcagtcactgatttgtcccatgggttttttcccagggaaccaatctgcccttttgaagaaaagacaaagataggaacgatggtggaggactacctggcaaattcttatcaggattcagtgacgtttgatgatgtggctgtggagttcaccccagaggagtgggctttactggacacaactgagaaatgcctctacagagatgtgatgttggagaactatgtgaacctggcctctgtggaagctacagtggatggaaactctgagaattgtggagaggtcttcagtgaatggttttgccttaaaacacacatgagagctcagaatggagggaacatctttgagggtaattgttatggaaaagacatcctcagtgtgcacaaggaagcctctattggacaggaactttccaaatttaatccatgtggaaaagtcttcaccttaactccagatcttgctgcacatcttggaattctcaatgcaagacaaccatacaaatgtaaggaatgtagaaaaggctttaagtattttgcaagccttgataatcacatgggaatccacattggagagaaattctgtgaatttcaggaatgtaggagagccatcactcattcctcacacctaaagcagtgtgtaacagttcatactggaaagaaatctaaaaagactaagaaacatgggaaatccttcactaatttttctcaactttctgcacatgtgaaaattcataaaggagagaagtcctttgaatgtaaagaatgtggaagatcctttagaaattcctcatcctttaatgttcacattcaaattcacactggaataaaaccacacaaatatacggaatgtgggaaagccttcactaggtcaactcaccttactcaacatgtaagaactcacactggaataaaaccctatgaatgtaaggaatgtggccaagccttcactcagtacacgggccttgctatacacatacgaaatcacactggagagaaacactatcagtgtaaggaatgtgggaaagccttcaatggatcctcaacccttactcaacataaaataattcacacaggagagaagccttatggatgtgttgaatgtgggaagaccttcattacttcttcctatcgtagtaaacatttgaaaactcaccatgaagaaaggccctttgtatgcaagatatgtgggaaagcatttctatattcctcaccccttaatgttcacctgcaaactcataccagagagaaagccctcatatgtaaagaatgtgggaaagcttttgctgtttcctcacacctaagtagacatgaaagaattcacactggggaggaaccctatgaatataagggtatgaatgttaccatttag

SEQ ID NO: 203903 - DNA, 565 bp, Homo sapiens
  Payload ID: 20217
  Gene Name: zinc finger protein 812
  ENST ID: ENST00000590544
  CDS Start-End: 469-565
gtcaaatacagaatgtgatgttccattccagccaatggaaaccggacgctgcagtagggtggacacgtcaggttataaatgaccctgtttcctttgtttagtgtactctagtggcaaaactgctggctagtgtacctgttctgccaaaagtaaaatgggcttactgaggaaattaaatttatgttcaagtgctatttctttatgcaccggggaacaagcatttctaacaacctggtcctacgtggctgaaactggatcccagaagccccgtccttcccgaagctcgtagcggaagtgacatcagcccgccgccactatcttttcccgcgctggctgcccacggtcagtgctgtttcacctttatcttggtggagtcgaccccggctgtgcagacaagaagctacagtggatggaaactctgagaattgtggagaggtcttcagtgaatggttttgccttaaaacacacatgagagctcagaatggagggaacatctttgagggtaattgttatggaaaagacatcctcagtgtgcacaaggaagcctctattggacaggaacttt

SEQ ID NO: 203904 - DNA, 587 bp, Homo sapiens
  Payload ID: 20217
  Gene Name: zinc finger protein 812
  ENST ID: ENST00000585964
  CDS Start-End: 502-587
actctagtggcaaaactgctggctagtgtacctgttctgccaaaagtaaaatgggcttactgaggaaattaaatttatgttcaagtgctatttctttatgcaccggggaacaagcatttctaacaacctggtcctacgtggctgaaactggatcccagaagccccgtccttcccgaagctcgtagcggaagtgacatcagcccgccgccactatcttttcccgcgctggctgcccacggtcagtgctgtttcacctttatcttggtggagtcgaccccggctgtggaaaaggatttctgccattctggtaaggttggctctggccccgcatcctcccgcgtcaggaacctggcgattccggagtgttcttggacttcaaataaccctgtacaaagaggaatggagattgcctctattcacctagattcataagttgccctgaggcaatcttggcatcaaggaagagagcattgaggcacaactgaccatcagcttcagagaatggcagtcactgatttgtcccatgggttttttcccagggaaccaatctgcccttttgaagaaaagacaaagataggaacgatggt

SEQ ID NO: 203905 - DNA, 6151 bp, Homo sapiens
  Payload ID: 20218
  Gene Name: zinc finger protein 813
  Uniprot ID: Q6ZN06
  ENST ID: ENST00000396403
  CDS Start-End: 129-1982
agattcgcgaaaacccggaagcggatcgcgtggagtgacggtcccacggcagcgcgattgacttctaaagactcttggtatgtgaggaagaaacctggaagaggaagaggaaagcaaaggagtcagggatggctcttcctcagggtctattgacattcagggatgtggccatagaattctctcaggaggagtggaaatgcctggaccctgctcagaggactctatacagggacgtgatgctggagaattataggaacctggtctccctggatatctcttccaaatgcatgatgaaggagttctcatcaacagcacaaggcaatagagaagtgatccacacagggacattgcaaagacatgaaagtcatcacactggagactttcgctttcaggaaattgataaagatattcataacttagagtttcagtggcaagaagatgaaagaaatagccatgaagcacccatgacagaaatcaaaaagttgactggtagtgcagaccgatatgatcaaaggcatgctggaaacaagcctattaaagatcagcttggatcaagctttcattcgcatctgcctgaactccacatgtttcagacccaagggaaaattggtaatcaagtggagaagtctatcaacgatgcttcctcaatttcaacatcccaaagaatttcttgtaggcccaaaacccatatttctaataactatgggaataatttccggaattcttcgttactcacacaaaaacaggaggtacacatgagagaaaagtctttccaatgtaatgagagtggcaaagcctttaattatagctcactcttaaggaaacatcaaataatccatttaggagagaaacaatataaatgtgatgtatgtggcaaggtctttaatcggaagcgaaacctagtgtgccatcgtagatgtcacactggggagaaaccttacaggtgtaatgagtgtggcaagactttcagtcagacgtattcccttacatgccatcgtagacttcatactggagagaaaccttacaaatgtgaagaatgtgacaaagctttcagtttcaaatcaaaccttaaaagacataggagaattcatgctggagaaaaaccatacaagtgtaatgaatgtggcaagacctttagtcagacgtcatcccttacatgccatcgtagacttcatactggagagaaacctttcaagtgtaatgagtgtggcaagacctttagtcggaagtcatcccttacatgccatcatagacttcatacgggagagaaaccttataagtgtaatgaatgtggcaagaccttcagtcaggagttaacccttaaatgccatcgtagacttcataccggagagaagccttacaagtgtaatgaatgtggcaaggtttttaataaaaaggcaaaccttgcacgtcatcatagacttcatagtggagagaaaccctacaagtgtactgagtgtgtcaagacgttcagtcgaaattcagcccttgtaattcataaggctattcatattggagagaaacgttacaagtgtaatgagtgtggcaagacgttcagtcgaatttcagccctcgtaattcatacggcaattcatactggagagaaaccttacaagtgtaatgaatgtggcaagggttttaatcggaaaacacaccttgcatgtcatcatagacttcatactggagagaaaccttacaagtgtaatgaatgtggcaaggtttttaatcgaaaaacacaccttgcacatcatcatagacttcatactggagataaaccttacaagtgtaatgaatgtggcaaggtttttaatcaaaaagcacaccttgcacgtcaccatagacttcatactggagagaaaccttacaagtgtaatgaatgtggcaaggtttttaatcaaaaagcaaaccttgcacgtcatcatagacttcatactggagagaaaccttacaagtttaatgagtgtggcaaagcttttaattgaaaagcaaagcttgcacatcatcatacaattcatactggaaagaaacaagtgcaatgagtgtggcaagaccttctgtcacaattcagtccttgtaattcataagaattcatactggagagaaacaagtgtaatgaacgttgcaaaatttttaatcaacaagcacaccttccacgtcatcatagacttcatagtggagagaaaccttagaaatgtgaagcatgtgacaaagtttacagtggcaaatcgagcctcaaaagacaggagaattcatactggagagaaagcttacaaaggtgaagaatatcacagagttttcagtcacaagtcaaaccttgaaagacataaaataaatcatactgcagagaaaccataaaattgtaagagttcgtgacaaggctttcgggcatgactcacacctggcacaacatcctagaatttatactggagagaaaccttacaagtgtaatgagtctggcaaagccttaatgagcagtcaacacttactcaccatcaggcaatccatggtgaaggaaacttgactaatgtaatgattgtcaccaagtcttcagtaacgctacaaccattgcaaatcattggagaacccataaggaagagagatcatacaagtgtaataatcggcaaatttttcagacatcgtccataccttgcagttcattggcgaactcatactggagacaaaccttataaatgtcatgattgaggcaaggtcttcagtcaagcttcatcctatgcaaaacataggagaattcatacaggagagaaacctcacgtgtgatgattgtggcaaagcctttacttcacgttcacacctccttagacatcagagaatgcacactggacggaaatcttacaaatgtcatcagtgtggcaaggttttcagtctgacttcactccttgcagaatatcagaaaattcattttgagataattgttccaaatgcaatgagtagagcaaaccatcaagcagtaattgacattaaagtgtttatgttaagaggattgggccaggtacagtgtctcacacctgtaatcccagcactttgggaggccaaggcgggtagatcacttgaggtcaggagtttcagatcagtctggccaacaaacatgagccacttttcccagtttgctttttgttctttaacaaaaactgatagggatttttatgggtaccgtgttgaatctaaatcacattgggttatataatcatttaacaatattaatttttccaatccatcaatatgggttatatgtctgtatatgtttttaatcatattgatgtatatttgtagatttcaaggtacaaacttctcacctttttacttttatttctatttctttaagttctctagcaaatggaagtgtttttaaattttcttttaaaattgtttattgttacaaacttctcatctttttgcttttattcctaagtatttcttactttaagttctctagcaaatggaagtgtttttaaattttcttttaaaattgtttattgttaatgtatggaaattcagctaatttttggtgctgatattgtactgtgcagatacactgaatctgtttattacttccagtagtattttggttgagtctttgtgattttctacacagaagatcatgtcatctacaaacacatataattttacttctttctttctgatttggatgggtttgatttcttttgctatttcattgctctggctaggacagccagtatttattgaatagaaggggtgagagcattcttccatcatgtgagatcctacaggaaaatcattccatgttccctgcttcgttatctactcgttggtcatttcatggatggcctttctattgttgaggtaaatttccttttctgtctattttgttcagaatttctatgatgagtggattttgaattttgtgaaatactttttctccatctattgagatgatgtggttttcatctttcattctgttcaagtggcatatcacattgatttgcttgactatgttgaaccatccttgcatcccagaaataagtggcacttgagtatctacagtcctttttacatcctcttgaatacagctttttagtacaaggggtcttcaagaagttcatggaaaaatacatattttgcatattatgagaaaattgtgtatgaatttcccagtttttgcaccaaaataaactggtacgaatctgttatgtctgaacaggtcctagtttgaggcacccagaaggataagacatgagttttaaaagagactttctctgccgggcgcagtggctcatgcctgtaatcccaacactttgggaggccaaggtgggtggatcacctgagatccagagttcgagaccagcctcaccaacatggagaaacagcatctctactaaaaatacaaaattagccaggcatggtggcaaatgcctgtaatcccagatactctggaggctgaggcaggagaatggcttgaacccgggaggcagagattgctgtgagccgagattgcaccattgcactccagcctggtcaacaagagcgaaactctgtctcaaaaaaaaaaaaaagaaaagaaaagaaaagagactctatcaaagcaatataaatcctgctaaaattgaaacaaaaaggagcatcaaatttacagtgagaccagatgcagtggctcaggcctgtaatcccagcactttcagaggccaagacaggtgggtcatgtaagcccaggtattcaagacaagcctgggcaacatggtgaaacccccttgtctacaaaaaatacaaaaattagctgggcacggtagcacatgcatgcagggccagctgctgtggagtctgtggtaggaggatagctcgagcctgggaggttgaggctgcagtgagctatgatcatgccactgcattccagcatgggtgatggagcgagatactggctcaaaaaaaaaaatacttcttgtaaagtttgggtagaggaataatgaaatcattgatgctttatgaaaagattatggagatgatgcccagaagaaataaacagtttgtaaatggataacttagtttgagttgggacaagacaatgttgaaggtgatgcatggagtggcaggcacaccatccacatcagtttttttgtttgtttttgttgttgttgtttttttgagatggtgtctcgctctgtctcccaggctggaatgcagtggtgcaatctcggctcactgcaacctctgcctcccgggttcaagtgattctcctgtctctgcctccttagtagctgggactacaggcgcgtgccaccacatcagctaatttttgtatttttagtaagacggggtttcaccatgttggcaaggctggtcttgaactcctgacctcacgatctgcccacctcagcctcccaaagtgtggagattacaggcatgagccaccatgccccttgcacatcagttttacaaaaaaatttatcttgtttgtgccacaatgaagaggactgacaggtaacagcagaaacaatagtcaggagtttgagaacaggctgattaacatggtgaaaccccgtctctactaaaaatacaaaaattagctgggtgtggtggcgggtgcttgtaatcccagttactcaggaggctgaggctgcattatcgctttaacctggggggcggaggttgcagtgagccaagatgggggcaataagagcaaaactttgtctcaaaaaaaaataaataaataaaaaataaaatatgtcaagccccttctcttcctgtctcctctcgtggtgtgtacttgactccccttctcgccagatctcacaggactttcagatttaagcaatacctggccaagaaacaaaagcaaaatcattccattcccccagtggattcagatcaaaactggtaataaaatcaggtacgactccaaaaggagacattggagaagaacgaagcggggtctataaggaattgcacgtgagatggcacacatatttatgctgtgtgagcattacaatcgcgttaccatatcaagctgaaaatgtcaccactatctggagtgttggaaatgttttattgggaatatgttttttctctgaatctgctatgaacacgtcagttgggtgggttcagtaataaatatgtgagacttttcatttcaaaataaaaaaggcaaatgatgtaa

SEQ ID NO: 203906 - DNA, 559 bp, Homo sapiens
  Payload ID: 20218
  Gene Name: zinc finger protein 813
  ENST ID: ENST00000490956
  CDS Start-End: 121-559
gaaaacccggaagcggatcgcgtggagtgacggtcccacggcagcgcgattgacttctaaagactcttggtatgtgaggaagaaacctggaagaggaagaggaaagcaaaggagtcagggatggctcttcctcagggtctattgacattcagggatgtggccatagaattctctcaggaggagtggaaatgcctggaccctgctcagaggactctatacagggacgtgatgctggagaattataggaacctggtctccctggacacagggtttctccttttttgtctggccgatctcaaactcctgccctcaggtgatccatcaacctcagcctccgaaactgctgcgattacagatatctcttccaaatgcatgatgaaggagttctcatcaacagcacaaggcaatagagaagtgatccacacagggacattgcaaagacatgaaagtcatcacactggagactttcgctttcaggaaattgataaagatattcataacttagagtttcagtggcaagaagatgaaagaaatagccatgaagcacccatgacagaaa

SEQ ID NO: 203907 - DNA, 535 bp, Homo sapiens
  Payload ID: 20218
  Gene Name: zinc finger protein 813
  ENST ID: ENST00000468450
  CDS Start-End: 161-535
agattcgcgaaaacccggaagcggatcgcgtggagtgacggtcccacggcagcgcgattgacttctaaagactcttggtatgtgaggaagaaacctggaagaggaagaggaaagcaaaggagtcagggatggctcttcctcagatatctcttccaaatgcatgatgaaggagttctcatcaacagcacaaggcaatagagaagtgatccacacagggacattgcaaagacatgaaagtcatcacactggagactttcgctttcaggaaattgataaagatattcataacttagagtttcagtggcaagaagatgaaagaaatagccatgaagcacccatgacagaaatcaaaaagttgactggtagtgcagaccgatatgatcaaaggcatgctggaaacaagcctattaaagatcagcttggatcaagctttcattcgcatctgcctgaactccacatgtttcagacccaagggaaaattggtaatcaagtggagaagtctatcaacgatgcttcctcaatttcaacatcccaa

SEQ ID NO: 203908 - DNA, 3146 bp, Homo sapiens
  Payload ID: 20219
  Gene Name: zinc finger protein 814
  Uniprot ID: B7Z6K7
  ENST ID: ENST00000435989
  CDS Start-End: 236-2803
attttgattggtgttggatttatttgtaggagaggctcctgagcgctaggtccgcactgtggtgactgaacccagaagtcggggagcagttgtcctccgctgcacagaggctactctggagctctgtgacggcgcccagcgtgacccactcctgggccaggatacggaccgtcgtgcccatatctcctggctggtcgccctatcctcccgactctgcttaaaaccacgtggttcgatggctgccgcggctacgctgaggctctccgctcagggcacagtgacttttgaagatgtggctgtgaactttacctgggaggaatggaatctccttagtgaggctcagagatgcctgtaccgtgatgtgacgctggagaacctggcacttatatcctccctgggttgttggtgtggagtggaagatgaggcggcaccttctaagcagagtatttatatacaaagagagactcaggtcaggactcctatggcaggtgtgtctcccaagaaggcccacccctgtgagatgtgtggcccgatcttgggagacattttgcatgtggcagatcatcagggaacacatcacaagcagaaactgcacaggtgtgaggcctgggggaataaattgtatgacagtggaaactttcatcagcaccagaatgagcacattggagagaaaccctacagagggagtgttgaggaggcgttgtttgcaaagaggtgtaagttgcatgtgtcaggggagtcatctgtcttcagtgagagtgggaaggactttttgcccaggtcaggattactccagcaggaggccagtcacactggggagaagtcaaacagcaaaactgagtgtgtgtctcccattcagtgtgggggagctcactacagctgtggagaatccatgaaacattttagcaccaaacatatactcagtcagcaccagagactgctcactagagaagagtgttatgtgtgctgtgaatgtgggaagtcctttagcaaatatgctagcttgagtaatcatcagagagttcacactgaaaaaaaacatgaatgtggagaatgtgggaaatcctttagcaaatatgttagcttcagtaatcatcagagagttcacactgaaaaaaaacatgaatgtggagaatgtgggaaatcctttagcaaatatgttagcttcagtaatcatcagagagttcacactgggaaaagaccttatgaatgtggagaatgtgggaaatcgtttagcaaatatgctagcttcagtaatcatcagagagttcacactgaaaaaaaacattatgaatgtggagaatgtgggaaatcctttagcaaatatgttagcttcagtaatcatcagagagttcacactgggaaaagaccttatgaatgtggagaatgtgggaaatcgtttagcaaatatgctagcttcagtaatcatcagagagttcacactgacaaaaaacattatgaatgtggagaatgtgggaaatcctttagtcaaaagagcagcctcattcaacatcagcgatttcacactggagaaaaaccttatgggtgtgaagaatgtgggaaatcttttagttcagaaggacatcttaggagccatcaacgagttcacgccggagaaagacctttcaagtgtggagaatgtgtgaaatctttcagtcataagcgcagccttgttcaccatcagcgagttcacagtggagaaagaccttatcagtgtggagaatgtgggaaatctttcagtcaaaagggcaacctcgttctacaccagcgagttcacactggagcaagaccttatgagtgtggagaatgtgggaaatcatttagttcaaaaggacatcttaggaaccatcagcaaattcacactggggacagactttatgagtgtggagagtgtgggaaatcttttagtcataaaggcaccctcattctacatcagcgagttcaccctagagaaagatcttatgggtgtggagaatgtgggaaatcttttagttcaatcgggcaccttaggagccatcagcgcgttcatactggagagaggccttatgagtgtggagaatgtgggaaatcttttagtcataagcgcagccttgttcaccatcagcgcatgcacactggagaaagaccttacaagtgtggagactgtgggaaatcttttaatgaaaaaggacaccttaggaatcatcagcgagttcacactacagaaagaccttttaagtgtggggaatgtgggaaatgttttagtcacaagggtaacctcattctacaccagcatggccatactggagaaagaccttatgtatgtagggaatgtggaaaattatttaagaagaagtctcacctccttgtacaccagagaattcacaatggagaaaagccatatgcttgtgaagcttgtcagaaattttttagaaacaagtaccaactcattgcacatcagagagttcacactggagaaaggccttatgaatgcaatgattgtggaaaatcatttacccacagctctacattctgtgttcataagcgaattcacactggagaaaagccttatgagtgcagtgaatgtggaaaatctttcgctgaaagctccagtttcacaaaacacaaaagagttcacactggagaaaagccttatgagtgcagtgaatgtggaaaatcttttgctgaaagctccagtctcactaaacacaagagagttcacactggagaaaagccttataaatgtgagaaatgtgggaaattatttaacaagaagtctcacctccttgtacaccagagttcacactggagaaaagccatatgagtgtgaggattgtcagaaagtttttagcaagaaggaccacctcattgcacaccagagagttcacactggagaaaggccatatgaatgcagtgattgtgggaagtcatctacccacagctctgcattctgtgttcataagagagttcacactggtcacaccaccttatgagtgcagtgaatgtgggaaatcctttgctgaaactttcagtctcattaaacacaggagagttcacactggagtaaggtcttgtgattgcagcaaatgtgggaaaaaagttacctgaaggtcttttctccttgaatatcagagagttcacactagacaaataaaatacatttgggc

SEQ ID NO: 203909 - DNA, 771 bp, Homo sapiens
  Payload ID: 20219
  Gene Name: zinc finger protein 814
  ENST ID: ENST00000597807
  CDS Start-End: 168-356
aacccagaagtcggggagcagttgtcctccgctgcacagaggctactctggagctctgtgacggcgcccagcgtgacccactcctgggccaggatacggaccgtcgtgcccatatctcctggctggtcgccctatcctcccgactctgcttaaaaccacgtggttcgatggctgccgcggctacgctgaggctctccgctcagggcacagtgacttttgaagatgtggctgtgaactttacctgggaggaatggaatctccttagtgaggctcagagatgcctgtaccgtgatgtgacgctggagaacctggcacttatatcctccctgggtaagttgctcacactcaccctgtgacctgagctagtctctgttttcccctatctttccccattggtaagactttctcatgtcaggagcatggacacagcttcctgcttcagttctgtgggtaggttcttggttggtaggtctgaggtgtacatactgccctactcctttcttggagcagccccaacacctgctttactgcaggctcccagggagggattcccagtcagaagcccaccttgttagtcctgtggatgtttgggtgtccttgtccagatttcaggttcctgtgtacccacagtctacttcctttctctagctgctattttcttatgccttcctgtggcaggaattgccttcacagactacatcactgcctatatagaccagaggctgttcttgcaagaccttctttagaaattctccttgaaatactcagttt

SEQ ID NO: 203910 - DNA, 909 bp, Homo sapiens
  Payload ID: 20219
  Gene Name: zinc finger protein 814
  ENST ID: ENST00000595295
  CDS Start-End: 20-139
cttaaaaccacgtggttcgatggctgccgcggctacgctgaggctctccgctcagcagcttcttcttggcacaatcctgaactgggcagaacgtccttcccaaactcgcggaagacaaatggctcctgtgacaccctgagcttacgtttctttacaaacgatgcttctctgacactctttctgtagaatttctctccaatatgctgcttctggtgctgatgaaggtatgcagtgtcatccaagttttttccacatgctccactcctgttcagcttctgcttgtgatgagtttcctggtggtcagcaaagtgaaaaacatcctccaagatgaggccacacatttcacaggggtgagccttcttaggagaaacacctgccctaggagtcctgctctgagactctctttgtacagaaattctctgcttacaaggtgcctcctcatcttttgatccacaccaacaacctgaaagcaagaaaatgctggtcaagtgcaaagtacctccggcgggaaggcacagcccacccacaagtacgtctcacaaattgaggaattaatctatagaaatatttgcaggaacacaatgttggcttcaagttgaagatggggctgctggctgggcatggtggctcacacctgtaatcccagcactttgggaggctgaggcgggtggatcacctgaggtcagaagttcaagaccagcatgaacaacatggtgaaaccccatctctactaaaaatacaaaaattagctggatgtggttgtggacacctgtaatcccagctactcgggaggctaaagcaggagaatcatttgaacccagaaggcagaggtttgtagtgagcagtgattacgccactgcaccccagcctggacaacagagtgagactcaatcacaaaaaaaaaaaaaa

SEQ ID NO: 203911 - DNA, 2090 bp, Homo sapiens
  Payload ID: 20219
  Gene Name: zinc finger protein 814
  ENST ID: ENST00000597832
  CDS Start-End: 218-424
tttatttgtaggagaggctcctgagcgctaggtccgcactgtggtgactgaacccagaagtcggggagcagttgtcctccgctgcacagaggctactctggagctctgtgacggcgcccagcgtgacccactcctgggccaggatacggaccgtcgtgcccatatctcctggctggtcgccctatcctcccgactctgcttaaaaccacgtggttcgatggctgccgcggctacgctgaggctctccgctcagggcacagtgacttttgaagatgtggctgtgaactttacctgggaggaatggaatctccttagtgaggctcagagatgcctgtaccgtgatgtgacgctggagaacctggcacttatatcctccctggtctatgcaacaaggtccagccagatgaagcctgtagccaggtagaactgtggtaatatcacctcctgactttgatccgttttatctctaagcatttcacaacctggtagcaaatcctgggttaatcttacaagggtgtttacattggttgacagaaatgggaatacctccatataacctgtcatggacttggtatcctggcttcagagattctccagggtcctcggatcaaaggactgaaaaaaatggcacttaagagtcccaggacaccacaagctagagaacctgtagatggcgtcaggaccaatgagggaatggaacaccctccacttccctgtgtgggttccctaagtgcttctgcagccaggagtgcctgaggggaaaggcagacattacaaacatgtcacaggatttgataagctcaggactccctgaaccctttcttgtccctggaaccaggtaaccctaaggctggttgtctgacctgcttttctcagtgcaaaatgtcatctctaccatctatgtgatctacaaaacggattcaacctcccaaggccccaaagtcctcatcctctctctctatgatgttcttcctttgattggcctttgggaaacttcttaaaagcctggatttggatcatgtccctcctttcttcaaaactctccatggcttctagaatcctcatgatgaatgcacagcccctggcctgcttgctctaccaggaagagctccatctcacacgttgttcctgacagatgcctgtgaaccccaggttccatccttccagctctgtccatctgcaggccattgcctgcacccctacctgtgcctgtcactctccccactgcatcccactggtgtcagaaacaggtgaaaccgactttgcaaaattataactgacgaaattatgacagtgaaagaaatcagacctaaccgactccatcttgcttccaacctttcagccgtcttttttcattcctgggcataggctgaattaactttggaaaagaattcagttcatggtttcactctgaaacaaaattgataatagccctttcctgaaaagacccctttcttgcctggggaccagcctgtctttgcaggactaacaaattagctacaagaatagaaattacggtttaggggtcatgcagcttctggctccaagagtctgaacctccccaagttgctcctgaagataaccttactattgtaaaacctaatgtgagtttctggggtgctagttgagttggtctcccctgtgtgagacacccatgggaagccatgggcggcctctgaggagaaaagtctccttattgccttcatgtctttatgccccgagagcataactcttcagcagcattccatgggttgctcagggagatcacactcccttgaagcagtggagcataatcaaacatcttggctcctcctgaaacccgcagccacccgtttcagttaagttaaagatcttaagtagtttagacacacgcctttgttcaaggaaattcacagaaacggccagtgctttacatcttatggaatgactcacgagttctcctttactgattaatccttttcctgatcgcttcctccccctccaatcagccataagaacaaagagcttgtaaaccaataaactgggtggagcccaagagctctgggccgccaggaagcctccaatgctctggccacctggacccgcctttt

SEQ ID NO: 203912 - DNA, 648 bp, Homo sapiens
  Payload ID: 20219
  Gene Name: zinc finger protein 814
  ENST ID: ENST00000597342
  CDS Start-End: 157-498
cggggagcagttgtcctccgctgcacagaggctactctggagctctgtgacggcgcccagcgtgacccactcctgggccaggatacggaccgtcgtgcccatatctcctggctggtcgccctatcctcccgactctgcttaaaaccacgtggttcgatggctgccgcggctacgctgaggctctccgctcaggagtctcactctgtcatccagactggagtgcagtggcgtgatcacagctcaccacaacctccgcctacaggagatattttgatacagggcacagtgacttttgaagatgtggctgtgaactttacctgggaggaatggaatctccttagtgaggctcagagatgcctgtaccgtgatgtgacgctggagaacctggcacttatatcctccctggatcctgcactggatggatcagcggacaacacacagaccggtaatctgggtcaatcagttctgccatcccacccagaacagaaaacagcatgaaaaactcactttaaccccctatgaatccatctccaaccagactgatcagcactccccacttcccaagcccctacccgccaaattttgaaaactctgatcccagaatgctcagggagactgatttgaataataaaactcctgtctcccgaa

SEQ ID NO: 203913 - DNA, 528 bp, Homo sapiens
  Payload ID: 20219
  Gene Name: zinc finger protein 814
  ENST ID: ENST00000596604
  CDS Start-End: 119-373
ggagctctgtgacggcgcccagcgtgacccactcctgggccaggatacggaccgtcgtgcccatatctcctggctggtcgccctatcctcccgactctgcttaaaaccacgtggttcgatggctgccgcggctacgctgaggctctccgctcagggcacagtgacttttgaagatgtggctgtgaactttacctgggaggaatggaatctccttagtgaggctcagagatgcctgtaccgtgatgtgacgctggagaacctggcacttatatcctccctggatcctgcactggatggatcagcggacaacacacagaccggtaatctgggtcaatcagttctgccatcccacccagaacagaaaacagcatgaaaaactcactttaaccccctatgaatccatctccaaccagactgatcagcactccccacttcccaagcccctacccgccaaattttgaaaactctgatcccagaatgctcagggagactgatttgaataataaaactcctgtctcccgaacagca

SEQ ID NO: 203914 - DNA, 389 bp, Homo sapiens
  Payload ID: 20219
  Gene Name: zinc finger protein 814
  ENST ID: ENST00000595048
  CDS Start-End: 1-284
ggctctccgctcagggcacagtgacttttgaagatgtggctgtgaactttacctgggaggaatggaatctccttagtgaggctcagagatgcctgtaccgtgatgtgacgctggagaacctggcacttatatcctccctggggatgacatttctccatgtttgtcaggccttggactctctacgtcaggtgatccatccacccacctcggcctcccaaagtgctgggattacaggatctcactctattccccaggctagagtgcgatggcaccatctcggctgattgcaacctccattttccaggaaggctctttaattccccctgattacaaaggttttgtgtgaacataatttggtgtaataaaaaaaaatttacaccacaagagac

SEQ ID NO: 203915 - DNA, 757 bp, Homo sapiens
  Payload ID: 20219
  Gene Name: zinc finger protein 814
  ENST ID: ENST00000597348
  CDS Start-End: 236-475
attttgattggtgttggatttatttgtaggagaggctcctgagcgctaggtccgcactgtggtgactgaacccagaagtcggggagcagttgtcctccgctgcacagaggctactctggagctctgtgacggcgcccagcgtgacccactcctgggccaggatacggaccgtcgtgcccatatctcctggctggtcgccctatcctcccgactctgcttaaaaccacgtggttcgatggctgccgcggctacgctgaggctctccgctcagggcacagtgacttttgaagatgtggctgtgaactttacctgggaggaatggaatctccttagtgaggctcagagatgcctgtaccgtgatgtgacgctggagaacctggcacttatatcctccctgggttgttggtgtggagtggaagatgaggcggcaccttctaagcagagtatttatatacaaagagagactcagggatgacatttctccatgtttgtcaggccttggactctctacgtcaggtgatccatccacccacctcggcctcccaaagtgctgggattacaggtgtgagccactgcgcctgacccttgcaggcaggatctcactctattccccaggctagagtgcgatggcaccatctcggctgattgcaacctccattttccaggaaggctctttaattccccctgattacaaaggttttgtgtgaacataatttggtgtaataaaaaaaaatttacaccacaagagacaaacata

SEQ ID NO: 203916 - DNA, 579 bp, Homo sapiens
  Payload ID: 20219
  Gene Name: zinc finger protein 814
  ENST ID: ENST00000595894
  CDS Start-End: 6-281
gttcgatggctgccgcggctacgctgaggctctccgctcagggcacagtgacttttgaagatgtggctgtgaactttacctgggaggaatggaatctccttagtgaggctcagagatgcctgtaccgtgatgtgacgctggagaacctggcacttatatcctccctggggatgacatttctccatgtttgtcaggccttggactctctacgtcaggtgatccatccacccacctcggcctcccaaagtgctgggattacaggtgtgagccactgcgcctgacccttgcagcagcttcttcttggcacaatcctgaactgggcagaacgtccttcccaaactcgcggaagacaaatggctcctgtgacaccctgagcttacgtttctttacaaacgatgcttctctgacactctttctgtagaatttctctccaatatgctgcttctggtgctgatgaagtctatgcaacaaggtccagccagatgaagcctgtagccaggtagaactgtgaaatgggaatacctccatataacctgtcatggacttggtatcctggcttcagagattctccagggtcct

SEQ ID NO: 203917 - DNA, 461 bp, Homo sapiens
  Payload ID: 20219
  Gene Name: zinc finger protein 814
  ENST ID: ENST00000600634
  CDS Start-End: 16-291
aaaccacgtggttcgatggctgccgcggctacgctgaggctctccgctcagggcacagtgacttttgaagatgtggctgtgaactttacctgggaggaatggaatctccttagtgaggctcagagatgcctgtaccgtgatgtgacgctggagaacctggcacttatatcctccctggggatgacatttctccatgtttgtcaggccttggactctctacgtcaggtgatccatccacccacctcggcctcccaaagtgctgggattacaggtgtgagccactgcgcctgacccttgcaggatctcactctattccccaggctagagtgcgatggcaccatctcggctgattgcaacctccattttccaggaaggctctttaattccccctgattacaaaggttttgtgtgaacataatttggtgtaataaaaaaaaatttacaccacaagagacaaacat

SEQ ID NO: 203918 - DNA, 2006 bp, Homo sapiens
  Payload ID: 20219
  Gene Name: zinc finger protein 814
  ENST ID: ENST00000614383
  CDS Start-End: 273-2006
aatgggtccggacttccggcgccctctggtggcggccattttgattggtgttggatttatttgtaggagaggctcctgagcgctaggtccgcactgtggtgactgaacccagaagtcggggagcagttgtcctccgctgcacagaggctactctggagctctgtgacggcgcccagcgtgacccactcctgggccaggatacggaccgtcgtgcccatatctcctggctggtcgccctatcctcccgactctgcttaaaaccacgtggttcgatggctgccgcggctacgctgaggctctccgctcagggcacagtgacttttgaagatgtggctgtgaactttacctgggaggaatggaatctccttagtgaggctcagagatgcctgtaccgtgatgtgacgctggagaacctggcacttatatcctccctgggttgttggtgtggagtggaagatgaggcggcaccttctaagcagagtatttatatacaaagagagactcaggtcaggactcctatggcaggtgtgtctcccaagaaggcccacccctgtgagatgtgtggcccgatcttgggagacattttgcatgtggcagatcatcagggaacacatcacaagcagaaactgcacaggtgtgaggcctgggggaataaattgtatgacagtggaaactttcatcagcaccagaatgagcacattggagagaaaccctacagagggagtgttgaggaggcgttgtttgcaaagaggtgtaagttgcatgtgtcaggggagtcatctgtcttcagtgagagtgggaaggactttttgcccaggtcaggattactccagcaggaggccagtcacactggggagaagtcaaacagcaaaactgagtgtgtgtctcccattcagtgtgggggagctcactacagctgtggagaatccatgaaacattttagcaccaaacatatactcagtcagcaccagagactgctcactagagaagagtgttatgtgtgctgtgaatgtgggaagtcctttagcaaatatgctagcttcagtaatcatcagagagttcacactgacaaaaaacattatgaatgtggagaatgtgggaaatcctttagtcaaaagagcagcctcattcaacatcagcgatttcacactggagaaaaaccttatgggtgtgaagaatgtgggaaatcttttagtcataagcgcagccttgttcaccatcagcgagttcacagtggagaaagaccttatcagtgtggagaatgtgggaaatctttcagtcaaaagggcaacctcgttctacaccagcgagttcacactggagcaagaccttatgagtgtggagaatgtgggaaatcatttagtcataagcgcagccttgttcaccatcagcgcatgcacactggagaaagaccttacaagtgtggagactgtgggaaatcttttaatgaaaaaggacaccttaggaatcatcagcgagttcacactacagaaagaccttttaagtgtggggaatgtgggaaatgttttagtcacaagggtaacctcattctacaccagcatggccatactggagaaagaccttatgtatgtagggaatgtggaaaattatttaagaagaagtctcacctccttgtacaccagagaattcacaatggagaaaagccatatgcttgtgaagcttgtcagaaattttttagaaacaactctacattctgtgttcataagcgaattcacactggagaaaagccttatgagtgcagtgaatgtggaaaatctttcgctgaaagctccagtttcacaaaacacaaaagagttcacactggagaaaagccttatgagtgcagtgaatgtggaaaatcttttgctgaaagctccagtctcactaaacacaagagagttcacactggagaaaagccttataaatgtgagaaatgtgggaaattatttaacaagaagtctcacctccttgtacaccagagttcacactggagaaaagccatatga

SEQ ID NO: 203919 - DNA, 484 bp, Homo sapiens
  Payload ID: 20220
  Gene Name: zinc finger protein 816
  ENST ID: ENST00000332302
  CDS Start-End: 189-484
ctagttgtctggtgctgctatataggggacgtggggtccccacagacctgcaggttccggcccctcttttctcaacccagagcaaattgaaacgtccgggtcttcctgtggaactttcttatctctgcatggtctctggtgcagtgggtagcaaaggaccatctttctctcgggatttccaaagactcatgttacgtgaggaagccaccaagaagagcaaagaaaaggagccagggatggctcttcctcagatggagtcctactctgcagcccaagctggagtgcaatggcacgatcttggctcactgcaacattcgtctcttgttctcaagttattctcgtgcatcagcctcccagggacgcttgactttcagggatgtggctatagagttctctttggaggagtggaaatgcctgaaccctgcacagagggctttatacagggctgtgatgttggagaactacaggaacctggagtttgtgg

SEQ ID NO: 203920 - DNA, 2697 bp, Homo sapiens
  Payload ID: 20220
  Gene Name: zinc finger protein 816
  Uniprot ID: Q0VGE8
  ENST ID: ENST00000357666
  CDS Start-End: 302-2257
cgtggactgaaagttgcacggcggcgtgtgcgtttcctagttgtctggtgctgctatataggggacgtggggtccccacagacctgcaggttccggcccctcttttctcaacccagagcaaattgaaacgtccgggtaacacaccgctgtgccacggttttggcgagggctgacaattgtgagctgtagaagtaccagcctaacaactgttcaagtgactcctgacctagatgggtggtttcatgcacctccagtacaactgtggctcctagcagctgtggcacaggatttccaaagactcatgttacgtgaggaagccaccaagaagagcaaagaaaaggagccagggatggctcttcctcagggacgcttgactttcagggatgtggctatagagttctctttggaggagtggaaatgcctgaaccctgcacagagggctttatacagggctgtgatgttggagaactacaggaacctggagtttgtggatagctctttaaaatccatgatggagttctcatcaaccaggcacagtattacaggagaagtgatccacacagggacgttgcaaagacataaaagtcatcacattggagatttttgcttcccagaaatgaagaaagatattcatcactttgagtttcagtggcaagaagttgaaagaaatggccatgaagcacccatgacaaaaatcaaaaagttgactggtagtacagaccgaagtgatcacaggcatgctggaaacaagcctattaaagatcagcttggattaagctttcattcgcatctgcctgaactccacatgtttcagactaaagggaaaattagtaaccaattggacaagtctatcggtgcttcctcagcttcagaatcccaaagaatttcttgtaggctcaaaactcatatttctaataagtatgggaagaatttcctccattcttcattcacacaaatacaggaaatatgcatgagagaaaaaccttgccaaagtaatgagtgtggcaaagcctttaattatagctcactcttaaggagacaccacataacccattcaagagagagagaatataaatgtgatgtatgtggcaagatctttaatcagaagcaatacattgtatatcatcatagatgtcacactggtgagaaaacttacaagtgtaatgagtgtgggaagaccttcactcagatgtcatcccttgtatgccatcgtagacttcatactggagagaaaccttacaagtgtaatgagtgtggcaagaccttcagtgagaagtcatcccttagatgccatcgtagacttcatactggagagaaaccttacaagtgtaatgagtgtggcaagacttttggtcgaaattcagcccttgtaattcataaggcaattcatactggagagaaaccttacaagtgtaatgagtgtggcaagaccttcagtcagaaatcatcccttcaatgccatcatatacttcacactggagagaaaccttacaaatgtgaagaatgtgacaatgtttacattcgcagatcacaccttgaaagacataggaagattcatactggagagggatcatacaaatgtaaggtttgtgacaaggttttccggagtgattcataccttgcagaacatcagagagttcatactggagagaaaccatacaagtgtaataaatgtggcaggagtttcagtcggaagtcatcccttcaataccatcatacacttcacactggagagaaaccttacacatgtaatgaatgtggcaaggtttttagtcgaagagaaaaccttgcacgtcatcatagacttcatgctggagagaaaccttacaaatgtgaagaatgtgacaaagttttcagtcgcagatcacaccttgaaagacataggagaattcatactggggaaaaaccatacaaatgtaaggtttgtgacaaggctttccggagtgattcatgccttgcaaaccatacgagagttcatactggagagaaaccttacaagtgtaataaatgtgcgaaggtttttaatcaaaaaggaatccttgcacaacatcagagagttcatactggagagaaaccttacaagtgtaatgaatgtggcaaggtttttaatcaaaaagcaagccttgcaaaacatcagagagttcatactgcagagaaaccttacaagtgtaatgagtgtggcaaagcctttactggacagtcaacacttattcaccatcaagcaatccatgggtgtagggaaactttacaaatgtaatgattgtcacaaagtcttcagtaatgctacaaccattgcaaatcattacagaatccatattgaagagagatctacaagtgtaataaatgtggcaaatttttcagacgtcattcataacttgtagttcatcagtgaactcatactggagagaaaccttacaaatatcatgactgtgacaaggtcttcagtcaagcttcatcctatgcaaaacatagaattcatacaggagagaaacctcacaagtgtgatgattgtggcaaagcctttacttcatgttcacacctcattagacatcagagaattcatactggacagatgccttacaaatgtaagggtggcaaggtcttcactctgtggtcattccatgcagaacatcagaaaattcatttttgagataattgttccaaataaaatgaatataaaaaatcataaaactttaa

SEQ ID NO: 203921 - DNA, 2504 bp, Homo sapiens
  Payload ID: 20220
  Gene Name: zinc finger protein 816
  Uniprot ID: Q0VGE8
  ENST ID: ENST00000444460
  CDS Start-End: 172-2127
cacagacccggaagcggatggcgtggactgaaagttgcacggcggcgtgtgcgtttcctagttgtctggtgctgctatataggggacgtggggtccccacagacctgcaggttccggcccctcttttctcaacccagagcaaattgaaacgtccgggatttccaaagactcatgttacgtgaggaagccaccaagaagagcaaagaaaaggagccagggatggctcttcctcagggacgcttgactttcagggatgtggctatagagttctctttggaggagtggaaatgcctgaaccctgcacagagggctttatacagggctgtgatgttggagaactacaggaacctggagtttgtggatagctctttaaaatccatgatggagttctcatcaaccaggcacagtattacaggagaagtgatccacacagggacgttgcaaagacataaaagtcatcacattggagatttttgcttcccagaaatgaagaaagatattcatcactttgagtttcagtggcaagaagttgaaagaaatggccatgaagcacccatgacaaaaatcaaaaagttgactggtagtacagaccgaagtgatcacaggcatgctggaaacaagcctattaaagatcagcttggattaagctttcattcgcatctgcctgaactccacatgtttcagactaaagggaaaattagtaaccaattggacaagtctatcggtgcttcctcagcttcagaatcccaaagaatttcttgtaggctcaaaactcatatttctaataagtatgggaagaatttcctccattcttcattcacacaaatacaggaaatatgcatgagagaaaaaccttgccaaagtaatgagtgtggcaaagcctttaattatagctcactcttaaggagacaccacataacccattcaagagagagagaatataaatgtgatgtatgtggcaagatctttaatcagaagcaatacattgtatatcatcatagatgtcacactggtgagaaaacttacaagtgtaatgagtgtgggaagaccttcactcagatgtcatcccttgtatgccatcgtagacttcatactggagagaaaccttacaagtgtaatgagtgtggcaagaccttcagtgagaagtcatcccttagatgccatcgtagacttcatactggagagaaaccttacaagtgtaatgagtgtggcaagacttttggtcgaaattcagcccttgtaattcataaggcaattcatactggagagaaaccttacaagtgtaatgagtgtggcaagaccttcagtcagaaatcatcccttcaatgccatcatatacttcacactggagagaaaccttacaaatgtgaagaatgtgacaatgtttacattcgcagatcacaccttgaaagacataggaagattcatactggagagggatcatacaaatgtaaggtttgtgacaaggttttccggagtgattcataccttgcagaacatcagagagttcatactggagagaaaccatacaagtgtaataaatgtggcaggagtttcagtcggaagtcatcccttcaataccatcatacacttcacactggagagaaaccttacacatgtaatgaatgtggcaaggtttttagtcgaagagaaaaccttgcacgtcatcatagacttcatgctggagagaaaccttacaaatgtgaagaatgtgacaaagttttcagtcgcagatcacaccttgaaagacataggagaattcatactggggaaaaaccatacaaatgtaaggtttgtgacaaggctttccggagtgattcatgccttgcaaaccatacgagagttcatactggagagaaaccttacaagtgtaataaatgtgcgaaggtttttaatcaaaaaggaatccttgcacaacatcagagagttcatactggagagaaaccttacaagtgtaatgaatgtggcaaggtttttaatcaaaaagcaagccttgcaaaacatcagagagttcatactgcagagaaaccttacaagtgtaatgagtgtggcaaagcctttactggacagtcaacacttattcaccatcaagcaatccatgggtgtagggaaactttacaaatgtaatgattgtcacaaagtcttcagtaatgctacaaccattgcaaatcattacagaatccatattgaagagagatctacaagtgtaataaatgtggcaaatttttcagacgtcattcataacttgtagttcatcagtgaactcatactggagagaaaccttacaaatatcatgactgtgacaaggtcttcagtcaagcttcatcctatgcaaaacatagaattcatacaggagagaaacctcacaagtgtgatgattgtggcaaagcctttacttcatgttcacacctcattagacatcagagaattcatactggacagatgccttacaaatgtaagggtggcaaggtcttcactctgtggtcattccatgcagaacatca

SEQ ID NO: 203922 - DNA, 553 bp, Homo sapiens
  Payload ID: 20220
  Gene Name: zinc finger protein 816
  ENST ID: ENST00000457013
  CDS Start-End: 211-553
aggtcccgcttctgtcctgcgccgattggcacagacccggaagcggatggcgtggactgaaagttgcacggcggcgtgtgcgtttcctagttgtctggtgctgctatataggggacgtggggtccccacagacctgcaggttccggcccctcttttctcaacccagagcaaattgaaacgtccgggtgagagtccgatttccaaagactcatgttacgtgaggaagccaccaagaagagcaaagaaaaggagccagggatggctcttcctcagggacgcttgactttcagggatgtggctatagagttctctttggaggagtggaaatgcctgaaccctgcacagagggctttatacagggctgtgatgttggagaactacaggaacctggagtttgtggatagctctttaaaatccatgatggagttctcatcaaccaggcacagtattacaggagaagtgatccacacagggacgttgcaaagacataaaagtcatcacattggagatttttgcttcccagaaatgaagaaagatattcatcactttgagt

SEQ ID NO: 203923 - DNA, 491 bp, Homo sapiens
  Payload ID: 20220
  Gene Name: zinc finger protein 816
  ENST ID: ENST00000438970
  CDS Start-End: 161-391
aagcggatggcgtggactgaaagttgcacggcggcgtgtgcgtttcctagttgtctggtgctgctatataggggacgtggggtccccacagacctgcaggttccggcccctcttttctcaacccagagcaaattgaaacgtccgggatttccaaagactcatgttacgtgaggaagccaccaagaagagcaaagaaaaggagccagggatggctcttcctcagggacgcttgactttcagggatgtggctatagagttctctttggaggagtggaaatgcctgaaccctgcacagagggctttatacagggctgtgatgttggagaactacaggaacctggagtttgtggaattttgctcttgttgcccaggctggagtgcaatgtggtgatctccgcatgctgcaacctctgcctcctggcttcaagcaattctgctgcctcagcctcctgagtagctgggattacaggcacccaccaccatgactggct

SEQ ID NO: 203924 - DNA, 529 bp, Homo sapiens
  Payload ID: 20220
  Gene Name: zinc finger protein 816
  ENST ID: ENST00000535506
  CDS Start-End: 178-471
gacccggaagcggatggcgtggactgaaagttgcacggcggcgtgtgcgtttcctagttgtctggtgctgctatataggggacgtggggtccccacagacctgcaggttccggcccctcttttctcaacccagagcaaattgaaacgtccgggtgagagtccgatttccaaagactcatgttacgtgaggaagccaccaagaagagcaaagaaaaggagccagggatggctcttcctcagggacgcttgactttcagggatgtggctatagagttctctttggaggagtggaaatgcctgaaccctgcacagagggctttatacagggctgtgatgttggagaactacaggaacctggagtttgtgggtgaggaaaatgtccctccagacatgaggaatctgcacttgtctatcttggctctttctggttttatattctcttttgtgattttgccccatacatgcttttgatgtacatgtcattgttttctgcggtgatgaccctcctatctgtcatggacagcttctt

SEQ ID NO: 203925 - DNA, 562 bp, Homo sapiens
  Payload ID: 20220
  Gene Name: zinc finger protein 816
  ENST ID: ENST00000391786
  CDS Start-End: 141-317
aagttgcacggcggcgtgtgcgtttcctagttgtctggtgctgctatataggggacgtggggtccccacagacctgcaggttccggcccctcttttctcaacccagagcaaattgaaacgtccgggatttccaaagactcatgttacgtgaggaagccaccaagaagagcaaagaaaaggagccagggatggctcttcctcagggatgtggctatagagttctctttggaggagtggaaatgcctgaaccctgcacagagggctttatacagggctgtgatgttggagaactacaggaacctggagtttgtggatagctctttaaaatccatgatggagttctcatcaaccaggcacagtattacaggagaagtgatccacacagggacgttgcaaagacataaaagtcatcacattggagatttttgcttcccagaaatgaagaaagatattcatcactttgagtttcagtggcaagaagttgaaagaaatggccatgaagcacccatgacaaaaatcaaaaagttgactggtagtacagaccgaagtgatcacaggcatg

SEQ ID NO: 203926 - DNA, 582 bp, Homo sapiens
  Payload ID: 20220
  Gene Name: zinc finger protein 816
  ENST ID: ENST00000270457
  CDS Start-End: 161-454
aagcggatggcgtggactgaaagttgcacggcggcgtgtgcgtttcctagttgtctggtgctgctatataggggacgtggggtccccacagacctgcaggttccggcccctcttttctcaacccagagcaaattgaaacgtccgggatttccaaagactcatgttacgtgaggaagccaccaagaagagcaaagaaaaggagccagggatggctcttcctcagggacgcttgactttcagggatgtggctatagagttctctttggaggagtggaaatgcctgaaccctgcacagagggctttatacagggctgtgatgttggagaactacaggaacctggagtttgtgggtgaggaaaatgtccctccagacatgaggaatctgcacttgtctatcttggctctttctggttttatattctcttttgtgattttgccccatacatgcttttgatgtacatgtcattgttttctgcggtgatgaccctcctatctgtcatggacagcttcttagagactcttctttggagtggttttacataaaaacagaaaattcacgaacactttgactaatacaattga

SEQ ID NO: 203927 - DNA, 1874 bp, Homo sapiens
  Payload ID: 20221
  Gene Name: zinc finger protein 821
  ENST ID: ENST00000313565
  CDS Start-End: 424-1536
agctgcgggtgcgcgagccgcgcgctcccgccgcccgcgtcgccatctttttccccctccgtctgtctgtctgctgttggctttgtccgtctgcagcgccgcccctcggctccccgccaccggctcggctcggcccggagccccttccgctcgccggggcccagtcccggagcgccccggcccggctggcttgggctgcggtcccgggtccattgtccggcggtccgtctgtccggaggcggggcccagggacccagagcgcagcgcagcgccgaggcgccggatacagatcacttggattcagtcgagtttgctttgctccgtgggaactgcaccagagctggaggttagcatcttgcaaggaggtagtaacatatccagtcgtgaaactgggaaagaccagagctcttgcatcagggaaacatgtcccgtcggaaacagacaaatccaaataaagttcactgtgacagtgagggtgatgaagaggagacgacacaagatgaagtctcttcccacacatcagaggaagatggaggggtggtcaaagtggagaaagagttagaaaatacagaacagcctgttggtgggaacgaagtggtagagcacgaggtcacagggaatttgaattctgaccccttgcttgaactctgccagtgtcccctctgccagctagactgcgggagccgggagcagttgattgctcacgtgtaccagcacactgcagcagtggtgagcgccaagagctacatgtgtcctgtctgtggccgggcccttagctccccggggtcattgggtcgccacctcttaatccactcggaggaccagcgatctaactgtgctgtgtgtggagcccggttcaccagccatgccacttttaacagtgagaaacttcctgaagtactaaatatggaatccctacccacagtccacaatgagggtccctccagtgctgaggggaaggatattgcctttagtcctccagtgtaccctgctggaattctgcttgtgtgcaacaactgtgctgcctaccgtaaactgctggaagcccagactcccagtgtacgcaagtgggctctacgtcgacagaatgagcctttggaagtacggctgcagcggctggaacgagagcgcacggccaagaagagccggcgggacaatgagacccccgaggagcgggaggtgaggcgcatgagggaccgtgaagccaagcgcttgcagcgcatgcaggagacagacgagcagcgggcacgccggctgcagcgggatcgggaggccatgaggctgaagcgggccaatgaaaccccggaaaagcggcaggcccggctcatccgagagcgagaggccaagcggctcaagaggaggctggagaaaatggacatgatgttgcgagctcagtttggccaggacccttctgccatggcagccttagcagctgaaatgaacttcttccagctgcctgtaagtggggtggagttggacagccagcttctgggcaagatggcctttgaagagcagaacagcagctctctgcactgaaccacaccctcctgcctgccctccttcccacctacctacccacccacccacacccacagccacgaggaccagtgctgctgccacccacgaggccctgtccttgctgccagaggcaggcctgggtttattgcaggtggacctgagcagcccttgcatatgggaacaggatgatggggtcaggagggacctggctcaaggcagctctggacaagggagcaggcagtccagagaactggcctccccagcccactgccacaggctgtgcttctaggactgtggggcccctgtgtggcccatgaagttgtgaagtcaaataaattaattttatctttactgcc

SEQ ID NO: 203928 - DNA, 2000 bp, Homo sapiens
  Payload ID: 20221
  Gene Name: zinc finger protein 821
  Uniprot ID: O75541
  ENST ID: ENST00000425432
  CDS Start-End: 424-1662
agctgcgggtgcgcgagccgcgcgctcccgccgcccgcgtcgccatctttttccccctccgtctgtctgtctgctgttggctttgtccgtctgcagcgccgcccctcggctccccgccaccggctcggctcggcccggagccccttccgctcgccggggcccagtcccggagcgccccggcccggctggcttgggctgcggtcccgggtccattgtccggcggtccgtctgtccggaggcggggcccagggacccagagcgcagcgcagcgccgaggcgccggatacagatcacttggattcagtcgagtttgctttgctccgtgggaactgcaccagagctggaggttagcatcttgcaaggaggtagtaacatatccagtcgtgaaactgggaaagaccagagctcttgcatcagggaaacatgtcccgtcggaaacagacaaatccaaataaagttcactgggatcaagtatttgctgggctagaagagcaagcccgccaggcgatgatgaaaactgattttcctggagaccttggcagtcagcgacaagctatccaacaactaagagatcaggactccagtagcagtgacagtgagggtgatgaagaggagacgacacaagatgaagtctcttcccacacatcagaggaagatggaggggtggtcaaagtggagaaagagttagaaaatacagaacagcctgttggtgggaacgaagtggtagagcacgaggtcacagggaatttgaattctgaccccttgcttgaactctgccagtgtcccctctgccagctagactgcgggagccgggagcagttgattgctcacgtgtaccagcacactgcagcagtggtgagcgccaagagctacatgtgtcctgtctgtggccgggcccttagctccccggggtcattgggtcgccacctcttaatccactcggaggaccagcgatctaactgtgctgtgtgtggagcccggttcaccagccatgccacttttaacagtgagaaacttcctgaagtactaaatatggaatccctacccacagtccacaatgagggtccctccagtgctgaggggaaggatattgcctttagtcctccagtgtaccctgctggaattctgcttgtgtgcaacaactgtgctgcctaccgtaaactgctggaagcccagactcccagtgtacgcaagtgggctctacgtcgacagaatgagcctttggaagtacggctgcagcggctggaacgagagcgcacggccaagaagagccggcgggacaatgagacccccgaggagcgggaggtgaggcgcatgagggaccgtgaagccaagcgcttgcagcgcatgcaggagacagacgagcagcgggcacgccggctgcagcgggatcgggaggccatgaggctgaagcgggccaatgaaaccccggaaaagcggcaggcccggctcatccgagagcgagaggccaagcggctcaagaggaggctggagaaaatggacatgatgttgcgagctcagtttggccaggacccttctgccatggcagccttagcagctgaaatgaacttcttccagctgcctgtaagtggggtggagttggacagccagcttctgggcaagatggcctttgaagagcagaacagcagctctctgcactgaaccacaccctcctgcctgccctccttcccacctacctacccacccacccacacccacagccacgaggaccagtgctgctgccacccacgaggccctgtccttgctgccagaggcaggcctgggtttattgcaggtggacctgagcagcccttgcatatgggaacaggatgatggggtcaggagggacctggctcaaggcagctctggacaagggagcaggcagtccagagaactggcctccccagcccactgccacaggctgtgcttctaggactgtggggcccctgtgtggcccatgaagttgtgaagtcaaataaattaattttatctttactgcc

SEQ ID NO: 203929 - DNA, 1822 bp, Homo sapiens
  Payload ID: 20221
  Gene Name: zinc finger protein 821
  ENST ID: ENST00000446827
  CDS Start-End: 377-1489
ctaaatttagatttcggagattgtgttgtctaagggtttgtctgagccgcctcggaagacctccggctcttgtcaggctcttgtctggtaattcctgggaatttacctgggctcatgcttgaagaagcagagggaccatctcggctgattagacacgccccagacccaaccccaggggtcaggtgaacagccaggcggctaagtgaccagctttcttgtcctctcctttttggcagatacagatcacttggattcagtcgagtttgctttgctccgtgggaactgcaccagagctggaggttagcatcttgcaaggaggtagtaacatatccagtcgtgaaactgggaaagaccagagctcttgcatcagggaaacatgtcccgtcggaaacagacaaatccaaataaagttcactgtgacagtgagggtgatgaagaggagacgacacaagatgaagtctcttcccacacatcagaggaagatggaggggtggtcaaagtggagaaagagttagaaaatacagaacagcctgttggtgggaacgaagtggtagagcacgaggtcacagggaatttgaattctgaccccttgcttgaactctgccagtgtcccctctgccagctagactgcgggagccgggagcagttgattgctcacgtgtaccagcacactgcagcagtggtgagcgccaagagctacatgtgtcctgtctgtggccgggcccttagctccccggggtcattgggtcgccacctcttaatccactcggaggaccagcgatctaactgtgctgtgtgtggagcccggttcaccagccatgccacttttaacagtgagaaacttcctgaagtactaaatatggaatccctacccacagtccacaatgagggtccctccagtgctgaggggaaggatattgcctttagtcctccagtgtaccctgctggaattctgcttgtgtgcaacaactgtgctgcctaccgtaaactgctggaagcccagactcccagtgtacgcaagtgggctctacgtcgacagaatgagcctttggaagtacggctgcagcggctggaacgagagcgcacggccaagaagagccggcgggacaatgagacccccgaggagcgggaggtgaggcgcatgagggaccgtgaagccaagcgcttgcagcgcatgcaggagacagacgagcagcgggcacgccggctgcagcgggatcgggaggccatgaggctgaagcgggccaatgaaaccccggaaaagcggcaggcccggctcatccgagagcgagaggccaagcggctcaagaggaggctggagaaaatggacatgatgttgcgagctcagtttggccaggacccttctgccatggcagccttagcagctgaaatgaacttcttccagctgcctgtaagtggggtggagttggacagccagcttctgggcaagatggcctttgaagagcagaacagcagctctctgcactgaaccacaccctcctgcctgccctccttcccacctacctacccacccacccacacccacagccacgaggaccagtgctgctgccacccacgaggccctgtccttgctgccagaggcaggcctgggtttattgcaggtggacctgagcagcccttgcatatgggaacaggatgatggggtcaggagggacctggctcaaggcagctctggacaagggagcaggcagtccagagaactggcctccccagcccactgccacaggctgtgcttctaggactgtggggcccctgtgtggcccatgaagttgtgaagtcaaataaattaattttatcttta

SEQ ID NO: 203930 - DNA, 1549 bp, Homo sapiens
  Payload ID: 20221
  Gene Name: zinc finger protein 821
  ENST ID: ENST00000562808
  CDS Start-End: 261-449
agatacagatcacttggattcagtcgagtttgctttgctccgtgggaactgcaccagagctggaggtctgaaaaagaactgtgtttgatatgcagatatgctagaagactgcctgaaagctgcttcctttgccacttcctgtggaggcctgtctttgccatttgcggtttctttattcttttggttagcatcttgcaaggaggtagtaacatatccagtcgtgaaactgggaaagaccagagctcttgcatcagggaaacatgtcccgtcggaaacagacaaatccaaataaagttcactgggatcaagtatttgctgggctagaagagcaagcccgccaggcgatgatgaaaactgattttcctggagaccttggcagtcagcgacaagctatccaacaactaagagatcaggactccagtagcagtgagttctgcaccttctggtgacagtgagggtgatgaagaggagacgacacaagatgaagtctcttcccacacatcagaggaagatggaggggtggtcaaagtggagaaagagttagaaaatacagaacagcctgttggtgggaacgaagtggtagagcacgaggtcacagggaatttgaattctgaccccttgcttgaactctgccagtgtcccctctgccagctagactgcgggagccgggagcagttgattgctcacgtgtaccagcacactgcagcagtggtgagcgccaagagctacatgtgtcctgtctgtggccgggcccttagctccccggggtcattgggtcgccacctcttaatccactcggaggaccagcgatctaactgtgctgtgtgtggagcccggttcaccagccatgccacttttaacagtgagaaacttcctgaagtactaaatatggaatccctacccacagtccacaatgagggtccctccagtgctgaggggaaggatattgcctttagtcctccagtgtaccctgctggaattctgcttgtgtgcaacaactgtgctgcctaccgtaaactgctggaagcccagactcccagtgtacgcaagtgggctctacgtcgacagaatgagcctttggaagtacggctgcagcggctggaacgagagcgcacggccaagaagagccggcgggacaatgagacccccgaggagcgggaggtgaggcgcatgagggaccgtgaagccaagcgcttgcagcgcatgcaggagacagacgagcagcgggcacgccggctgcagcgggatcgggaggccatgaggctgaagcgggccaatgaaaccccggaaaagcggcaggcccggctcatccgagagcgagaggccaagcggctcaagaggaggctggagaaaatggacatgatgttgcgagctcagtttggccaggacccttctgccatggcagccttagcagctgaaatgaacttcttccagctgcctgtaagtggggtggagttggacagccagcttctgggcaagatggcctttgaagagcagaacagcagctctctgcactgaaccacaccctcctgcctgccctccttcccac

SEQ ID NO: 203931 - DNA, 1858 bp, Homo sapiens
  Payload ID: 20221
  Gene Name: zinc finger protein 821
  Uniprot ID: O75541
  ENST ID: ENST00000565601
  CDS Start-End: 409-1647
agtccccgcgtctgggtctcgcagaaaagcttctaaatttagatttcggagattgtgttgtctaagggtttgtctgagccgcctcggaagacctccggctcttgtcaggctcttgtctggtaattcctgggaatttacctgggctcatgcttgaagaagcagagggaccatctcggctgattagacacgccccagacccaaccccaggggtcaggtgaacagccaggcggctaagtgaccagctttcttgtcctctcctttttggcagatacagatcacttggattcagtcgagtttgctttgctccgtgggaactgcaccagagctggaggttagcatcttgcaaggaggtagtaacatatccagtcgtgaaactgggaaagaccagagctcttgcatcagggaaacatgtcccgtcggaaacagacaaatccaaataaagttcactgggatcaagtatttgctgggctagaagagcaagcccgccaggcgatgatgaaaactgattttcctggagaccttggcagtcagcgacaagctatccaacaactaagagatcaggactccagtagcagtgacagtgagggtgatgaagaggagacgacacaagatgaagtctcttcccacacatcagaggaagatggaggggtggtcaaagtggagaaagagttagaaaatacagaacagcctgttggtgggaacgaagtggtagagcacgaggtcacagggaatttgaattctgaccccttgcttgaactctgccagtgtcccctctgccagctagactgcgggagccgggagcagttgattgctcacgtgtaccagcacactgcagcagtggtgagcgccaagagctacatgtgtcctgtctgtggccgggcccttagctccccggggtcattgggtcgccacctcttaatccactcggaggaccagcgatctaactgtgctgtgtgtggagcccggttcaccagccatgccacttttaacagtgagaaacttcctgaagtactaaatatggaatccctacccacagtccacaatgagggtccctccagtgctgaggggaaggatattgcctttagtcctccagtgtaccctgctggaattctgcttgtgtgcaacaactgtgctgcctaccgtaaactgctggaagcccagactcccagtgtacgcaagtgggctctacgtcgacagaatgagcctttggaagtacggctgcagcggctggaacgagagcgcacggccaagaagagccggcgggacaatgagacccccgaggagcgggaggtgaggcgcatgagggaccgtgaagccaagcgcttgcagcgcatgcaggagacagacgagcagcgggcacgccggctgcagcgggatcgggaggccatgaggctgaagcgggccaatgaaaccccggaaaagcggcaggcccggctcatccgagagcgagaggccaagcggctcaagaggaggctggagaaaatggacatgatgttgcgagctcagtttggccaggacccttctgccatggcagccttagcagctgaaatgaacttcttccagctgcctgtaagtggggtggagttggacagccagcttctgggcaagatggcctttgaagagcagaacagcagctctctgcactgaaccacaccctcctgcctgccctccttcccacctacctacccacccacccacacccacagccacgaggaccagtgctgctgccacccacgaggccctgtccttgctgccagaggcaggcctgggtttattgcaggtggacctgagcagcccttgcatatgggaacaggatgatggggtcaggagggacctggctcaaggcagctctggacaa

SEQ ID NO: 203932 - DNA, 1748 bp, Homo sapiens
  Payload ID: 20221
  Gene Name: zinc finger protein 821
  ENST ID: ENST00000564134
  CDS Start-End: 438-854
gcacgcgcctcactagctgcgggtgcgcgagccgcgcgctcccgccgcccgcgtcgccatctttttccccctccgtctgtctgtctgctgttggctttgtccgtctgcagcgccgcccctcggctccccgccaccggctcggctcggcccggagccccttccgctcgccggggcccagtcccggagcgccccggcccggctggcttgggctgcggtcccgggtccattgtccggcggtccgtctgtccggaggcggggcccagggacccagagcgcagcgcagcgccgaggcgccggatacagatcacttggattcagtcgagtttgctttgctccgtgggaactgcaccagagctggaggttagcatcttgcaaggaggtagtaacatatccagtcgtgaaactgggaaagaccagagctcttgcatcagggaaacatgtcccgtcggaaacagacaaatccaaataaagttcactgggatcaagtatttgctgggctagaagagcaagcccgccaggcgatgatgaaaactgattttcctggagaccttggcagtcagcgacaagctatccaacaactaagagatcaggactccagtagcagtgacagtgagggtgatgaagaggagacgacacaagatgaagtctcttcccacacatcagaggaagatggaggggtggtcaaagtggagaaagagttagaaaatacagaacagcctgttggtgggaacgaagtggtagagcacgaggcaaggaatttgaattctgaccccttgcttgaactctgccagtgtcccctctgccagctagactgcgggagccgggagcagttgattgctcacgtgtaccagtgagaaacttcctgaagtactaaatatggaatccctacccacagtccacaatgagggtccctccagtgctgaggggaaggatattgcctttagtcctccagtgtaccctgctggaattctgcttgtgtgcaacaactgtgctgcctaccgtaaactgctggaagcccagactcccagtgtacgcaagtgggctctacgtcgacagaatgagcctttggaagtacggctgcagcggctggaacgagagcgcacggccaagaagagccggcgggacaatgagacccccgaggagcgggaggtgaggcgcatgagggaccgtgaagccaagcgcttgcagcgcatgcaggagacagacgagcagcgggcacgccggctgcagcgggatcgggaggccatgaggctgaagcgggccaatgaaaccccggaaaagcggcaggcccggctcatccgagagcgagaggccaagcggctcaagaggaggctggagaaaatggacatgatgttgcgagctcagtttggccaggacccttctgccatggcagccttagcagctgaaatgaacttcttccagctgcctgtaagtggggtggagttggacagccagcttctgggcaagatggcctttgaagagcagaacagcagctctctgcactgaaccacaccctcctgcctgccctccttcccacctacctacccacccacccacacccacagccacgaggaccagtgctgctgccacccacgaggccctgtccttgctgccagaggcaggcctgggtttattgcaggtggacctgagcagcccttgcatatgggaacaggatgatggggtcaggagggacctggctcaaggcagctctggacaagggagcaggcagtccagagaactggcctccc

SEQ ID NO: 203933 - DNA, 1187 bp, Homo sapiens
  Payload ID: 20221
  Gene Name: zinc finger protein 821
  ENST ID: ENST00000563878
  CDS Start-End: 510-698
gcccgcgtcgccatctttttccccctccgtctgtctgtctgctgttggctttgtccgtctgcagcgccgcccctcggctccccgccaccggctcggctcggcccggagccccttccgctcgccggggcccagtcccggagcgccccggcccggctggcttgggctgcggtcccgggtccattgtccggcggtccgtctgtccggaggcggggcccagggacccagagcgcagcgcagcgccgaggcgccggatacagatcacttggattcagtcgagtttgctttgctccgtgggaactgcaccagagctggaggtctgaaaaagaactgtgtttgatatgcagatatgctagaagactgcctgaaagctgcttcctttgccacttcctgtggaggcctgtctttgccatttgcggtttctttattcttttggttagcatcttgcaaggaggtagtaacatatccagtcgtgaaactgggaaagaccagagctcttgcatcagggaaacatgtcccgtcggaaacagacaaatccaaataaagttcactgggatcaagtatttgctgggctagaagagcaagcccgccaggcgatgatgaaaactgattttcctggagaccttggcagtcagcgacaagctatccaacaactaagagatcaggactccagtagcagtgagttctgcaccttctggtgacagtgagggtgatgaagaggagacgacacaagatgaagtctcttcccacacatcagaggaagatggaggggtggtcaaagtggagaaagagttagaaaatacagaacagcctgttggtgggaacgaagtggtagagcacgaggtcacagggaatttgaattctgaccccttgcttgaactctgccagtgtcccctctgccagctagactgcgggagccgggagcagttgattgctcacgtgtaccagcacactgcagcagtggtgagcgccaagagctacatgtgtcctgtctgtggccgggcccttagctccccggggtcattgggtcgccacctcttaatccactcggaggaccagcgatctaactgtgctgtgtgtggagcccggttcaccagccatgccacttttaacagtgagaaacttcctgaagtactaaatatggaatccctacccacagtccacaatgagggtccctccagtgctgaggg

SEQ ID NO: 203934 - DNA, 867 bp, Homo sapiens
  Payload ID: 20221
  Gene Name: zinc finger protein 821
  ENST ID: ENST00000563827
  CDS Start-End: 206-406
gtgttgtctaagggtttgtctgagccgcctcggaagacctccggctcttgtcaggctcttgtctgatacagatcacttggattcagtcgagtttgctttgctccgtgggaactgcaccagagctggaggttagcatcttgcaaggaggtagtaacatatccagtcgtgaaactgggaaagaccagagctcttgcatcagggaaacatgtcccgtcggaaacagacaaatccaaataaagttcactgggatcaagtatttgctgggctagaagagcaagcccgccaggcgatgatgaaaactgattttcctggagaccttggcagtcagcgacaagctatccaacaactaagagatcaggactccagtagcagtgagttctgcaccttctggtcacagggaatttgaattctgaccccttgcttgaactctgccagtgtcccctctgccagctagactgcgggagccgggagcagttgattgctcacgtgtaccagtgagaaacttcctgaagtactaaatatggaatccctacccacagtccacaatgagggtccctccagtgctgaggggaaggatattgcctttagtcctccagtgtaccctgctggaattctgcttgtgtgcaacaactgtgctgcctaccgtaaactgctggaagcccagactcccagtgtacgcaagtgggctctacgtcgacagaatgagcctttggaagtacggctgcagcggctggaacgagagcgcacggccaagaagagccggcgggacaatgagacccccgaggagcgggaggtgaggcgcatgagggaccgtgaagccaagcgcttgcagcgcatgcaggagacagacgagcagcgggcacgccg

SEQ ID NO: 203935 - DNA, 619 bp, Homo sapiens
  Payload ID: 20221
  Gene Name: zinc finger protein 821
  ENST ID: ENST00000565843
  CDS Start-End: 304-619
gggggaggggaggatgggcgtgggcgtgcagaccggggggtatcagtccccgcgtctgggtctcgcagaaaagcttctaaatttagatttcggagattgtgttgtctaagggtttgtctgagccgcctcggaagacctccggctcttgtcaggctcttgtctgatacagatcacttggattcagtcgagtttgctttgctccgtgggaactgcaccagagctggaggttagcatcttgcaaggaggtagtaacatatccagtcgtgaaactgggaaagaccagagctcttgcatcagggaaacatgtcccgtcggaaacagacaaatccaaataaagttcactgggatcaagtatttgctgggctagaagagcaagcccgccaggcgatgatgaaaactgattttcctggagaccttggcagtcagcgacaagctatccaacaactaagagatcaggactccagtagcagtgacagtgagggtgatgaagaggagacgacacaagatgaagtctcttcccacacatcagaggaagatggaggggtggtcaaagtggagaaagagttagaaaatacagaacagcctgttggtgggaacgaagtggtagagcacgaggcaa

SEQ ID NO: 203936 - DNA, 871 bp, Homo sapiens
  Payload ID: 20221
  Gene Name: zinc finger protein 821
  ENST ID: ENST00000565516
  CDS Start-End: 120-871
ggggaaaatgacatgtgctaacaataaccttttttattgcaggttagcatcttgcaaggaggtagtaacatatccagtcgtgaaactgggaaagaccagagctcttgcatcagggaaacatgtcccgtcggaaacagacaaatccaaataaagttcactgtgacagtgagggtgatgaagaggagacgacacaagatgaagtctcttcccacacatcagaggaagatggaggggtggtcaaagtggagaaagagttagaaaatacagaacagcctgttggtgggaacgaagtggtagagcacgaggtcacagggaatttgaattctgaccccttgcttgaactctgccagtgtcccctctgccagctagactgcgggagccgggagcagttgattgctcacgtgtaccagcacactgcagcagtggtgagcgccaagagctacatgtgtcctgtctgtggccgggcccttagctccccggggtcattgggtcgccacctcttaatccactcggaggaccagcgatctaactgtgctgtgtgtggagcccggttcaccagccatgccacttttaacagtgagaaacttcctgaagtactaaatatggaatccctacccacagtccacaatgagggtccctccagtgctgaggggaaggatattgcctttagtcctccagtgtaccctgctggaattctgcttgtgtgcaacaactgtgctgcctaccgtaaactgctggaagcccagactcccagtgtacgcaagtgggctctacgtcgacagaatgagcctttggaagtacggctgcagcggctggaacgagagcgcacggccaagaagagccggcgggacaatgagacccccgaggagcg

SEQ ID NO: 203937 - DNA, 1719 bp, Homo sapiens
  Payload ID: 20221
  Gene Name: zinc finger protein 821
  ENST ID: ENST00000568666
  CDS Start-End: 510-1719
gcccgcgtcgccatctttttccccctccgtctgtctgtctgctgttggctttgtccgtctgcagcgccgcccctcggctccccgccaccggctcggctcggcccggagccccttccgctcgccggggcccagtcccggagcgccccggcccggctggcttgggctgcggtcccgggtccattgtccggcggtccgtctgtccggaggcggggcccagggacccagagcgcagcgcagcgccgaggcgccggatacagatcacttggattcagtcgagtttgctttgctccgtgggaactgcaccagagctggaggtctgaaaaagaactgtgtttgatatgcagatatgctagaagactgcctgaaagctgcttcctttgccacttcctgtggaggcctgtctttgccatttgcggtttctttattcttttggttagcatcttgcaaggaggtagtaacatatccagtcgtgaaactgggaaagaccagagctcttgcatcagggaaacatgtcccgtcggaaacagacaaatccaaataaagttcactgggatcaagtatttgctgggctagaagagcaagcccgccaggcgatgatgaaaactgattttcctggagaccttggcagtcagcgacaagctatccaacaactaagagatcaggactccagtagcagtgacagtgagggtgatgaagaggagacgacacaagatgaagtctcttcccacacatcagaggaagatggaggggtggtcaaagtggagaaagagttagaaaatacagaacagcctgttggtgggaacgaagtggtagagcacgaggtcacagggaatttgaattctgaccccttgcttgaactctgccagtgtcccctctgccagctagactgcgggagccgggagcagttgattgctcacgtgtaccagcacactgcagcagtggtgagcgccaagagctacatgtgtcctgtctgtggccgggcccttagctccccggggtcattgggtcgccacctcttaatccactcggaggaccagcgatctaactgtgctgtgtgtggagcccggttcaccagccatgccacttttaacagtgagaaacttcctgaagtactaaatatggaatccctacccacagtccacaatgagggtccctccagtgctgaggggaaggatattgcctttagtcctccagtgtaccctgctggaattctgcttgtgtgcaacaactgtgctgcctaccgtaaactgctggaagcccagactcccagtgtacgcaagtgggctctacgtcgacagaatgagcctttggaagtacggctgcagcggctggaacgagagcgcacggccaagaagagccggcgggacaatgagacccccgaggagcgggaggtgaggcgcatgagggaccgtgaagccaagcgcttgcagcgcatgcaggagacagacgagcagcgggcacgccggctgcagcgggatcgggaggccatgaggctgaagcgggccaatgaaaccccggaaaagcggcaggcccggctcatccgagagcgagaggccaagcggctcaagaggaggctggagaaaatggacatgatgttgcgagctcagtttggccaggacccttctgccatggcagccttagcagctgaaatgaacttcttccagctgcctgtaagtggggtggagttggacagccagcttctgggcaagatggcctttg

SEQ ID NO: 203938 - DNA, 672 bp, Homo sapiens
  Payload ID: 20221
  Gene Name: zinc finger protein 821
  ENST ID: ENST00000568322
  CDS Start-End: 357-672
agtgccacaagttcccctgcccctgggtctgcagccaatgttattttatcagttgagaatcatgtcagaaaattaaatactcaaaagaaatctcaagatttcccagctctgaggttctgacagctgaacttggcccctcccaccaaggcccgtggtcacattcaaagcctcgggagccgaagccaccgcgaagcgtgggggaatgaggcgaagaggatacagatcacttggattcagtcgagtttgctttgctccgtgggaactgcaccagagctggaggttagcatcttgcaaggaggtagtaacatatccagtcgtgaaactgggaaagaccagagctcttgcatcagggaaacatgtcccgtcggaaacagacaaatccaaataaagttcactgggatcaagtatttgctgggctagaagagcaagcccgccaggcgatgatgaaaactgattttcctggagaccttggcagtcagcgacaagctatccaacaactaagagatcaggactccagtagcagtgacagtgagggtgatgaagaggagacgacacaagatgaagtctcttcccacacatcagaggaagatggaggggtggtcaaagtggagaaagagttagaaaatacagaacagcctgttggtgggaacgaagtggtagagcacgaggcaa

SEQ ID NO: 203939 - DNA, 906 bp, Homo sapiens
  Payload ID: 20221
  Gene Name: zinc finger protein 821
  ENST ID: ENST00000562985
  CDS Start-End: 307-495
ctcgggagccgaagccaccgcgaagcgtgggggaatgaggcgaagaggatacagatcacttggattcagtcgagtttgctttgctccgtgggaactgcaccagagctggaggtctgaaaaagaactgtgtttgatatgcagatatgctagaagactgcctgaaagctgcttcctttgccacttcctgtggaggcctgtctttgccatttgcggtttctttattcttttggttagcatcttgcaaggaggtagtaacatatccagtcgtgaaactgggaaagaccagagctcttgcatcagggaaacatgtcccgtcggaaacagacaaatccaaataaagttcactgggatcaagtatttgctgggctagaagagcaagcccgccaggcgatgatgaaaactgattttcctggagaccttggcagtcagcgacaagctatccaacaactaagagatcaggactccagtagcagtgagttctgcaccttctggtgacagtgagggtgatgaagaggagacgacacaagatgaagtctcttcccacacatcagaggaagatggaggggtggtcaaagtggagaaagagttagaaaatacagaacagcctgttggtgggaacgaagtggtagagcacgaggtcacagggaatttgaattctgaccccttgcttgaactctgccagtgtcccctctgccagctagactgcgggagccgggagcagttgattgctcacgtgtaccagcacactgcagcagtggtgagcgccaagagctacatgtgtcctgtctgtggccgggcccttagctccccggggtcattgggtcgccacctcttaatccactcggaggaccagcgatctaactgtgctgtgtgtggagcccggttcaccagccatgccacttttaa

SEQ ID NO: 203940 - DNA, 1954 bp, Homo sapiens
  Payload ID: 20221
  Gene Name: zinc finger protein 821
  ENST ID: ENST00000568961
  CDS Start-End: 524-712
cgcgcgctcccgccgcccgcgtcgccatctttttccccctccgtctgtctgtctgctgttggctttgtccgtctgcagcgccgcccctcggctccccgccaccggctcggctcggcccggagccccttccgctcgccggggcccagtcccggagcgccccggcccggctggcttgggctgcggtcccgggtccattgtccggcggtccgtctgtccggaggcggggcccagggacccagagcgcagcgcagcgccgaggcgccggatacagatcacttggattcagtcgagtttgctttgctccgtgggaactgcaccagagctggaggtctgaaaaagaactgtgtttgatatgcagatatgctagaagactgcctgaaagctgcttcctttgccacttcctgtggaggcctgtctttgccatttgcggtttctttattcttttggttagcatcttgcaaggaggtagtaacatatccagtcgtgaaactgggaaagaccagagctcttgcatcagggaaacatgtcccgtcggaaacagacaaatccaaataaagttcactgggatcaagtatttgctgggctagaagagcaagcccgccaggcgatgatgaaaactgattttcctggagaccttggcagtcagcgacaagctatccaacaactaagagatcaggactccagtagcagtcacagggaatttgaattctgaccccttgcttgaactctgccagtgtcccctctgccagctagactgcgggagccgggagcagttgattgctcacgtgtaccagcacactgcagcagtggtgagcgccaagagctacatgtgtcctgtctgtggccgggcccttagctccccggggtcattgggtcgccacctcttaatccactcggaggaccagcgatctaactgtgctgtgtgtggagcccggttcaccagccatgccacttttaacagtgagaaacttcctgaagtactaaatatggaatccctacccacagtccacaatgagggtccctccagtgctgaggggaaggatattgcctttagtcctccagtgtaccctgctggaattctgcttgtgtgcaacaactgtgctgcctaccgtaaactgctggaagcccagactcccagtgtacgcaagtgggctctacgtcgacagaatgagcctttggaagtacggctgcagcggctggaacgagagcgcacggccaagaagagccggcgggacaatgagacccccgaggagcgggaggtgaggcgcatgagggaccgtgaagccaagcgcttgcagcgcatgcaggagacagacgagcagcgggcacgccggctgcagcgggatcgggaggccatgaggctgaagcgggccaatgaaaccccggaaaagcggcaggcccggctcatccgagagcgagaggccaagcggctcaagaggaggctggagaaaatggacatgatgttgcgagctcagtttggccaggacccttctgccatggcagccttagcagctgaaatgaacttcttccagctgcctgtaagtggggtggagttggacagccagcttctgggcaagatggcctttgaagagcagaacagcagctctctgcactgaaccacaccctcctgcctgccctccttcccacctacctacccacccacccacacccacagccacgaggaccagtgctgctgccacccacgaggccctgtccttgctgccagaggcaggcctgggtttattgcaggtggacctgagcagcccttgcatatgggaacaggatgatggggtcaggagggacctggctcaaggcagctctggacaagggagcaggcagtccagagaactggcctccccagcccactgccacaggctgtgcttctaggactgtggggcccctgtgtggcccatgaagttgtgaagtcaaataaattaattttatctttactgcc

SEQ ID NO: 203941 - DNA, 1722 bp, Homo sapiens
  Payload ID: 20221
  Gene Name: zinc finger protein 821
  ENST ID: ENST00000566987
  CDS Start-End: 132-320
gaaaaatccgctggtgtagactgcagggcttgacttccagtgggcatgtgacatgttagcatcttgcaaggaggtagtaacatatccagtcgtgaaactgggaaagaccagagctcttgcatcagggaaacatgtcccgtcggaaacagacaaatccaaataaagttcactgggatcaagtatttgctgggctagaagagcaagcccgccaggcgatgatgaaaactgattttcctggagaccttggcagtcagcgacaagctatccaacaactaagagatcaggactccagtagcagtgagttctgcaccttctggtgacagtgagggtgatgaagaggagacgacacaagatgaagtctcttcccacacatcagaggaagatggaggggtggtcaaagtggagaaagagttagaaaatacagaacagcctgttggtgggaacgaagtggtagagcacgaggtcacagggaatttgaattctgaccccttgcttgaactctgccagtgtcccctctgccagctagactgcgggagccgggagcagttgattgctcacgtgtaccagcacactgcagcagtggtgagcgccaagagctacatgtgtcctgtctgtggccgggcccttagctccccggggtcattgggtcgccacctcttaatccactcggaggaccagcgatctaactgtgctgtgtgtggagcccggttcaccagccatgccacttttaacagtgagaaacttcctgaagtactaaatatggaatccctacccacagtccacaatgagggtccctccagtgctgaggggaaggatattgcctttagtcctccagtgtaccctgctggaattctgcttgtgtgcaacaactgtgctgcctaccgtaaactgctggaagcccagactcccagtgtacgcaagtgggctctacgtcgacagaatgagcctttggaagtacggctgcagcggctggaacgagagcgcacggccaagaagagccggcgggacaatgagacccccgaggagcgggaggtgaggcgcatgagggaccgtgaagccaagcgcttgcagcgcatgcaggagacagacgagcagcgggcacgccggctgcagcgggatcgggaggccatgaggctgaagcgggccaatgaaaccccggaaaagcggcaggcccggctcatccgagagcgagaggccaagcggctcaagaggaggctggagaaaatggacatgatgttgcgagctcagtttggccaggacccttctgccatggcagccttagcagctgaaatgaacttcttccagctgcctgtaagtggggtggagttggacagccagcttctgggcaagatggcctttgaagagcagaacagcagctctctgcactgaaccacaccctcctgcctgccctccttcccacctacctacccacccacccacacccacagccacgaggaccagtgctgctgccacccacgaggccctgtccttgctgccagaggcaggcctgggtttattgcaggtggacctgagcagcccttgcatatgggaacaggatgatggggtcaggagggacctggctcaaggcagctctggacaagggagcaggcagtccagagaactggcctccccagcccactgccacaggctgtgcttctaggactgtggggcccctgtgtggcccatgaagttgtgaagtcaaataaattaattttatcttta

SEQ ID NO: 203942 - DNA, 1032 bp, Homo sapiens
  Payload ID: 20221
  Gene Name: zinc finger protein 821
  ENST ID: ENST00000562797
  CDS Start-End: 395-1032
gccgcccgcgtcgccatctttttccccctccgtctgtctgtctgctgttggctttgtccgtctgcagcgccgcccctcggctccccgccaccggctcggctcggcccggagccccttccgctcgccggggcccagtcccggagcgccccggcccggctggcttgggctgcggtcccgggtccattgtccggcggtccgtctgtccggaggcggggcccagggacccagagcgcagcgcagcgccgaggcgccggatacagatcacttggattcagtcgagtttgctttgctccgtgggaactgcaccagagctggaggttagcatcttgcaaggaggtagtaacatatccagtcgtgaaactgggaaagaccagagctcttgcatcagggaaacatgtcccgtcggaaacagacaaatccaaataaagttcactgtgacagtgagggtgatgaagaggagacgacacaagatgaagtctcttcccacacatcagaggaagatggaggggtggtcaaagtggagaaagagttagaaaatacagaacagcctgttggtgggaacgaagtggtagagcacgaggtcacagggaatttgaattctgaccccttgcttgaactctgccagtgtcccctctgccagctagactgcgggagccgggagcagttgattgctcacgtgtaccagcacactgcagcagtggtgagcgccaagagctacatgtgtcctgtctgtggccgggcccttagctccccggggtcattgggtcgccacctcttaatccactcggaggaccagcgatctaactgtgctgtgtgtggagcccggttcaccagccatgccacttttaacagtgagaaacttcctgaagtactaaatatggaatccctacccacagtccacaatgagggtccctccagtgctgaggggaaggatattgcctttagtcctccagtgtaccctgctggaattctgcttgtgtgcaacaactgtgctgcctaccgtaaactgctggaagcccagactcccagtgt

SEQ ID NO: 203943 - DNA, 1833 bp, Homo sapiens
  Payload ID: 20221
  Gene Name: zinc finger protein 821
  ENST ID: ENST00000611294
  CDS Start-End: 424-843
agctgcgggtgcgcgagccgcgcgctcccgccgcccgcgtcgccatctttttccccctccgtctgtctgtctgctgttggctttgtccgtctgcagcgccgcccctcggctccccgccaccggctcggctcggcccggagccccttccgctcgccggggcccagtcccggagcgccccggcccggctggcttgggctgcggtcccgggtccattgtccggcggtccgtctgtccggaggcggggcccagggacccagagcgcagcgcagcgccgaggcgccggatacagatcacttggattcagtcgagtttgctttgctccgtgggaactgcaccagagctggaggttagcatcttgcaaggaggtagtaacatatccagtcgtgaaactgggaaagaccagagctcttgcatcagggaaacatgtcccgtcggaaacagacaaatccaaataaagttcactgggatcaagtatttgctgggctagaagagcaagcccgccaggcgatgatgaaaactgattttcctggagaccttggcagtcagcgacaagctatccaacaactaagagatcaggactccagtagcagtgacagtgagggtgatgaagaggagacgacacaagatgaagtctcttcccacacatcagaggaagatggaggggtggtcaaagtggagaaagagttagaaaatacagaacagcctgttggtgggaacgaagtggtagagcacgaggtcacagggaatttgaattctgaccccttgcttgaactctgccagtgtcccctctgccagctagactgcgggagccgggagcagttgattgctcacgtgtaccagtgagaaacttcctgaagtactaaatatggaatccctacccacagtccacaatgagggtccctccagtgctgaggggaaggatattgcctttagtcctccagtgtaccctgctggaattctgcttgtgtgcaacaactgtgctgcctaccgtaaactgctggaagcccagactcccagtgtacgcaagtgggctctacgtcgacagaatgagcctttggaagtacggctgcagcggctggaacgagagcgcacggccaagaagagccggcgggacaatgagacccccgaggagcgggaggtgaggcgcatgagggaccgtgaagccaagcgcttgcagcgcatgcaggagacagacgagcagcgggcacgccggctgcagcgggatcgggaggccatgaggctgaagcgggccaatgaaaccccggaaaagcggcaggcccggctcatccgagagcgagaggccaagcggctcaagaggaggctggagaaaatggacatgatgttgcgagctcagtttggccaggacccttctgccatggcagccttagcagctgaaatgaacttcttccagctgcctgtaagtggggtggagttggacagccagcttctgggcaagatggcctttgaagagcagaacagcagctctctgcactgaaccacaccctcctgcctgccctccttcccacctacctacccacccacccacacccacagccacgaggaccagtgctgctgccacccacgaggccctgtccttgctgccagaggcaggcctgggtttattgcaggtggacctgagcagcccttgcatatgggaacaggatgatggggtcaggagggacctggctcaaggcagctctggacaagggagcaggcagtccagagaactggcctccccagcccactgccacaggctgtgcttctaggactgtggggcccctgtgtggcccatgaagttgtgaagtcaaataaattaattttatctttactgcc

SEQ ID NO: 203944 - DNA, 2423 bp, Homo sapiens
  Payload ID: 20222
  Gene Name: zinc finger protein 823
  Uniprot ID: P16415
  ENST ID: ENST00000341191
  CDS Start-End: 155-1987
aaagagcccgcggagtcttctccacgcccctgcgctctgagtcctggctctggcgctgagagagagacgccctggaaggtctgtatcagcgtctgtcgcgctgggacccacactggcttttaaggaggacacccggacacctggaagctgggaaatggactcagtggcctttgaagatgtggctgtgaacttcacacaagaggagtgggctttgctgggtccatcacagaagagtctctacagaaatgtcatgcaggaaaccattaggaacctggactgtatagaaatgaaatgggaggaccagaacattggagatcagtgccaaaatgccaagagaaatctaagaagtcatacatgtgaaattaaagatgacagtcaatgtggagaaacttttggccagattccagatagtattgtgaacaagaacactcctcgagtaaatccatgtgacagtggtgagtgtggagaagtcgtcttgggtcattcgtctcttaattgcaacatcagagttgacactggacacaaatcatgtgagcatcaggaatatggagagaagccatatacacataaacaacgtgggaaagccatcagtcatcagcactccttccagacacatgaaaggccccccaccggaaagaaacccttcgattgtaaagaatgtgcaaaaacctttagttctcttggaaacctccgaagacacatggcggcacaccatggagatggaccttataaatgtaagttgtgtgggaaagcctttgtttggcccagtttatttcatttgcacgaaagaacacacactggagagaaaccgtatgaatgtaagcagtgttctaaagcctttcctttttacagttcctatctaagacatgaaagaatccacacgggagagaaagcgtatgaatgtaagcagtgttccaaagcctttcctgattacagtacctatctaagacatgagagaactcacaccggagagaaaccctataaatgtacacaatgtgggaaagccttcagctgttactattacactcgactacatgaaaggactcacacgggagaacaaccctatgcatgtaagcaatgtgggaaaacgttttatcatcacacaagctttcgaagacacatgataaggcacactggagacggaccacataaatgtaagatatgtgggaaaggctttgattgtcctagttcagttcgaaatcatgaaactactcacactggagagaaaccctatgaatgtaagcagtgtgggaaagtgttatctcatagctcgagctttcgaagtcacatgataacacacacaggagatggaccccagaaatgcaagatatgtgggaaagcctttggttgtcccagtttatttcaaagacatgaaaggactcacactggagagaaaccctatcaatgtaaacaatgtggtaaagccttcagtcttgccggttcccttcgaagacatgaagcaactcacactggagtgaaaccctataaatgtcagtgtgggaaagcctttagtgatctctcttcctttcaaaatcatgagacaactcacactggagagaagccatatgagtgtaaggaatgtgggaaagcattcagttgtttcaaatacctttctcaacataaaaggacccacacagtagaaaaaccttatgagtgtaaaacatgtagaaaagccttcagtcatttcagtaacttaaaagtccatgaaaggattcactctggagagaagccatatgaatgtaaggaatgtggaaaagcattctcttggctcacttgccttctacgacatgaaagaattcacactggagagaaaccctatgaatgtctacaatgtggtaaagccttcactcgttcccgtttccttcgaggacatgaaaaaactcacactggagagaagctgtatgaatgtaaggaatgtgggaaagcattgagttctctccgttccttgcatagacataaaaggactcactggaaagatactctctaaatgtatggaatgtgggaaaacattcagtactttaatttcagaaacttgaaagaactcactttggagatagaccctatgaatgtaaacatgggataaagccttaagtagtttcaatttttttaaatacagttatcccccaatatattgcaggggattggttccagcaccctctaaatccacagatgccaagtcctttgttatatggcatatttgcatgtaacctatgcatatcttccagtatactgtgtaaatcatctctagatgacttttaatacctcatgcattgtaaaagctatgtaaatagttgtttgattgtattgtttagagaatcatgacaagaaaaatagtctctacatgttcgatgcagacacaaccattgcaggcccacctacgtggtatatgtcacccagaacattaaaatttgttttaacattca

SEQ ID NO: 203945 - DNA, 550 bp, Homo sapiens
  Payload ID: 20222
  Gene Name: zinc finger protein 823
  ENST ID: ENST00000440527
  CDS Start-End: 191-394
aatcaggcacgctgcagggaggagggtgcgacgttcaaagagcccgcggagtcttctccacgcccctgcgctctgagtcctggctctggcgctgagagagagacgccctggaaggtctgtatcagcgtctgtcgcgctgggacccacactggcttttaaggaggacacccggacacctggaagctgggaaatggactcagtggcctttgaagatgtggctgtgaacttcacacaagaggagtgggctttgctgggtccatcacagaagagtctctacagaaatgtcatgcaggaaaccattaggaacctggactgtatagaagtcatacatgtgaaattaaagatgacagtcaatgtggagaaacttttggccagattccagatagtattgtgaacaagaacactcctcgagtaaatccatgtgacagtggtgagtgtggagaagtcgtcttgggtcattcgtctcttaattgcaacatcagagttgacactggacacaaatcatgtgagcatcaggaatatggagagaagccatatacacataaacaac

SEQ ID NO: 203946 - DNA, 1540 bp, Homo sapiens
  Payload ID: 20222
  Gene Name: zinc finger protein 823
  ENST ID: ENST00000431998
  CDS Start-End: 132-1540
cctgcgctctgagtcctggctctggcgctgagagagagacgccctggaaggtctgtatcagcgtctgtcgcgctgggacccacactggcttttaaggaggacacccggacacctggaagctgggaaatgaaatgaaatgggaggaccagaacattggagatcagtgccaaaatgccaagagaaatctaagaagtcatacatgtgaaattaaagatgacagtcaatgtggagaaacttttggccagattccagatagtattgtgaacaagaacactcctcgagtaaatccatgtgacagtggtgagtgtggagaagtcgtcttgggtcattcgtctcttaattgcaacatcagagttgacactggacacaaatcatgtgagcatcaggaatatggagagaagccatatacacataaacaacgtgggaaagccatcagtcatcagcactccttccagacacatgaaaggccccccaccggaaagaaacccttcgattgtaaagaatgtgcaaaaacctttagttctcttggaaacctccgaagacacatggcggcacaccatggagatggaccttataaatgtaagttgtgtgggaaagcctttgtttggcccagtttatttcatttgcacgaaagaacacacactggagagaaaccgtatgaatgtaagcagtgttctaaagcctttcctttttacagttcctatctaagacatgaaagaatccacacgggagagaaagcgtatgaatgtaagcagtgttccaaagcctttcctgattacagtacctatctaagacatgagagaactcacaccggagagaaaccctataaatgtacacaatgtgggaaagccttcagctgttactattacactcgactacatgaaaggactcacacgggagaacaaccctatgcatgtaagcaatgtgggaaaacgttttatcatcacacaagctttcgaagacacatgataaggcacactggagacggaccacataaatgtaagatatgtgggaaaggctttgattgtcctagttcagttcgaaatcatgaaactactcacactggagagaaaccctatgaatgtaagcagtgtgggaaagtgttatctcatagctcgagctttcgaagtcacatgataacacacacaggagatggaccccagaaatgcaagatatgtgggaaagcctttggttgtcccagtttatttcaaagacatgaaaggactcacactggagagaaaccctatcaatgtaaacaatgtggtaaagccttcagtcttgccggttcccttcgaagacatgaagcaactcacactggagtgaaaccctataaatgtcagtgtgggaaagcctttagtgatctctcttcctttcaaaatcatgagacaactcacactggagagaagccatatgagtgtaaggaatgtgggaaagcattcagttgtttcaaatacctttctcaacataaaaggacccacacagtagaaaaaccttatgagtgtaaaacatgtagaaaagccttcagtcatttcagtaactt

SEQ ID NO: 203947 - DNA, 698 bp, Homo sapiens
  Payload ID: 20222
  Gene Name: zinc finger protein 823
  ENST ID: ENST00000586121
  CDS Start-End: 422-698
tctgtcgcgctgggacccacactggcttttaaggaggacacccggacacctggaagctgggaaatgaagtcatacatgtgaaattaaagatgacagtcaatgtggagaaacttttggccagattccagatagtattgtgaacaagaacactcctcgagtaaatccatgtgacagtggtgagtgtggagaagtcgtcttgggtcattcgtctcttaattgcaacatcagagttgacactggacacaaatcatgtgagcatcaggaatatggagagaagccatatacacataaacaacgtgggaaagccatcagtcatcagcactccttccagacacatgaaaggccccccaccggaaagaaacccttcgattgtaaagaatgtgcaaaaacctttagttctcttggaaacctccgaagacacatggcggcacaccatggagatggaccttataaatgtaagttgtgtgggaaagcctttgtttggcccagtttatttcatttgcacgaaagaacacacactggagagaaaccgtatgaatgtaagcagtgttctaaagcctttcctttttacagttcctatctaagacatgaaagaatccacacgggagagaaagcgtatgaatgtaagcagtgttccaaagcctttcctgattacagtacctatctaagacatgagagaactcacaccggagagaaac

SEQ ID NO: 203948 - DNA, 4197 bp, Homo sapiens
  Payload ID: 20223
  Gene Name: zinc finger protein 827
  Uniprot ID: Q17R98
  ENST ID: ENST00000379448
  CDS Start-End: 65-3298
gcccccacgggggtttatttgatctcacattaaccaaggaggagaatgtgagaaaagggggaaaatgcccaggaggaagcaggagcagcccaagcgccttccctcacatgttagtaggcaggaagaggcggagggagagctcagtgaaggagaacactggtatggaaactcttcagagactccgtcagaagcatcctatggggaagtccaggagaactataagttgtctctggaggaccggatccaggagcagtccacgtccccggacacctccttgggaagcacgactcccagcagccacacgttggagctggtggcactggacagtgaggtcctgcgagactcactgcagtgtcaagatcacctttccccgggagtgtcttctttgtgtgacgatgacccaggctccaacaagcccctgagcagcaatttgaggcggctgctggaggctggttccctcaaactcgatgctgcagccacggctaatggcagagtggagtcccccgtaaacgttggctcgaacctctccttttccccgccttcccaccacgcccagcagctcagtgttctggccaggaagttggccgagaagcaggaacagaatgaccaatacactccaagtaaccgttttatatggaatcaaggtaagtggttgccaaactcaaccaccacctgcagcttgtctccggattcagccatcctaaaactgaaagctgcagccaatgccgttctgcaggacaaatctctcaccaggactgaggagaccatgcgatttgagtccttttcctccccttttagctcccagtctgccagttctaccttggccgctttgtccaagaaggtcagtgaaagaagtttgactcctggtcaggagcaccctccaccggccagctccttcctttccctggcttctatgacctcctcagcggcccttctgaaggaggtggccgcaagggctgcgggcagtcttctggctgagaaatcatcgctgctgcctgaggaccctctaccgcccccgccttcagagaagaaaccagaaaaagtcactccgccacctccaccgccacctccaccacctccaccaccaccaccacaatccctggaattattattactcccagttcctaagggaagagtttctaaaccctccaattcagcctcagaagaggaaagtggaaagcctttccagtgtccaatatgtggtttggttattaaaaggaagagttactggaagcggcacatggtgattcacacaggtttaaaaagtcatcagtgtccgctctgtccattccggtgtgctcgcaaggacaatctcaaatcccacatgaaggttcatcagcaccaggatcggggagagacctttcagtgccagctgtgcccttttacttcctcacgccacttcagcctgaaactccacatgcgttgccatcagcacttcctgaggacagaagccaaggtgaaggaggagatcccagacccagatgtcaagggatctccccacctcagtgacagtgcctgcctggggcagcaaagggaaggaggagggacagagctagtggggaccatgatgacgtctaacactccagagaggactagccagggaggggctggcgtctcgcctttgctggtgaaggaggaacccaaggaagataacggcctgcccacctcctttactttgaatgctgccgacaggcccgccaaccacacaaagctgaaagacccctccgagtatgtggccaacagtgcgtcagcattgttcagccaggacatctctgttaagatggcgtctgattttctcatgaagctgtcagctgcaaatcagaaggagcccatgaatcttaattttaaagtgaaagaggagcctaaggaaggggagtccctaagcacgactttgcctcggtccagctatgtgttcagcccggaatctgaagtgtcagccccaggcgtctctgaggacgcactaaagccccaggaagggaagggaagtgtgctaaggcgggatgtgtcagtcaaagcagcctctgaacttctcatgaaactctcagcggaaagctacaaggaaacacagatggtgaagattaaagaggaacccatggaggttgacatccaggactcccatgtctcgatatcacccagccggaatgttggctacagcactttaatcgggcgagagaaaaccgaacccttacagaagatgccagagggcagagtacccccagagagaaacctcttcagtcaggatatctctgtgaaaatggcttccgagctcctctttcaactgtcagaaaaagtgagcaaagagcacaatcatacaaaagaaaacaccatccggaccacgaccagccctttcttttcagaagacacatttagacaatcaccattcacctccaattcaaaagaactgctgcccagtgactccgtgctgcacggaagaatatcagctccagaaacagaaaagatagtcctagaggcaggaaatggattaccatcctggaaattcaatgaccagctttttccctgtgacgtgtgtgggaaagtgtttggccgacagcagacattgtcccgacacctctcgctgcacacagaggaaagaaaatacaaatgccacttgtgcccctatgctgctaagtgccgtgcaaatctgaaccagcacttgaccgtccattccgtgaagctggtgagtacagacaccgaggacattgtcagcgccgtcacctctgaaggcagtgatgggaagaaacatccttattattacagttgtcacgtgtgtggatttgagaccgagctcaatgtccagtttgtcagccacatgtcactccacgtggacaaggagcagtggatgttttcgatctgctgcactgcctgcgacttcgtcaccatggaggaagcagagataaagactcacattggcaccaagcacacaggggaagacaggaagacccccagcgaatcaaatagcccctcttcatcctccctctcagctctgagtgattcagccaacagcaaagatgattcagatggctcccagaaaaacaagggcgggaacaatctgctggtcatctctgtcatgcctgggagccagccctcactgaacagtgaggaaaagccagagaaagggttcgaatgtgttttttgcaactttgtctgcaagacgaagaacatgtttgagcgtcatctgcagatacacctcatcacccggatgtttgagtgtgatgtgtgccacaagttcatgaagacccccgaacagctgctggagcataagaaatgccacactgtccccaccggtgggctcaagtaaggaaactcaggacagtggtgagtttcagactcctctaggtgcccattctgcatttattccaccaaccgccccgctgccatggagtgccacctcaagacccactacaagatggagtacaagtgccggatctgccagacggtgaaggccaaccagctggagctggagacgcacacccgggagcaccgcctgggcaaccactacaagtgcgaccagtgcggctacctgtccaagaccgccaacaagctcatcgagcacgtgcgcgtccacaccggggagcggcccttccactgtgaccagtgcagctacagctgcaagcgcaaggacaatctcaacctgcacaagaagctgaagcacgccccacgccagaccttcagctgcgaagagtgcctgttcaagaccacacaccctttcgtcttcagccgccacgtcaagaagcaccagagtggggactgccccgaggaggacaagaagggcctgtgtccagcccccaaggaaccggccggcccgggggccccgctcctggtggtcgggagctcccggaatctcctgtctcccctgtcagttatgtctgcctcccaggctctgcagaccgtggccctgtcggcagcccacggcagcagctcagagcccaacctggcactcaaggctttggccttcaacggctcccctttgcgctttgacaagtaccggaactcagattttgcccatctcattcccttgacaatgttataccccaagaaccacttggatctcacattccaccctccccgacctcagactgcgcctcccagcatcccctcacccaaacactccttcctggcctatctcggactgagagaaagagcagagactgtctgagggcagccatgttctgtaccaaaaacagagagacaaaagac

SEQ ID NO: 203949 - DNA, 7463 bp, Homo sapiens
  Payload ID: 20223
  Gene Name: zinc finger protein 827
  Uniprot ID: Q17R98
  ENST ID: ENST00000508784
  CDS Start-End: 229-3474
aaaaaaaaaaaaaggaaaaaagaaaggaaagaaaagaagaaaacccctcttctggctccaggaaacaagcttcaacccattgcacacaccggagaaggggtttccccctgcccgcccgcccgccccccaactacctccccgctcctgccagtgtctgcctctctgcccccacgggggtttatttgatctcacattaaccaaggaggagaatgtgagaaaagggggaaaatgcccaggaggaagcaggagcagcccaagcgccttccctcacatgttagtaggcaggaagaggcggagggagagctcagtgaaggagaacactggtatggaaactcttcagagactccgtcagaagcatcctatggggaagtccaggagaactataagttgtctctggaggaccggatccaggagcagtccacgtccccggacacctccttgggaagcacgactcccagcagccacacgttggagctggtggcactggacagtgaggtcctgcgagactcactgcagtgtcaagatcacctttccccgggagtgtcttctttgtgtgacgatgacccaggctccaacaagcccctgagcagcaatttgaggcggctgctggaggctggttccctcaaactcgatgctgcagccacggctaatggcagagtggagtcccccgtaaacgttggctcgaacctctccttttccccgccttcccaccacgcccagcagctcagtgttctggccaggaagttggccgagaagcaggaacagaatgaccaatacactccaagtaaccgttttatatggaatcaaggtaagtggttgccaaactcaaccaccacctgcagcttgtctccggattcagccatcctaaaactgaaagctgcagccaatgccgttctgcaggacaaatctctcaccaggactgaggagaccatgcgatttgagtccttttcctccccttttagctcccagtctgccagttctaccttggccgctttgtccaagaaggtcagtgaaagaagtttgactcctggtcaggagcaccctccaccggccagctccttcctttccctggcttctatgacctcctcagcggcccttctgaaggaggtggccgcaagggctgcgggcagtcttctggctgagaaatcatcgctgctgcctgaggaccctctaccgcccccgccttcagagaagaaaccagaaaaagtcactccgccacctccaccgccacctccaccacctccaccaccaccaccacaatccctggaattattattactcccagttcctaagggaagagtttctaaaccctccaattcagcctcagaagaggaaagtggaaagcctttccagtgtccaatatgtggtttggttattaaaaggaagagttactggaagcggcacatggtgattcacacaggtttaaaaagtcatcagtgtccgctctgtccattccggtgtgctcgcaaggacaatctcaaatcccacatgaaggttcatcagcaccaggatcggggagagacctttcagtgccagctgtgcccttttacttcctcacgccacttcagcctgaaactccacatgcgttgccatcagcacttcctgaggacagaagccaaggtgaaggaggagatcccagacccagatgtcaagggatctccccacctcagtgacagtgcctgcctggggcagcaaagggaaggaggagggacagagctagtggggaccatgatgacgtctaacactccagagaggactagccagggaggggctggcgtctcgcctttgctggtgaaggaggaacccaaggaagataacggcctgcccacctcctttactttgaatgctgccgacaggcccgccaaccacacaaagctgaaagacccctccgagtatgtggccaacagtgcgtcagcattgttcagccaggacatctctgttaagatggcgtctgattttctcatgaagctgtcagctgcaaatcagaaggagcccatgaatcttaattttaaagtgaaagaggagcctaaggaaggggagtccctaagcacgactttgcctcggtccagctatgtgttcagcccggaatctgaagtgtcagccccaggcgtctctgaggacgcactaaagccccaggaagggaagggaagtgtgctaaggcgggatgtgtcagtcaaagcagcctctgaacttctcatgaaactctcagcggaaagctacaaggaaacacagatggtgaagattaaagaggaacccatggaggttgacatccaggactcccatgtctcgatatcacccagccggaatgttggctacagcactttaatcgggcgagagaaaaccgaacccttacagaagatgccagagggcagagtacccccagagagaaacctcttcagtcaggatatctctgtgaaaatggcttccgagctcctctttcaactgtcagaaaaagtgagcaaagagcacaatcatacaaaagaaaacaccatccggaccacgaccagccctttcttttcagaagacacatttagacaatcaccattcacctccaattcaaaagaactgctgcccagtgactccgtgctgcacggaagaatatcagctccagaaacagaaaagatagtcctagaggcaggaaatggattaccatcctggaaattcaatgaccagctttttccctgtgacgtgtgtgggaaagtgtttggccgacagcagacattgtcccgacacctctcgctgcacacagaggaaagaaaatacaaatgccacttgtgcccctatgctgctaagtgccgtgcaaatctgaaccagcacttgaccgtccattccgtgaagctggtgagtacagacaccgaggacattgtcagcgccgtcacctctgaaggcagtgatgggaagaaacatccttattattacagttgtcacgtgtgtggatttgagaccgagctcaatgtccagtttgtcagccacatgtcactccacgtggacaaggagcagtggatgttttcgatctgctgcactgcctgcgacttcgtcaccatggaggaagcagagataaagactcacattggcaccaagcacacaggggaagacaggaagacccccagcgaatcaaatagcccctcttcatcctccctctcagctctgagtgattcagccaacagcaaagatgattcagatggctcccagaaaaacaagggcgggaacaatctgctggtcatctctgtcatgcctgggagccagccctcactgaacagtgaggaaaagccagagaaagggttcgaatgtgttttttgcaactttgtctgcaagacgaagaacatgtttgagcgtcatctgcagatacacctcatcacccggatgtttgagtgtgatgtgtgccacaagttcatgaagacccccgaacagctgctggagcataagaaatgccacactgtccccaccggtgggctcaactcaggacagtggtgagtttcagactcctctaggtgcccattctgcatttattccaccaaccgccccgctgccatggagtgccacctcaagacccactacaagatggagtacaagtgccggatctgccagacggtgaaggccaaccagctggagctggagacgcacacccgggagcaccgcctgggcaaccactacaagtgcgaccagtgcggctacctgtccaagaccgccaacaagctcatcgagcacgtgcgcgtccacaccggggagcggcccttccactgtgaccagtgcagctacagctgcaagcgcaaggacaatctcaacctgcacaagaagctgaagcacgccccacgccagaccttcagctgcgaagagtgcctgttcaagaccacacaccctttcgtcttcagccgccacgtcaagaagcaccagagtggggactgccccgaggaggacaagaagggcctgtgtccagcccccaaggaaccggccggcccgggggccccgctcctggtggtcgggagctcccggaatctcctgtctcccctgtcagttatgtctgcctcccaggctctgcagaccgtggccctgtcggcagcccacggcagcagctcagagcccaacctggcactcaaggctttggccttcaacggctcccctttgcgctttgacaagtaccggaactcagattttgcccatctcattcccttgacaatgttataccccaagaaccacttggatctcacattccaccctccccgacctcagactgcgcctcccagcatcccctcacccaaacactccttcctggcctatctcggactgagagaaagagcagagactgtctgagggcagccatgttctgtaccaaaaacagagagacaaaagacaaaaaaaaaaaaaaaaaccacaaaacttaaacacaaccccagcaggtgtatgttgctgcaaaacctacagaccccgatgggtctggaacatgtgtactgtatatctttagtaaggaatagaaaattggctctgtgtgtatacctattgcattgacctgaaagctgctttatccaatcttcagagaggtgacctactgcatacttctaccttcagaggcatgcctccccagccacccactcccactctcagcccttctccgtacttttctctgaaaggaatcttgtcttgttaaaccctaaagagagtgtccttaatagcaatcagcacttgtaagcttatatactggtgcatttggttttctgttgggtgaatgcggtgtgtgggcgtttgtggattctgaaagagaaagccgtgtgtcgtgtgccatgacatttctattgcacattctttgtactggcttctttaacagcgatgaacgttcttttccctcctgggttgttcatccacgacagtctctccctgtgctccttcatcacctttccctctctctttgatggctacagagtggtagggcctggtgcttagtcgatgaaggaatggtagccatctacagtgctgctggagatttccgccagagcgctggagaccttgcgctcagatcttctctggtgatgaagaggcgaggaatcaagtgactgatctggaagaaatatctcgcagcactgcagctaacatcacagaacttaagtgtgttttgtgtgtgtgcccacacgtagacaaatgtgtacggtgcacacacacagtgcatcattttttaagggcagattatatatatatatgagatgtattaattcagtggttaccatttgtttgcaggaaaaagaaatgtatgggtgaaaaaatttatggttgataaatccagccaaggagattaaaaggggtttggataaattctgggtataaatgctcagactaaaaaaaagaaatggcagttttgcacagtgctatggtcttgcactagtttttgtttctcatctgaaaaaaaaaaagtaaaataaaaggaagaaaatgtaccttttttatggaatgagtagactgtatgtttgaagatttagccacaacctctttgacatataatgacgcaacaaaaaggtgctgtttagtcctatggttcagtttatgcccctgacaagtttccattgtgttttgccgatcttctggctaatcgtggtatcctccatgttattagtaattctgtattccattttgttaacgcctggtagatgtaacctgctaggaggctaactttatacttatttaaaagctcttattttgtggtcattaaaatggcaatttatgtgcagcactttattgcagcaggaagcaggtgtgggttggttgtaaagctctttgctaatcttaaaaagtaatgggtgatttaaaaagaaaaaaggaaaaaaatctttggctgaatatgttcattgcttgtatttttaaaacaacagaatttccagtatgaaacaggctgaaagagcaggaagaaatgttctttgtataataatgggaagtttggaatataaaagtttatatattatttatctattggagaactggtgtacaggaggaacattttcttactgtgttgctgttttccatcatgtgttatcctaagagttggggttttttaaaatctgtttcaccaggggaaaataaaagcatccctaatgttcttcctctagtcagtttgctttgctgaaagctccctggaaattagtacagttctacaggaagccagaagactgtactgtctgtccacaccatggtctcctcagtcccctccacgccagcccctcttccccacacctagtaggtgtgctacacctccctttgccagtcatcccgccatggatggggagcctacttggtgccctggcaaacctgtttacactaaggagatgcccacagggagcgggaagctcccaaaccctcagtcattctccagcagagacctttgctcttggccaggtttgaaacgatgttcaacctcgccacgtcaatgtctcagtaaaagacactatagatagttatggacaatacactccaagaatactgggcttatgggtgggttggttttttgttttgttttgttttgttttcaagtcatgtctttatccccatataatggagaatgtgccacttggctaataatgtgttttcaaaactacaagttcagtgatgacaggaaagagggctaaagtagtcccacagaggctggtagaaaaggcgaatcacacttaagcaccagcaggttaaaaacctgaaagggtggccctgacaattcagactataggttttacagcatgccacttgtgcaataggaggtctagggttgaaactttcaagaacgagaggaggtgaaggaaggagacgtttactgctcaaatgccatgcatttcactgcttgccactgaacttgtatttgaatgacttagtaatgcttaatataattgggcaacttttttagcactttggaaagagtcatcaatctttctggtaaattataaaagttttctgagtgagaaaaggtgtgtttggagtttgtttgactttttatattattattgttattaataaagaaaaaaatctacagcatttttcagactccaccctagaaaatatgtacccctgaatttggtttgcagtttgatactcagggaaggatgtattccatagatatcctttccgtataaaacactaacatctttgagaaattcacctaccaactaacttcaattgttgtcactatgcattcttcaatgaaaactagcttatttttccatatagtaatgcagttagggttctcagcactttctttcttctatcctttttttaactcttcatattatgttcagatgatcatactgtcaaggtttgtgtacattactgaaaatttgtattgtataaagctttttgcattacgaggctgtacagggtcattttgacagtaactggtatattcctttgcatcttatgttgcattgccaatttctagtgtatccagtttgaaagtataatatactctaattaaaaaaaaaaaaaggttggctata

SEQ ID NO: 203950 - DNA, 3165 bp, Homo sapiens
  Payload ID: 20223
  Gene Name: zinc finger protein 827
  ENST ID: ENST00000513320
  CDS Start-End: 83-2278
gccagtgtctgcctctctgcccccacgggggtttatttgatctcacattaaccaaggaggagaatgtgagaaaagggggaaaatgcccaggaggaagcaggagcagcccaagcgccttccctcaccctcagaagaggaaagtggaaagcctttccagtgtccaatatgtggtttggttattaaaaggaagagttactggaagcggcacatggtgattcacacaggtttaaaaagtcatcagtgtccgctctgtccattccggtgtgctcgcaaggacaatctcaaatcccacatgaaggttcatcagcaccaggatcggggagagacctttcagtgccagctgtgcccttttacttcctcacgccacttcagcctgaaactccacatgcgttgccatcagcacttcctgaggacagaagccaaggtgaaggaggagatcccagacccagatgtcaagggatctccccacctcagtgacagtgcctgcctggggcagcaaagggaaggaggagggacagagctagtggggaccatgatgacgtctaacactccagagaggactagccagggaggggctggcgtctcgcctttgctggtgaaggaggaacccaaggaagataacggcctgcccacctcctttactttgaatgctgccgacaggcccgccaaccacacaaagctgaaagacccctccgagtatgtggccaacagtgcgtcagcattgttcagccaggacatctctgttaagatggcgtctgattttctcatgaagctgtcagctgcaaatcagaaggagcccatgaatcttaattttaaagtgaaagaggagcctaaggaaggggagtccctaagcacgactttgcctcggtccagctatgtgttcagcccggaatctgaagtgtcagccccaggcgtctctgaggacgcactaaagccccaggaagggaagggaagtgtgctaaggcgggatgtgtcagtcaaagcagcctctgaacttctcatgaaactctcagcggaaagctacaaggaaacacagatggtgaagattaaagaggaacccatggaggttgacatccaggactcccatgtctcgatatcacccagccggaatgttggctacagcactttaatcgggcgagagaaaaccgaacccttacagaagatgccagagggcagagtacccccagagagaaacctcttcagtcaggatatctctgtgaaaatggcttccgagctcctctttcaactgtcagaaaaagtgagcaaagagcacaatcatacaaaagaaaacaccatccggaccacgaccagccctttcttttcagaagacacatttagacaatcaccattcacctccaattcaaaagaactgctgcccagtgactccgtgctgcacggaagaatatcagctccagaaacagaaaagatagtcctagaggcaggaaatggattaccatcctggaaattcaatgaccagctttttccctgtgacgtgtgtgggaaagtgtttggccgacagcagacattgtcccgacacctctcgctgcacacagaggaaagaaaatacaaatgccacttgtgcccctatgctgctaagtgccgtgcaaatctgaaccagcacttgaccgtccattccgtgaagctggtgagtacagacaccgaggacattgtcagcgccgtcacctctgaaggcagtgatgggaagaaacatccttattattacagttgtcacgtgtgtggatttgagaccgagctcaatgtccagtttgtcagccacatgtcactccacgtggacaaggagcagtggatgttttcgatctgctgcactgcctgcgacttcgtcaccatggaggaagcagagataaagactcacattggcaccaagcacacaggggaagacaggaagacccccagcgaatcaaatagcccctcttcatcctccctctcagctctgagtgattcagccaacagcaaagatgattcagatggctcccagaaaaacaagggcgggaacaatctgctggtcatctctgtcatgcctgggagccagccctcactgaacagtgaggaaaagccagagaaagggttcgaatgtgttttttgcaactttgtctgcaagacgaagaacatgtttgagcgtcatctgcagatacacctcatcacccggatgtttgagtgtgatgtgtgccacaagttcatgaagacccccgaacagctgctggagcataagaaatgccacactgtccccaccggtgggctcaactcaggacagtggtgagtttcagactcctctaggtgcccattctgcatttattccaccaaccgccccgctgccatggagtgccacctcaagacccactacaagatggagtacaagtgccggatctgccagacggtgaaggccaaccagctggagctggagacgcacacccgggagcaccgcctgggcaaccactacaagtgcgaccagtgcggctacctgtccaagaccgccaacaagctcatcgagcacgtgcgcgtccacaccggggagcggcccttccactgtgaccagtgcagctacagctgcaagcgcaaggacaatctcaacctgcacaagaagctgaagcacgccccacgccagaccttcagctgcgaagagtgcctgttcaagaccacacaccctttcgtcttcagccgccacgtcaagaagcaccagagtggggactgccccgaggaggacaagaagggcctgtgtccagcccccaaggaaccggccggcccgggggccccgctcctggtggtcgggagctcccggaatctcctgtctcccctgtcagttatgtctgcctcccaggctctgcagaccgtggccctgtcggcagcccacggcagcagctcagagcccaacctggcactcaaggctttggccttcaacggctcccctttgcgctttgacaagtaccggaactcagattttgcccatctcattcccttgacaatgttataccccaagaaccacttggatctcacattccaccctccccgacctcagactgcgcctcccagcatcccctcacccaaacactccttcctggcctatctcggactgagagaaagagcagagactgtctgagggcagccatgttctgtaccaaaaacagagagacaaaagacaaaaaaaaa

SEQ ID NO: 203951 - DNA, 858 bp, Homo sapiens
  Payload ID: 20223
  Gene Name: zinc finger protein 827
  ENST ID: ENST00000511659
  CDS Start-End: 1-536
acgtgtgtggatttgagaccgagctcaatgtccagtttgtcagccacatgtcactccacgtggacaaggagcagtggatgttttcgatctgctgcactgcctgcgacttcgtcaccatggaggaagcagagataaagactcacattggcaccaagcacacaggggaagacaggaagacccccagcgaatcaaatagcccctcttcatcctccctctcagctctgagtgattcagccaacagcaaagatgattcagatggctcccagaaaaacaagggcgggaacaatctgctggtcatctctgtcatgcctgggagccagccctcactgaacagtgaggaaaagccagagaaagggttcgaatgtgttttttgcaactttgtctgcaagacgaagaacatgtttgagcgtcatctgcagatacacctcatcacccggatgtttgagtgtgatgtgtgccacaagttcatgaagacccccgaacagctgctggagcataagaaatgccacactgtccccaccggtgggctcaagtaaggaaagtgcccattctgcatttattccaccaaccgccccgctgccatggagtgccacctcaagacccactacaagatggagtacaagtgccggatctgccagacggtgaaggccaaccagctggagctggagacgcacacccgggagcaccgcctgggcaaccactacaagtgcgaccagtgcggctacctgtccaagaccgccaacaagctcatcgagcacgtgcgcgtccacaccggggagcggcccttccactgtgaccagtgcagctacagctgcaagcgcaaggacaatctcaacctgcacaagaagctgaagcacg

SEQ ID NO: 203952 - DNA, 538 bp, Homo sapiens
  Payload ID: 20223
  Gene Name: zinc finger protein 827
  ENST ID: ENST00000503462
  CDS Start-End: 1-538
ttcatgaagacccccgaacagctgctggagcataagaaatgccacactgtccccaccggtgggctcaagtgcccattctgcatttattccaccaaccgccccgctgccatggagtgccacctcaagacccactacaagatggagtacaagtgccggatctgccagacggtgaaggccaaccagctggagctggagacgcacacccgggagcaccgcctgggcaaccactacaagtgcgaccagtgcggctacctgtccaagaccgccaacaagctcatcgagcacgtgcgcgtccacaccggggagcggcccttccactgtgaccagtgcagctacagctgcaagcgcaaggacaatctcaacctgcacaagaagctgaagcacgccccacgccagaccttcagctgcgaagagtgcctgttcaagaccacacaccctttcgtcttcagccgccacgtcaagaagcaccagagtggggactgccccgaggaggacaagaagggcctgtgtccagcccccaaggaaccggccggcccgg

SEQ ID NO: 203953 - DNA, 4977 bp, Homo sapiens
  Payload ID: 20224
  Gene Name: zinc finger protein 829
  Uniprot ID: Q3KNS6
  ENST ID: ENST00000520965
  CDS Start-End: 68-1609
agatctgggaggtgagatattttggtccccaggagaactggctcaggtctgcaagttcccatccgggatgactggaaagggcttaggtgaggataccgaagaccgatggggagctggcgccttgggcccctgcgggcggagcggcctgaaaggtggaggttgtgtttgggaggccgaggcaggaggatcacgaggtcaagagatcgagaccatcctggccaacatggaaacctctctgaggtctggtcagattccaaccctggacagcagtgaacacaacctttcccctgagccactggaattggacagaatgccccattctcctctgatctccattcctcatgtgtggtgtcacccagaagaggaggaaagaatgcatgatgaacttctacaagcagtatccaaggggccggtgatgttcagggatgtttccatagacttctctcaagaggaatgggaatgcctggacgctgatcagatgaatttatacaaagaagtgatgttggagaatttcagcaacctggtttcagtgggactttccaattctaagccagctgtgatctccttattggaacaaggaaaagagccctggatggttgatagagagctgactagaggcctgtgttcagatctggaatcaatgtgtgagaccaaaatattatctctaaagaagagacatttcagtcaagtaataattacccgtgaagacatgtctacttttattcagcccacatttcttattccacctcaaaaaactatgagtgaagagaaaccatgggaatgtaagatatgtggaaagacctttaatcaaaactcacaatttatccaacatcagagaattcattttggtgaaaaacactatgaatctaaggagtatgggaagtcctttagtcgtggctcactcgttactcgacatcagaggattcacactggtaaaaaaccctatgaatgtaaggaatgtggcaaggcttttagttgtagttcatatttttctcaacatcagaggattcacactggtgagaaaccctatgaatgtaaggaatgtggaaaagcctttaagtattgctcaaaccttaatgatcatcagagaattcacactggtgagaaaccctatgaatgtaaagtatgtggaaaagcctttactaaaagttcacaactttttctacatctgagaattcatactggtgagaaaccttatgaatgtaaagaatgtgggaaagcctttactcaacactcaaggcttattcagcatcagagaatgcatactggtgagaaaccttatgaatgtaagcagtgtgggaaggcctttaatagtgcctcaacacttactaaccatcacagaattcatgctggtgagaagctctatgaatgtgaagaatgtagaaaggcctttattcagagctcagaacttattcaacatcagagaatccatacagatgaaaaaccatatgaatgtaatgaatgtgggaaggcctttaataaaggctcaaatcttactcgacatcagagaattcacactggtgagaaaccctatgactgtaaggaatgtggaaaggcttttggtagtcgctctgacctcattcgccatgagggaattcatactggttgaatgacagtaaagtaagaccattttgttaacctttataataatttttttaaaacaggtaaggagaacaaattaggatacatattatcaaaggttctcctatgtattcgtttttaaacgatacgataacaaagtaccaagtaccaaaaccttggtggcttaaaacaagagaaatttattctctcatagtttagagcctggaaatctaaactcaagggtgctgatcgttttggttccttctgaggactctgaggatctgttctatgcctttttcctaacctctgttaacagctggcagtccttggcattccatggcttttacatacaccattccaatctctgcctccatcttcacattgcattctcgctgtgtatctctgtgtatgtcttttatttggacaccagtcaggttagattggggttacctggtgacctcatcttaacttgattatatctgccaagaccctgtttccaagtaaggtcacatttaccggtaccaggggttaggacttcagcatatctttttaggggatacagttcaacccataataccctgttagaatgattttgtctaatatatttgtaatttccttttatacataagttgttagtcaaatttattttattttattttattttgagacagagtctcgctctgttgcccaggctggagtgcagtggtgtgatctcagctcactgcaacctccagctcctgagttcaagcgattcttgtgcctcagcctctcaagtagttgggattacaggcatgcgccaccatgcccggctaattttttttttttttttttttgtatttttagtagcgacggggtttcaccatgttggccaggctggtcttgaactcctgacttcaagtgatctgcccgcctcagcctcccaaagtgctgggattacagacgtgagccaccgtgatggccaaaacagactttataccaacaaaaattaaaaaggacaaagaaggtcatttataatgataaaggataaattcaacaagaagataaaacaatcctaaatatgtatgcacccaacactgcaacacccagatccataacacagatactactagacctaagaaaagagatagacagcaatacaacaatagcaggggacttcaccactccattgacagcactagacagatcactgggacagaaatcaacaaagaaactctggacttaaattggactctacaccaaatggacccaacagacatctgaagaacattctacccaacaaccacagaatatatactcttctcttctgtgcatggaacattctcaaaaataggtcatatactggaccacaaagcaagtatcaataaattttaaaaaaacaaaatcatatctaacatcttctctgaccatagtggaataaaactagatatcaataccaagaggaactctcaaaacagatacatggaatttaaacagcttgctcctgaatgatttttggatcaatgatgaaactaaggtggaaatttaaaattttttgaaataaatgaaaatagagacaaaacacatgaaaacatctgagatacagcaaaagcagtgctaagagaggattttatagcattaaatgcctacaccaaaaagatagaaaaatctcaaatgaatagcctaacgtcacatctcaaggaactaggaaaaaacaaaacaaactcaacccaaagctggcagaagaaaagcaataacaaatatcagagcaggcaaaaatgagactgagaacaaaggaatgcaaaagatcaataaaagaaaaagttggttctttgcaaagataaaactgacagaccactagctagattaaccaagaaaaaaagaagattcaaataaatacaatcagaaatgataaggtgatattataactgataacacagacatataaaatatcagcagaaactatatgcacatattagaaaacctagaggaagtggataaattcctagaaacacataaccttccaagattgaaccagggagaaataggaatcctcaacagactactgagtattgaaattgaatcagtaatagaaaaaaatcttgcaaaaacaaaaagcccaggaccagacagattcacagctgaattctactagacatgcaaggaagaactagtaacagcactattgaaactattccaaaaattataggagggaatcctccctaactcattctacaaagccagtatcatcctgatactgaagccaggcaaggataaaacacacaaaaaaactacaagccaatatccctgatgaaaatagacacaaaaatcttcagcaaaatactagcaaaccaaatcaaacagtacataaaaaagatagtaacagcacagtcaagtggattttattcctggggtgtaaggatggctcaacatatgcaactcaatacatgattcatcacatacacagaattaaaaataagccaggcactcacacctgtaatcccagcactttgcaaggccaaggcgggcagatcacatgatgtcaagagtttgagaccagtctggctgacatggcgaaaccctgtctctactaaaaatagaaaaattggctgggcatggtggcaggcactgtagtcccagctacttgggaggctgaggcaggagaattacttgaacctgagaagcggaggttgcagtgagctgagatagtgccattgcactccagcctgggcaacagagcaaattgcttgaatgtgggaggtggaggttgcagtgagccgagattatgccattgcactccagccgggggagcaacaaagccagactccatctcaaaaaaaaaccaaaaaaaatcctatttagtacaaggtacattatttaggtaatgagtccattaaaagccaacactttccccactacactatatgtgtatgtaacacaactgcccttgtaacttcctaaacctataattaagaaacaataaaaggcaaattaagaatgcttttttaaaaggtgggggcattatgctaataagttactgtggatttcagagtgcagagtagaaagatcacaagaatttagtgtggtaggtgggaacagaaaatgggtgtataaattttattgacgtgggagtactggatattgtagagacagatatcatcagggcaaggagattaaagatttttgcattgacggtttgacactatattgtggtaataacactgtatgtgttgggagatagaacaggaaacatcttccctggaatatgtatactattaaatgttttatcaaacttttgatcaaacaagacagcacaatttataatttcatttctatttctatgttatgagaaactgatcatttattcaaatgtttaacaggcatgttcatgttactataaactcttctgtttcaccatca

SEQ ID NO: 203954 - DNA, 1805 bp, Homo sapiens
  Payload ID: 20224
  Gene Name: zinc finger protein 829
  Uniprot ID: Q3KNS6
  ENST ID: ENST00000391711
  CDS Start-End: 366-1664
agaacacatctgctttcctgtgtgagggtgaggcttgggccgggttccccgggaggctcatctccattgcgcagcgctacggcgacccgcaactccgaggctcggctggatgttgagagttgagggagcagccgtttcgggtgggcccaggcgaggagctgacaggaatcggcgtgggtcccgctctggactacatttcccagagggcctggtggcctgccacttttctcgcaggaattcgaacgtttcgtcactcctggcgggacccttagatctgggaggaaacctctctgaggtctggtcagattccaaccctggacagcagtgaacacaacctttcccctgagccactggaattggacagaatgccccattctcctctgatctccattcctcatgtgtggtgtcacccagaagaggaggaaagaatgcatgatgaacttctacaagcagtatccaaggggccggtgatgttcagggatgtttccatagacttctctcaagaggaatgggaatgcctggacgctgatcagatgaatttatacaaagaagtgatgttggagaatttcagcaacctggtttcagtgggactttccaattctaagccagctgtgatctccttattggaacaaggaaaagagccctggatggttgatagagagctgactagaggcctgtgttcagatctggaatcaatgtgtgagaccaaaatattatctctaaagaagagacatttcagtcaagtaataattacccgtgaagacatgtctacttttattcagcccacatttcttattccacctcaaaaaactatgagtgaagagaaaccatgggaatgtaagatatgtggaaagacctttaatcaaaactcacaatttatccaacatcagagaattcattttggtgaaaaacactatgaatctaaggagtatgggaagtcctttagtcgtggctcactcgttactcgacatcagaggattcacactggtaaaaaaccctatgaatgtaaggaatgtggcaaggcttttagttgtagttcatatttttctcaacatcagaggattcacactggtgagaaaccctatgaatgtaaggaatgtggaaaagcctttaagtattgctcaaaccttaatgatcatcagagaattcacactggtgagaaaccctatgaatgtaaagtatgtggaaaagcctttactaaaagttcacaactttttctacatctgagaattcatactggtgagaaaccttatgaatgtaaagaatgtgggaaagcctttactcaacactcaaggcttattcagcatcagagaatgcatactggtgagaaaccttatgaatgtaagcagtgtgggaaggcctttaatagtgcctcaacacttactaaccatcacagaattcatgctggtgagaagctctatgaatgtgaagaatgtagaaaggcctttattcagagctcagaacttattcaacatcagagaatccatacagatgaaaaaccatatgaatgtaatgaatgtgggaaggcctttaataaaggctcaaatcttactcgacatcagagaattcacactggtgagaaaccctatgactgtaaggaatgtggaaaggcttttggtagtcgctctgacctcattcgccatgagggaattcatactggttgaatgacagtaaagtaagaccattttgttaacctttataataatttttttaaaacaggtaaggagaacaaattaggatacatattatcaaaggttctcctatgtattcgtttttaaacgatacgataacaaagtaccaagtac

SEQ ID NO: 203955 - DNA, 1690 bp, Homo sapiens
  Payload ID: 20224
  Gene Name: zinc finger protein 829
  Uniprot ID: Q3KNS6
  ENST ID: ENST00000611922
  CDS Start-End: 803-1549
tgagagttgagggagcagccgtttcgggtgggcccaggcgaggagctgacaggaatcggcgtgggtcccgctctggactacatttcccagagggcctggtggcctgccacttttctcgcaggaattcgaacgtttcgtcactcctggcgggacccttagatctgggaggaaacctctctgaggtctggtcagattccaaccctggacagcagtgaacacaacctttcccctgagccactggaattggacagaatgccccattctcctctgatctccattcctcatgtgtggtgtcacccagaagaggaggaaagaatgcatgatgaacttctacaagcagtatccaaggggccggtgatgttcagggatgtttccatagacttctctcaagaggaatgggaatgcctggacgctgatcagatgaatttatacaaagaagtgatgttggagaatttcagcaacctggtttcagtgggactttccaattctaagccagctgtgatctccttattggaacaaggaaaagagccctggatggttgatagagagctgactagaggcctgtgttcagatctggaatcaatgtgtgagaccaaaatattatctctaaagaagagacatttcagtcaagtaataattacccgtgaagacatgtctacttttattcagcccacatttcttattccacctcaaaaaactatgagtgaagagaaaccatgggaatgtaagatatgtggaaagacctttaatcaaaactcacaatttatccaacatcagagaattcattttggtgaaaaacactatgaataaggagtatgggaagtcctttagtcgtggctcactcgttactcgacatcagaggattcacactggtaaaaaaccctatgaatgtaaggaatgtggcaaggcttttagttgtagttcatatttttctcaacatcagaggattcacactggtgagaaaccctatgaatgtaaggaatgtggaaaagcctttaagtattgctcaaaccttaatgatcatcagagaattcacactggtgagaaaccctatgaatgtaaagtatgtggaaaagcctttactaaaagttcacaactttttctacatctgagaattcatactggtgagaaaccttatgaatgtaaagaatgtgggaaagcctttactcaacactcaaggcttattcagcatcagagaatgcatactggtgagaaaccttatgaatgtaagcagtgtgggaaggcctttaatagtgcctcaacacttactaaccatcacagaattcatgctggtgagaagctctatgaatgtgaagaatgtagaaaggcctttattcagagctcagaacttattcaacatcagagaatccatacagatgaaaaaccatatgaatgtaatgaatgtgggaaggcctttaataaaggctcaaatcttactcgacatcagagaattcacactggtgagaaaccctatgactgtaaggaatgtggaaaggcttttggtagtcgctctgacctcattcgccatgagggaattcatactggttgaatgacagtaaagtaagaccattttgttaacctttataataatttttttaaaacaggtaaggagaacaaattaggatacatattatcaaaggttctcctatgtattcgtttttaaacgatacgataacaaagtaccaagtac

SEQ ID NO: 203956 - DNA, 2599 bp, Homo sapiens
  Payload ID: 20225
  Gene Name: zinc finger protein 83
  Uniprot ID: P51522
  ENST ID: ENST00000301096
  CDS Start-End: 402-1952
agacctggcttctgtactgcgcgcgcacatgcgcgcaaacccggaagcggattatgtggagtgaaagttacaccgtggcggattgacttctaaggactcttggtacatgaggaagaaacccggaaggggaagaggaaagcaaaggcgtcaggaatggttcttcctcaggtattttttctaaatgtgagatcaaggaattaccaccaaaaaaggagagtaatacaggagaaatattccagacagtaatgttggaaagacatgaaagccacgacatacaagatttttgcttcagagaaacccagaaaaatgtacatgactctcagtgtctgtggaaacatgattgaagacattataagcgagtgcgtgtgacctataaggaaagtctcattggtagaagagacatgcatgggagaaaggatgatgcacaaaagcagcctgttaaaaatcagcttggattaaacccgcagtcacatctaccagaactgcagctatttcaagctgaagggaaaatatataaatatgatcacatggaaaaatctgtcaacagtagttccttagtttccccaccccaacgtatttcttctactgtcaaaacccacatttctcatacatatgaatgtaattttgtggattcattattcacacaaaaagagaaagcaaatattgggacagaacactacaaatgtagtgagcgtggcaaggcctttcatcaaggcttacattttactatacatcaaataatccatactaaagagacgcaatttaaatgtgatatatgtggcaagatcttcaataaaaaatcaaaccttgcaagtcatcaaagaattcatactggagagaagccatataaatgtaatgaatgtggcaaggtcttccataatatgtcacaccttgcacagcatcgcaggattcatactggagagaaaccatataaatgtaatgaatgtggcaaggtctttaatcaaatttcacaccttgcacaacatcaaagaattcataccggagagaaaccttataaatgtaatgaatgtggaaaggtcttccatcaaatttcacaccttgcacaacatcggacaattcatactggagaaaaaccttacgaatgtaacaaatgtggcaaggtgttcagtcgcaattcctaccttgtacaacatctgatcattcatactggagagaaaccttacagatgtaatgtatgtggaaaggtcttccatcatatttcacaccttgcacaacatcagagaatccacactggagagaaaccttacaaatgtaatgagtgtggcaaggtcttcagtcacaagtcatccctagtaaatcactggagaattcatactggagagaaaccttacaaatgtaatgagtgtggcaaggtcttcagtcacaagtcatccctagtaaatcactggagaatccacactggagagaaaccttacaaatgtaatgaatgtggcaaggtcttcagtcgcaattcataccttgcccaacatctgataattcatgccggtgagaaaccttataagtgtgatgaatgtgacaaagcattcagtcaaaattcacatcttgtacaacatcacagaatccatactggagagaaaccttacaaatgtgatgaatgtggcaaagtcttcagtcaaaattcataccttgcatatcattggagaattcatactggagaaaaagcttataaatgtaatgaatgtgggaaggtcttcggtctaaactcatccctagcacatcatcggaaaattcacactggagagaaacctttcaaatgtaatgaatgtggcaaagcttttagtatgcgttcaagcctcactaatcatcatgcgatccacactggagagaaacatttcaaatgtaatgaatgtggcaaactcttccgcgacaattcatatcttgtacgtcatcagagatttcatgccggaaagaaatctaacacatgtaattaatgtggcagagtgttcagttagcattaaagccttgtaagacatacaataatttatactggagaaaaactttgcaagtataatgaatgtagcagagcctttagtttttgttcaaggcttaataaccgttagctagaccatagaggacagaaactttactaatgtactgaatgtggcaaggtcttaaggtaaaatctgagaccaggattcttcaaagaattcttgctggtgagaaacctaacaaatgtaatgaatgtggcaaggtcttctggcacaattctcacattgtacaatattgcaaaaattcatgcttgagagaaacaaaaacactgagagtgggaaaccattatgacttcaaacattcatcaacatcagagaatccatactaaagagcatttataataattatatgtgatagagattttccgcaggccaaagtctcactaggcatcaaaaacttttttgatgaaaccatacaaatgtaacgtgcatgcttaagcttttacccaggcatcaaaaccggaacatcacagggtttatactggagagtaactacacaaagataatgtaataagcctttcagtgtaatattcatgattttgtcgtgagagatccactcaataaaaaccaggcaaatgtagtgaatctgg

SEQ ID NO: 203957 - DNA, 3743 bp, Homo sapiens
  Payload ID: 20225
  Gene Name: zinc finger protein 83
  Uniprot ID: P51522
  ENST ID: ENST00000541777
  CDS Start-End: 1557-3107
gtgcttttgattcagtagttctgggaagagagctcagtgtccacatattacagtgctctttaaagattcagaaggaggcagtcagtggaggaatttgtgagatattttcctaagtccatctgtaatgtcttctttcctacagaaacatagggctggggatctagaaaacttccaacatgtcatgtttcctactttttataagcaggagtctctttctaacctgttggagcaaggcaaagagccctggactgtgtagcatgaagtgaaaataagatgggtgggaattttttttttttttttttttttttttttgagacaatctcactctgttgcccaggctggagtgcagtgacacgatctcggttcactgtaacctccacctctggggttcaagcaattctcctgcctcagcctcccaagtagctgggactgcagtcacatgccaccatgcccagctaatttttgtatttttagtagagacagggtttcaccatgttggccaggctgtgtttgaactcctgacttcaggtgatccacctgcctgggcctcccaaagtgttgggattacaggcatgagccactgctcccggcctactgtcacttcttaacatattaatctttgtatttctgaccacctcaatatccacagtactcagtccccatgctactctcaccatgtaaggaaagacacttgcttatctgtaggacggctttctcagaacacagcctaaaccgatgtctgctctgtacgatggtggacataccgctgtctaggaaggattaccaagtgacatggtcagcaacacaaccccgttcttgtagctcccttgaaatgattcctttctatgcatctatttgccatgtcgtgtcgtgttgtgcaggtttgtcgtgtgggtatatgtgtgccgtggtggtttgctgcacccatcaacccatcatctaggttttaagccctgcatgcattaggtatctttcccaatgttctccctccccttgccccctaccccctgataggccctgctctatgttgcttccctccctgtgaccatgtgttctaatcgttcaactcccacttatgagtgagaacatgcggtgtttggttttctgttcctgtgttagtttgctgagaacgatggcttccagctccatccatgtccctacaaaggacatgatctcattcttttttttctttttccgagatggagtttttgctcttgttgcccaggctggagtgcagtggcacaatctcggctcaccaccacctccgcctcccgggttcaagcgattctcccgcctcagcctcagaagttgctggaattacaggtattttttctaaatgtgagatcaaggaattaccaccaaaaaaggagagtaatacaggagaaatattccagacagtaatgttggaaagacatgaaagccacgacatacaagatttttgcttcagagaaacccagaaaaatgtacatgactctcagtgtctgtggaaacatgattgaagacattataagcgagtgcgtgtgacctataaggaaagtctcattggtagaagagacatgcatgggagaaaggatgatgcacaaaagcagcctgttaaaaatcagcttggattaaacccgcagtcacatctaccagaactgcagctatttcaagctgaagggaaaatatataaatatgatcacatggaaaaatctgtcaacagtagttccttagtttccccaccccaacgtatttcttctactgtcaaaacccacatttctcatacatatgaatgtaattttgtggattcattattcacacaaaaagagaaagcaaatattgggacagaacactacaaatgtagtgagcgtggcaaggcctttcatcaaggcttacattttactatacatcaaataatccatactaaagagacgcaatttaaatgtgatatatgtggcaagatcttcaataaaaaatcaaaccttgcaagtcatcaaagaattcatactggagagaagccatataaatgtaatgaatgtggcaaggtcttccataatatgtcacaccttgcacagcatcgcaggattcatactggagagaaaccatataaatgtaatgaatgtggcaaggtctttaatcaaatttcacaccttgcacaacatcaaagaattcataccggagagaaaccttataaatgtaatgaatgtggaaaggtcttccatcaaatttcacaccttgcacaacatcggacaattcatactggagaaaaaccttacgaatgtaacaaatgtggcaaggtgttcagtcgcaattcctaccttgtacaacatctgatcattcatactggagagaaaccttacagatgtaatgtatgtggaaaggtcttccatcatatttcacaccttgcacaacatcagagaatccacactggagagaaaccttacaaatgtaatgagtgtggcaaggtcttcagtcacaagtcatccctagtaaatcactggagaattcatactggagagaaaccttacaaatgtaatgagtgtggcaaggtcttcagtcacaagtcatccctagtaaatcactggagaatccacactggagagaaaccttacaaatgtaatgaatgtggcaaggtcttcagtcgcaattcataccttgcccaacatctgataattcatgccggtgagaaaccttataagtgtgatgaatgtgacaaagcattcagtcaaaattcacatcttgtacaacatcacagaatccatactggagagaaaccttacaaatgtgatgaatgtggcaaagtcttcagtcaaaattcataccttgcatatcattggagaattcatactggagaaaaagcttataaatgtaatgaatgtgggaaggtcttcggtctaaactcatccctagcacatcatcggaaaattcacactggagagaaacctttcaaatgtaatgaatgtggcaaagcttttagtatgcgttcaagcctcactaatcatcatgcgatccacactggagagaaacatttcaaatgtaatgaatgtggcaaactcttccgcgacaattcatatcttgtacgtcatcagagatttcatgccggaaagaaatctaacacatgtaattaatgtggcagagtgttcagttagcattaaagccttgtaagacatacaataatttatactggagaaaaactttgcaagtataatgaatgtagcagagcctttagtttttgttcaaggcttaataaccgttagctagaccatagaggacagaaactttactaatgtactgaatgtggcaaggtcttaaggtaaaatctgagaccaggattcttcaaagaattcttgctggtgagaaacctaacaaatgtaatgaatgtggcaaggtcttctggcacaattctcacattgtacaatattgcaaaaattcatgcttgagagaaacaaaaacactgagagtgggaaaccattatgacttcaaacattcatcaacatcagagaatccatactaaagagcatttataataattatatgtgatagagattttccgcaggccaaagtctcactaggcatcaaaaacttttttgatgaaaccatacaaatgtaacgtgcatgcttaagcttttacccaggcatcaaaaccggaacatcacagggtttatactggagagtaactacacaaagataatgtaataagcctttcagtgtaatattcatgattttgtcgtgagagatccactcaataaaaaccaggcaaatgt

SEQ ID NO: 203958 - DNA, 2633 bp, Homo sapiens
  Payload ID: 20225
  Gene Name: zinc finger protein 83
  Uniprot ID: P51522
  ENST ID: ENST00000545872
  CDS Start-End: 447-1997
ggcttctgtactgcgcgcgcacatgcgcgcaaacccggaagcggattatgtggagtgaaagttacaccgtggcggaatggggtgtattgattctgagcaataaacaacatatttttaacattcaggattgacttctaaggactcttggtacatgaggaagaaacccggaaggggaagaggaaagcaaaggcgtcaggaatggttcttcctcaggtattttttctaaatgtgagatcaaggaattaccaccaaaaaaggagagtaatacaggagaaatattccagacagtaatgttggaaagacatgaaagccacgacatacaagatttttgcttcagagaaacccagaaaaatgtacatgactctcagtgtctgtggaaacatgattgaagacattataagcgagtgcgtgtgacctataaggaaagtctcattggtagaagagacatgcatgggagaaaggatgatgcacaaaagcagcctgttaaaaatcagcttggattaaacccgcagtcacatctaccagaactgcagctatttcaagctgaagggaaaatatataaatatgatcacatggaaaaatctgtcaacagtagttccttagtttccccaccccaacgtatttcttctactgtcaaaacccacatttctcatacatatgaatgtaattttgtggattcattattcacacaaaaagagaaagcaaatattgggacagaacactacaaatgtagtgagcgtggcaaggcctttcatcaaggcttacattttactatacatcaaataatccatactaaagagacgcaatttaaatgtgatatatgtggcaagatcttcaataaaaaatcaaaccttgcaagtcatcaaagaattcatactggagagaagccatataaatgtaatgaatgtggcaaggtcttccataatatgtcacaccttgcacagcatcgcaggattcatactggagagaaaccatataaatgtaatgaatgtggcaaggtctttaatcaaatttcacaccttgcacaacatcaaagaattcataccggagagaaaccttataaatgtaatgaatgtggaaaggtcttccatcaaatttcacaccttgcacaacatcggacaattcatactggagaaaaaccttacgaatgtaacaaatgtggcaaggtgttcagtcgcaattcctaccttgtacaacatctgatcattcatactggagagaaaccttacagatgtaatgtatgtggaaaggtcttccatcatatttcacaccttgcacaacatcagagaatccacactggagagaaaccttacaaatgtaatgagtgtggcaaggtcttcagtcacaagtcatccctagtaaatcactggagaattcatactggagagaaaccttacaaatgtaatgagtgtggcaaggtcttcagtcacaagtcatccctagtaaatcactggagaatccacactggagagaaaccttacaaatgtaatgaatgtggcaaggtcttcagtcgcaattcataccttgcccaacatctgataattcatgccggtgagaaaccttataagtgtgatgaatgtgacaaagcattcagtcaaaattcacatcttgtacaacatcacagaatccatactggagagaaaccttacaaatgtgatgaatgtggcaaagtcttcagtcaaaattcataccttgcatatcattggagaattcatactggagaaaaagcttataaatgtaatgaatgtgggaaggtcttcggtctaaactcatccctagcacatcatcggaaaattcacactggagagaaacctttcaaatgtaatgaatgtggcaaagcttttagtatgcgttcaagcctcactaatcatcatgcgatccacactggagagaaacatttcaaatgtaatgaatgtggcaaactcttccgcgacaattcatatcttgtacgtcatcagagatttcatgccggaaagaaatctaacacatgtaattaatgtggcagagtgttcagttagcattaaagccttgtaagacatacaataatttatactggagaaaaactttgcaagtataatgaatgtagcagagcctttagtttttgttcaaggcttaataaccgttagctagaccatagaggacagaaactttactaatgtactgaatgtggcaaggtcttaaggtaaaatctgagaccaggattcttcaaagaattcttgctggtgagaaacctaacaaatgtaatgaatgtggcaaggtcttctggcacaattctcacattgtacaatattgcaaaaattcatgcttgagagaaacaaaaacactgagagtgggaaaccattatgacttcaaacattcatcaacatcagagaatccatactaaagagcatttataataattatatgtgatagagattttccgcaggccaaagtctcactaggcatcaaaaacttttttgatgaaaccatacaaatgtaacgtgcatgcttaagcttttacccaggcatcaaaaccggaacatcacagggtttatactggagagtaactacacaaagataatgtaataagcctttcagtgtaatattcatgattttgtcgtgagagatccactcaataaaaaccaggcaaatgt

SEQ ID NO: 203959 - DNA, 2726 bp, Homo sapiens
  Payload ID: 20225
  Gene Name: zinc finger protein 83
  Uniprot ID: P51522
  ENST ID: ENST00000536937
  CDS Start-End: 529-2079
agacctggcttctgtactgcgcgcgcacatgcgcgcaaacccggaagcggattatgtggagtgaaagttacaccgtggcggattgacttctaaggactcttggtacatgaggaagaaacccggaaggggaagaggaaagcaaaggcgtcaggaatggttcttcctcagggtctattgacattcagggatgtggccatagaattctctcaggaggagtggaaatgcctggaccctgctcagaggactctatacagagatgtgatgttggagaattataggaacctggtctccctgggtattttttctaaatgtgagatcaaggaattaccaccaaaaaaggagagtaatacaggagaaatattccagacagtaatgttggaaagacatgaaagccacgacatacaagatttttgcttcagagaaacccagaaaaatgtacatgactctcagtgtctgtggaaacatgattgaagacattataagcgagtgcgtgtgacctataaggaaagtctcattggtagaagagacatgcatgggagaaaggatgatgcacaaaagcagcctgttaaaaatcagcttggattaaacccgcagtcacatctaccagaactgcagctatttcaagctgaagggaaaatatataaatatgatcacatggaaaaatctgtcaacagtagttccttagtttccccaccccaacgtatttcttctactgtcaaaacccacatttctcatacatatgaatgtaattttgtggattcattattcacacaaaaagagaaagcaaatattgggacagaacactacaaatgtagtgagcgtggcaaggcctttcatcaaggcttacattttactatacatcaaataatccatactaaagagacgcaatttaaatgtgatatatgtggcaagatcttcaataaaaaatcaaaccttgcaagtcatcaaagaattcatactggagagaagccatataaatgtaatgaatgtggcaaggtcttccataatatgtcacaccttgcacagcatcgcaggattcatactggagagaaaccatataaatgtaatgaatgtggcaaggtctttaatcaaatttcacaccttgcacaacatcaaagaattcataccggagagaaaccttataaatgtaatgaatgtggaaaggtcttccatcaaatttcacaccttgcacaacatcggacaattcatactggagaaaaaccttacgaatgtaacaaatgtggcaaggtgttcagtcgcaattcctaccttgtacaacatctgatcattcatactggagagaaaccttacagatgtaatgtatgtggaaaggtcttccatcatatttcacaccttgcacaacatcagagaatccacactggagagaaaccttacaaatgtaatgagtgtggcaaggtcttcagtcacaagtcatccctagtaaatcactggagaattcatactggagagaaaccttacaaatgtaatgagtgtggcaaggtcttcagtcacaagtcatccctagtaaatcactggagaatccacactggagagaaaccttacaaatgtaatgaatgtggcaaggtcttcagtcgcaattcataccttgcccaacatctgataattcatgccggtgagaaaccttataagtgtgatgaatgtgacaaagcattcagtcaaaattcacatcttgtacaacatcacagaatccatactggagagaaaccttacaaatgtgatgaatgtggcaaagtcttcagtcaaaattcataccttgcatatcattggagaattcatactggagaaaaagcttataaatgtaatgaatgtgggaaggtcttcggtctaaactcatccctagcacatcatcggaaaattcacactggagagaaacctttcaaatgtaatgaatgtggcaaagcttttagtatgcgttcaagcctcactaatcatcatgcgatccacactggagagaaacatttcaaatgtaatgaatgtggcaaactcttccgcgacaattcatatcttgtacgtcatcagagatttcatgccggaaagaaatctaacacatgtaattaatgtggcagagtgttcagttagcattaaagccttgtaagacatacaataatttatactggagaaaaactttgcaagtataatgaatgtagcagagcctttagtttttgttcaaggcttaataaccgttagctagaccatagaggacagaaactttactaatgtactgaatgtggcaaggtcttaaggtaaaatctgagaccaggattcttcaaagaattcttgctggtgagaaacctaacaaatgtaatgaatgtggcaaggtcttctggcacaattctcacattgtacaatattgcaaaaattcatgcttgagagaaacaaaaacactgagagtgggaaaccattatgacttcaaacattcatcaacatcagagaatccatactaaagagcatttataataattatatgtgatagagattttccgcaggccaaagtctcactaggcatcaaaaacttttttgatgaaaccatacaaatgtaacgtgcatgcttaagcttttacccaggcatcaaaaccggaacatcacagggtttatactggagagtaactacacaaagataatgtaataagcctttcagtgtaatattcatgattttgtcgtgagagatccactcaataaaaaccaggcaaatgtagtgaatctgg

SEQ ID NO: 203960 - DNA, 522 bp, Homo sapiens
  Payload ID: 20225
  Gene Name: zinc finger protein 83
  ENST ID: ENST00000598536
  CDS Start-End: 399-491
aaatctggaagcggatcgcgtggagtgacggtcacaccgcggcgggtttctatgatgacaggatggtcctaagtcttcacacatcagggccacagccccaacctcacaggaaacagaattaatttccaaagactcatgttacatgagaaagccaccaagaagaccaaagaaaaggagacaaggatggctcttcctcagggatgcttgactttcagggatgtggctatagaattctctttggaggagtggaaatgcctgaaccctgcacagagggctttatacagggccgtgatgttggagaactacaggaacctggagtctgtgggattgacttctaaggactcttggtacatgaggaagaaacccggaaggggaagaggaaagcaaaggcgtcaggaatggttcttcctcaggtattttttctaaatgtgagatcaaggaattaccaccaaaaaaggagagtaatacaggagaaatattccagacagtaatgttggaaagacatgaaagccacgacataca

SEQ ID NO: 203961 - DNA, 670 bp, Homo sapiens
  Payload ID: 20225
  Gene Name: zinc finger protein 83
  ENST ID: ENST00000595939
  CDS Start-End: 113-274
cggaagcggattatgtggagtgaaagttacaccgtggcggattgacttctaaggactcttggtacatgaggaagaaacccggaaggggaagaggaaagcaaaggcgtcaggaatggttcttcctcagggtctattgacattcagggatgtggccatagaattctctcaggaggagtggaaatgcctggaccctgctcagaggactctatacagagatgtgatgttggagaattataggaacctggtctccctggatgttctgcgttcttcatgatagctcagtgggggttccagaagtaaagaaggcttaaaaccttatggctggcaaggcgtggtgactcatgcctgtaatcccagcactttgggaggccaaagcttgtggatcacttcaggctggagtgcagtggcacaatctcggctcaccaccacctccgcctcccgggttcaagcgattctcccgcctcagcctcagaagttgctggaattacaggtattttttctaaatgtgagatcaaggaattaccaccaaaaaaggagagtaatacaggagaaatattccagacagtaatgttggaaagacatgaaagccacgacatacaagatttttgcttcagagaaacccagaaaaatgtacatgactctcagtgtctgtggaaacatgattgaagac

SEQ ID NO: 203962 - DNA, 560 bp, Homo sapiens
  Payload ID: 20225
  Gene Name: zinc finger protein 83
  ENST ID: ENST00000596930
  CDS Start-End: 128-505
acatgcgcgcaaacccggaagcggattatgtggagtgaaagttacaccgtggcggattgacttctaaggactcttggtacatgaggaagaaacccggaaggggaagaggaaagcaaaggcgtcaggaatggttcttcctcagggtctattgacattcagggatgtggccatagaattctctcaggaggagtggaaatgcctggaccctgctcagaggactctatacagagatgtgatgttggagaattataggaacctggtctccctgggacatgatctcattcttttttttctttttccgagatggagtttttgctcttgttgcccaggctggagtgcagtggcacaatctcggctcaccaccacctccgcctcccgggttcaagcgattctcccgcctcagcctcagaagttgctggaattacaggtattttttctaaatgtgagatcaaggaattaccaccaaaaaaggagagtaatacaggagaaatattccagacagtaatgttggaaagacatgaaagccacgacatacaagatttttgcttcagagaaaccca

SEQ ID NO: 203963 - DNA, 704 bp, Homo sapiens
  Payload ID: 20225
  Gene Name: zinc finger protein 83
  ENST ID: ENST00000601257
  CDS Start-End: 409-624
agattctcgcaaatctggaagcggatcgcgtggagtgacggtcacaccgcggcgggtttctatgatgacaggatggtcctaagtcttcacacatcagggccacagccccaacctcacaggaaacagaattaatttccaaagactcatgttacatgagaaagccaccaagaagaccaaagaaaaggagacaaggatggctcttcctcagggatgcttgactttcagggatgtggctatagaattctctttggaggagtggaaatgcctgaaccctgcacagagggctttatacagggccgtgatgttggagaactacaggaacctggagtctgtgggattgacttctaaggactcttggtacatgaggaagaaacccggaaggggaagaggaaagcaaaggcgtcaggaatggttcttcctcagggtctattgacattcagggatgtggccatagaattctctcaggaggagtggaaatgcctggaccctgctcagaggactctatacagagatgtgatgttggagaattataggaacctggtctccctggggtctccctctgatgccgagccgaagctggacggtactgctgccatcttggctcactgcaacctccctgcctgattctcctgcctcagcctgctgagtgcctgtgattgcaggcgcgcgccgccacgcctgactggttttcgtatttttttggt

SEQ ID NO: 203964 - DNA, 576 bp, Homo sapiens
  Payload ID: 20225
  Gene Name: zinc finger protein 83
  ENST ID: ENST00000601140
  CDS Start-End: 113-280
cggaagcggattatgtggagtgaaagttacaccgtggcggattgacttctaaggactcttggtacatgaggaagaaacccggaaggggaagaggaaagcaaaggcgtcaggaatggttcttcctcagggtctattgacattcagggatgtggccatagaattctctcaggaggagtggaaatgcctggaccctgctcagaggactctatacagagatgtgatgttggagaattataggaacctggtctccctgggacggctttctcagaacacagcctaaaccgatgtctgctctgtacgatggtggacataccgctgtctaggaaggattaccaagtgacatgatggagtttttgctcttgttgcccaggctggagtgcagtggcacaatctcggctcaccaccacctccgcctcccgggttcaagcgattctcccgcctcagcctcagaagttgctggaattacaggtattttttctaaatgtgagatcaaggaattaccaccaaaaaaggagagtaatacaggagaaatattccagacagtaatgttggaaagacatgaaagccacgacatac

SEQ ID NO: 203965 - DNA, 2890 bp, Homo sapiens
  Payload ID: 20225
  Gene Name: zinc finger protein 83
  ENST ID: ENST00000594682
  CDS Start-End: 329-646
gcaaatctggaagcggatcgcgtggagtgacggtcacaccgcggcgaattaatttccaaagactcatgttacatgagaaagccaccaagaagaccaaagaaaaggagacaaggatggctcttcctcagggatgcttgactttcagggatgtggctatagaattctctttggaggagtggaaatgcctgaaccctgcacagagggctttatacagggccgtgatgttggagaactacaggaacctggagtctgtgggattgacttctaaggactcttggtacatgaggaagaaacccggaaggggaagaggaaagcaaaggcgtcaggaatggttcttcctcagggtctattgacattcagggatgtggccatagaattctctcaggaggagtggaaatgcctggaccctgctcagaggactctatacagagatgtgatgttggagaattataggaacctggtctccctgggtattttttctaaatgtgagatcaaggaattaccaccaaaaaaggagagtaatacaggagaaatattccagacagtaatgttggaaagacatgaaagccacgacatacaagatttttgcttcagagaaacccagaaaaatgtacatgactctcagtgtctgtggaaacatgattgaagacattataagcgagtgcgtgtgacctataaggaaagtctcattggtagaagagacatgcatgggagaaaggatgatgcacaaaagcagcctgttaaaaatcagcttggattaaacccgcagtcacatctaccagaactgcagctatttcaagctgaagggaaaatatataaatatgatcacatggaaaaatctgtcaacagtagttccttagtttccccaccccaacgtatttcttctactgtcaaaacccacatttctcatacatatgaatgtaattttgtggattcattattcacacaaaaagagaaagcaaatattgggacagaacactacaaatgtagtgagcgtggcaaggcctttcatcaaggcttacattttactatacatcaaataatccatactaaagagacgcaatttaaatgtgatatatgtggcaagatcttcaataaaaaatcaaaccttgcaagtcatcaaagaattcatactggagagaagccatataaatgtaatgaatgtggcaaggtcttccataatatgtcacaccttgcacagcatcgcaggattcatactggagagaaaccatataaatgtaatgaatgtggcaaggtctttaatcaaatttcacaccttgcacaacatcaaagaattcataccggagagaaaccttataaatgtaatgaatgtggaaaggtcttccatcaaatttcacaccttgcacaacatcggacaattcatactggagaaaaaccttacgaatgtaacaaatgtggcaaggtgttcagtcgcaattcctaccttgtacaacatctgatcattcatactggagagaaaccttacagatgtaatgtatgtggaaaggtcttccatcatatttcacaccttgcacaacatcagagaatccacactggagagaaaccttacaaatgtaatgagtgtggcaaggtcttcagtcacaagtcatccctagtaaatcactggagaattcatactggagagaaaccttacaaatgtaatgagtgtggcaaggtcttcagtcacaagtcatccctagtaaatcactggagaatccacactggagagaaaccttacaaatgtaatgaatgtggcaaggtcttcagtcgcaattcataccttgcccaacatctgataattcatgccggtgagaaaccttataagtgtgatgaatgtgacaaagcattcagtcaaaattcacatcttgtacaacatcacagaatccatactggagagaaaccttacaaatgtgatgaatgtggcaaagtcttcagtcaaaattcataccttgcatatcattggagaattcatactggagaaaaagcttataaatgtaatgaatgtgggaaggtcttcggtctaaactcatccctagcacatcatcggaaaattcacactggagagaaacctttcaaatgtaatgaatgtggcaaagcttttagtatgcgttcaagcctcactaatcatcatgcgatccacactggagagaaacatttcaaatgtaatgaatgtggcaaactcttccgcgacaattcatatcttgtacgtcatcagagatttcatgccggaaagaaatctaacacatgtaattaatgtggcagagtgttcagttagcattaaagccttgtaagacatacaataatttatactggagaaaaactttgcaagtataatgaatgtagcagagcctttagtttttgttcaaggcttaataaccgttagctagaccatagaggacagaaactttactaatgtactgaatgtggcaaggtcttaaggtaaaatctgagaccaggattcttcaaagaattcttgctggtgagaaacctaacaaatgtaatgaatgtggcaaggtcttctggcacaattctcacattgtacaatattgcaaaaattcatgcttgagagaaacaaaaacactgagagtgggaaaccattatgacttcaaacattcatcaacatcagagaatccatactaaagagcatttataataattatatgtgatagagattttccgcaggccaaagtctcactaggcatcaaaaacttttttgatgaaaccatacaaatgtaacgtgcatgcttaagcttttacccaggcatcaaaaccggaacatcacagggtttatactggagagtaactacacaaagataatgtaataagcctttcagtgtaatattcatgattttgtcgtgagagatccactcaataaaaaccaggcaaatgt

SEQ ID NO: 203966 - DNA, 810 bp, Homo sapiens
  Payload ID: 20225
  Gene Name: zinc finger protein 83
  ENST ID: ENST00000600714
  CDS Start-End: 284-661
gaattaatttccaaagactcatgttacatgagaaagccaccaagaagaccaaagaaaaggagacaaggatggctcttcctcagggatgcttgactttcagggatgtggctatagaattctctttggaggagtggaaatgcctgaaccctgcacagagggctttatacagggccgtgatgttggagaactacaggaacctggagtctgtgggattgacttctaaggactcttggtacatgaggaagaaacccggaaggggaagaggaaagcaaaggcgtcaggaatggttcttcctcagggtctattgacattcagggatgtggccatagaattctctcaggaggagtggaaatgcctggaccctgctcagaggactctatacagagatgtgatgttggagaattataggaacctggtctccctgggtattttttctaaatgtgagatcaaggaattaccaccaaaaaaggagagtaatacaggagaaatattccagacagtaatgttggaaagacatgaaagccacgacatacaagatttttgcttcagagaaacccagaaaaatggtctccctctgatgccgagccgaagctggacggtactgctgccatcttggctcactgcaacctccctgcctgattctcctgcctcagcctgctgagtgcctgtgattgcaggcgcgcgccgccacgcctgactggttttcgtatttttttggtggagacggggattcgctgtgttggccgggctggtctccagctcctaaccgggagtgatccgccagcctcggcctcccaaggtgccgggatt

SEQ ID NO: 203967 - DNA, 4442 bp, Homo sapiens
  Payload ID: 20225
  Gene Name: zinc finger protein 83
  Uniprot ID: P51522
  ENST ID: ENST00000597597
  CDS Start-End: 2255-3805
aggagaggggtacaaaatgaggagcagaatgccaggtaaaaagaaaagaaaacaagagctagagagagaaggggagaatgagagatatgtacacaattagggagggaagcacagtaatgaagaaagatgggctgggcgcagtggcttacgcctgtaatcccagcactttaggagactgaggcaagaagattgcttgagtacaggagttcgagtctagcttgggcaacatagtgagacccccatctctaccaaaaaaaaaaaaaaacaaccgggcatgatagtgtgcacctgtaatcccagctactctgaaggccgaggcagaaggatcacttgaacccaggaggtccaggctgcagtgagccgagatcatgtcactgcactccagcctggtcaacagagcaagaccctgtctcaaaagaaaaaaaggggcggaggactttgggtttagatgagtgggtgagttcattggatacgattagttgtgacatttgacttctttgtatataatctagtaacttaaaactgcttaaattatacagatgagattgagaattttaagaatcctatctataagacatgtacattctatgaatgttggcctcagaggttagcttccacttggaatccctattcagctacagtggagtgacttattcacttgtgagtcactctgttcccttttcccagagtggggtagggagtggggcagtgaagtgagaaaaaaatccctttctgttaacacataatttttaacttaattaattaactaacattaagagacagggtctggccaattgcctaggctggaatgcagtggcatgatctttaactgcagcctggtcctcctgggctcaagtaatcctcctacgtcagcttcctaagtagctgggaccacagtgatgagccaccaagaagcccggctagttttctttttctttcttttttttttttttgtagaaacgaggtttcactgtgtttcccaggctagtctcaaaatcctgggctcaaagtatcctcctgccttggccgcccagagtactgagattacaggaaagagccaccgcacgtggtctacatagtttttttttttttttgagttggaatttccctgttgtttcccaggctggagtgcagtggcgtgatttcggctcaccacaatctcagcttcccagattcatgcgattctcttgcttcagcctcccaactagctgggattacagacgcccaccaagcccagctactttttgtatttttagtagagatggagtttcaccatgtagcccaggctactctcgaactcctgacgtcaaacaatctgcccaccttggcctttcagagtgctagtattacaggcatgagccactgtggccagcccaatttttgtatttctagtagagggtttcaacatgttggcaggctggtctctaattcctgagcttaagcgattctgtctcctcagcttcctaagtagctgggaacatagacacacagacgtgtaccttcatgcctggctatgtttttgtatttttggcaaagatggggtttcaccatgttgcccaggctgatctcaaacccctgagattaagcgatccacctgcctcagcctcccagagtgctgggatgacaggcatgagccactgcacccagtttctgcatggggtttggtcagggctgggtctgcgccctgaagaggagctcattccagcccagctccccactgctgcagcgtgtgtggactcctccagaagggtgtggtgtgggcttctccagaagggtgcgggagttttcctgtaggagtttatcgtctctggtgcagtgggcagcagaggggaccatatttcctcagggtgaggtctcctttgtatgtgttgttatgttacaggaatggggtgtattgattctgagcaataaacaacatatttttaacattcaggattgacttctaaggactcttggtacatgaggaagaaacccggaaggggaagaggaaagcaaaggcgtcaggaatggttcttcctcaggtattttttctaaatgtgagatcaaggaattaccaccaaaaaaggagagtaatacaggagaaatattccagacagtaatgttggaaagacatgaaagccacgacatacaagatttttgcttcagagaaacccagaaaaatgtacatgactctcagtgtctgtggaaacatgattgaagacattataagcgagtgcgtgtgacctataaggaaagtctcattggtagaagagacatgcatgggagaaaggatgatgcacaaaagcagcctgttaaaaatcagcttggattaaacccgcagtcacatctaccagaactgcagctatttcaagctgaagggaaaatatataaatatgatcacatggaaaaatctgtcaacagtagttccttagtttccccaccccaacgtatttcttctactgtcaaaacccacatttctcatacatatgaatgtaattttgtggattcattattcacacaaaaagagaaagcaaatattgggacagaacactacaaatgtagtgagcgtggcaaggcctttcatcaaggcttacattttactatacatcaaataatccatactaaagagacgcaatttaaatgtgatatatgtggcaagatcttcaataaaaaatcaaaccttgcaagtcatcaaagaattcatactggagagaagccatataaatgtaatgaatgtggcaaggtcttccataatatgtcacaccttgcacagcatcgcaggattcatactggagagaaaccatataaatgtaatgaatgtggcaaggtctttaatcaaatttcacaccttgcacaacatcaaagaattcataccggagagaaaccttataaatgtaatgaatgtggaaaggtcttccatcaaatttcacaccttgcacaacatcggacaattcatactggagaaaaaccttacgaatgtaacaaatgtggcaaggtgttcagtcgcaattcctaccttgtacaacatctgatcattcatactggagagaaaccttacagatgtaatgtatgtggaaaggtcttccatcatatttcacaccttgcacaacatcagagaatccacactggagagaaaccttacaaatgtaatgagtgtggcaaggtcttcagtcacaagtcatccctagtaaatcactggagaattcatactggagagaaaccttacaaatgtaatgagtgtggcaaggtcttcagtcacaagtcatccctagtaaatcactggagaatccacactggagagaaaccttacaaatgtaatgaatgtggcaaggtcttcagtcgcaattcataccttgcccaacatctgataattcatgccggtgagaaaccttataagtgtgatgaatgtgacaaagcattcagtcaaaattcacatcttgtacaacatcacagaatccatactggagagaaaccttacaaatgtgatgaatgtggcaaagtcttcagtcaaaattcataccttgcatatcattggagaattcatactggagaaaaagcttataaatgtaatgaatgtgggaaggtcttcggtctaaactcatccctagcacatcatcggaaaattcacactggagagaaacctttcaaatgtaatgaatgtggcaaagcttttagtatgcgttcaagcctcactaatcatcatgcgatccacactggagagaaacatttcaaatgtaatgaatgtggcaaactcttccgcgacaattcatatcttgtacgtcatcagagatttcatgccggaaagaaatctaacacatgtaattaatgtggcagagtgttcagttagcattaaagccttgtaagacatacaataatttatactggagaaaaactttgcaagtataatgaatgtagcagagcctttagtttttgttcaaggcttaataaccgttagctagaccatagaggacagaaactttactaatgtactgaatgtggcaaggtcttaaggtaaaatctgagaccaggattcttcaaagaattcttgctggtgagaaacctaacaaatgtaatgaatgtggcaaggtcttctggcacaattctcacattgtacaatattgcaaaaattcatgcttgagagaaacaaaaacactgagagtgggaaaccattatgacttcaaacattcatcaacatcagagaatccatactaaagagcatttataataattatatgtgatagagattttccgcaggccaaagtctcactaggcatcaaaaacttttttgatgaaaccatacaaatgtaacgtgcatgcttaagcttttacccaggcatcaaaaccggaacatcacagggtttatactggagagtaactacacaaagataatgtaataagcctttcagtgtaatattcatgattttgtcgtgagagatccactcaataaaaaccaggcaaatgta

SEQ ID NO: 203968 - DNA, 509 bp, Homo sapiens
  Payload ID: 20225
  Gene Name: zinc finger protein 83
  ENST ID: ENST00000597161
  CDS Start-End: 118-396
aaacccggaagcggattatgtggagtgaaagttacaccgtggcggattgacttctaaggactcttggtacatgaggaagaaacccggaaggggaagaggaaagcaaaggcgtcaggaatggttcttcctcagggtctattgacattcagggatgtggccatagaattctctcaggaggagtggaaatgcctggaccctgctcagaggactctatacagagatgtgatgttggagaattataggaacctggtctccctggatggagtttttgctcttgttgcccaggctggagtgcagtggcacaatctcggctcaccaccacctccgcctcccgggttcaagcgattctcccgcctcagcctcagaagttgctggaattacaggtattttttctaaatgtgagatcaaggaattaccaccaaaaaaggagagtaatacaggagaaatattccagacagtaatgttggaaagacatgaaagccacgacatacaagatttttgcttcagag

SEQ ID NO: 203969 - DNA, 2246 bp, Homo sapiens
  Payload ID: 20226
  Gene Name: zinc finger protein 830
  Uniprot ID: Q96NB3
  ENST ID: ENST00000361952
  CDS Start-End: 38-1156
gacggaaaccagaatcgttttgggtctggtcgccaagatggcgtcctccgcctccgcccggactccggcagggaagcgagtgataaatcaggaagaattgcggcggttaatgaaggagaagcagcgtctgagcaccagtcggaaacggatagaatctccattcgcgaagtacaaccgtttggggcagctgagttgtgccctgtgtaacactccggttaagagcgagctcctgtggcagactcacgtcctgggaaagcagcaccgagagaaagtggccgagctgaaaggcgcgaaggaagccagccagggttcgtccgccagttcagcgcctcattccgtcaagaggaaagcgccggacgcagacgaccaagatgtcaagagagcgaaggccaccttggtgcctcaggtacagccctccacatctgcgtggaccaccaactttgacaaaataggaaaggagttcattagagcgactcccagtaagccttcaggactcagtttactccccgattatgaagatgaggaggaggaggaagaggaggaggaaggagatggagaaagaaaaaggggggacgccagcaagccgctctccgacgcacagggcaaggagcactcagtttcctcttcacgggaggtaacaagtagtgtgctgccaaacgatttctttagtactaatcctcccaaggcccccataattcctcattcagggtcaattgagaaagcagaaatacatgaaaaagtggtggaaaggagagaaaacaccgcggaagcgttaccggaaggtttttttgacgaccctgaggtagatgcaagagtacgaaaggttgatgctccaaaagatcagatggacaaagagtgggacgaattccaaaaagccatgaggcaggtcaacactatttccgaagccatagttgccgaagaggatgaggagggacggttggaccgccagattggggagatcgatgagcagatagagtgttaccgacgggtggaaaagctacggaatcgccaggatgaaataaaaaataaacttaaagaaatcctgaccataaaagaactgcagaaaaaggaagaagagaatgctgacagcgatgatgagggggaactacaggatttgttgtctcaggattggagggtgaaaggggcattgttatagggttttaaagacccaaggtttctaacagcctctgctgttgtataaaaagtgctgtctctcagtagtatagcggttacttcatgcctcaagatttgggtacctggattgctaaactggattgttgagataaaatgagccagtgagctacagcactttggaaaatttgtgtaacatgtttttgaggtaaagttgtttttgaaatttctgaagtgttatataccaaaatgccaacatttccacgacagacttaactgtataatttcgttgtaaaatctgtaagttgtaaatattgtacatagttaaatctgtattctgttttgaatttttttaattaatagaaagaccaaccggcaaactttcagatgaatgcttactgtggtatttggaatgtatgtatcttctgaaccctacatcaagttgaaaaggtttgttttcttgtttctttggtttttgtatggttttttagaacacttcataaacacataagtcattgtaggttaatcagttctcttagtgtgctttattttaaaaacataagaaaactatatgccaaacatgaccaaaccaatgatggtcagatgtggttgcacatgagagtcacctatgaagcattaaaataattaaagtgtctgaggccttccccttcaataaatctgggattgggcccaggcaactgtgttttttaagcacccaggttattctaatatatgccagggttagagagtaactgccctaaatccagaacccatttatgtttttcaggttttttctttttctttaaataacacattccataaatttgctgtttcttgaatgaaggaaaaaatattatcttttatttatttcatccagccttaaattttgttatttggtggtaaattagggttccttgtttgcaggtcctatctattgtagaaagaatatttaagttgtctttccagcagtaacaattggctcttgctggtcattgatagtttaaatcactccttcctttagagattgaggtactcaaataggaaaagggaattagcagtgttctggagttgaaatgcatacagcatattcaaataaaagtgagcaataataataa

SEQ ID NO: 203970 - DNA, 667 bp, Homo sapiens
  Payload ID: 20226
  Gene Name: zinc finger protein 830
  ENST ID: ENST00000578339
  CDS Start-End: 1-321
aaagatcagatggacaaagagtgggacgaattccaaaaagccatgaggcaggtcaacactatttccgaagccatagttgccgaagaggatgaggagggacggttggaccgccagattggggagatcgatgagcagatagagtgttaccgacgggtggaaaagctacggaatcgccaggatgaaataaaaaataaacttaaagaaatcctgaccataaaagaactgcagaaaaaggaagaagagaatgctgacagcgatgatgagggggaactacaggatttgttgtctcaggattggagggtgaaaggggcattgttatagggttttaaagacccaaggtttctaacagcctctgctgttgtataaaaagtgctgtctctcagtagtatagcggttacttcatgcctcaagatttgggtacctggattgctaaactggattgttgagataaaatgagccagtgagctacagcactttggaaaatttgtgtaacatgtttttgagaaagaccaaccggcaaactttcagatgaatgcttactgtggtatttggaatgtatgtatcttctgaaccctacatcaagttgaaaaggtttgttttcttgtttctttggtttttgtatggttttttagaacacttcataaacacataagtcattgtaggttaa

SEQ ID NO: 203971 - DNA, 9404 bp, Homo sapiens
  Payload ID: 20227
  Gene Name: zinc finger protein 831
  Uniprot ID: Q5JPB2
  ENST ID: ENST00000371030
  CDS Start-End: 1-5034
atggaggttccagaacccacctgccctgcccctcctgcgagggaccagccagctcccactcctggccctccaggggccccaggtggccaggcctcacctcacctgaccctgggccctgtccttctgccgccagagcagggcctggccccccccactgtgttcctgaaggccctgcccatcccactgtaccacacggtgcctcccgggggcctccagccccgcgccccgctagtgacgggcagcctagatgggggcaacgtgcccttcatactcagccctgtgctgcagcctgaagggcctggccccacccaggtggggaagccggcggcccctacgctgacggtgaacatcgtgggcactctgcctgtcctgtcgccgggcctgggccccacgctgggcagcccaggcaaggtgcggaatgcgggcaagtacctgtgtccgcactgtggtcgcgactgcctgaagcccagtgttctagagaagcacatccggtcccacacgggtgagaggcccttcccgtgtgccacctgcggcatcgcctttaagacccagagcaatctctacaagcacaggcggacgcagacgcacctcaacaactcccggctgtcctcagagtccgagggcgccgggggcggcctcctggaggaaggggacaaggccggagagccccccagaccagagggcaggggcgagagcaggtgccaggggatgcacgaaggcgcctcggagagacccctttctccgggtgcccacgtgcccctacttgccaagaacctggatgtgaggaccgaagctgctccctgtccagggtccgcatttgccgacagagaggctccttgggactctgcccccatggcgtcacctgggctcccagcggccagcacacaaccctggcgtaagttgccagagcagaagtcgccgaccgccgggaagccgtgcgccctgcagcggcagcaggcgacggcagcggagaagccctgggatgccaaggcccccgagggccggctgcggaagtgtgagagcaccgactcggggtacctgtcgcgctccgacagcgcggagcagccgcatgcgccctgcagccccctgcacagcctttcggagcacagcgccgagtccgagggggagggcggcccgggcccggggccaggggtcgcaggggccgagcccggggcgcgagaagccggcctggagctggagaagaagcggctggaggagcgcatcgcccagctcatctcccacaaccaggcggtggtggacgatgcccagctggacaacgtgcggccccggaagaccgggctgtccaaacagggcagcatcgacctgcccacgccctacacctacaaggactccttccactttgacatccgcgcgctggagccaggccgtaggagggccccgggccccgtgcgctccacctggacgcccccagacaagtctcggcccctcttcttccactccgtccccactcagctctccaccaccgtggaatgtgtccccgtcaccaggagcaactcgctgcccttcgtcgagggctccaggacgtggctggagcccagggagccccgggacccctggtccaggacgcagaagcctctgagccccaggcccggcccagcccgcctgggctgccgctcgggactaagctcgactgacgttcccagtgggcatccccgggccctggtcagacaggccgcggtggaggacctgccaggcacccccattggcgatgccctggtgcccgcagaggacacagacgcaaagagaactgctgcgcgggaggccatggccggcaagggcagagcgggcggcaggaagtgcggccagagaaggctgaagatgttctcccaggagaagtggcaggtgtacggggatgagacgttcaaaaggatctaccagaaaatgaaagccagtccccatggaggcaagaaagccagggaggtgggaatgggcagtggggcagaactgggctttcctctgcagaaagaggcagcagggagctcaggcacagtccccacccaagacaggaggacccctgtccatgaggacatatccgcaggggcaacgccagagccttggggaaatccaccagccctggaggcctccttggtgactgaacccactaagcatggggagacggtggccaggagaggagacagtgaccgacccagggtggaagaggctgtgtcatcccctgcactgggtggcagagacagtccctgttcaggcagtaggagccccctggtctctccaaatgggaggctggaactggggtggcagatgcccccagcacctggccccctcaaagggggtgatgtagaggctcccaggccagtttggccggaccccaagctggaaggaggtgcccgaggtgtgggggatgttcaggagacctgcctgtgggcccagactgtcctgagatggcccagcaggggctcaggggaggacaagctcccctcagagaggaagaagctgaaagtggaggacctgcacagctggaagcaaccagagcctgtgagcgcagagaccccaggtgggcccacgcagcctgcctctttgtcatcccagaagcaggatgccgatcccggggaggtgccagggggctcaaaggagagtgccaggcaggtgggcgagcctctggagtcctctggagcctccttggctgctgcttctgttgccctgaagagggtggggccaagggacaaggctaccccactgcatcctgcagccccagcccccgcagagcacccctcgctggccaccccacctcaggctcctagagtgctctctgccctggcagataatgccttttcccccaagtacctcctcaggttacctcaggcagagacccccttaccactgcccattccctggggaccaaggcacagccaggactctctctgcagcagtgggtggcctgaagaacgggcatcatttgttgggtcaggactggggacccctctttctcccagcccagcctcaggcccctccccaggtgaggcggacagcatcctggaggaccccagctgttccaggccacaggatgggagaaaaggggcacagttggggggggacaagggggacaggatggccactagcaggccagcagccagggagttgcccatctcagcaccaggggctcccagggaggctacctcctccccgcccactccaacgtgtgaggcacacttagttcaggacatggagggtgacagccaccgtatccatcgcctctgcatgggcagcactttggcaagggccaggctctctggggatgtcctgaatccctgggtacccaactgggagctgggggagcctcctgggaatgccccagaagatccttcttcagggcccctggtgggccccgacccgtgttcccccctccagcctggctccttcctcactgccctcactcggcctcagggtgtgcccccaggctggccagagctggccttgtcttcccactcagggacgtcccggagccacagcacccgcagtccccacagcacccaaaacccctttccctcactgaaggctgagccgcggctcacgtggtgttgcctgagccgcagtgtccctctgcccgcggagcagaaggcaaaggcggcatctgtgtacttggcggtgcactttcctggtagcagcctccgagatgagggtcccaatggccctcctgggagcaatggaggatggacctggacaagccctggagaaggagggccggcgcagatgtccaagttctcctacccaacagtcccaggggtgatgccccagcaccaggtgtctgagccagaatggaagaaaggcctgccttggagggcaaagatgtctcgtgggaacagcaagcagagaaaactgaagatcaaccctaaaaggtacaaagggaatttcttgcagagctgtgttcagctgagagccagtagacttcgcacaccaacctgggtgcgaagaagaagccgccaccctcccgcacttgagggactgaagccatgcaggacccctgggcagacctcttcagaaatagcaggtctgaatctgcaagaggagccatcttgtgccacctcagaatcacctccttgttgtgggaaggaagagaagaaggaaggtgactgcagacaaaccttaggaaccctctctcttggtacaagttcaagaattgtcagggaaatggacaaacgaactgtgaaggatatttctccatctgctggtgagcatggtgactgtactactcacagcactgctgccacatcaggattatctctgcaatctgacacctgcctggcagtggttaatgacgtgcctctaccccctggcaaaggtcttgaccttgggttgctggagactcagctgctggcctcccaggattcagtctcaacagatcccaaaccatacatcttctcagatgctcaaaggccttcttcctttgggtccaaaggaacttttccccaccatgacattgctacctctgtggctgccgtttgtatttctctgccagtgagaacagatcacatagcccaggaaattcacagtgctgaatcacgagaccacagccagactgcagggaggactctgacatcaagctccccagacagcaaagtcacagaagagggcagagcacagaccctcttgccagggagaccttcatctggacaaagaatttcagattcggttccactggagtcaactgaaaaaactcatcttgaaataccagcttcaggaccaagttcagctagttcacaccacaaggaagggagacacaagacgttttttccttccagaggccagtatgggtgtggggaaatgactgtcccctgcccctctttaggaagtgacggtaggaaacgtcaggtatctggattaatcactcggaaagattctgtggttccttctaagccagagcagcccatagaaattcctgaagccccttctaaatccctcaagaagaggagtctggaaggaatgagaaagcaaactcgagtagagttcagtgacaccagcagcgacgatgaagaccgattagttatagaaatatgaagcttccagagaaacatggtgtctggtcaaaaagactgttgacgcttcacaagtaaatgttgtcaggctggcggaagaactaaactctatctgtgaaacacctacagattaggaaagccattttgagttatttacaagccaactccaaccaacttctgacccccaactcagccgcagcgttccccagctccccttgggagtgctctgctcatcttcaaatggtgccaggcagggcagacatggcaaggaagcaaactctgcaaatggtcaacgtgcacagtgactgggccttgactcccagcctcgtcttctgcacctgtcccccactgcctctctgcaatcaaatggcactaaccaagaaagccaccatcaacacatttctccacaagtggaccccacacagtcgaggcaactggctttctccattagtaaactgaggatttgcttccaaggtggagagcacacttgggataattggagtagcttgacaaagagacgggggtgtgaactgggcacaaagatacttctgttcattttggagacaaaattcagatacattaaaaaactgaagcttgttcagagtaattcacgtccttggtggagttgtaaatacacttcaaaatgcctatgatccggtgacatgctgattacttttaaatgttgcacaaatggtcaatgcttatttatggtcagatgatgcaagcacatgctcttgtgcctggtgcgtttgctgtggagatctctgagactgtcggtttttctagttcttgcaaaggaacggtgttaaaagttaatagaactgtctctctgtaatgagtcattttttgagagggaaaaattcacttattttcctctgattcttcttgtcatattgtgctctgagcaatttcaattagagggttacattttagtaatctgtacagcttcaactgatgcctgctcgtcgtgacgggagccttttagatttccttcagaagcttcaaggatacaaaactaattggagttttgacgctgttttacatctcggtaattttattttcggggcttagtgttactttgctgtcaaattaaatcagcctctgtattgtgcacgtcagaactgcacagagaaaattccccagtattccaagccggtgcgcccctgtgcagaagaaaacagatctacgtcagccagcccggggggcaaagcctcagttccactgccttcctctccctctccttccacgggagaggagaaacttaaagaggtttacattgctgcatttcaataaaattttatacttgcttttggtatgattttgtacaatttgaaatttgtagctgagctcttttggtgtaactttgatgtaatgatgttcatatgacatcttgtacttcagagacacagcagcaatgcagagcatctcacacatgtgaatacacttcagtcagtctgtgcctgtgactaagtatggtcaaatttcaagtatcttcatgtgaattttccaattttggtgtttttcatagaaaacttcaatgccagaccagcttccctggttacttagcatatatttgtgaccatttcatatgcactcataaatatccaaggatttcaggcccagccaagaaaaacataagaagggaggtaaaaaggatgttggacattgacttagtgtactttttaaacccaacaaaagcgatgtggtgattatctcccttttcgaaggattcatgccactgtaatgagagaggcagtgtaggcaaatggtctgagccttggatggagattgaagtcctgactttagctgggaaatcttggttaagagtctttctgtaccttagtttccctaagtgagaataagagagttggacaagacgaatgtatctccaggttccaatttttctgagaatggttgatagagaagctgctctctccttaaaatgcatggactcaatggcttgaagatattccccatggggaaccattgccacggaggccttgcatgcaagaagtttgggtggggacagtgaggaactgaaacacaagcaccttccaccaattattgctgtgaagaacctgagcctgaagaagctccatctaattttttccccagagttccagattttagggtgcaatcatccagcctatacatgtggctcatagttcaaaaaattaaaagcaaaaccagaactctccagtaggaatggagaaaacctatctgtaggctgaactggctcctttgtcttaggaggcactggtcaggggaaaaaagctgtcttccagacccctcctttctgggtggctactgtggaatcaacggggtcactggctgtaaatcagtaagtcatagctccaaacagcaccaacttcaggatgatggtggaagctctgtccctataggagccaccgttgccagctgtcacatcccaacctaggtcaaatatggcggaatattgatttcgtctctaactccctgtatctcttacaaaggtaaagcaggtagcgaagccaccttgcttccctggtctttgcctagtggctggcaatgtttacaagtgtaccttactttatatcaacatgaatttgtgaaaaagctgtatgtcaatggattttttaaaaattaaaaatgtattttgaatgaccctaagggagctggctctttaaaagcatcctaaggtaaagattttttttaaatgaagaatctttttataaagcaatgaacaatctctgattttataaatcttaattttcctatgggttttcttaaagtgaaatacaattataagaatacattttaagggtaacattaacaacctagaacccagtttgggttactaaaaataaaatgtcagtattatcaattgataactaccacagttttatactctgcaagtgtgtactgcatgatggttaaggaaaaacaaatttattttagaacaaagcaaaccagagtttaaagatcagggatttccttctttccccagtgctaattttcccagtgttaattttattatatctttaggtaagggtcttaaccaactgatgcctcagtttcttccacagagaatagttagagggatgctgtcatgaactaagggaagggcactgaatttttttttgccaatatcaaaagtgacatttccccatgatgttcaagactcaccaggtttctctctccacctgtacctacacccagctagatcttgtcgttaaagatgtatggagggaagaggtttcaatccttccctccttggcaacctacattgttaagtgactcaaagtcatgtgatttttggtggacaactggaatcctccttcttgtaaaacacattgaaaaacagctcatctctcctgttaggcttaacccttgagatttgagacaaagctaataatcccctttggttcacatctcacagtaaccaggagaacctatggttcatttgccaagtgattaaaaaaaaagatggaggagggtgtctctgaattttaatggaaacactgccaatagcatggtgggtaacctagggcaagacagactttttcttcctgaaatcactcttctaaagctgagaccggaagaggaaccttgcagaagtgcactgtgaccacagttcttggcatgaaagataaacaatttgcagtctcatgccaaaaagtatttccttgcatttacattcattacttagaatgatcacattattcatttttttccccagcacagaaatttgcattttgcacagaatttgcctggtgcagcagatctttatagttatggaaactgtcatcattatcggaatgtgctgctgctcaactccccagacataatttaatatggtgaggagaatatgacctgcctggctctatgggtgatcatatttctactgctgcagcaagctgggcttgtgtatttttcctcacttcagttgttcttcccatagttcatgtagggaggcactttggcttttgaaacactacatttctcaatatttaagcacaatttattgtccttatttttcagaacccattaaatataagggtcagaacctagaaaatcttatgtgctggatttctaccctgtatgattcttttcatccatgctttgcacttacgtaggaatatacataatttggtctgaagaagtataggaacagttgagcacattacttcaccactggaagaataggaaccagggaaaaacatcagcctctgccacttggagcactagaggatgacggaatgtcttgtatatgcggtcaactgttcaggatttactactcaattggttgttcacaatcagggaaatgattggcttcttggttgtttgttgaactttctttctttatatggttaaattattttgttttgataaaaataaaacttaaaatgcaaa

SEQ ID NO: 203972 - DNA, 3450 bp, Homo sapiens
  Payload ID: 20228
  Gene Name: zinc finger protein 835
  Uniprot ID: Q9Y2P0
  ENST ID: ENST00000537055
  CDS Start-End: 233-1846
ggcctggtgcgcgggctcctccgcagcagcagaagtcttgaccttagctcgtctaaggaaggaggcaccagggtctgcgttggcccaggaggacccgagactgagtagaagcggagccgactgcaccaggctaggagggggccggccagcgcgttcgaaggtgataccgggaggcgagagcaacgacccagagaaaagatgtgagatcaagacagcagcccagggatcgaggatggagggactcttgagcgtcgccctccagggcgcagagttggaaggaaactggaaacacgagggccaggttgaggacctgcaggaaaaccaggaaagctgtccagagccagaggccgtggcctgcaagggagaccctgctggggacagcatgcaggaacgcgatgaattcagccgaatcccaagaaccatatcgagccctgctgctacccaagccagtgtccccgacgacagcagttcccggaggtgcagcgcgcctggggagagcccgaaggagaggcatcctgacagccgccagcgggagagaggtggaggccccaagaagccgtggaaatgcggggactgcgggaaggccttcagctactgttcagcgttcatcttacaccagagaatccacaccggggagaagccatttgcgtgccccgagtgcggcaaggccttcagccagagcgtgcacctgaccctgcaccagcgcacgcacacgggcgagaagccctacgcctgccacgagtgcggcaaggccttcagccagggctcgtacctggcgtcccactggcgcacgcacacgggcgagaagccgcaccgctgcgccgactgcggcaaggccttcacgcgcgtcacgcacctgacccagcaccggcgcgtgcacacgggcgagcggccctacgcgtgcgcccagtgcgccaaggcgttccgcaaccgctcgtccctgatagagcaccagcgcatccacaccggtgagaagccctacgagtgctccgcgtgcgccaaggccttccgcttctcctcagcgctcatccgccaccagcgcatccacacggaggagaagccctaccgctgcggccagtgcgccaaggccttcgcgcagatcgcgcacctgacccagcaccggcgcgtgcacacgggcgagaagccctacacgtgccaggactgcggcgcgctcttcagccagagcgcctctctggccgagcaccggcgcatccacacaggcgagaagccctacgcgtgcggccagtgcgccaaggccttcacccaggtgtcgcacctgacgcagcaccagcgcacgcacaccggagagcggccttacccctgccacgactgcggcaagcgcttcagcaaccgctcccacctcctccagcaccgcctcgtgcacaccggtgagcggccctacaggtgcctgcaatgcggggccgccttcagccacgtgtcctcgcttatagagcaccagaagatccacaccggagagcggccctacaagtgcggcgagtgcggcaaagctttcagccagggctcctcgctcgccctgcaccagcgcacgcacacgggcgagcggccctacacctgccccgagtgcggcaaggccttcagcaaccgctcctacctgatccagcaccacatcgtgcacaccggggagaagccctacgagtgcagcggctgcgggaaggccttcagcttctcctccgcgctcatccgacaccagaggacgcatgcagacagttcgggacgcctttgcccagctcccacgcctgactcaacacctgggctctcacagggaggagaaacctgtcaacaggggtgccctggcagaaacccgcgtggaccagcagaagattaagagctgagggcctcctttccaacctcacaatgctatgggggagatactgtgttatccccgacgcttcctgtgaggaaaccgaggctcagagaagcttgttaacttgcctgagggcacacagtggggaagacacagggctaagactgtacctcacatctgccagactcccctgcggtcttcctggtgcaaaattataaatggggcacgggcaagtagacctgcagaaacacctatggctggcctttaatttctttctttttttctttgagacagtgtctctctctgtcacccaggctagagtgcagtggagcgatctcggctcactgaaacttctgcctcccgggtacaagtgattctcctgcctcaacctcccgagtagttaaaattacaggagtctggctaatttttttttttttttttttctgagacggagtcttgctctgtcgcccaggctggagtgcagtgatgcaatctcggctcactgcaacctccgcctcccgggttcaagtgattcccctacctcagcctcccgagtagctgggactacaggcgcccggccaccacacccggactagtttttttgtattttagtagaggcggggtttcaccatgttggctaggatggtctcgatctcctgacttcgttatccacccgcctcggcctcccaaagtgctgggattacaggcatgagccaccgcgcccagcctaatttttgtatttttagtagaggcagggtttcaccatgttggccaggctgtctcgaactcctaacatcaggcgatctgcctgccttggcatcccaaagtgctgggactacaggcctgagctacggtgcctggccagctggccttttcattgttgattttattgagtaagcccttgctcagtaaatttaattgaattaaagtgaataaaaggtttggtttctttggccaagttggcatatttactaaaggagcagagtctgaagaagaaatctggattcactaagatagaaatagtgcttagagaaaatgagcaggagaaatctagagctgaaagttattctagaagaagggagtgcttctcctctacaaaagatttttagagtgggcctagtctttttttcagtatgaggaaacacctacccatctccaccatttttccccctaactcaaagacctgactttaatgcttgtatcagtcagctcttgctgtgtaacaaaccatccagccctcatttatccatttactatttctcatgcatctggaggtcagctgctggttctgttggtctggaccaggcttggtctggacctggaccaggagggctcagctgggccaatttgatcttcttctcctgactcacatctcacctgggtgtgttctcagggaggtggcaggagtctgagagggagtggacacacaggcatgctttcaagtctctgatattgtcacatttgcatctagtcccacaggccaaagcaagcctcctagccaagcctaggatcagcacaggaagagccttcctaagcatgtggtcccagggaagggtgaaaagtaggagttatgaacgtaatccacctactacaatgttgaattaaagttataatctcataacttc

SEQ ID NO: 203973 - DNA, 507 bp, Homo sapiens
  Payload ID: 20228
  Gene Name: zinc finger protein 835
  ENST ID: ENST00000601659
  CDS Start-End: 231-507
gatgcgcaggcgcagtccaccccggcctggtgcgcgggctcctccgcagcagcagaagtcttgaccttagctcgtctaaggaaggaggcaccagggtctgcgttggcccaggaggacccgagactgagtagaagcggagccgactgcaccaggctaggagggggccggccagcgcgttcgaagacccagagaaaagatgtgagatcaagacagcagcccagggatcgaggatggagggactcttgagcgtcgccctccagggcgcagagttggaaggaaactggaaacacgagggccaggttgaggacctgcaggaaaaccaggaaagctgtccagagccagaggccgtggcctgcaagggagaccctgctggggacagcatgcaggaacgcgatgaattcagccgaatcccaagaaccatatcgagccctgctgctacccaagccagtgtccccgacgacagcagttcccggaggtgcagcgcgcctggggagagcccgaaggaga

SEQ ID NO: 203974 - DNA, 2811 bp, Homo sapiens
  Payload ID: 20229
  Gene Name: zinc finger protein 836
  ENST ID: ENST00000322146
  CDS Start-End: 1-2811
ttatgtatagttcagggacctttgacattcagggatgtagccatagaattctctcaggaggagtggaaatccctggaccctgtgcagaaagctttgtactgggatgtgatgttggagaactacaggaacctggtcttcctgggtatccttcctaaatgtatgaccaaggaattaccaccaatagggaacagtaatacaggagaaaaatgccaaacagtgacgctggaaagacatgaatgttatgatgttgaaaatttttacttaagggaaatccagaaaaatctacaggaccttgagtttcaatggaaagatggtgaaataaattataaagaagtgccaatgacctataaaaacaatcttaatggtaaaagaggtcaacatagtcaagaggatgtagaaaacaaatgtattgaaaatcagcttacattaagctttcagtcacgtctgactgaactgcagaaatttcaaactgaagggaaaatttatgagtgtaaccaatctgagaagacagttaataacagttccctagtttcaccacttcaaagaattcttcctagtgtccaaaccaacatttctaaaaaatatgagaatgagtttttgcagctgtcattacccacccaacttgagaaaacacacattagggaaaaaccttatatgtgtaaagggtgtggcaaagcctttagagtgtcttcaagtcttattaaccatcagatggtacatactacagagaaaccttacaaatgcaatgaatgtggcaaagcctttcatcggggctcactactaactatacatcagatagtccatacaagggggaagccatatcaatgtggtgtatgtggcaagatcttcagacaaaattcagatcttgtaaatcaccggagaagtcacactggagagaaaccgtacaaatgtaatgaatgtggcaagtcctttagtcaaagttataaccttgcaatacatcagagaattcacactggagagaaaccttacaaatgtaatgagtgtgggaaaaccttcaaacaaggctcatgcctcactacacatcagataatccatacaggagagaaaccatatcaatgtgatatatgtggcaaggtcttcaggcagaattctaatcttgtaaatcaccagagaatccacactggagagaaaccatacaaatgcaacatatgtggaaagtcctttagtcaaagttccaacctggcaactcatcagacagttcatagtggaaacaaaccttacaaatgtgatgagtgtggcaaaacctttaaacggagctccagcctcactacacatcagataatccatacaggagagaaaccatatacatgtgatgtatgcgacaaggtcttcagtcaacgttcacaacttgcaaggcaccagagaagtcatactggagagaaaccttacaaatgcaatgaatgtggcaaggtcttcagtcagacttcacatcttgtggggcatcggagaattcatactggagagaaaccttacaaatgtgataaatgtggtaaagcctttaaacagggctcattactcactcgacataagataattcataccagagagaaacgttaccaatgcggtgaatgtggaaaggtctttagtgaaaattcatgccttgtaagacatttaagaattcatactggggagcaaccttacaaatgtaatgtgtgtggcaaggtcttcaattacagtggaaacctttcaattcataagagaatacatacgggagagaaacctttccaatgtaatgaatgtggcacagtcttcaggaactactcatgcctagcacgtcatctaagaattcatactgggcagaaaccttacaaatgtaatgtgtgtggcaaggtcttcaatgacagtggaaacctttcaaatcataagagaattcatactggagagaagccgtttcaatgtaacgaatgcggcaaggttttcagttactactcatgcctagcacgtcatcggaaaattcataccggagagaaaccttacaaatgtaatgattgtggcaaagcctatactcagcgttcaagcctcactaaacatctgataattcatactggagagaaaccttacaattgtaatgagtttggaggggcatttatccaaagttcaaaacttgcaagatatcacagaaatcctactggggagaaaccacacaaatgtagccattgtggtagaacttttagtcatataacaggcctgacgtaccatcagagaaggcatactggagagatgccatacaaatgtattgaatgtggccaggtctttaattccacttcgaaccttgcaaggcatcggagaattcacactggagagaaaccttacaaatgtaatgaatgtggcaaggtctttcgtcatcaatcaacactagcacgtcatcggagtattcatactggagagaaaccttacgtgtgtaatgagtgtggcaaagcctttagagtgcgttcaattctggttaatcatcagaaaatgcatactggggacaaaccttacaaatgtaatgaatgtggtaaagcttttattgaaaggtcaaagctggtgtaccatcaaagaaatcacactggagagaagccatacaaatgtattgaatgtggcaaggcctttgggcggttttcttgcctcaacaaacaccaaatgattcattctggagaaaaaccttataaatgtaatgagtgtggcaaatctttcattagtcgctcaggcctcactaaacatcagacaaaacatactgcagagagtcttaaaacaaaattcaatgtggaaaagcctttagatgttctcctaacttctgggttcaaataa

SEQ ID NO: 203975 - DNA, 558 bp, Homo sapiens
  Payload ID: 20229
  Gene Name: zinc finger protein 836
  ENST ID: ENST00000596428
  CDS Start-End: 242-558
agagtgggaacaaaggaggtgtaacagggtcttgctctgtcagactagagtacagtgccatgatctccgctcactgcagcctcaacctcctgggctcaagcagtctttctgcctcagagtgctgggattacagacgggagccaccacgccaggcctacgagatttgacttgtaaagaattaattatattgactgagagagaagcccagaagaggaagaagaggaaagaaaaggagtcagggatggctcttacacagggacctttgacattcagggatgtagccatagaattctctcaggaggagtggaaatccctggaccctgtgcagaaagctttgtactgggatgtgatgttggagaactacaggaacctggtcttcctgggtatccttcctaaatgtatgaccaaggaattaccaccaatagggaacagtaatacaggagaaaaatgccaaacagtgacgctggaaagacatgaatgttatgatgttgaaaatttttacttaagggaaatccagaaaaatctacaggaccttgagtttcaatggaaagatggtga

SEQ ID NO: 203976 - DNA, 3209 bp, Homo sapiens
  Payload ID: 20229
  Gene Name: zinc finger protein 836
  Uniprot ID: Q6ZNA1
  ENST ID: ENST00000597252
  CDS Start-End: 375-3185
agcgctgcgcgtcagtttccgtctacctggactaaacatttgcttcgccccgtctgcctgaatcgaacgtgcacttggcagtcttcccttgtccatacccgtttcctggggatcgctacggaccttaaaataccagcaacagccccttcgccccaagtaaggtcttgctctgtcagactagagtacagtgccatgatctccgctcactgcagcctcaacctcctgggctcaagcagtctttctgcctcagagtgctgggattacagacgggagccaccacgccaggcctacgagatttgacttgtaaagaattaattatattgactgagagagaagcccagaagaggaagaagaggaaagaaaaggagtcagggatggctcttacacagggacctttgacattcagggatgtagccatagaattctctcaggaggagtggaaatccctggaccctgtgcagaaagctttgtactgggatgtgatgttggagaactacaggaacctggtcttcctgggtatccttcctaaatgtatgaccaaggaattaccaccaatagggaacagtaatacaggagaaaaatgccaaacagtgacgctggaaagacatgaatgttatgatgttgaaaatttttacttaagggaaatccagaaaaatctacaggaccttgagtttcaatggaaagatggtgaaataaattataaagaagtgccaatgacctataaaaacaatcttaatggtaaaagaggtcaacatagtcaagaggatgtagaaaacaaatgtattgaaaatcagcttacattaagctttcagtcacgtctgactgaactgcagaaatttcaaactgaagggaaaatttatgagtgtaaccaatctgagaagacagttaataacagttccctagtttcaccacttcaaagaattcttcctagtgtccaaaccaacatttctaaaaaatatgagaatgagtttttgcagctgtcattacccacccaacttgagaaaacacacattagggaaaaaccttatatgtgtaaagggtgtggcaaagcctttagagtgtcttcaagtcttattaaccatcagatggtacatactacagagaaaccttacaaatgcaatgaatgtggcaaagcctttcatcggggctcactactaactatacatcagatagtccatacaagggggaagccatatcaatgtggtgtatgtggcaagatcttcagacaaaattcagatcttgtaaatcaccggagaagtcacactggagagaaaccgtacaaatgtaatgaatgtggcaagtcctttagtcaaagttataaccttgcaatacatcagagaattcacactggagagaaaccttacaaatgtaatgagtgtgggaaaaccttcaaacaaggctcatgcctcactacacatcagataatccatacaggagagaaaccatatcaatgtgatatatgtggcaaggtcttcaggcagaattctaatcttgtaaatcaccagagaatccacactggagagaaaccatacaaatgcaacatatgtggaaagtcctttagtcaaagttccaacctggcaactcatcagacagttcatagtggaaacaaaccttacaaatgtgatgagtgtggcaaaacctttaaacggagctccagcctcactacacatcagataatccatacaggagagaaaccatatacatgtgatgtatgcgacaaggtcttcagtcaacgttcacaacttgcaaggcaccagagaagtcatactggagagaaaccttacaaatgcaatgaatgtggcaaggtcttcagtcagacttcacatcttgtggggcatcggagaattcatactggagagaaaccttacaaatgtgataaatgtggtaaagcctttaaacagggctcattactcactcgacataagataattcataccagagagaaacgttaccaatgcggtgaatgtggaaaggtctttagtgaaaattcatgccttgtaagacatttaagaattcatactggggagcaaccttacaaatgtaatgtgtgtggcaaggtcttcaattacagtggaaacctttcaattcataagagaatacatacgggagagaaacctttccaatgtaatgaatgtggcacagtcttcaggaactactcatgcctagcacgtcatctaagaattcatactgggcagaaaccttacaaatgtaatgtgtgtggcaaggtcttcaatgacagtggaaacctttcaaatcataagagaattcatactggagagaagccgtttcaatgtaacgaatgcggcaaggttttcagttactactcatgcctagcacgtcatcggaaaattcataccggagagaaaccttacaaatgtaatgattgtggcaaagcctatactcagcgttcaagcctcactaaacatctgataattcatactggagagaaaccttacaattgtaatgagtttggaggggcatttatccaaagttcaaaacttgcaagatatcacagaaatcctactggggagaaaccacacaaatgtagccattgtggtagaacttttagtcatataacaggcctgacgtaccatcagagaaggcatactggagagatgccatacaaatgtattgaatgtggccaggtctttaattccacttcgaaccttgcaaggcatcggagaattcacactggagagaaaccttacaaatgtaatgaatgtggcaaggtctttcgtcatcaatcaacactagcacgtcatcggagtattcatactggagagaaaccttacgtgtgtaatgagtgtggcaaagcctttagagtgcgttcaattctggttaatcatcagaaaatgcatactggggacaaaccttacaaatgtaatgaatgtggtaaagcttttattgaaaggtcaaagctggtgtaccatcaaagaaatcacactggagagaagccatacaaatgtattgaatgtggcaaggcctttgggcggttttcttgcctcaacaaacaccaaatgattcattctggagaaaaaccttataaatgtaatgagtgtggcaaatctttcattagtcgctcaggcctcactaaacatcagacaaaacatactgcagagagtcttaaaacaaaattcaatgtggaaaagcctttagatgttctcctaacttctgggttcaaataattcatacttattgatatagcttgt

SEQ ID NO: 203977 - DNA, 612 bp, Homo sapiens
  Payload ID: 20229
  Gene Name: zinc finger protein 836
  ENST ID: ENST00000599618
  CDS Start-End: 1-93
aaacatcagacaaaacatactgcagagagtcttaaaacaaaattcaatgtggaaaagcctttagatgttctcctaacttctgggttcaaataattcatacttattgatatagcttgtatatttgtcacttccgtctgaaatctcatgtggaattttaatcccctttattggaggtggggcctggtgggagatgattggatcacaggggtggatttctcaagaatggtttagcaccacccgctttttgctcttcttgggatagtgagttctggtgagatcttgtttttttgtttgttttgcttttttgagacggagtctctctctgtcgccaggctggaatgcagttgcagtgagccaagatcgtgccagtgcactccagcctgggtgacagcgagaccctgtctccagaaaaaaaaaaaaaaaaaaaaaaaagtgtatggaactttcctctctcttgctcctattcttgccatgtgacatgcccactcccctttttccttccaccatgattttaacattcctgaggcttcctcggaaggtgagcagatgccagcaccatgtttcctgtaaagcctgcagaactgtgagtcaattaaacttctttataaatta

SEQ ID NO: 203978 - DNA, 808 bp, Homo sapiens
  Payload ID: 20229
  Gene Name: zinc finger protein 836
  ENST ID: ENST00000597065
  CDS Start-End: 523-789
agggttcccaaatctggccagtctttctgccctttcccttgcgggtcgcaccccgcccaggcccctctcccgccccaggtctctcagtcttttttctcagggcgtgtagcttcctgcacacccggaagcagatcgcgcggggaaaagatcacagcgctgcgcgtcagtttccgtctacctggactaaacatttgcttcgccccgtctgcctgaatcgaacgtgcacttggcagtcttcccttgtccatacccgtttcctggggatcgctacggaccttaaaataccagcaacagccccttcgccccaaggtcttgctctgtcagactagagtacagtgccatgatctccgctcactgcagcctcaacctcctgggctcaagcagtctttctgcctcagagtgctgggattacagacgggagccaccacgccaggcctacgagatttgacttgtaaagaattaattatattgactgagagagaagcccagaagaggaagaagaggaaagaaaaggagtcagggatggctcttacacagggacctttgacattcagggatgtagccatagaattctctcaggaggagtggaaatccctggaccctgtgcagaaagctttgtactgggatgtgatgttggagaactacaggaacctggtcttcctgggtaaggataattttgctctagaagttaagatctgccctcgtgtatttttgtattttctctgttgtctttcttgggagcccttccattatttgactgagactgaagccttgttgactcacaaataaaaagcttcataatgctgca

SEQ ID NO: 203979 - DNA, 2038 bp, Homo sapiens
  Payload ID: 20230
  Gene Name: zinc finger protein 837
  Uniprot ID: Q96EG3
  ENST ID: ENST00000427624
  CDS Start-End: 324-1919
ggcggcccggaggtggcgggaggacggctccgcgctgcatgcggggcggggaccagggacccgtgcgggccgcctccagagaatgaggctgccagccttgagagcaccaccgttacctggttgaagaggggaggggaagtccagcattggcctctgcagcgtggatctcccggccaggctctcagctgtcaggtgagtctcacctcacacctctcagaagacatggacaatggcagtgaatggagccaggaggacccggagtgtcggcttgccactgagaaacggagggcaggaatcctacaaccagaactctgcgccccaggatggaggctccagcccagaaggctgggcagggaggactccccaaggccgatgcccagggtgcctccggggcccgggagaagaggcccgaggagccgaggcccctcgaagaggaccgagctgggagccgccccactcaaaagggggacctgcgtggagcggcgggcggtaggacgactcccccaggcgggggctcccggggctgcagcctcggggtgagccccggcccggggacccggcacagcgccgggaccagacccctcgtgcgggagccgtgcggccccacctcttctcagaaccctgagctggttatccccgaggggctgcaagcccgggagggcccctgtaggagcccagcgcgtggcggggactgcagcaggaactcctgcctggcgtggcatcgcggggcgcccgctggggagacgccacccgtgtgtgacccctgtccggagcggatccagaaccacccccggactcaactgtgtgaggtccacacggactgttggccgtgccaaccagggactggcgctccgacctgcccgaggaccccaaagccgacctcccgcgggaggaaccccttggtggagcagccccgggcttgcgcgtgcggcgaggcctttgcgtggagggccctgcggatcccccaggagaggctgcaggcgacggaggagccccgtccgtgtgcccggtgcgggaagcgcttccgccccaaccagcagcagcaggcgggcaagagtcccccagtgtgtcctgagtgcggccaaacctcgcgacctcgccctattgtccccgaccccccggcccagcgactgtacgcttgcgacgagtgcggcaaggccttcacgcgcacctccagcctgctgcagcaccagcgcatccacacgggcgagcggccctacgagtgcgccgagtgcggcaaggccttcgtgcgctgctccggcctgtaccgccaccagaagacgcactcggccgagcgccaccggcgtggccccgtcctggcgcggcgcgccttccggctggggtgcccgccctgcggggactacagcgagcggagtccccgacgggggtcgggagccggggagaagccgtacgagtgcgccgactgcgccaaggccttcgggctgttctcgcacctcgtggagcaccggcgcgtgcacaccggcgagaagccctacgcgtgccccgagtgcggcaaggccttcaaccagcgctcgaacctgagccggcaccagcgcactcacagcagcgccaagccctacgcgtgcccactgtgcgaaaaggccttcaagggccgctcgggcctggtgcaacaccagcgcgcgcacaccggcgagcggccctatggctgctccgagtgcggaaagaccttccgcggctgctccgagctgcgccagcacgagcgcctgcactcgggcgagaagccctacatctgccgcgactgcggcaaggccttcgtgcgcaactgcagcctggtgcgccacctgcgcacgcacacgggcgagcggccctacgcgtgcggagattgcggccgcgccttcagccaacgctccaacctcaacgagcaccggaagcggcacgggggccgcgccgcgccttgactgcagggagccgagagtcgacgcgtcgcccaagcgaaccctgcgtcgaggaggggcctttgtcccggaaaacccaccaacgtttgtaactttgattaaacttcactttgtacacatgg

SEQ ID NO: 203980 - DNA, 1969 bp, Homo sapiens
  Payload ID: 20230
  Gene Name: zinc finger protein 837
  Uniprot ID: Q96EG3
  ENST ID: ENST00000597582
  CDS Start-End: 260-1855
cgcctgcgcttgctgtggcccgggtccctcagtgccgcggcggcccggaggtggcgggaggacggctccgcgctgcatgcggggcggggaccagggacccgtgcgggccgcctccagagaatgaggctgccagccttgagagcaccaccgttacctggttgaagaggggaggggaagtccagcattggcctctgcagcgtggatctcccggccaggctctcagctgtcagatcctacaaccagaactctgcgccccaggatggaggctccagcccagaaggctgggcagggaggactccccaaggccgatgcccagggtgcctccggggcccgggagaagaggcccgaggagccgaggcccctcgaagaggaccgagctgggagccgccccactcaaaagggggacctgcgtggagcggcgggcggtaggacgactcccccaggcgggggctcccggggctgcagcctcggggtgagccccggcccggggacccggcacagcgccgggaccagacccctcgtgcgggagccgtgcggccccacctcttctcagaaccctgagctggttatccccgaggggctgcaagcccgggagggcccctgtaggagcccagcgcgtggcggggactgcagcaggaactcctgcctggcgtggcatcgcggggcgcccgctggggagacgccacccgtgtgtgacccctgtccggagcggatccagaaccacccccggactcaactgtgtgaggtccacacggactgttggccgtgccaaccagggactggcgctccgacctgcccgaggaccccaaagccgacctcccgcgggaggaaccccttggtggagcagccccgggcttgcgcgtgcggcgaggcctttgcgtggagggccctgcggatcccccaggagaggctgcaggcgacggaggagccccgtccgtgtgcccggtgcgggaagcgcttccgccccaaccagcagcagcaggcgggcaagagtcccccagtgtgtcctgagtgcggccaaacctcgcgacctcgccctattgtccccgaccccccggcccagcgactgtacgcttgcgacgagtgcggcaaggccttcacgcgcacctccagcctgctgcagcaccagcgcatccacacgggcgagcggccctacgagtgcgccgagtgcggcaaggccttcgtgcgctgctccggcctgtaccgccaccagaagacgcactcggccgagcgccaccggcgtggccccgtcctggcgcggcgcgccttccggctggggtgcccgccctgcggggactacagcgagcggagtccccgacgggggtcgggagccggggagaagccgtacgagtgcgccgactgcgccaaggccttcgggctgttctcgcacctcgtggagcaccggcgcgtgcacaccggcgagaagccctacgcgtgccccgagtgcggcaaggccttcaaccagcgctcgaacctgagccggcaccagcgcactcacagcagcgccaagccctacgcgtgcccactgtgcgaaaaggccttcaagggccgctcgggcctggtgcaacaccagcgcgcgcacaccggcgagcggccctatggctgctccgagtgcggaaagaccttccgcggctgctccgagctgcgccagcacgagcgcctgcactcgggcgagaagccctacatctgccgcgactgcggcaaggccttcgtgcgcaactgcagcctggtgcgccacctgcgcacgcacacgggcgagcggccctacgcgtgcggagattgcggccgcgccttcagccaacgctccaacctcaacgagcaccggaagcggcacgggggccgcgccgcgccttgactgcagggagccgagagtcgacgcgtcgcccaagcgaaccctgcgtcgaggaggggcctttgtcccggaaaacccaccaacgtttgtaactttgattaaacttcactttgtaca

SEQ ID NO: 203981 - DNA, 2987 bp, Homo sapiens
  Payload ID: 20231
  Gene Name: zinc finger protein 839
  Uniprot ID: A8K0R7
  ENST ID: ENST00000442396
  CDS Start-End: 16-2799
cccgcctcggccgccatggcggatgcggagccggaggctgggggcggcagcgaggatggcggcggcggcggcggcccggctcctccgggccagagcggcagcgtcgcacgtgtggccccgctgggccccgagcagctgcggcaggtcctggagcaggtgacgaaggcgcagccgccgccgccgccgccccccttcgtgctgcgggacgcggcgcggcggctgcgggacgcggcccaacaggccgccctgcagcggggccggggcaccgagcccccgcgcctgccgcgcctgctcccgccccagcaactagaagccatttgtgtcaaggtaacgtctggagaaacaaaaggtcaggaaaggccaatgctcctaccgaccacaatccagccccaaactgcaagaaagagccagctgccccgggggaattcctgcctggtggggctccatatcgccagccctcagctgctcagggtacagccgcttgtgagaaccgagccacagtcctgcttcctaagtgacttatgccaacctcctgctcaggggtttgtacagagaccactgccagccctccaggtggtccctgcaaagagagtcccagcccccaaggctccagatgaacagggctccatgttgacccctttgtctgcctctgacccgctggcagtaacatctctttcatccagttcagcacatccatttatttccaacttgcatacaagacatactgagaaactaaaaaaatcgttaaaagtaaagacacgttctggacgggtatctcgacctcccaaatataaagctaaagattataagttcataaaaacagaggatctggcggatggtcatctgtcagattctgatgattactcagaactctgtgtggaagaagatgaagatcagagggagaggcacgcactctttgacttatcgagctgctccctgaggcccaaaagctttaagtgtcagacttgtgaaaagtcatatatagggaaggggggactggcccgacattttaaacttaacccaggccacggccagttggaccccgagatggtgctgtctgagaaagccagtggaagcaccctccgggggtgcacggaggaaaggacgctcagcctgacctccctggggctgtccatgccagcggatccatgtgagggaggggcccgctcctgcttggtgacagagtcagcacgcggtggcctgcagaatggtcagtctgtagacgttgaagagacattgccatctgaaccagaaaatggagctcttttgcgatcagagagataccaaggacctagaagacgcgcatgctcagagacccttgcagagtcccgcacagctgtcctccagcagagaagagctgctcagctacctggtggccctgctgcggcaggggagcagagggcgtcgccaagcaaagccaggctcaaggagttcctccagcagtgtgaccgggaggatctggtggaattggctctgcctcagctggctcaggttgtgaccgtgtatgagtttcttctgatgaaggttgaaaaagatcatctagcaaagccttttttcccagctatatataaggaatttgaagagttgcataaaatggttaagaaaatgtgccaagattacctcagtagttctggtctgtgttcccaggagaccctggaaataaacaatgataaggttgctgagtcattaggaatcacagaattcctacggaagaaagaaatacacccagacaaccttggacccaagcacctcagccgagacatggatggggagcagctagagggagctagcagcgagaagagggaacgtgaggctgcggaggagggactggcctcagtgaaaaggcccagaagagaagccctgtccaacgataccactgaatctcttgctgccaacagcagaggccgggagaagcccaggcccttgcatgctttggccgctggtttttcccctccagtaaatgtgactgtctctccccgttctgaagaaagccatacaacgacggtttctggtggcaatgggagcgtgttccaggcgggcccgcagcttcaggcactggctaacttagaagccaggagggggtctataggtgctgctctctcatcccgggatgtcagtgggctgcctgtttatgctcagtcaggagagcctaggaggctgacccaggcacaggtggcagcgtttcctggagagaatgctttggaacactcttcagaccaggacacctgggacagcctgaggagcccgggtttctgcagccctttgtcatctggtggtggagcagagtccctgccgcctggggggcctggacatgcagaggcaggacacctcggcaaggtttgtgacttccacctgaaccaccagcagcccagccccaccagcgtcctgcctacagaggtggcagcccctccgcttgagaaaattttgtctgtggatagcgtggcagtggactgtgcctacaggactgtgcccaagccagggcctcagcctggcccacatggatcactattgactgaagggtgtctcagaagcctttcgggggacttgaaccggttcccctgtgggatggaggtgcactctggccagagagaactggagagcgtggttgctgtcggcgaagccatggcttttgaaatttccaatgggagccatgagttactgtctcagggacagaagcagatttttattcagacttccgatgggcttatcttgtcccctccaggtacaatagtgtctcaggaggaggacattgtcacagtgactgatgcagaggggcgtgcctgcggatgggcccgctagaaggagttcctctagaagctgtggagtcggtcgtcaccgtggagccagagccctcacagtgaagtggagtcagatcctagattcgtctgattttatccagagaaggtctatggcaagcaatgtatatttttctaatgtgaatattgcacagatgaaccttttatttataaagaataatgtctttctgc

SEQ ID NO: 203982 - DNA, 931 bp, Homo sapiens
  Payload ID: 20231
  Gene Name: zinc finger protein 839
  ENST ID: ENST00000558490
  CDS Start-End: 1-743
agagataccaaggacctagaagacgcgcatgctcagagacccttgcagagtcccgcacagctgtcctccagcagagaagagctgctcagctacctggtggccctgctgcggcaggggagcagagggcgtcgccaagcaaagccaggctcaaggagttcctccagcagtgtgaccgggaggatctggtggaattggctctgcctcagctggctcaggttgtgaccgtgtatgagtttcttctgatgaaggttgaaaaagatcatctagcaaagccttttttcccagctatatataaggaatttgaagagttgcataaaatggttaagaaaatgtgccaagattacctcagtagttctggtctgtgttcccaggagaccctggaaataaacaatgataaggttgctgagtcattaggaatcacagaattcctacggaagaaagaaatacacccagacaaccttggacccaagcacctcagccgagacatggatggggagcagctagagggagctagcagcgagaagagggaacgtgaggctgcggaggagggactggcctcagtgaaaaggcccagaagagaagccctgtccaacgataccactgaatctcttgctgccaacagcagaggccgggagaagcccaggcccttgcatgctttggccgctggtacaatagtgtctcaggaggaggacattgtcacagtgactgatgcagaggggcgtgcctgcggatgggcccgctagaaggagttcctctagaagctgtggagtcggtcgtcaccgtggagccagagccctcacagtgaagtggagtcagatcctagattcgtctgattttatccagagaaggtctatggcaagcaatgtatatttttctaatgtgaatattgcacagatgaaccttttatttataaagaataatgtctttctgc

SEQ ID NO: 203983 - DNA, 583 bp, Homo sapiens
  Payload ID: 20231
  Gene Name: zinc finger protein 839
  ENST ID: ENST00000560568
  CDS Start-End: 413-583
tttcaggtgtgagccacggcgcccggccactaaaaggtttttatggggtatataaagcatgattgttttattttacttttgggtgtgcaacactgtctagaatggtcagtctgtagacgttgaagagacattgccatctgaaccagaaaatggagctcttttgcgatcagagagataccaaggacctagaagacgcgcatgctcagagacccttgcagagtcccgcacagctgtcctccagcagagaagagctgctcagctacctggtggccctgctgcggcaggggagcagagggcgtcgccaagcaaagccaggctcaaggagttcctccagcagtgtgaccgggaggatctggtggaattggctctgcctcagctggctcaggttgtgaccgtgtatgagtttcttctgatgaaggttgaaaaagatcatctagcaaagccttttttcccagctatatataaggaatttgaagagttgcataaaatggttaagaaaatgtgccaagattacctcagtagttctggtctgtgttcccaggagaccctggaaataaacaatgataaggttgctgagtcatta

SEQ ID NO: 203984 - DNA, 2905 bp, Homo sapiens
  Payload ID: 20231
  Gene Name: zinc finger protein 839
  Uniprot ID: A8K0R7
  ENST ID: ENST00000559185
  CDS Start-End: 282-2717
gaaacactctcgttaacaattcaaactgtggtcccctcccagatgtataaatccaaatgtttaggggtgggcacagtactctgcatctccagacagcatcctccgctgattcggatgcatgatgacgtcagaacacttggatattgtggtaacttttgggccaggggctctgaaaccccgaagacctccccctgggagatccgggacagctcccagagaagcaactagaagccatttgtgtcaaggtaacgtctggagaaacaaaaggtcaggaaaggccaatgctcctaccgaccacaatccagccccaaactgcaagaaagagccagctgccccgggggaattcctgcctggtggggctccatatcgccagccctcagctgctcagggtacagccgcttgtgagaaccgagccacagtcctgcttcctaagtgacttatgccaacctcctgctcaggggtttgtacagagaccactgccagccctccaggtggtccctgcaaagagagtcccagcccccaaggctccagatgaacagggctccatgttgacccctttgtctgcctctgacccgctggcagtaacatctctttcatccagttcagcacatccatttatttccaacttgcatacaagacatactgagaaactaaaaaaatcgttaaaagtaaagacacgttctggacgggtatctcgacctcccaaatataaagctaaagattataagttcataaaaacagaggatctggcggatggtcatctgtcagattctgatgattactcagaactctgtgtggaagaagatgaagatcagagggagaggcacgcactctttgacttatcgagctgctccctgaggcccaaaagctttaagtgtcagacttgtgaaaagtcatatatagggaaggggggactggcccgacattttaaacttaacccaggccacggccagttggaccccgagatggtgctgtctgagaaagccagtggaagcaccctccgggggtgcacggaggaaaggacgctcagcctgacctccctggggctgtccatgccagcggatccatgtgagggaggggcccgctcctgcttggtgacagagtcagcacgcggtggcctgcagaatggtcagtctgtagacgttgaagagacattgccatctgaaccagaaaatggagctcttttgcgatcagagagataccaaggacctagaagacgcgcatgctcagagacccttgcagagtcccgcacagctgtcctccagcagagaagagctgctcagctacctggtggccctgctgcggcaggggagcagagggcgtcgccaagcaaagccaggctcaaggagttcctccagcagtgtgaccgggaggatctggtggaattggctctgcctcagctggctcaggttgtgaccgtgtatgagtttcttctgatgaaggttgaaaaagatcatctagcaaagccttttttcccagctatatataaggaatttgaagagttgcataaaatggttaagaaaatgtgccaagattacctcagtagttctggtctgtgttcccaggagaccctggaaataaacaatgataaggttgctgagtcattaggaatcacagaattcctacggaagaaagaaatacacccagacaaccttggacccaagcacctcagccgagacatggatggggagcagctagagggagctagcagcgagaagagggaacgtgaggctgcggaggagggactggcctcagtgaaaaggcccagaagagaagccctgtccaacgataccactgaatctcttgctgccaacagcagaggccgggagaagcccaggcccttgcatgctttggccgctggtttttcccctccagtaaatgtgactgtctctccccgttctgaagaaagccatacaacgacggtttctggtggcaatgggagcgtgttccaggcgggcccgcagcttcaggcactggctaacttagaagccaggagggggtctataggtgctgctctctcatcccgggatgtcagtgggctgcctgtttatgctcagtcaggagagcctaggaggctgacccaggcacaggtggcagcgtttcctggagagaatgctttggaacactcttcagaccaggacacctgggacagcctgaggagcccgggtttctgcagccctttgtcatctggtggtggagcagagtccctgccgcctggggggcctggacatgcagaggcaggacacctcggcaaggtttgtgacttccacctgaaccaccagcagcccagccccaccagcgtcctgcctacagaggtggcagcccctccgcttgagaaaattttgtctgtggatagcgtggcagtggactgtgcctacaggactgtgcccaagccagggcctcagcctggcccacatggatcactattgactgaagggtgtctcagaagcctttcgggggacttgaaccggttcccctgtgggatggaggtgcactctggccagagagaactggagagcgtggttgctgtcggcgaagccatggcttttgaaatttccaatgggagccatgagttactgtctcagggacagaagcagatttttattcagacttccgatgggcttatcttgtcccctccaggtacaatagtgtctcaggaggaggacattgtcacagtgactgatgcagaggggcgtgcctgcggatgggcccgctagaaggagttcctctagaagctgtggagtcggtcgtcaccgtggagccagagccctcacagtgaagtggagtcagatcctagattcgtctgattttatccagagaaggtctatggcaagcaatgtatatttttctaatgtgaatattgcacagatgaaccttttatttataaagaataatgtctttctgc

SEQ ID NO: 203985 - DNA, 1951 bp, Homo sapiens
  Payload ID: 20231
  Gene Name: zinc finger protein 839
  ENST ID: ENST00000561251
  CDS Start-End: 1-1428
ccatgtgagggaggggcccgctcctgcttggtgacagagtcagcacgcggtggcctgcagttcctccagcagtgtgaccgggaggatctggtggaattggctctgcctcagctggctcaggttgtgaccgtgtatgagtttcttctgatgaaggttgaaaaagatcatctagcaaagccttttttcccagctatatataaggaatttgaagagttgcataaaatggttaagaaaatgtgccaagattacctcagtagttctggtctgtgttcccaggagaccctggaaataaacaatgataaggttgctgagtcattaggaatcacagaattcctacggaagaaagaaatacacccagacaaccttggacccaagcacctcagccgagacatggatggggagcagctagagggagctagcagcgagaagagggaacgtgaggctgcggaggagggactggcctcagtgaaaaggcccagaagagaagccctgtccaacgataccactgaatctcttgctgccaacagcagaggccgggagaagcccaggcccttgcatgctttggccgctggtttttcccctccagtaaatgtgactgtctctccccgttctgaagaaagccatacaacgacggtttctggtggcaatgggagcgtgttccaggcgggcccgcagcttcaggcactggctaacttagaagccaggagggggtctataggtgctgctctctcatcccgggatgtcagtgggctgcctgtttatgctcagtcaggagagcctaggaggctgacccaggcacaggtggcagcgtttcctggagagaatgctttggaacactcttcagaccaggacacctgggacagcctgaggagcccgggtttctgcagccctttgtcatctggtggtggagcagagtccctgccgcctggggggcctggacatgcagaggcaggacacctcggcaaggtttgtgacttccacctgaaccaccagcagcccagccccaccagcgtcctgcctacagaggtggcagcccctccgcttgagaaaattttgtctgtggatagcgtggcagtggactgtgcctacaggactgtgcccaagccagggcctcagcctggcccacatggatcactattgactgaagggtgtctcagaagcctttcgggggacttgaaccggttcccctgtgggatggaggtgcactctggccagagagaactggagagcgtggttgctgtcggcgaagccatggcttttgaaatttccaatgggagccatgagttactgtctcagggacagaagcagatttttattcagacttccgatgggcttatcttgtcccctccaggtacaatagtgtctcaggaggaggacattgtcacagtgactgatgcagaggggcgtgcctgcggatgggcccgctagaaggagttcctctagaagctgtggagtcggtcgtcaccgtggagccagagccctcacagtgaagtggagtcagatcctagattcgtctgattttatccagagaaggtctatggcaagcaatgtatatttttctaatgtgaatattgcacagatgaaccttttatttataaagaataatgtctttctgccctgctgtctacatttttctatggagcttgtcataataatagcagatattacctgatcaggaatccctgtggcgcgtctgacgctcatgagtttttcatgatggtgatgagtagcactgcactgtcacctgatgattggccctgctccgtttcccttctctcctgggagatatgctgcttttccaccagacttgctccatactagaagcttcttttgggttcaattaaaaagaaaataagctagtcattctgggcagcattttattgatagaagggggaaaaagtcatttctacttgcatgattttttaaattaaattaaattaaattaatttaa

SEQ ID NO: 203986 - DNA, 2971 bp, Homo sapiens
  Payload ID: 20231
  Gene Name: zinc finger protein 839
  Uniprot ID: A8K0R7
  ENST ID: ENST00000558850
  CDS Start-End: 351-2786
agaatgccattggttaggccttttacttttgtcgttttaaaggacactctggacatccaaccgatgcacatcccacgcccccaccccccacgtttcctgaggctgcgtctggcctggaggaaccgcccagtgaagacaggtgctcgcagatatcaccgcctagtgttccctgggcccacttgcggggaagtcttggaggtgaaaatccaggtctggaatgaatgcattccacagatgcatatggagagctactgcatgcccagcaccattcctaggctgggagcaaaacgcaactagaagccatttgtgtcaaggtaacgtctggagaaacaaaaggtcaggaaaggccaatgctcctaccgaccacaatccagccccaaactgcaagaaagagccagctgccccgggggaattcctgcctggtggggctccatatcgccagccctcagctgctcagggtacagccgcttgtgagaaccgagccacagtcctgcttcctaagtgacttatgccaacctcctgctcaggggtttgtacagagaccactgccagccctccaggtggtccctgcaaagagagtcccagcccccaaggctccagatgaacagggctccatgttgacccctttgtctgcctctgacccgctggcagtaacatctctttcatccagttcagcacatccatttatttccaacttgcatacaagacatactgagaaactaaaaaaatcgttaaaagtaaagacacgttctggacgggtatctcgacctcccaaatataaagctaaagattataagttcataaaaacagaggatctggcggatggtcatctgtcagattctgatgattactcagaactctgtgtggaagaagatgaagatcagagggagaggcacgcactctttgacttatcgagctgctccctgaggcccaaaagctttaagtgtcagacttgtgaaaagtcatatatagggaaggggggactggcccgacattttaaacttaacccaggccacggccagttggaccccgagatggtgctgtctgagaaagccagtggaagcaccctccgggggtgcacggaggaaaggacgctcagcctgacctccctggggctgtccatgccagcggatccatgtgagggaggggcccgctcctgcttggtgacagagtcagcacgcggtggcctgcagaatggtcagtctgtagacgttgaagagacattgccatctgaaccagaaaatggagctcttttgcgatcagagagataccaaggacctagaagacgcgcatgctcagagacccttgcagagtcccgcacagctgtcctccagcagagaagagctgctcagctacctggtggccctgctgcggcaggggagcagagggcgtcgccaagcaaagccaggctcaaggagttcctccagcagtgtgaccgggaggatctggtggaattggctctgcctcagctggctcaggttgtgaccgtgtatgagtttcttctgatgaaggttgaaaaagatcatctagcaaagccttttttcccagctatatataaggaatttgaagagttgcataaaatggttaagaaaatgtgccaagattacctcagtagttctggtctgtgttcccaggagaccctggaaataaacaatgataaggttgctgagtcattaggaatcacagaattcctacggaagaaagaaatacacccagacaaccttggacccaagcacctcagccgagacatggatggggagcagctagagggagctagcagcgagaagagggaacgtgaggctgcggaggagggactggcctcagtgaaaaggcccagaagagaagccctgtccaacgataccactgaatctcttgctgccaacagcagaggccgggagaagcccaggcccttgcatgctttggccgctggtttttcccctccagtaaatgtgactgtctctccccgttctgaagaaagccatacaacgacggtttctggtggcaatgggagcgtgttccaggcgggcccgcagcttcaggcactggctaacttagaagccaggagggggtctataggtgctgctctctcatcccgggatgtcagtgggctgcctgtttatgctcagtcaggagagcctaggaggctgacccaggcacaggtggcagcgtttcctggagagaatgctttggaacactcttcagaccaggacacctgggacagcctgaggagcccgggtttctgcagccctttgtcatctggtggtggagcagagtccctgccgcctggggggcctggacatgcagaggcaggacacctcggcaaggtttgtgacttccacctgaaccaccagcagcccagccccaccagcgtcctgcctacagaggtggcagcccctccgcttgagaaaattttgtctgtggatagcgtggcagtggactgtgcctacaggactgtgcccaagccagggcctcagcctggcccacatggatcactattgactgaagggtgtctcagaagcctttcgggggacttgaaccggttcccctgtgggatggaggtgcactctggccagagagaactggagagcgtggttgctgtcggcgaagccatggcttttgaaatttccaatgggagccatgagttactgtctcagggacagaagcagatttttattcagacttccgatgggcttatcttgtcccctccaggtacaatagtgtctcaggaggaggacattgtcacagtgactgatgcagaggggcgtgcctgcggatgggcccgctagaaggagttcctctagaagctgtggagtcggtcgtcaccgtggagccagagccctcacagtgaagtggagtcagatcctagattcgtctgattttatccagagaaggtctatggcaagcaatgtatatttttctaatgtgaatattgcacagatgaaccttttatttataaagaataatgtctttc

SEQ ID NO: 203987 - DNA, 1770 bp, Homo sapiens
  Payload ID: 20231
  Gene Name: zinc finger protein 839
  ENST ID: ENST00000559155
  CDS Start-End: 1-1582
cgttgaagagacattgccatctgaaccagaaaatggagctcttttgcgatcagagagataccaaggacctagaagacgcgcatgctcagagacccttgcagagtcccgcacagctgtcctccagcagagaagagctgctcagctacctggtggccctgctgcggcaggggagcagagggcgtcgccaagcaaagccaggctcaaggagttcctccagcagtgtgaccgggaggatctggtggaattggctctgcctcagctggctcaggttgtgaccgtgtatgagtttcttctgatgaaggttgaaaaagatcatctagcaaagccttttttcccagctatatataaggaatttgaagagttgcataaaatggttaagaaaatgtgccaagattacctcagtagttctggtctgtgttcccaggagaccctggaaataaacaatgataaggttgctgagtcattaggaatcacagaattcctacggaagaaagaaatacacccagacaaccttggacccaagcacctcagccgagacatggatggggagcagctagagggagctagcagcgagaagagggaacgtgaggctgcggaggagggactggcctcagtgaaaaggcccagaagagaagccctgtccaacgataccactgaatctcttgctgccaacagcagaggccgggagaagcccaggcccttgcatgctttggccgctggtgagggtttttcccctccagtaaatgtgactgtctctccccgttctgaagaaagccatacaacgacggtttctggtggcaatgggagcgtgttccaggcgggcccgcagcttcaggcactggctaacttagaagccaggagggggtctataggtgctgctctctcatcccgggatgtcagtgggctgcctgtttatgctcagtcaggagagcctaggaggctgacccaggcacaggtggcagcgtttcctggagagaatgctttggaacactcttcagaccaggacacctgggacagcctgaggagcccgggtttctgcagccctttgtcatctggtggtggagcagagtccctgccgcctggggggcctggacatgcagaggcaggacacctcggcaaggtttgtgacttccacctgaaccaccagcagcccagccccaccagcgtcctgcctacagaggtggcagcccctccgcttgagaaaattttgtctgtggatagcgtggcagtggactgtgcctacaggactgtgcccaagccagggcctcagcctggcccacatggatcactattgactgaagggtgtctcagaagcctttcgggggacttgaaccggttcccctgtgggatggaggtgcactctggccagagagaactggagagcgtggttgctgtcggcgaagccatggcttttgaaatttccaatgggagccatgagttactgtctcagggacagaagcagatttttattcagacttccgatgggcttatcttgtcccctccaggtacaatagtgtctcaggaggaggacattgtcacagtgactgatgcagaggggcgtgcctgcggatgggcccgctagaaggagttcctctagaagctgtggagtcggtcgtcaccgtggagccagagccctcacagtgaagtggagtcagatcctagattcgtctgattttatccagagaaggtctatggcaagcaatgtatatttttctaatgtgaatattgcacagatgaaccttttatttataaagaataatgtctttctgc

SEQ ID NO: 203988 - DNA, 2865 bp, Homo sapiens
  Payload ID: 20231
  Gene Name: zinc finger protein 839
  ENST ID: ENST00000559098
  CDS Start-End: 1-1482
gcggcgcggcggctgcgggacgcggcccaacaggccgccctgcagcggggccggggcaccgagcccccgcgcctgccgcgcctgctcccgccccagcaactagaagccatttgtgtcaaggtaacgtctggagaaacaaaaggtcaggaaaggccaatgctcctaccgaccacaatccagccccaaactgcaagaaagagccagctgccccgggggaattcctgcctggtggggctccatatcgccagccctcagctgctcagggtacagccgcttgtgagaaccgagccacagtcctgcttcctaagtgacttatgccaacctcctgctcaggggtttgtacagagaccactgccagccctccaggtggtccctgcaaagagagtcccagcccccaaggctccagatgaacagggctccatgttgacccctttgtctgcctctgacccgctggcagtaacatctctttcatccagttcagcacatccatttatttccaacttgcatacaagacatactgagaaactaaaaaaatcgttaaaagtaaagacacgttctggacgggtatctcgacctcccaaatataaagctaaagattataagttcataaaaacagaggatctggcggatggtcatctgtcagattctgatgattactcagaactctgtgtggaagaagatgaagatcagagggagaggcacgcactctttgacttatcgagctgctccctgaggcccaaaagctttaagtgtcagacttgtgaaaagtcatatatagggaaggggggactggcccgacattttaaacttaacccaggccacggccagttggaccccgagatggtgctgtctgagaaagccagtggaagcaccctccgggggtgcacggaggaaaggacgctcagcctgacctccctggggctgtccatgccagcggatccatgtgagggaggggcccgctcctgcttggtgacagagtcagcacgcggtggcctgcagaatggtcagtctgtagacgttgaagagacattgccatctgaaccagaaaatggagctcttttgcgatcagagagataccaaggacctagaagacgcgcatgctcagagacccttgcagagtcccgcacagctgtcctccagcagagaagagctgctcagctacctggtggccctgctgcggcaggggagcagagggcgtcgccaagcaaagccaggctcaaggagttcctccagcagtgtgaccgggaggatctggtggaattggctctgcctcagctggctcaggttgtgaccgtgtatgagtttcttctgatgaaggttgaaaaagatcatctagcaaagccttttttcccagctatatataaggaatttgaagagttgcataaaatggttaagaaaatgtgccaagattacctcagtagttctggtctgtgttcccaggagaccctggaaataaacaatgataagaaaactcaaaaatgaagataagctagaagaaaatggaaaacaccataatcttcccactcactgatgatcagagttaaaacctcaggttgctgagtcattaggaatcacagaattcctacggaagaaagaaatacacccagacaaccttggacccaagcacctcagccgagacatggatggggagcagctagagggagctagcagcgagaagagggaacgtgaggctgcggaggagggactggcctcagtgaaaaggcccagaagagaagccctgtccaacgataccactgaatctcttgctgccaacagcagaggccgggagaagcccaggcccttgcatgctttggccgctggtttttcccctccagtaaatgtgactgtctctccccgttctgaagaaagccatacaacgacggtttctggtggcaatgggagcgtgttccaggcgggcccgcagcttcaggcactggctaacttagaagccaggagggggtctataggtgctgctctctcatcccgggatgtcagtgggctgcctgtttatgctcagtcaggagagcctaggaggctgacccaggcacaggtggcagcgtttcctggagagaatgctttggaacactcttcagaccaggacacctgggacagcctgaggagcccgggtttctgcagccctttgtcatctggtggtggagcagagtccctgccgcctggggggcctggacatgcagaggcaggacacctcggcaaggtttgtgacttccacctgaaccaccagcagcccagccccaccagcgtcctgcctacagaggtggcagcccctccgcttgagaaaattttgtctgtggatagcgtggcagtggactgtgcctacaggactgtgcccaagccagggcctcagcctggcccacatggatcactattgactgaagggtgtctcagaagcctttcgggggacttgaaccggttcccctgtgggatggaggtgcactctggccagagagaactggagagcgtggttgctgtcggcgaagccatggcttttgaaatttccaatgggagccatgagttactgtctcagggacagaagcagatttttattcagacttccgatgggcttatcttgtcccctccaggtacaatagtgtctcaggaggaggacattgtcacagtgactgatgcagaggggcgtgcctgcggatgggcccgctagaaggagttcctctagaagctgtggagtcggtcgtcaccgtggagccagagccctcacagtgaagtggagtcagatcctagattcgtctgattttatccagagaaggtctatggcaagcaatgtatatttttctaatgtgaatattgcacagatgaaccttttatttataaagaataatgtctttctgc

SEQ ID NO: 203989 - DNA, 876 bp, Homo sapiens
  Payload ID: 20231
  Gene Name: zinc finger protein 839
  ENST ID: ENST00000560112
  CDS Start-End: 1-433
ggttgaaaaagatcatctagcaaagccttttttcccagctatatataaggaatttgaagagttgcataaaatggttaagaaaatgtgccaagattacctcagtagttctggtctgtgttcccaggagaccctggaaataaacaatgataaggttgctgagtcattaggaatcacagaattcctacggaagaaagaaatacacccagacaaccttggacccaagcacctcagccgagacatggatggggagcagctagagggagctagcagcgagaagagggaacgtgaggctgcggaggagggactggcctcagtgaaaaggcccagaagagaagccctgtccaacgataccactgaatctcttgctgccaacagcagaggccgggagaagcccaggcccttgcatgctttggccgctgtcaggagagcctaggaggctgacccaggcacaggtggcagcgtttcctggagagaatgctttggaacactcttcagaccaggacacctgggacagcctgaggagcccgggtttctgcagccctttgtcatctggtggtggagcagagtccctgccgcctggggggcctggacatgcagaggcaggacacctcggcaaggtttgtgacttccacctgaaccaccagcagcccagccccaccagcgtcctgcctacagaggtggcagcccctccgcttgagaaaattttgtctgtggatagcgtggcagtggactgtgcctacaggactgtgcccaagccagggcctcagcctggcccacatggatcactattgactgaagggtgtctcagaagcctttcgggggacttgaaccggttcccctgtgggatggaggtgcactctggccagagagaactgg

SEQ ID NO: 203990 - DNA, 756 bp, Homo sapiens
  Payload ID: 20231
  Gene Name: zinc finger protein 839
  ENST ID: ENST00000558462
  CDS Start-End: 1-571
acgcgcatgctcagagacccttgcagagtcccgcacagctgtcctccagcagagaagagctgctcagctacctggtggccctgctgcggcaggggagcagagggcgtcgccaagcaaagccaggctcaaggagttcctccagcagtgtgaccgggaggatctggtggaattggctctgcctcagctggctcaggttgtgaccgtgtatgagtttcttctgatgaaggttgctgagtcattaggaatcacagaattcctacggaagaaagaaatacacccagacaaccttggacccaagcacctcagccgagacatggatggggagcagctagagggagctagcagcgagaagagggaacgtgaggctgcggaggagggactggcctcagtgaaaaggcccagaagagaagccctgtccaacgataccactgaatctcttgctgccaacagcagaggccgggagaagcccaggcccttgcatgctttggccgctggtacaatagtgtctcaggaggaggacattgtcacagtgactgatgcagaggggcgtgcctgcggatgggcccgctagaaggagttcctctagaagctgtggagtcggtcgtcaccgtggagccagagccctcacagtgaagtggagtcagatcctagattcgtctgattttatccagagaaggtctatggcaagcaatgtatatttttctaatgtgaatattgcacagatgaaccttttatttataaagaataatgtctttc

SEQ ID NO: 203991 - DNA, 7162 bp, Homo sapiens
  Payload ID: 20232
  Gene Name: zinc finger protein 84
  Uniprot ID: P51523
  ENST ID: ENST00000327668
  CDS Start-End: 581-2797
gggggctccgggaatggcgggggaggcgcgcgggagtggccgcggggagcttcggcttcaaggccctgggcgtccgcgcgcggatgcgggtctggggcgggttggggctgggccgggtcgtgaagatgccgtgggccgcggagctgcgcggattctgggctgtggggcgggcacggcctttccggaggcgccgctcctgggcgtcctttcaggcgggcgtggaggcgccagcctcgggcgcgtttagcctcgggcgcgtttagcctcgacctcgggccagcccgcttgccgcgccgtggccctaaggagcggctgccctgctggaccgcatccaccagcagcctggctctgccgctatcgaaggaggcttttaaagcgctggggttacagtccacagatcctggtccctacaaataagcctgctcatgtgagataagaaaggagttcctggaaccaggaattcattctcagtgtagaagacctagctgagacctcactccacagttttggggcagaagcagaagagacgcacagtagaaccgatctcagccttgctgatcatctcgtacagcagcagaaaatgaccatgttacaggagtcattctcatttgacgatttatctgtggacttcacccaaaaggagtggcagctactggatccctctcagaagaatttatacaaggatgtgatgttggagaactatagcagcctagtgtcactggggtatgaagttatgaaaccagatgtcatcttcaaattggagcaaggagaagagccgtgggtaggagatggagaaattccaagttcagattctccagaagtctggaaagtagatggtaacatgatgtggcaccaggataaccaagacaagcttaaaattataaaaagaggtcatgaatgtgatgcatttggaaaaaatttcaatctgaacatgaactttgttcctttaaggaaatcaaacagtgaaggtgacttagatggattgattttaaaacatcatttagatttgcttattccaaaaggagattatggaaaagcagaatcagatgactttaatgtgtttgataatttttttctccattccaagcctgaggatactgatacctggttaaaatactatgactgtgataaatataaagagagctataaaaagtcacagattatcatatatcatagaaatcgtttaggggagaaactctatgaatgcagtgaatgtaggaagcgcttcagtaagaaaccaagtctcattaaacatcagagcagacatataagagacatagcctttggctgtggtaattgtggcaaaacctttccccagaagtctcagtttattacacatcacagaactcatacaggagaaaaaccttataattgtagccagtgtgggaaagccttctcccaaaagtcacagctcacatcccatcagcggacacatacaggagagaaaccttatgagtgtggtgaatgtgggaaagccttctcccggaagtcacatctcatatcgcattggagaacacacacaggagagaaaccctatggatgcaatgaatgtgggagggcctttagtgaaaagtccaatctcattaaccatcagagaattcataccggtgagaagccttttgaatgcagggaatgtgggaaagccttcagcaggaagtcacaactcgttacacatcacagaactcacacaggaacaaaaccctttggatgtagtgattgtagaaaagcattctttgagaagtcagagcttattagacatcagacaattcatactggagagaaaccctatgaatgcagcgagtgtaggaaagcatttagagagaggtcgagtctcattaatcatcagagaacacatacaggagagaaacctcatggatgcattcagtgtgggaaggccttctcccagaagtcacatctcatatcacatcagatgacacacacaggagaaaaaccctttatatgcagtaaatgtgggaaagccttcagcaggaaatcacagctcgttagacatcagagaactcatacgggagaaaaaccgtatgaatgcagtgagtgtgggaaagctttcagtgaaaaattaagtctcactaatcatcaaagaattcatacaggagaaaaaccatatgtatgcagtgaatgtgggaaagccttttgtcagaagtcacatctcatatcacatcagaggacacatacaggggagaaaccctatgaatgcagtgaatgtgggaaggcctttggtgagaagtcaagtcttgcaactcatcagagaactcatactggagaaaaaccgtatgaatgcagggactgtgaaaaagctttctcccagaaatcacagctaaatacccatcagagaattcacactggagagaaaccctatgaatgcagtctttgtaggaaagctttttttgagaagtcggagctaattagacatctgagaactcatacaggagaaaaaccttatgaatgcaatgaatgtagaaaagccttcagggagaagtcaagtctcatcaatcatcagagaatacatacaggagagaagccttttgaatgcagtgagtgtggcaaagctttctctcggaagtcacaccttataccacatcaaaggacacatacgggtgagaaaccctatggatgcagtgaatgtaggaaggccttctctcagaagtcacagctggttaatcatcagagaattcatacaggagagaagccttatcgatgcattgaatgtgggaaagctttctcacagaagtcacagctcatcaatcatcagagaactcatacagtaaaaaaatcctaggaatacagttaatagtagtctttgacagatcatcttggacttcaggaaatgcaattatgataacgtttgtagacagtcacgtcatgttaggtgtttgtactccatgaggatgagaactctaaatgaggtggtgtatggaaagccgatcataattcatagagtagagtgaacctatgactgcagtggatctcaaaaacttttaaaaccatagacaagccttatagagtagaacattcacagcaaagaagaatcctgtgaatgtccaaaagccttccagaagtcaagtctcttaagctattagaaatattcccactggggatgagggaaaaccccatgaatgcgggaaatgaggcaatatttttaagaaatgacagttcattgtacataagaaaatgctcttaggaatgaagttctatgaaagtactaaatatgggacagtgcaacaagtaacgagactattttgtattttggagaattcatattatggagaacctaacaatttaaagacactgggaacacttgcccctcagtatagtactgtcaagggaagccatacactttttgtagacatgggtaccaaaaatacccaattctaagtggttgacagatgttcactttgaagtgtgaagttttaaaaatacgtgaataaattggttattgaaacatctaagacatttcttagtggtatttgtggcttatcttctagtgtcacgtatgttttgtgttttggacttacctataatttaatgtaattgggagtatgaaatgcatatgccttttagtgcctctgatgtctgtgaagacaacactacacaccactggtttttattttttaacaataatataaaaaatggaaactcatgtaacatgactacatgaataagtaccttaagtgataacccgtttcttttaacttatagacatacataaggggtcttttgtttttatggacctttctattcagtaactgaagccaacattgtgtaagtcttctgcatcctcagagtctgagtaacagtttatataaaataaatatgcaaaggcaggaaccacagaataaccatagtaatatataactgaatgagcaaaataaaggtgtgtgaactacattacaacacccaaactaaatgaaataaagtagtgctgtattaaatctttttctcatttagtgaggtgcctccatatagtatatatatatgtatcttaagtgatatgtaacccaaatgtcactattttaatttactgtgataaagtatcatggatattttgtgctgctgttatgctttttgtgttgcataaaatatcttgtaaaaattagatggataaatgaattattaaaaaatcacatttctgaagatgtaaagtattagggaattttgtgctggaaaaacatttttgacattcaaggatgcctattttatcttctagcaaatttctgtggtccctggaaaagtacagatgatcctggacttacagtggggttacctcccaataaacccattgtaagttgaaaacattgtaagtcaaaaatgcatttaatacacccaacttaccaaacatcatagcttagcgtagcctaccttaaacattctcagaacacattctaatgcatcatctattttataaaaaggtgttgaatatctgatgtaattattgaatactgaaggtgaaaaatagtagtgtatggataccattgtaatgttgagaaactgtaagtcacatcctcttaagtcaggaactatctgtataaggaaacaagatttccattttatcatttgaaatgtatttgactttgtttcactagttgcattatccccatggaaaacttcacattgagaacttaccattatatatttccataaaaatgcatgaaccatcccttagctaagtaaggattttgtaatgttctctcaataatgttgcttggcaaagttaatattttttgtatgctgatgaaatttagaaaagtccaatattgagcttgattgcaaacttagaaaaactcaagacttctccttttatgttcaaattgttgtatcagtatggtattttgcacctttaccttaaacaatattttctcctttaattattgattttgcaacattttgggaaagttggaattttaaataaatgaataattttctaaaccagaataccagttcaacagccaaataattctgtctttccatgctgtaattttaaagcatttaattttccaactttttgttcatactcaagtgtatgaacttcctggctgggcacagtggctcatgcctgtaatcccagcactttgggaggctgaggacctcaagtggagacctcaagtggatcacttgaggtcaggagttgaagaccagcatgttcatggccaacatggcaaaaccctgtcttaaattagccgggcatggttgtgcgtgcctgtaatcccagttactcaggaggctgaggcaggagaatcacttgaacctgagaggcagaggttgcagtgagccaagattgtgcagcctgggcgacagagcgagcctctgtcaaaaaaagaaaagaaaaagaacttcctactttttaatatctcaaattcattttactagacgtgggagaccaactaatgcaaatgaacagttacagggtgatgttgtactttgtgatttttgccctattttttctttccatctatcaccattctctttccaatcccagagattgatttattaggtcttggaaattctagattattccattaactattaagcagttaaacctgatacttcctacactagataatggaacttcaacattagcctattgattgcccaagaacaaacatttttttctaaatgtcaggtgttatggggaggattgatgctgacagcagaggtctagttaaaaactgatgcagaggttcaaatacgttgtgcagtaatcactagaactcaccttctaaagtgtcatgagagctctgattctgcaattagagattttttaatgtgtttttgaaattaccttgtaaaccacaaatctgtgtctctgcattgccccttattgtttcctaccacaaattctacatcaagaagaaagttttaaagttagactggatttatttgtgattttatggagcacaataaggtacattgagatagcatactaaaggaggccaaatacaggaagcatcatcttttcttattctcttactgcctggattttcccactgacctggaattgtgcacagttctacaaaggacaattgacattgttttccttttactaagtagtgggttttccttaaggtccagactgaattttgagacctgtatcaggattgccttctgtgtgactttttcttgcaggatctgacatcattacctatgggtccatatatttgtgatactttggtttcgggaacatcacttttagaatgttgacataaaatgcacccacagaatgccgtatttatcaaaagtaactttctagcaaaatctacagcagtaggcatttggaatctgcatttgagacctctgcagtcatttggtcattccagcaatctatgtccaggttgtcaatttcagaggtcttattagtctatacaggtaccaatgagctttcagatgttcaacacctacccctggcctaactgctgataaccaaccataacccttgcagatgcatgcatgttttctgcaccttgctatcatttttcagtccatttttcacatgtatacatagtgattatttttaaatgcaaccctgatttcacatgcctcatgttgaaatatcgtgtggcttattgtggacttaaagtgtaacattctccttatggtatgtaaggacttttgtataaaccaatgcctatctatctatcatttctgaaaactttttcctcctatgcaatattttctggcctctgtgaacaacttgtagttccttgagatttctattatcacttatgtttttgcaaatctgcaattgaaatgcccttgttccttgttaatgcctattgaatctatatgaacctgtacgtgtgtttctcactgtgataatataatcattgcatgttttatctttcccactagaaagcttctagaaagctagtactatcttttttgtctgtgtaatttttgcatcacaagctatatttaaatgtgggtgcagtgagtggctgttttctgccacatggagaaacatggtctgcagtgagagagaagaatgaagccatgatgaaagcaaaatcaagaaagagtcccgattgtgttccagtacctggttcttctggtcttcatgttcaggtccacctctgcccttttcatgtcttgattgttgaattcttctgtgagatactccaaatatcctaataaattctcatgtttgctt

SEQ ID NO: 203992 - DNA, 7020 bp, Homo sapiens
  Payload ID: 20232
  Gene Name: zinc finger protein 84
  Uniprot ID: P51523
  ENST ID: ENST00000392319
  CDS Start-End: 438-2654
actcttggtaatgcttgcaggtggcccgttcttcctctttgtccttcgctgccacgtgagaggggagtgtacgcgtgtgcgcgcgtgcgagtgtgcgcgtgtgcagtccccgactcgtcccggcccgttcggagccgcccgggagcgcacaaaggccgacggtttgggcgcgtgcgcgggacacgggggacgggcggtgtcacgtgatcgcgaggccgcgggcgcgcgggcgcgactcggcggcggcgtcttttatcctggtccctacaaataagcctgctcatgtgagataagaaaggagttcctggaaccaggaattcattctcagtgtagaagacctagctgagacctcactccacagttttggggcagaagcagaagagacgcacagtagaaccgatctcagccttgctgatcatctcgtacagcagcagaaaatgaccatgttacaggagtcattctcatttgacgatttatctgtggacttcacccaaaaggagtggcagctactggatccctctcagaagaatttatacaaggatgtgatgttggagaactatagcagcctagtgtcactggggtatgaagttatgaaaccagatgtcatcttcaaattggagcaaggagaagagccgtgggtaggagatggagaaattccaagttcagattctccagaagtctggaaagtagatggtaacatgatgtggcaccaggataaccaagacaagcttaaaattataaaaagaggtcatgaatgtgatgcatttggaaaaaatttcaatctgaacatgaactttgttcctttaaggaaatcaaacagtgaaggtgacttagatggattgattttaaaacatcatttagatttgcttattccaaaaggagattatggaaaagcagaatcagatgactttaatgtgtttgataatttttttctccattccaagcctgaggatactgatacctggttaaaatactatgactgtgataaatataaagagagctataaaaagtcacagattatcatatatcatagaaatcgtttaggggagaaactctatgaatgcagtgaatgtaggaagcgcttcagtaagaaaccaagtctcattaaacatcagagcagacatataagagacatagcctttggctgtggtaattgtggcaaaacctttccccagaagtctcagtttattacacatcacagaactcatacaggagaaaaaccttataattgtagccagtgtgggaaagccttctcccaaaagtcacagctcacatcccatcagcggacacatacaggagagaaaccttatgagtgtggtgaatgtgggaaagccttctcccggaagtcacatctcatatcgcattggagaacacacacaggagagaaaccctatggatgcaatgaatgtgggagggcctttagtgaaaagtccaatctcattaaccatcagagaattcataccggtgagaagccttttgaatgcagggaatgtgggaaagccttcagcaggaagtcacaactcgttacacatcacagaactcacacaggaacaaaaccctttggatgtagtgattgtagaaaagcattctttgagaagtcagagcttattagacatcagacaattcatactggagagaaaccctatgaatgcagcgagtgtaggaaagcatttagagagaggtcgagtctcattaatcatcagagaacacatacaggagagaaacctcatggatgcattcagtgtgggaaggccttctcccagaagtcacatctcatatcacatcagatgacacacacaggagaaaaaccctttatatgcagtaaatgtgggaaagccttcagcaggaaatcacagctcgttagacatcagagaactcatacgggagaaaaaccgtatgaatgcagtgagtgtgggaaagctttcagtgaaaaattaagtctcactaatcatcaaagaattcatacaggagaaaaaccatatgtatgcagtgaatgtgggaaagccttttgtcagaagtcacatctcatatcacatcagaggacacatacaggggagaaaccctatgaatgcagtgaatgtgggaaggcctttggtgagaagtcaagtcttgcaactcatcagagaactcatactggagaaaaaccgtatgaatgcagggactgtgaaaaagctttctcccagaaatcacagctaaatacccatcagagaattcacactggagagaaaccctatgaatgcagtctttgtaggaaagctttttttgagaagtcggagctaattagacatctgagaactcatacaggagaaaaaccttatgaatgcaatgaatgtagaaaagccttcagggagaagtcaagtctcatcaatcatcagagaatacatacaggagagaagccttttgaatgcagtgagtgtggcaaagctttctctcggaagtcacaccttataccacatcaaaggacacatacgggtgagaaaccctatggatgcagtgaatgtaggaaggccttctctcagaagtcacagctggttaatcatcagagaattcatacaggagagaagccttatcgatgcattgaatgtgggaaagctttctcacagaagtcacagctcatcaatcatcagagaactcatacagtaaaaaaatcctaggaatacagttaatagtagtctttgacagatcatcttggacttcaggaaatgcaattatgataacgtttgtagacagtcacgtcatgttaggtgtttgtactccatgaggatgagaactctaaatgaggtggtgtatggaaagccgatcataattcatagagtagagtgaacctatgactgcagtggatctcaaaaacttttaaaaccatagacaagccttatagagtagaacattcacagcaaagaagaatcctgtgaatgtccaaaagccttccagaagtcaagtctcttaagctattagaaatattcccactggggatgagggaaaaccccatgaatgcgggaaatgaggcaatatttttaagaaatgacagttcattgtacataagaaaatgctcttaggaatgaagttctatgaaagtactaaatatgggacagtgcaacaagtaacgagactattttgtattttggagaattcatattatggagaacctaacaatttaaagacactgggaacacttgcccctcagtatagtactgtcaagggaagccatacactttttgtagacatgggtaccaaaaatacccaattctaagtggttgacagatgttcactttgaagtgtgaagttttaaaaatacgtgaataaattggttattgaaacatctaagacatttcttagtggtatttgtggcttatcttctagtgtcacgtatgttttgtgttttggacttacctataatttaatgtaattgggagtatgaaatgcatatgccttttagtgcctctgatgtctgtgaagacaacactacacaccactggtttttattttttaacaataatataaaaaatggaaactcatgtaacatgactacatgaataagtaccttaagtgataacccgtttcttttaacttatagacatacataaggggtcttttgtttttatggacctttctattcagtaactgaagccaacattgtgtaagtcttctgcatcctcagagtctgagtaacagtttatataaaataaatatgcaaaggcaggaaccacagaataaccatagtaatatataactgaatgagcaaaataaaggtgtgtgaactacattacaacacccaaactaaatgaaataaagtagtgctgtattaaatctttttctcatttagtgaggtgcctccatatagtatatatatatgtatcttaagtgatatgtaacccaaatgtcactattttaatttactgtgataaagtatcatggatattttgtgctgctgttatgctttttgtgttgcataaaatatcttgtaaaaattagatggataaatgaattattaaaaaatcacatttctgaagatgtaaagtattagggaattttgtgctggaaaaacatttttgacattcaaggatgcctattttatcttctagcaaatttctgtggtccctggaaaagtacagatgatcctggacttacagtggggttacctcccaataaacccattgtaagttgaaaacattgtaagtcaaaaatgcatttaatacacccaacttaccaaacatcatagcttagcgtagcctaccttaaacattctcagaacacattctaatgcatcatctattttataaaaaggtgttgaatatctgatgtaattattgaatactgaaggtgaaaaatagtagtgtatggataccattgtaatgttgagaaactgtaagtcacatcctcttaagtcaggaactatctgtataaggaaacaagatttccattttatcatttgaaatgtatttgactttgtttcactagttgcattatccccatggaaaacttcacattgagaacttaccattatatatttccataaaaatgcatgaaccatcccttagctaagtaaggattttgtaatgttctctcaataatgttgcttggcaaagttaatattttttgtatgctgatgaaatttagaaaagtccaatattgagcttgattgcaaacttagaaaaactcaagacttctccttttatgttcaaattgttgtatcagtatggtattttgcacctttaccttaaacaatattttctcctttaattattgattttgcaacattttgggaaagttggaattttaaataaatgaataattttctaaaccagaataccagttcaacagccaaataattctgtctttccatgctgtaattttaaagcatttaattttccaactttttgttcatactcaagtgtatgaacttcctggctgggcacagtggctcatgcctgtaatcccagcactttgggaggctgaggacctcaagtggagacctcaagtggatcacttgaggtcaggagttgaagaccagcatgttcatggccaacatggcaaaaccctgtcttaaattagccgggcatggttgtgcgtgcctgtaatcccagttactcaggaggctgaggcaggagaatcacttgaacctgagaggcagaggttgcagtgagccaagattgtgcagcctgggcgacagagcgagcctctgtcaaaaaaagaaaagaaaaagaacttcctactttttaatatctcaaattcattttactagacgtgggagaccaactaatgcaaatgaacagttacagggtgatgttgtactttgtgatttttgccctattttttctttccatctatcaccattctctttccaatcccagagattgatttattaggtcttggaaattctagattattccattaactattaagcagttaaacctgatacttcctacactagataatggaacttcaacattagcctattgattgcccaagaacaaacatttttttctaaatgtcaggtgttatggggaggattgatgctgacagcagaggtctagttaaaaactgatgcagaggttcaaatacgttgtgcagtaatcactagaactcaccttctaaagtgtcatgagagctctgattctgcaattagagattttttaatgtgtttttgaaattaccttgtaaaccacaaatctgtgtctctgcattgccccttattgtttcctaccacaaattctacatcaagaagaaagttttaaagttagactggatttatttgtgattttatggagcacaataaggtacattgagatagcatactaaaggaggccaaatacaggaagcatcatcttttcttattctcttactgcctggattttcccactgacctggaattgtgcacagttctacaaaggacaattgacattgttttccttttactaagtagtgggttttccttaaggtccagactgaattttgagacctgtatcaggattgccttctgtgtgactttttcttgcaggatctgacatcattacctatgggtccatatatttgtgatactttggtttcgggaacatcacttttagaatgttgacataaaatgcacccacagaatgccgtatttatcaaaagtaactttctagcaaaatctacagcagtaggcatttggaatctgcatttgagacctctgcagtcatttggtcattccagcaatctatgtccaggttgtcaatttcagaggtcttattagtctatacaggtaccaatgagctttcagatgttcaacacctacccctggcctaactgctgataaccaaccataacccttgcagatgcatgcatgttttctgcaccttgctatcatttttcagtccatttttcacatgtatacatagtgattatttttaaatgcaaccctgatttcacatgcctcatgttgaaatatcgtgtggcttattgtggacttaaagtgtaacattctccttatggtatgtaaggacttttgtataaaccaatgcctatctatctatcatttctgaaaactttttcctcctatgcaatattttctggcctctgtgaacaacttgtagttccttgagatttctattatcacttatgtttttgcaaatctgcaattgaaatgcccttgttccttgttaatgcctattgaatctatatgaacctgtacgtgtgtttctcactgtgataatataatcattgcatgttttatctttcccactagaaagcttctagaaagctagtactatcttttttgtctgtgtaatttttgcatcacaagctatatttaaatgtgggtgcagtgagtggctgttttctgccacatggagaaacatggtctgcagtgagagagaagaatgaagccatgatgaaagcaaaatcaagaaagagtcccgattgtgttccagtacctggttcttctggtcttcatgttcaggtccacctctgcccttttcatgtcttgattgttgaattcttctgtgagatactccaaatatcctaataaattctcatgtttgcttc

SEQ ID NO: 203993 - DNA, 559 bp, Homo sapiens
  Payload ID: 20232
  Gene Name: zinc finger protein 84
  ENST ID: ENST00000438628
  CDS Start-End: 352-559
gcagtccccgactcgtcccggcccgttcggagccgcccgggagcgcacaaaggccgacggtttgggcgcgtgcgcgggacacgggggacgggcggtgtcacgtgatcgcgaggccgcgggcgcgcgggcgcgactcggcggcggcgtcttttgtgagttcatccacagatcctggtccctacaaataagcctgctcatgtgagataagaaaggagttcctggaaccaggaattcattctcagtgtagaagacctagctgagacctcactccacagttttggggcagaagcagaagagacgcacagtagaaccgatctcagccttgctgatcatctcgtacagcagcagaaaatgaccatgttacaggagtcattctcatttgacgatttatctgtggacttcacccaaaaggagtggcagctactggatccctctcagaagaatttatacaaggatgtgatgttggagaactatagcagcctagtgtcactggggtatgaagttatgaaaccagatgtcatcttcaaattggagcaaggagaagagccgtgggtaggag

SEQ ID NO: 203994 - DNA, 546 bp, Homo sapiens
  Payload ID: 20232
  Gene Name: zinc finger protein 84
  ENST ID: ENST00000545299
  CDS Start-End: 529-546
gacctggaaagatgttcttcacataatgggaaaaaaacaaaaacagcttttaaatatgaccatatgcttccattgtatgaaaaatatcacaatagtttccatcatcctaagaatggttacctgtggtgagatcatagataatagttcttatttagcttgtagacctaggcttccactgttccattttactatattctgtttccctgagagtgctgtttcagttatatagcaagcgtacctctggccttagatgatcgtgaattccaagttcctagcaagagagaaagagatttcatgtgcaatgtgaatataccagttgaagtacatttctcccgaagtccacagatcctggtccctacaaataagcctgctcatgtgagataagaaaggagttcctggaaccaggaattcattctcagtgtagaagacctagctgagacctcactccacagttttggggcagaagcagaagagacgcacagtagaaccgatctcagccttgctgatcatctcgtacagcagcagaaaatgaccatgttacaggtg

SEQ ID NO: 203995 - DNA, 3501 bp, Homo sapiens
  Payload ID: 20232
  Gene Name: zinc finger protein 84
  ENST ID: ENST00000543758
  CDS Start-End: 614-2827
aatgcttgcaggtggcccgttcttcctctttgtccttcgctgccacgtgagaggggagtgtacgcgtgtgcgcgcgtgcgagtgtgcgcgtgtgcagtccccgactcgtcccggcccgttcggagccgcccgggagcgcacaaaggccgacggtttgggcgcgtgcgcgggacacgggggacgggcggtgtcacgtgatcgcgaggccgcgggcgcgcgggcgcgactcggcggcggcgtcttttagacctaggcttccactgttccattttactatattctgtttccctgagagtgctgtttcagttatatagcaagcgtacctctggccttagatgatcgtgaattccaagttcctagcaagagagaaagagatttcatgtgcaatgtgaatataccagttgaagtacatttctcccgaagtccacagatcctggtccctacaaataagcctgctcatgtgagataagaaaggagttcctggaaccaggaattcattctcagtgtagaagacctagctgagacctcactccacagttttggggcagaagcagaagagacgcacagtagaaccgatctcagccttgctgatcatctcgtacagcagcagaaaatgaccatgttacaggagtcattctcatttgacgatttatctgtggacttcacccaaaaggagtggcagctactggatccctctcagaagaatttatacaaggatgtgatgttggagaactatagcagcctagtgtcactggggtatgaagttatgaaaccagatgtcatcttcaaattggagcaaggagaagagccgtgggtaggagatggagaaattccaagttcagattctccagtctggaaagtagatggtaacatgatgtggcaccaggataaccaagacaagcttaaaattataaaaagaggtcatgaatgtgatgcatttggaaaaaatttcaatctgaacatgaactttgttcctttaaggaaatcaaacagtgaaggtgacttagatggattgattttaaaacatcatttagatttgcttattccaaaaggagattatggaaaagcagaatcagatgactttaatgtgtttgataatttttttctccattccaagcctgaggatactgatacctggttaaaatactatgactgtgataaatataaagagagctataaaaagtcacagattatcatatatcatagaaatcgtttaggggagaaactctatgaatgcagtgaatgtaggaagcgcttcagtaagaaaccaagtctcattaaacatcagagcagacatataagagacatagcctttggctgtggtaattgtggcaaaacctttccccagaagtctcagtttattacacatcacagaactcatacaggagaaaaaccttataattgtagccagtgtgggaaagccttctcccaaaagtcacagctcacatcccatcagcggacacatacaggagagaaaccttatgagtgtggtgaatgtgggaaagccttctcccggaagtcacatctcatatcgcattggagaacacacacaggagagaaaccctatggatgcaatgaatgtgggagggcctttagtgaaaagtccaatctcattaaccatcagagaattcataccggtgagaagccttttgaatgcagggaatgtgggaaagccttcagcaggaagtcacaactcgttacacatcacagaactcacacaggaacaaaaccctttggatgtagtgattgtagaaaagcattctttgagaagtcagagcttattagacatcagacaattcatactggagagaaaccctatgaatgcagcgagtgtaggaaagcatttagagagaggtcgagtctcattaatcatcagagaacacatacaggagagaaacctcatggatgcattcagtgtgggaaggccttctcccagaagtcacatctcatatcacatcagatgacacacacaggagaaaaaccctttatatgcagtaaatgtgggaaagccttcagcaggaaatcacagctcgttagacatcagagaactcatacgggagaaaaaccgtatgaatgcagtgagtgtgggaaagctttcagtgaaaaattaagtctcactaatcatcaaagaattcatacaggagaaaaaccatatgtatgcagtgaatgtgggaaagccttttgtcagaagtcacatctcatatcacatcagaggacacatacaggggagaaaccctatgaatgcagtgaatgtgggaaggcctttggtgagaagtcaagtcttgcaactcatcagagaactcatactggagaaaaaccgtatgaatgcagggactgtgaaaaagctttctcccagaaatcacagctaaatacccatcagagaattcacactggagagaaaccctatgaatgcagtctttgtaggaaagctttttttgagaagtcggagctaattagacatctgagaactcatacaggagaaaaaccttatgaatgcaatgaatgtagaaaagccttcagggagaagtcaagtctcatcaatcatcagagaatacatacaggagagaagccttttgaatgcagtgagtgtggcaaagctttctctcggaagtcacaccttataccacatcaaaggacacatacgggtgagaaaccctatggatgcagtgaatgtaggaaggccttctctcagaagtcacagctggttaatcatcagagaattcatacaggagagaagccttatcgatgcattgaatgtgggaaagctttctcacagaagtcacagctcatcaatcatcagagaactcatacagtaaaaaaatcctaggaatacagttaatagtagtctttgacagatcatcttggacttcaggaaatgcaattatgataacgtttgtagacagtcacgtcatgttaggtgtttgtactccatgaggatgagaactctaaatgaggtggtgtatggaaagccgatcataattcatagagtagagtgaacctatgactgcagtggatctcaaaaacttttaaaaccatagacaagccttatagagtagaacattcacagcaaagaagaatcctgtgaatgtccaaaagccttccagaagtcaagtctcttaagctattagaaatattcccactggggatgagggaaaaccccatgaatgcgggaaatgaggcaatatttttaagaaatgacagttcattgtacataagaaaatgctcttaggaatgaagttctatgaaagtactaaatatgggacagtgcaacaagtaacgagactattttgtattttggagaattcatattatggagaacctaacaatttaaagacactgggaacacttgcccctcagtatagtactgtcaagggaagccatacactttttgtagacatgggtaccaaaaatacccaattctaagtggttgacagatgttcactttgaagtgtgaagttttaaaaatacgtgaataaattggttattgaaacatctaagaca

SEQ ID NO: 203996 - DNA, 562 bp, Homo sapiens
  Payload ID: 20232
  Gene Name: zinc finger protein 84
  ENST ID: ENST00000543310
  CDS Start-End: 329-562
aaataaggttattgacctggaaagatgttcttcacataatgggaaaaaaacaaaaacagcttttaaatatgaccatatgcttccattgtatgaaaaatatcacaatagtttccatcatcctaagaatggttacctgtgtccacagatcctggtccctacaaataagcctgctcatgtgagataagaaaggagttcctggaaccaggaattcattctcagtgtagaagacctagctgagacctcactccacagttttggggcagaagcagaagagacgcacagtagaaccgatctcagccttgctgatcatctcgtacagcagcagaaaatgaccatgttacaggagtcattctcatttgacgatttatctgtggacttcacccaaaaggagtggcagctactggatccctctcagaagaatttatacaaggatgtgatgttggagaactatagcagcctagtgtcactggggtatgaagttatgaaaccagatgtcatcttcaaattggagcaaggagaagagccgtgggtaggagatggagaaattccaagttcagattct

SEQ ID NO: 203997 - DNA, 647 bp, Homo sapiens
  Payload ID: 20232
  Gene Name: zinc finger protein 84
  ENST ID: ENST00000535439
  CDS Start-End: 184-621
atcctggtccctacaaataagcctgctcatgtgagataagaaaggagttcctggaaccaggaattcattctcagtgtagaagacctagctgagacctcactccacagttttggggcagaagcagaagagacgcacagtagaaccgatctcagccttgctgatcatctcgtacagcagcagaaaatgaccatgttacaggagtcattctcatttgacgatttatctgtggacttcacccaaaaggagtggcagctactggatccctctcagaagaatttatacaaggatgtgatgttggagaactatagcagcctagtgtcactggggtatgaagttatgaaaccagatgtcatcttcaaattggagcaaggagaagagccgtgggtaggagatggagaaattccaagttcagattctccagtgagtggctgttttctgccacatggagaaacatggtctgcagtgagagagaagaatgaagccatgatgaaagcaaaatcaagaaagagtcccgattgtgttccagtacctggttcttctggtcttcatgttcaggtccacctctgcccttttcatgtcttgattgttgaattcttctgtgagatactccaaatatcctaataaattctcatgtttgcttcatctgg

SEQ ID NO: 203998 - DNA, 540 bp, Homo sapiens
  Payload ID: 20232
  Gene Name: zinc finger protein 84
  ENST ID: ENST00000542874
  CDS Start-End: 191-445
tccacagatcctggtccctacaaataagcctgctcatgtgagataagaaaggagttcctggaaccaggaattcattctcagtgtagaagacctagctgagacctcactccacagttttggggcagaagcagaagagacgcacagtagaaccgatctcagccttgctgatcatctcgtacagcagcagaaaatgaccatgttacaggagtcattctcatttgacgatttatctgtggacttcacccaaaaggagtggcagctactggatccctctcagaagaatttatacaaggatgtgatgttggagaactatagcagcctagtgtcactggggtatgaagttatgaaaccagatgtcatcttcaaattggagcaaggagaagagccgtgggtaggagatggagaaattccaagttcagattctccagggacctccatagtatgacactactgctgcctgttcagttatttcttcctatctcccattcatgaagtctggaaagtagatggtaacatgatgtggcaccaggataaccaaga

SEQ ID NO: 203999 - DNA, 3237 bp, Homo sapiens
  Payload ID: 20232
  Gene Name: zinc finger protein 84
  Uniprot ID: P51523
  ENST ID: ENST00000539354
  CDS Start-End: 347-2563
gtgtgcagtccccgactcgtcccggcccgttcggagccgcccgggagcgcacaaaggccgacggtttgggcgcgtgcgcgggacacgggggacgggcggtgtcacgtgatcgcgaggccgcgggcgcgcgggcgcgactcggcggcggcgtctttttccacagatcctggtccctacaaataagcctgctcatgtgagataagaaaggagttcctggaaccaggaattcattctcagtgtagaagacctagctgagacctcactccacagttttggggcagaagcagaagagacgcacagtagaaccgatctcagccttgctgatcatctcgtacagcagcagaaaatgaccatgttacaggagtcattctcatttgacgatttatctgtggacttcacccaaaaggagtggcagctactggatccctctcagaagaatttatacaaggatgtgatgttggagaactatagcagcctagtgtcactggggtatgaagttatgaaaccagatgtcatcttcaaattggagcaaggagaagagccgtgggtaggagatggagaaattccaagttcagattctccagaagtctggaaagtagatggtaacatgatgtggcaccaggataaccaagacaagcttaaaattataaaaagaggtcatgaatgtgatgcatttggaaaaaatttcaatctgaacatgaactttgttcctttaaggaaatcaaacagtgaaggtgacttagatggattgattttaaaacatcatttagatttgcttattccaaaaggagattatggaaaagcagaatcagatgactttaatgtgtttgataatttttttctccattccaagcctgaggatactgatacctggttaaaatactatgactgtgataaatataaagagagctataaaaagtcacagattatcatatatcatagaaatcgtttaggggagaaactctatgaatgcagtgaatgtaggaagcgcttcagtaagaaaccaagtctcattaaacatcagagcagacatataagagacatagcctttggctgtggtaattgtggcaaaacctttccccagaagtctcagtttattacacatcacagaactcatacaggagaaaaaccttataattgtagccagtgtgggaaagccttctcccaaaagtcacagctcacatcccatcagcggacacatacaggagagaaaccttatgagtgtggtgaatgtgggaaagccttctcccggaagtcacatctcatatcgcattggagaacacacacaggagagaaaccctatggatgcaatgaatgtgggagggcctttagtgaaaagtccaatctcattaaccatcagagaattcataccggtgagaagccttttgaatgcagggaatgtgggaaagccttcagcaggaagtcacaactcgttacacatcacagaactcacacaggaacaaaaccctttggatgtagtgattgtagaaaagcattctttgagaagtcagagcttattagacatcagacaattcatactggagagaaaccctatgaatgcagcgagtgtaggaaagcatttagagagaggtcgagtctcattaatcatcagagaacacatacaggagagaaacctcatggatgcattcagtgtgggaaggccttctcccagaagtcacatctcatatcacatcagatgacacacacaggagaaaaaccctttatatgcagtaaatgtgggaaagccttcagcaggaaatcacagctcgttagacatcagagaactcatacgggagaaaaaccgtatgaatgcagtgagtgtgggaaagctttcagtgaaaaattaagtctcactaatcatcaaagaattcatacaggagaaaaaccatatgtatgcagtgaatgtgggaaagccttttgtcagaagtcacatctcatatcacatcagaggacacatacaggggagaaaccctatgaatgcagtgaatgtgggaaggcctttggtgagaagtcaagtcttgcaactcatcagagaactcatactggagaaaaaccgtatgaatgcagggactgtgaaaaagctttctcccagaaatcacagctaaatacccatcagagaattcacactggagagaaaccctatgaatgcagtctttgtaggaaagctttttttgagaagtcggagctaattagacatctgagaactcatacaggagaaaaaccttatgaatgcaatgaatgtagaaaagccttcagggagaagtcaagtctcatcaatcatcagagaatacatacaggagagaagccttttgaatgcagtgagtgtggcaaagctttctctcggaagtcacaccttataccacatcaaaggacacatacgggtgagaaaccctatggatgcagtgaatgtaggaaggccttctctcagaagtcacagctggttaatcatcagagaattcatacaggagagaagccttatcgatgcattgaatgtgggaaagctttctcacagaagtcacagctcatcaatcatcagagaactcatacagtaaaaaaatcctaggaatacagttaatagtagtctttgacagatcatcttggacttcaggaaatgcaattatgataacgtttgtagacagtcacgtcatgttaggtgtttgtactccatgaggatgagaactctaaatgaggtggtgtatggaaagccgatcataattcatagagtagagtgaacctatgactgcagtggatctcaaaaacttttaaaaccatagacaagccttatagagtagaacattcacagcaaagaagaatcctgtgaatgtccaaaagccttccagaagtcaagtctcttaagctattagaaatattcccactggggatgagggaaaaccccatgaatgcgggaaatgaggcaatatttttaagaaatgacagttcattgtacataagaaaatgctcttaggaatgaagttctatgaaagtactaaatatgggacagtgcaacaagtaacgagactattttgtattttggagaattcatattatggagaacctaacaatttaaagacactgggaacacttgcccctcagtatagtactgtcaagggaagccatacactttttgtagacatgggtaccaaaaatacccaattctaagtggttgacagatgttcactttgaagtgtgaagttttaaaaatacgtgaataaattggttattgaaacatctaagaca

SEQ ID NO: 204000 - DNA, 960 bp, Homo sapiens
  Payload ID: 20232
  Gene Name: zinc finger protein 84
  ENST ID: ENST00000540031
  CDS Start-End: 251-960
ggacgggcggtgtcacgtgatcgcgaggccgcgggcgcgcgggcgcgactcggcggcggcgtcttttatcctggtccctacaaataagcctgctcatgtgagataagaaaggagttcctggaaccaggaattcattctcagtgtagaagacctagctgagacctcactccacagttttggggcagaagcagaagagacgcacagtagaaccgatctcagccttgctgatcatctcgtacagcagcagaaaatgaccatgttacaggagtcattctcatttgacgatttatctgtggacttcacccaaaaggagtggcagctactggatccctctcagaagaatttatacaaggatgtgatgttggagaactatagcagcctagtgtcactggggtatgaagttatgaaaccagatgtcatcttcaaattggagcaaggagaagagccgtgggtaggagatggagaaattccaagttcagattctccagaagtctggaaagtagatggtaacatgatgtggcaccaggataaccaagacaagcttaaaattataaaaagaggtcatgaatgtgatgcatttggaaaaaatttcaatctgaacatgaactttgttcctttaaggaaatcaaacagtgaaggtgacttagatggattgattttaaaacatcatttagatttgcttattccaaaaggagattatggaaaagcagaatcagatgactttaatgtgtttgataatttttttctccattccaagcctgaggatactgatacctggttaaaatactatgactgtgataaatataaagagagctataaaaagtcacagattatcatatatcatagaaatcgtttaggggagaaactctatgaatgcagtgaatgtaggaagcgcttcagtaagaaaccaagtctcattaaacatcagagcagacatataagagacatagcctttggctg

SEQ ID NO: 204001 - DNA, 558 bp, Homo sapiens
  Payload ID: 20232
  Gene Name: zinc finger protein 84
  ENST ID: ENST00000536123
  CDS Start-End: 394-558
ggcggcggcgtcttttgtgagttcaagacctaggcttccactgttccattttactatattctgtttccctgagagtgctgtttcagttatatagcaagcgtacctctggccttagatgatcgtgaattccaagttcctagcaagagagaaagagatttcatgtgcaatgtgaatataccagttgaagtacatttctcccgaagtccacagatcctggtccctacaaataagcctgctcatgtgagataagaaaggagttcctggaaccaggaattcattctcagtgtagaagacctagctgagacctcactccacagttttggggcagaagcagaagagacgcacagtagaaccgatctcagccttgctgatcatctcgtacagcagcagaaaatgaccatgttacaggagtcattctcatttgacgatttatctgtggacttcacccaaaaggagtggcagctactggatccctctcagaagaatttatacaaggatgtgatgttggagaactatagcagcctagtgtcactggggtatgaagttatgaaaccagat

SEQ ID NO: 204002 - DNA, 3503 bp, Homo sapiens
  Payload ID: 20233
  Gene Name: zinc finger protein 841
  Uniprot ID: Q6ZN19
  ENST ID: ENST00000389534
  CDS Start-End: 88-2862
tgactttcagatttgacttttaaagaattaattatattgactgagagagaggcccaggagagaaagaagaaagaaaaggagccagggatggctcttcctcagggatctttgacattcagggatgtggctgtagaattctctcaggaggagtggaaatgcctggaccctgttcagaaagctttgtacagggacgtgatgttggagaactacaggaacctcggcttcctgggactctgtcttcctgacctgaatattatctccatgttggagcaagggaaagagccctggactgtggtgagccaagtgaaaatagcgaggaacccaaactgtggggaatgcatgaaaggcgtgatcaccggtatctctcctaaatgtgtgatcaaggaattaccaccaatacagaacagtaacacaggagaaaaattccaagcagtgatgttggaaggacatgaaagctatgacactgaaaatttttacttcagggaaatccggaaaaatctacaggaagttgactttcaatggaaagatggtgaaataaattataaagaagggccgatgacccataaaaacaatcttactggtcaaagagttcgacatagtcaaggggacgtagaaaacaagcatatggaaaatcagcttatattaaggtttcagtccggtctgggtgaattgcagaaatttcaaactgcagagaaaatttatggatgtaatcaaattgagaggacagttaataattgttttttagcttcaccacttcaaagaatttttcctggtgtccaaaccaacatttctaggaaatatgggaatgattttttgcaactttcgttacctacacaagacgagaaaacacatattagggaaaaaccttacataggtaatgagtgtggcaaagccttcagagtgtcttcaagtcttattaatcatcagatgatacatactacagagaaaccttacagatgcaatgagtctggtaaagcctttcatcggggctcactactaacagtacatcagatagtccatacaagagggaaaccataccaatgtgatgtatgtggcaggatcttcagacaaaattcagatcttgtaaatcaccggagaagtcacactggagacaaaccctacatatgtaatgaatgtggcaagtcctttagtaaaagttcccaccttgcagttcatcagagaattcatactggagagaaaccttacaaatgtaatcgatgtgggaagtgctttagtcaaagttcctctcttgcaactcatcagacagttcatactggagacaaaccctacaaatgtaatgaatgtggcaaaacctttaaacggaactcaagcctcactgcacatcatataatccatgcaggaaagaaaccatatacatgtgatgtatgtggcaaggtcttttatcagaattcacaacttgtaaggcaccagataattcatactggagagacaccttacaaatgtaatgaatgtggcaaggtcttctttcaacgttcacgtcttgcagggcaccggagaattcatactggagagaaaccctacaaatgtaatgaatgtggcaaggtcttcagtcaacattcacatcttgcagtgcatcagagagttcatactggagagaaaccttacaaatgtaatgaatgtggcaaagcctttaattggggctcattactaactgtacatcagagaattcataccggagagaaaccttacaaatgtaatgtgtgtggcaaggtctttaattacggtggatacctttcggttcatatgagatgtcatactggagagaaacctctccattgtaataaatgtggcatggtcttcacttactattcatgcctagcacgtcatcaaagaatgcataccggagagaaaccttacaaatgtaatgtgtgtggcaaggtcttcattgacagtggaaacctttcaattcataggcgaagtcataccggagagaaacctttccagtgtaacgaatgcggcaaggtcttcagttactactcatgcctagcacgtcatcggaaaattcataccggagagaaaccttataaatgtaatgattgtggcaaagcctatactcagcgttcaagcctcactaaacatctggtaattcatactggagagaacccttaccactgtaatgaatttggtgaggcttttatccaaagttcaaaacttgcaagatatcacagaaatcctactggggagaaaccacacaaatgtagtgaatgtggtagaacttttagtcataaaacaagtctggtgtaccatcagagaagacatactggagagatgccatacaaatgtattgaatgtgggaaagtctttaactccactacaaccctggcaaggcatcggagaattcatactggagagaaaccttacaaatgtaatgaatgtggcaaggtcttccgttatcgctcaggcctcgcacgtcattggagtattcatactggagagaaaccttacaaatgtaatgagtgtggcaaagcctttagagtacgttcaattctgcttaatcatcagatgatgcatactggagagaaaccttataaatgtaatgaatgtggtaaagcttttatcgaaaggtcaaacttggtttaccatcagagaaaccatactggagagaagccatacaaatgtatggaatgtggcaaggcgtttgggcggcggtcttgcctcactaaacaccaacgaattcattctagtgaaaaaccttataaatgtaatgagtgtggcaaatcttacattagtcgctcaggcctcactaaacatcagataaaacatgctggagagaaccttacaactaaactcaatgtggaaaggccgttagatgttgtcctaacctctgggatccccaaataatttatacttactcatatagcttgtatatttgtcctttccctttgaagtctcatgtggaattgtagtaatctccagtattggaggtggagcctagtgggaggtgattggatgatgggggtggctttctcaagaaagttttagtaccatccccttgttgctgtccttgtgatagttctcatgaggtctggctcatgcctgtaatcccagcactttgggaggctgaggtgggcggatcacttgaggtcaggagttcaagagcagcctggccaacatggtgaaaccctgtttctgccaaaaatacaaaaattagctgggcttcgtggcgggtactggtagtaccagctactcgagaggctgagtcaggagaattgcttgaaccctggaggcggaggttgcagtgagccgagatcgcgccactgcactctagcctgggtgacagagtgagactccatcacgcacacgcacgcacgaaagtgaatggcacctccctcttgtttgttcttctggccatgtgacatgcccttcacctcccaccatcattttaaccttcctcaggtttcccgagagggtgaacagacgtcagcgccatgtttcctataaagcctgcaaaattgtgagtcaattaaacctctttatacatt

SEQ ID NO: 204003 - DNA, 3620 bp, Homo sapiens
  Payload ID: 20233
  Gene Name: zinc finger protein 841
  Uniprot ID: Q6ZN19
  ENST ID: ENST00000426391
  CDS Start-End: 553-2979
acacccggaagcagatcgcgctggggaaaggccacgtcgctatgagtgtgtttcagtctacctggattaaacgtttgcttctcttcgtctaccttgattaaacgtgcacttcgcagtcctcggttctccatacccgtgacctggggatcgctacggaccttaaaatacccgcaacagccccttcgtcccaagctggagagcagtggcatgatctcggctcactgcagcttctacttcctggcctcaagcagtctttccacctcagcctctcaacgcactggaattacagatgtgagccaccacactaggcctacaagtggtccttacaccagattaatttatcttgaaatggcgggcaactgaatcgcacacctcaatctatgatttgacttttaaagaattaattatattgactgagagagaggcccaggagagaaagaagaaagaaaaggagccagggatggctcttcctcaggtatctctcctaaatgtgtgatcaaggaattaccaccaatacagaacagtaacacaggagaaaaattccaagcagtgatgttggaaggacatgaaagctatgacactgaaaatttttacttcagggaaatccggaaaaatctacaggaagttgactttcaatggaaagatggtgaaataaattataaagaagggccgatgacccataaaaacaatcttactggtcaaagagttcgacatagtcaaggggacgtagaaaacaagcatatggaaaatcagcttatattaaggtttcagtccggtctgggtgaattgcagaaatttcaaactgcagagaaaatttatggatgtaatcaaattgagaggacagttaataattgttttttagcttcaccacttcaaagaatttttcctggtgtccaaaccaacatttctaggaaatatgggaatgattttttgcaactttcgttacctacacaagacgagaaaacacatattagggaaaaaccttacataggtaatgagtgtggcaaagccttcagagtgtcttcaagtcttattaatcatcagatgatacatactacagagaaaccttacagatgcaatgagtctggtaaagcctttcatcggggctcactactaacagtacatcagatagtccatacaagagggaaaccataccaatgtgatgtatgtggcaggatcttcagacaaaattcagatcttgtaaatcaccggagaagtcacactggagacaaaccctacatatgtaatgaatgtggcaagtcctttagtaaaagttcccaccttgcagttcatcagagaattcatactggagagaaaccttacaaatgtaatcgatgtgggaagtgctttagtcaaagttcctctcttgcaactcatcagacagttcatactggagacaaaccctacaaatgtaatgaatgtggcaaaacctttaaacggaactcaagcctcactgcacatcatataatccatgcaggaaagaaaccatatacatgtgatgtatgtggcaaggtcttttatcagaattcacaacttgtaaggcaccagataattcatactggagagacaccttacaaatgtaatgaatgtggcaaggtcttctttcaacgttcacgtcttgcagggcaccggagaattcatactggagagaaaccctacaaatgtaatgaatgtggcaaggtcttcagtcaacattcacatcttgcagtgcatcagagagttcatactggagagaaaccttacaaatgtaatgaatgtggcaaagcctttaattggggctcattactaactgtacatcagagaattcataccggagagaaaccttacaaatgtaatgtgtgtggcaaggtctttaattacggtggatacctttcggttcatatgagatgtcatactggagagaaacctctccattgtaataaatgtggcatggtcttcacttactattcatgcctagcacgtcatcaaagaatgcataccggagagaaaccttacaaatgtaatgtgtgtggcaaggtcttcattgacagtggaaacctttcaattcataggcgaagtcataccggagagaaacctttccagtgtaacgaatgcggcaaggtcttcagttactactcatgcctagcacgtcatcggaaaattcataccggagagaaaccttataaatgtaatgattgtggcaaagcctatactcagcgttcaagcctcactaaacatctggtaattcatactggagagaacccttaccactgtaatgaatttggtgaggcttttatccaaagttcaaaacttgcaagatatcacagaaatcctactggggagaaaccacacaaatgtagtgaatgtggtagaacttttagtcataaaacaagtctggtgtaccatcagagaagacatactggagagatgccatacaaatgtattgaatgtgggaaagtctttaactccactacaaccctggcaaggcatcggagaattcatactggagagaaaccttacaaatgtaatgaatgtggcaaggtcttccgttatcgctcaggcctcgcacgtcattggagtattcatactggagagaaaccttacaaatgtaatgagtgtggcaaagcctttagagtacgttcaattctgcttaatcatcagatgatgcatactggagagaaaccttataaatgtaatgaatgtggtaaagcttttatcgaaaggtcaaacttggtttaccatcagagaaaccatactggagagaagccatacaaatgtatggaatgtggcaaggcgtttgggcggcggtcttgcctcactaaacaccaacgaattcattctagtgaaaaaccttataaatgtaatgagtgtggcaaatcttacattagtcgctcaggcctcactaaacatcagataaaacatgctggagagaaccttacaactaaactcaatgtggaaaggccgttagatgttgtcctaacctctgggatccccaaataatttatacttactcatatagcttgtatatttgtcctttccctttgaagtctcatgtggaattgtagtaatctccagtattggaggtggagcctagtgggaggtgattggatgatgggggtggctttctcaagaaagttttagtaccatccccttgttgctgtccttgtgatagttctcatgaggtctggctcatgcctgtaatcccagcactttgggaggctgaggtgggcggatcacttgaggtcaggagttcaagagcagcctggccaacatggtgaaaccctgtttctgccaaaaatacaaaaattagctgggcttcgtggcgggtactggtagtaccagctactcgagaggctgagtcaggagaattgcttgaaccctggaggcggaggttgcagtgagccgagatcgcgccactgcactctagcctgggtgacagagtgagactccatcacgcacacgcacgcacgaaagtgaatggcacctccctcttgtttgttcttctggccatgtgacatgcccttcacctcccaccatcattttaaccttcctcaggtttcccgagagggtgaacagacgtcagcgccatgtttcctataaagcctgcaaaattgtgagtcaattaaacctctttatacatt

SEQ ID NO: 204004 - DNA, 721 bp, Homo sapiens
  Payload ID: 20233
  Gene Name: zinc finger protein 841
  ENST ID: ENST00000594440
  CDS Start-End: 451-721
gcagatcgcgctggggaaaggccacgtcgctatgagtgtgtttcagtctacctggattaaacgtttgcttctcttcgtctaccttgattaaacgtgcacttcgcagtcctcggttctccatacccgtgacctggggatcgctacggaccttaaaatacccgcaacagccccttcgtcccaagctggagagcagtggcatgatctcggctcactgcagcttctacttcctggcctcaagcagtctttccacctcagcctctcaacgcactggaattacagatgtgagccaccacactaggcctacaagtggtccttacaccagattaatttatcttgaaatggcgggcaactgaatcgcacacctcaatctatgatttgacttttaaagaattaattatattgactgagagagaggcccaggagagaaagaagaaagaaaaggagccagggatggctcttcctcagggatctttgacattcagggatgtggctgtagaattctctcaggaggagtggaaatgcctggaccctgttcagaaagctttgtacagggacgtgatgttggagaactacaggaacctcggcttcctgggactctgtcttcctgacctgaatattatctccatgttggagcaagggaaagagccctggactgtggtgagccaagtgaaaatagcgaggaacccaaactgtggggaatgcatgaaaggcgtgatcaccg

SEQ ID NO: 204005 - DNA, 3819 bp, Homo sapiens
  Payload ID: 20233
  Gene Name: zinc finger protein 841
  Uniprot ID: Q6ZN19
  ENST ID: ENST00000594295
  CDS Start-End: 404-3178
ggagtagagcataaaggaggggagaaatggggcaagaaatgactgactgtcactacaagatatgtctttggtgttttttttggctttgttctgttttgttttggggggggacatggtctctctctgccgcctaggctggagagcagtggcatgatctcggctcactgcagcttctacttcctggcctcaagcagtctttccacctcagcctctcaacgcactggaattacagatgtgagccaccacactaggcctacaagtggtccttacaccagattaatttatcttgaaatggcgggcaactgaatcgcacacctcaatctatgatttgacttttaaagaattaattatattgactgagagagaggcccaggagagaaagaagaaagaaaaggagccagggatggctcttcctcagggatctttgacattcagggatgtggctgtagaattctctcaggaggagtggaaatgcctggaccctgttcagaaagctttgtacagggacgtgatgttggagaactacaggaacctcggcttcctgggactctgtcttcctgacctgaatattatctccatgttggagcaagggaaagagccctggactgtggtgagccaagtgaaaatagcgaggaacccaaactgtggggaatgcatgaaaggcgtgatcaccggtatctctcctaaatgtgtgatcaaggaattaccaccaatacagaacagtaacacaggagaaaaattccaagcagtgatgttggaaggacatgaaagctatgacactgaaaatttttacttcagggaaatccggaaaaatctacaggaagttgactttcaatggaaagatggtgaaataaattataaagaagggccgatgacccataaaaacaatcttactggtcaaagagttcgacatagtcaaggggacgtagaaaacaagcatatggaaaatcagcttatattaaggtttcagtccggtctgggtgaattgcagaaatttcaaactgcagagaaaatttatggatgtaatcaaattgagaggacagttaataattgttttttagcttcaccacttcaaagaatttttcctggtgtccaaaccaacatttctaggaaatatgggaatgattttttgcaactttcgttacctacacaagacgagaaaacacatattagggaaaaaccttacataggtaatgagtgtggcaaagccttcagagtgtcttcaagtcttattaatcatcagatgatacatactacagagaaaccttacagatgcaatgagtctggtaaagcctttcatcggggctcactactaacagtacatcagatagtccatacaagagggaaaccataccaatgtgatgtatgtggcaggatcttcagacaaaattcagatcttgtaaatcaccggagaagtcacactggagacaaaccctacatatgtaatgaatgtggcaagtcctttagtaaaagttcccaccttgcagttcatcagagaattcatactggagagaaaccttacaaatgtaatcgatgtgggaagtgctttagtcaaagttcctctcttgcaactcatcagacagttcatactggagacaaaccctacaaatgtaatgaatgtggcaaaacctttaaacggaactcaagcctcactgcacatcatataatccatgcaggaaagaaaccatatacatgtgatgtatgtggcaaggtcttttatcagaattcacaacttgtaaggcaccagataattcatactggagagacaccttacaaatgtaatgaatgtggcaaggtcttctttcaacgttcacgtcttgcagggcaccggagaattcatactggagagaaaccctacaaatgtaatgaatgtggcaaggtcttcagtcaacattcacatcttgcagtgcatcagagagttcatactggagagaaaccttacaaatgtaatgaatgtggcaaagcctttaattggggctcattactaactgtacatcagagaattcataccggagagaaaccttacaaatgtaatgtgtgtggcaaggtctttaattacggtggatacctttcggttcatatgagatgtcatactggagagaaacctctccattgtaataaatgtggcatggtcttcacttactattcatgcctagcacgtcatcaaagaatgcataccggagagaaaccttacaaatgtaatgtgtgtggcaaggtcttcattgacagtggaaacctttcaattcataggcgaagtcataccggagagaaacctttccagtgtaacgaatgcggcaaggtcttcagttactactcatgcctagcacgtcatcggaaaattcataccggagagaaaccttataaatgtaatgattgtggcaaagcctatactcagcgttcaagcctcactaaacatctggtaattcatactggagagaacccttaccactgtaatgaatttggtgaggcttttatccaaagttcaaaacttgcaagatatcacagaaatcctactggggagaaaccacacaaatgtagtgaatgtggtagaacttttagtcataaaacaagtctggtgtaccatcagagaagacatactggagagatgccatacaaatgtattgaatgtgggaaagtctttaactccactacaaccctggcaaggcatcggagaattcatactggagagaaaccttacaaatgtaatgaatgtggcaaggtcttccgttatcgctcaggcctcgcacgtcattggagtattcatactggagagaaaccttacaaatgtaatgagtgtggcaaagcctttagagtacgttcaattctgcttaatcatcagatgatgcatactggagagaaaccttataaatgtaatgaatgtggtaaagcttttatcgaaaggtcaaacttggtttaccatcagagaaaccatactggagagaagccatacaaatgtatggaatgtggcaaggcgtttgggcggcggtcttgcctcactaaacaccaacgaattcattctagtgaaaaaccttataaatgtaatgagtgtggcaaatcttacattagtcgctcaggcctcactaaacatcagataaaacatgctggagagaaccttacaactaaactcaatgtggaaaggccgttagatgttgtcctaacctctgggatccccaaataatttatacttactcatatagcttgtatatttgtcctttccctttgaagtctcatgtggaattgtagtaatctccagtattggaggtggagcctagtgggaggtgattggatgatgggggtggctttctcaagaaagttttagtaccatccccttgttgctgtccttgtgatagttctcatgaggtctggctcatgcctgtaatcccagcactttgggaggctgaggtgggcggatcacttgaggtcaggagttcaagagcagcctggccaacatggtgaaaccctgtttctgccaaaaatacaaaaattagctgggcttcgtggcgggtactggtagtaccagctactcgagaggctgagtcaggagaattgcttgaaccctggaggcggaggttgcagtgagccgagatcgcgccactgcactctagcctgggtgacagagtgagactccatcacgcacacgcacgcacgaaagtgaatggcacctccctcttgtttgttcttctggccatgtgacatgcccttcacctcccaccatcattttaaccttcctcaggtttcccgagagggtgaacagacgtcagcgccatgtttcctataaagcctgcaaaattgtgagtcaattaaacctctttatacatt

SEQ ID NO: 204006 - DNA, 2027 bp, Homo sapiens
  Payload ID: 20233
  Gene Name: zinc finger protein 841
  ENST ID: ENST00000601738
  CDS Start-End: 1-1538
agaacagtaacacaggagaaaaattccaagcagtgatgttggaaggacatgaaagctatgacactgaaaatttttacttcagggaaatccggaaaaatctacaggaagttgactttcaatggaaagatggtgaaataaattataaagaagggccgatgacccataaaaacaatcttactggtcaaagagttcgacatagtcaaggggacgtagaaaacaagcatatggaaaatcagcttatattaaggtttcagtccggtctgggtgaattgcagaaatttcaaactgcagagaaaatttatggatgtaatcaaattgagaggacagttaataattgttttttagcttcaccacttcaaagaatttttcctggtgtccaaaccaacatttctaggaaatatgggaatgattttttgcaactttcgttacctacacaagacgagaaaacacatattagggaaaaaccttacataggtaatgagtgtggcaaagccttcagagtgtcttcaagtcttattaatcatcagatgatacatactacagagaaaccttacagatgcaatgagtctggtaaagcctttcatcggggctcactactaacagtacatcagatagtccatacaagagggaaaccataccaatgtgatgtatgtggcaggatcttcagacaaaattcagatcttgtaaatcaccggagaagtcacactggagacaaaccctacatatgtaatgaatgtggcaagtcctttagtaaaagttcccaccttgcagttcatcagagaattcatactggagagaaaccttacaaatgtaatcgatgtgggaagtgctttagtcaaagttcctctcttgcaactcatcagacagttcatactggagacaaaccctacaaatgtaatgaatgtggcaaaacctttaaacggaactcaagcctcactgcacatcatataatccatgcaggaaagaaaccatatacatgtgatgtatgtggcaaggtcttttatcagaattcacaacttgtaaggcaccagataattcatactggagagacaccttacaaatgtaatgaatgtggcaaggtcttccgttatcgctcaggcctcgcacgtcattggagtattcatactggagagaaaccttacaaatgtaatgagtgtggcaaagcctttagagtacgttcaattctgcttaatcatcagatgatgcatactggagagaaaccttataaatgtaatgaatgtggtaaagcttttatcgaaaggtcaaacttggtttaccatcagagaaaccatactggagagaagccatacaaatgtatggaatgtggcaaggcgtttgggcggcggtcttgcctcactaaacaccaacgaattcattctagtgaaaaaccttataaatgtaatgagtgtggcaaatcttacattagtcgctcaggcctcactaaacatcagataaaacatgctggagagaaccttacaactaaactcaatgtggaaaggccgttagatgttgtcctaacctctgggatccccaaataatttatacttactcatatagcttgtatatttgtcctttccctttgaagtctcatgtggaattgtagtaatctccagtattggaggtggagcctagtgggaggtgattggatgatgggggtggctttctcaagaaagttttagtaccatccccttgttgctgtccttgtgatagttctcatgaggtctggctcatgcctgtaatcccagcactttgggaggctgaggtgggcggatcacttgaggtcaggagttcaagagcagcctggccaacatggtgaaaccctgtttctgccaaaaatacaaaaattagctgggcttcgtggcgggtactggtagtaccagctactcgagaggctgagtcaggagaattgcttgaaccctggaggcggaggttgcagtgagccgagatcgcgccactgcactctagcctgggtgacagagtgagactccatcacgcacacgcacgcacgaaagtgaatggcacctccc

SEQ ID NO: 204007 - DNA, 2137 bp, Homo sapiens
  Payload ID: 20234
  Gene Name: zinc finger protein 843
  Uniprot ID: Q8N446
  ENST ID: ENST00000315678
  CDS Start-End: 726-1772
tcgtttctccctgtcttggtgagggccaggggacaggtcggggcagtatttgggggaagcgagaggcaagcagggcgggctggatacggagcgccctatgactgaggttagggaggacgcccgagacccccggcatcctagtcctgggccgtgggctccggacgccgggccaggacgcctccagctcccagggtcccttgcggggaccatgtttccccacaggccccgcggctgccgggtcctcgccacgtccccttcccggagctacgcgcccggctgggttccgatccgccgtgtctctcgggggcggctcgcggggcaggggcgctcccggctcggccgcacgcccaagtgtcatgcgggaggtacgcgggcacgggacctcaccggagagaatgatggctctgggatctgaaatctttccttccgcaggaactggacacggcagtgaggaccagcgtatccaagaggatggacttagtgatggggaacacccagggacatgcccgagagcctcaagaaacaccttcagatgacattgcccagcgtcttacattagagaactctccagacagcccccgaggcctggggccgggtgctgctcccagactgtgagctcgtggccacgggaagcctgagtgcggcagaggccccacagctgcgccaagtgcggcaaagcctcccgtacagttactccctgagcggtcatctccgaagccctgctcatgagaagcctcccctttgccctgactgtggaaagcgtttcagccagagctcctacctgctgcagcaccggcagattcacccagggccgtcagccctgcaagtgcaaggcctgcgggaggggttttactcagagcgcatccctcctccagcactggcgggtccacagcgactggcgagagaccttgtcgctgtccccagtgcggcaagacctgctgtggccgctccaacctcatcaagcaccagcgagtccactcgggagaagccattcgtctgcgggagtgcggcaagggtttagcggccagctctgctgctggctcaccaaggagcacacactggccgaagccctgcgtctgtccccagtaccagcaggtttttggggaccggtggaagctgatcggccaccagcgaattcacacaggagagtgtgtcccttctgctgctgcagctgcggtgacagtgtcaatgagaagacctccctctcccagcgcgtccttccgcacccaggggagaagacctgcaggggtgggagcgtggagagcgtcagcctcgcacccagctcagtcgccccggacagcacctctgggctccggccctgtgggagccccgggtccttccttcaacatctgcccccatccacactcctgccccgacctcccttcctttatcctggccccccactcagtctccagcctctggttccatccggccttcccgcagtgcctgcagtgcctctgggaggcctggaagttgcccaggttccgccagccacccagccggcagctcagcaggagggggcgatggggcccagaagctgtgcgagcgcgggacgggactcgcgggaggcggttcaggccccaggctaccctgagccagcccggaaggcctcgcagcacagagcggccggaccgctcggcgaggccagggccaggcttcagcgacagtgccgagctcctccaccgccctcgaacccacactggagaggagccctaccagtgtttccggtgtggaaggcctccagccggaggtccaacctggcccgacactgaagaaccagcgtgctgcagccctgggtggaattgttgcagccgccggtggactgtggatctgagatgcagtcccctccctccacacagacccgctcaggacggcttttctgtatggcagatctttctcagaagtgctgggggctattttgtttgttttttttcccctgaattctcgctcctttcccttatacattaagggatttaggcaggtgcggctgcgggcggtgactcacacctgtaatcccagcgctttaagagaccgaggtgggaggatcgcgtgagcccgaagaatttgagactagcctgggcagcctagcgagaccgcatctctgtgaaataaaaataaaacgagctggtgtggtggc

SEQ ID NO: 204008 - DNA, 3816 bp, Homo sapiens
  Payload ID: 20234
  Gene Name: zinc finger protein 843
  ENST ID: ENST00000564218
  CDS Start-End: 726-1607
tcgtttctccctgtcttggtgagggccaggggacaggtcggggcagtatttgggggaagcgagaggcaagcagggcgggctggatacggagcgccctatgactgaggttagggaggacgcccgagacccccggcatcctagtcctgggccgtgggctccggacgccgggccaggacgcctccagctcccagggtcccttgcggggaccatgtttccccacaggccccgcggctgccgggtcctcgccacgtccccttcccggagctacgcgcccggctgggttccgatccgccgtgtctctcgggggcggctcgcggggcaggggcgctcccggctcggccgcacgcccaagtgtcatgcgggaggtacgcgggcacgggacctcaccggagagaatgatggctctgggatctgaaatctttccttccgcaggaactggacacggcagtgaggaccagcgtatccaagaggatggacttagtgatggggaacacccagggacatgcccgagagcctcaagaaacaccttcagatgacattgcccagcgtcttacattagagaactctccagacagcccccgaggcctggggccgggtgctgctcccagactgtgagctcgtggccacgggaagcctgagtgcggcagaggccccacagctgcgccaagtgcggcaaagcctcccgtacagttactccctgagcggtcatctccgaagccctgctcatgagaagcctcccctttgccctgactgtggaaagcgtttcagccagagctcctacctgctgcagcaccggcagattcacccagggccgtcagccctgcaagtgcaaggcctgcgggaggggttttactcagagcgcatccctcctccagcactggcgggtccacagcgactggcgagagaccttgtcgctgtccccagtgcggcaagacctgctgtggccgctccaacctcatcaagcaccagcgagtccactcgggagaagccattcgtctgcgggagtgcggcaagggtttagcggccagctctgctgctggctcaccaaggagcacacactggccgaagccctgcgtctgtccccagtaccagcaggtttttggggaccggtggaagctgatcggccaccagcgaattcacacaggagagtgtgtcccttctgctgctgcagctgcggtgacagtgtcaatgagaagacctccctctcccagcgcgtccttccgcacccaggggagaagacctgcaggggtgggagcgtggagagcgtcagcctcgcacccagctcagtcgccccggacagcacctctgggctccggccctgtgggagccccgggtccttccttcaacatctgcccccatccacactcctgccccgacctcccttcctttatcctggccccccactcactgggattacaggcgcccaccaccacgcccagctaatttttgtatttttagtagagagggggtttgaccatgctggccaggctggtctcgaactcctgacctcaggtgatccgcccacctcagcctcccaaagtggtgggattataggcatgagccaccgcacccagcctctcttgtgctttttagataagtatttttaaaagtgtttgttagttgtcggctgggcgtggtggctcacgcctgtaatcccagcactttgggaggcagaggagggcggatcacgaggtcaggagatcgagaccagcctggctaacacggtgaaaccccgtctctactaaaaaaaatacaaaaaaattagccgggcatggtggcgggctcctgtagtcccagccaagctggaggctgaggcgggagaatggcgaatggcgtgaacccgggaggcggagcttgcagtgagccgagatcgcgccactgcactccagcctgggcgacagcgagactccgaatcaaaaaaaaaaaaaaaaaaaaagtgtttgttggtttgttggttgtcttaatgatgtgctattagagtgaggaagaaaagttaccctatgagaatttaaactgcatgaaagtctgtggtagcattactggttcagttccaagcttgctacctcagtccttgatgcctctttctcccaatccaagtagtatcaggcactgccgtctacttgttgtacctcagaagagtttttcgacagcaccccgtgccctctgtggcctgtgctctctcacaggtgcaagtcctgtcatcatgagcctggactgttgcagaagactcctagccaatctcccctgcttcccgcctctgcattctggttcagcatccatagaacctaccagttattatagattcctccctcagactccagactccaacactaaatctgatgtcagtctcctgcctgaaaggatctcctgcctgccactcccacccctccaccccctccgctgaccccagcagggcctacagaacagggttcaaatgctttagcgtggcatgcatgcttctccattgggcttcgcctgacctctgtgcctttgctggccagggcctcctgcacctctgtgtctttgcacttgatttatttctttccactgcccaaaatgacctttccccttttctgtctcccagacttgccctactcattcatatgagccccacttccacttagagactgccccacctctcgtgtcacacctgacgtggtgagtgctccagtggcattaagaacatagggcatgtctgtctggtaacctatctccccagcagactgagctccacgagagcagagaccctggtgcagggcctggctcacagtgggtgctcaattaatattacttatgtgaaggaaccacttccagctgctcaagtattctatgctaaaacttgggtttctttcatccttgttgtcctcccaagatacaatgtgtacataattggaaagttagccaaggtgactatgaaggtgaccccacccaatcaatctatgtcttcctggttactgtgcctgtcattcgatgattccacggttatgtctatagtgataacagaaaaaagcaactgaaaacaatattatttactcgggtctcgtgcatctcctccacacatttgtagaaatgagattaccacaaattgccaagatggttacatcaaattttcagcagcatcagtcataggacaaaaaggcctttgagtgtatttttaataatcagcatttactggtggcaaaatactggtttagaaaatatctgagattatggtcaggcacggtagctcacgctggtaatcccaacattttgggaggctgaggcaggtggatcacctgaagtcaggagttcaagaccagtctggccataatttcagatggtgagattatagtgaaaccccatctctactaaaaatgcaaaaattagctgggcgtgatggcacacatctacaattccagctactcaggaggctgaggctgcagtgagctgagatcgcaccactgcactctagcctgggcaacacagtgagactccatctaaaaaaaaatctgagattaataggttgccattttaggcgctctttatagaccagctggcctagtggtcctggttctgtaatatgtgaagtaaaggtctcgcaggggagcaccagtttcaaactctgtcctagtttgcagccttggctggagtgaccccagtcatgaggcaaactgagcacaagtgtgcaagtgtcatggattcagccagaacatcagtgttcccagcatcagacacagattcgggagaaatcaagtcacagtgtagagatgtattgtgatgtgtcactacactattatgaaatggaagaaaataaaattacaagcctcaacctttaaa

SEQ ID NO: 204009 - DNA, 1765 bp, Homo sapiens
  Payload ID: 20234
  Gene Name: zinc finger protein 843
  Uniprot ID: Q8N446
  ENST ID: ENST00000618063
  CDS Start-End: 354-1400
gggcgagacgcgcaaaagagagaatgatggctctgggatctgaaatctttccttccgcaggaactggacacggcagtgaggaccagcgtatccaagaggatggacttagtgatggggaacacccagggacatgcccgagagcctcaagaaacaccttcagatgacattgcccagcgtcttacattagagaactctccagacagcccccgaggcctggggccgggtgctgctcccagactgtgagctcgtggccacgggaagcctgagtgcggcagaggccccacagctgcgccaagtgcggcaaagcctcccgtacagttactccctgagcggtcatctccgaagccctgctcatgagaagcctcccctttgccctgactgtggaaagcgtttcagccagagctcctacctgctgcagcaccggcagattcacccagggccgtcagccctgcaagtgcaaggcctgcgggaggggttttactcagagcgcatccctcctccagcactggcgggtccacagcgactggcgagagaccttgtcgctgtccccagtgcggcaagacctgctgtggccgctccaacctcatcaagcaccagcgagtccactcgggagaagccattcgtctgcgggagtgcggcaagggtttagcggccagctctgctgctggctcaccaaggagcacacactggccgaagccctgcgtctgtccccagtaccagcaggtttttggggaccggtggaagctgatcggccaccagcgaattcacacaggagagtgtgtcccttctgctgctgcagctgcggtgacagtgtcaatgagaagacctccctctcccagcgcgtccttccgcacccaggggagaagacctgcaggggtgggagcgtggagagcgtcagcctcgcacccagctcagtcgccccggacagcacctctgggctccggccctgtgggagccccgggtccttccttcaacatctgcccccatccacactcctgccccgacctcccttcctttatcctggccccccactcagtctccagcctctggttccatccggccttcccgcagtgcctgcagtgcctctgggaggcctggaagttgcccaggttccgccagccacccagccggcagctcagcaggagggggcgatggggcccagaagctgtgcgagcgcgggacgggactcgcgggaggcggttcaggccccaggctaccctgagccagcccggaaggcctcgcagcacagagcggccggaccgctcggcgaggccagggccaggcttcagcgacagtgccgagctcctccaccgccctcgaacccacactggagaggagccctaccagtgtttccggtgtggaaggcctccagccggaggtccaacctggcccgacactgaagaaccagcgtgctgcagccctgggtggaattgttgcagccgccggtggactgtggatctgagatgcagtcccctccctccacacagacccgctcaggacggcttttctgtatggcagatctttctcagaagtgctgggggctattttgtttgttttttttcccctgaattctcgctcctttcccttatacattaagggatttaggcaggtgcggctgcgggcggtgactcacacctgtaatcccagcgctttaagagaccgaggtgggaggatcgcgtgagcccgaagaatttgagactagcctgggcagcctagcgagaccgcatctctgtgaaataaaaataaaacgagctggtgtggtggc

SEQ ID NO: 204010 - DNA, 6620 bp, Homo sapiens
  Payload ID: 20235
  Gene Name: zinc finger protein 844
  Uniprot ID: Q08AG5
  ENST ID: ENST00000439326
  CDS Start-End: 176-2176
gtttatccgcgggtcacattgccgttcgcctcagtctttggcccctcccgccgggtgaggttggcaccccgtttttcctgctctgagagggaccggttgccaccgccatacttctgtcgccctgtcgtctgtgttgtgactgctttggacgtgggagtcacctgaaagccaggaaatggacttggtggctttcgaggatgtggctgtgaacttcacccaggaggagtggtctttgctggatccttcccagaagaatctctacagagaagtgatgcaggaaaccttgaggaatctggcctccataggagaaaaatggaaagaccagaacattgaagatcagtacaaaaatcccaggaataatctaagaagtcttctgggagagagagttgatgaaaatacagaagaaaatcattgtggagaaacttctagccagattccagatgacacactgaacaaaaaaacttctcctggagtaaaatcatgtgaaagcagtgtgtgtggagaagtcttcgtgggtcattcttcccttaataggcacattagagctgacactgcacacaagccgtctgagtatcaggaatatggacaggagccatataagtgtcaacaacgtaagaaagccttcagatgtcacccctcctttcaaatgcaagaaaaggctcacactggagaaaaactctatgattgtaaagaatgtggaaaaaccttcatatcccattcaagcattcaaagacacatgataatgcacaatggagatggaacttataaatgtaagttttgtgggaaagcctgcccttgtctcagcatatatcttatacatgaacgagttcacactggagagaaaccatataaatgtaaacaatgtggtaaagcctttagttattcaacttcccttcaaatacatgaaagaactcacactggagagaagccttatgaatgtaaggaatgtgggaaagcattcggtagtcccaattccctttatgaacatagaagaactcacactggagagaagccatatgaatgcaaacaatgtggaaaagccttcagatggttccattcctttcaaatacatgaaagaactcacagtgaggagaaggcttatgaatgtaccaaatgtgggaaagcattcaagtgtcccagttatctttgtagacatgaagtgacccactctgggaaaaagccctgtgaatgtaaacaatgtgggaaagcattatcttatcttaactttcaaagacacatgaaaatgcacactagaatgagaccttataaatgtaagactgtggaaaagcctttgattctcccagttcgttttgaagacatgaaagaactcacactggagagaaaccttatgaatgcaagcactgtggtaaagccttcaatcgttccagttcctttcactatcatgaaaggactcacactggagagaaaccctatgaatgtaagcagtgtagtaaagccttcatttcttccacttcctttcgatatcatgaaaggactcacactggagagaaaccgtatgagtgtaagcaatgtgggaaagccttcagatctgcctcacaccttcaaatgcatggaaggactcacactcaagagaaaccctatgaatgtaagcagtgtggtaaagccttcattttttccacttcctttcgatatcatgaaaggactcacactggagagaaaccctatgagtgtaagcaatgtgggaaagccttcacatctgcctcacaccttcaaatgcatgaaaggactcacactggaaagcaactgtatgaatctaaacaatgtgaaaaaacctttggatctgtcagaaaccttcaaattcatgaaaagacacaccctggagagaaaccctataaggaatatggaaaagcattcaacaatttctcttcctttcaaatacatgcaacaatgcacagaggacagaatgcctatgaatgtaaagagtgtgacaaagcattcatatctgccaagatccttcgagtacatgcaagaacacaccctggagagaaaccctatgaatgtaaggaatgcggaaaagcgttcaattatttttcttctttgcgtatacacaaaaggatgcacactggagagaaaccatattaatgtaaggattgtgggaaagcattcagtttgcctggttcctttcgtagacataaaagggctcacactggagtgaaaccgtatgaatgcaaggaatgtggcaaagccttcacttcttctggttcctttcagtgtcataaaaggattcacactggagagaaaccctatgagtgtaagcagtgtggtaaagccttcatttcttccactgccattcgtagacatgaaaggactcacactggagagaaaccctatgagtgtaagcaatgtggaaaagcctttatttctttcagttccattcagtaccatgaaaggactcacactggagagaaacagtatgagtgtaagcagtgtggtaaagccttcatgtcttctactgcatttcagtatcatgaaaagacccacaccagagagaaacactatgaatgtaagcagtgtgggaaagccttcatttcttccggtagccttcgatatcatgaaaggactcacactggagagaaaccctatgaatgtaagcagtgtggtaaagccttcagatctgccactcaacttcagatgcatagaaagattcacactggcgagaaaccctatgaatgtaagcaatgtgggaaagcctacagatctgtctcacaacttctggtgcatgaaaggactcacactgtagagcaaccctatgaatataagcaatatgggaaagccttcagatttgctaagaaccttcaaatacagacaatgaatgtaaacaattaaatgtttatagcagctgcatactaacatgttattctgtattttttttttctttttgagacagagtctcgctctgtcacccaggctggagtgcagtggcgtgatctcagctcactgcaagctccacctcctgggttcacgccattctcctgcctcagtctcctgagtagctgggactacaggtgcctgccaccacacccggctgattttttgtattttttagtagagacggagtttcatcgtgttagccaggatggtctcaatctcctgacctcgtgatctgcccgcctcagtctcccaaagtgctgggattacaggtatgagccaccgtgcccggccgttattctctattttttgttgttgtttgagatgagtcttgttctgttgcccaggctggagtgcagtggcatgatctcgcctccgggttcaagcaattctcctgcctcaggctcctgaggaaaaagattcctaggattacaggtgtgcaccaccacacttggctaatttttatatttttagtagagatgaggtctcaccctattggccacactggtcttgaactcctgacctgaagtgatccacctgccttagcctcccaaagtgctgggatgacaggcatgagccactgcacccagctgttattctctatttaattaattgagaagccataataaaatatctcagtgccatcatgcattagatcaagtttatgttaccacattattttttggacattgtgagtcaatattaccaagtggacaaaatcccaggcatctttttcctcatgtaaattttaattttcatgcttatatacttagaacatttatcttggtcctaattttttgttcattcataataccaaaagttatctcatgttcttcagagtgactttgtgccatatcccacagtggcatacctgtcttcaaagagggtataattcacaaaaggacttacactagaggaaaaccctatgaatgtaagctgcgtgggaaagcattttctgatctgagtggcattgaaacccacatggtattgcacatgacagataggcctctctccccgttcatttctttttttttgagacggagtcttgctctgtcgctgaggctgagaacagtggttccatctctgttcactgccacctccacctcctgggttcaagtgattctcctgccccagcctcccaagtagctgggattacaggtgaccgccaccacgcccagctaatttttgtatttttagtagagacggggcttcactatgttggccaggttcgtctcgaactcctgacctcaggtgatccacctgcctcagcctcccaaagtgctgtgcatacaggcatgagccactgcacccggccttctccccattcattttcaaagacataaaaggatgcacaataaagagagaccctctgaatgcaagcaatatggaaaagcattccattgtatcagatccttttgtagccatgaaagaactcgctgaagagaaaccctgtaaatgaagggaatgtgaaaagccttcattcctgaaatgaagcaattcatactattaatatatgagagaaatcctattataagaaattgattgctgtgcacggtagcttacctgtaattccagcacttccagaggctaaggcaggtggatcacttgaggtcaggagttcaataccagcctgggcaacatagtgaaaccctgtctctaccaaaaatacaaaaattagccaggcatggtggcgcgtgcctgtagtcccagctactcaggaggctgaggcaggagaatcacttgaacccaggagctggatgttgcagtgacccgagattacgccactgtaccccagcagagtgagactccatctgaaaaaaaaagcaaggggccggcacggtggttcacgcctgtaatcccagcactttgggagaccaaggcaggcagatcacctgaggtcaggagttcgagaccagcctggctaacatggcaaaaccccatcgctactaaaaatacaaaaaattagatgggcatggtggcacatgcctgtaatcccagctacatgggagactgaggcaggagaattgcttgaacctgggaggcggaggttgcagtgagccaagatcacagcattgcacttcagcctgggcaacaagagtgaaactccatctcaaaaaaaaaaaaaaaaaaaattgaggaagcattcagttgtcccacttcctttcaaacaggaagagacactagagagaaaccctctgagataactgactgttgaattaagaagagaggcctggccggacacagtggctcacgcctgtaatcccagcactttgggaggctgaggtgggcggatcacgaggtcaggagatcaagaccatcctggctgacacggtgaaaccccgtctctactaaaaaatacaaaaaaactagctgggcgtggtggtgggcgcctgtagtcccagctactcgggaggctgaagcaggagaatggcgtgaatccaggaggcagagcttgcagtgaaccgagatcgcgccactgcactccagcggcgacagagcaagactccgtctcaaaaaaaaaaaaaaaaaaaagagaagtctgacaggacaataaaatttagaaatggagttggaggatgtcataatacaattcaccagtgtcctatcttacatgcaatttcaaaggcagacaagaggaagtcatcagtcacattttagaggcaccaaacaggtgccacatccatacaggctgactccctgctcccagcccattttttcctgaatctttggcttgccaatcaagaatgtcctcaaaatttgctcagaggtgtgggcctttgggtaaaggtgtcttcagaagctccacattaaagatccatcagtggttaagggcaaattgaagagaaataaagactaagatatttttttaaaagactgaaagaatagaacaatgaaaaagccccatctgtaatacagtttttctttttctttttttttgagacaaggtctctctctgtcacccaggctggagtagagtggcattatcctggctcattgcaatctgggcctcctggtttcaagtgattctggtgtctcagccacctgagtagtcaggattacaggtgcacaccaccacgcatggctaaatttttgtatttttagtagagatggggtttcaccatgttgagcaagctggtcttaaactcctgacctcaagtgatccgtctgtcttggcctttcaaaatgctgggattataggcgtgatccactgtgcctggcctggtgtttctttaggtataatgtctttaccagagagctaatgcagactgtcatgggtgagattgttctctgatgttcaattcccctactttgtatattgagtcagtatgagatgcgatttgtttggcaagcacctttgttcctgctgttactgacccttatcttgtagcctcacagctactatgcttttgtccagtccaactagataggagcttcttcctctgctgcagtgactggtctcacccagggctttcaggaaggtgagaataagcaccttcctcctcccaggaagttttgagtttcctgtgtttcatttctgaatgtaatgtctccatttattttcaattatgtttgattatatttgattaaaaacaataatttttttggcaaccaagatttctgtacatgtgtcatagaaatagttgaacttttccacaactgtatactgacaaacattattctttcttaattaattcagtagctatattaaaatatgtattagatcaagttca

SEQ ID NO: 204011 - DNA, 2036 bp, Homo sapiens
  Payload ID: 20235
  Gene Name: zinc finger protein 844
  ENST ID: ENST00000441304
  CDS Start-End: 65-280
ttctgtcgccctgtcgtctgtgttgtgactgctttggacgtgggagtcacctgaaagccaggaaatggacttggtggctttcgaggatgtggctgtgaacttcacccaggaggagtggtctttgctggatccttcccagaagaatctctacagagaagtgatgcaggaaaccttgaggaatctggcctccatagaagtcttctgggagagagagttgatgaaaatacagaagaaaatcattgtggagaaacttctagccagattccagatgacacactgaacaaaaaaacttctcctggagtaaaatcatgtgaaagcagtgtgtgtggagaagtcttcgtgggtcattcttcccttaataggcacattagagctgacactgcacacaagccgtctgagtatcaggaatatggacaggagccatataagtgtcaacaacgtaagaaagccttcagatgtcacccctcctttcaaatgcaagaaaaggctcacactggagaaaaactctatgattgtaaagaatgtggaaaaaccttcatatcccattcaagcattcaaagacacatgataatgcacaatggagatggaacttataaatgtaagttttgtgggaaagcctgcccttgtctcagcatatatcttatacatgaacgagttcacactggagagaaaccatataaatgtaaacaatgtggtaaagcctttagttattcaacttcccttcaaatacatgaaagaactcacactggagagaagccttatgaatgtaaggaatgtgggaaagcattcggtagtcccaattccctttatgaacatagaagaactcacactggagagaagccatatgaatgcaaacaatgtggaaaagccttcagatggttccattcctttcaaatacatgaaagaactcacagtgaggagaaggcttatgaatgtaccaaatgtgggaaagcattcaagtgtcccagttatctttgtagacatgaagtgacccactctgggaaaaagccctgtgaatgtaaacaatgtgggaaagcattatcttatcttaactttcaaagacacatgaaaatgcacactagaatgagaccttataaatgtaagactgtggaaaagcctttgattctcccagttcgttttgaagacatgaaagaactcacactggagagaaaccttatgaatgcaagcactgtggtaaagccttcaatcgttccagttcctttcactatcatgaaaggactcacactggagagaaaccctatgaatgtaagcagtgtagtaaagccttcatttcttccacttcctttcgatatcatgaaaggactcacactggagagaaaccgtatgagtgtaagcaatgtgggaaagccttcagatctgcctcacaccttcaaatgcatggaaggactcacactcaagagaaaccctatgaatgtaagcagtgtggtaaagccttcattttttccacttcctttcgatatcatgaaaggactcacactggagagaaaccctatgagtgtaagcaatgtgggaaagccttcacatctgcctcacaccttcaaatgcatgaaaggactcacactggaaagcaactgtatgaatctaaacaatgtgaaaaaacctttggatctgtcagaaaccttcaaattcatgaaaagacacaccctggagagaaaccctataaggaatatggaaaagcattcaacaatttctcttcctttcaaatacatgcaacaatgcacagaggacagaatgcctatgaatgtaaagagtgtgacaaagcattcatatctgccaagatccttcgagtacatgcaagaacacaccctggagagaaaccctatgaatgtaaggaatgcggaaaagcgttcaattatttttcttctttgcgtatacacaaaaggatgcacactggagagaaaccatattaatgtaaggattgtgggaaagcattcagtttgcctggttcctttcgtagacataaaagggctcacactggagtgaaaccgtatgaatgcaaggaatgtggcaaagcc

SEQ ID NO: 204012 - DNA, 716 bp, Homo sapiens
  Payload ID: 20235
  Gene Name: zinc finger protein 844
  ENST ID: ENST00000550826
  CDS Start-End: 427-716
agtctttggcccctcccgccgggtgaggttggcaccccgtttttcctgctctgagagggaccggttgccaccgccatacttctgtcgccctgtcgtctgtgttgtgactgctttggacgtgggagtcacctgaaagccaggaaatgaagtcttctgggagagagagttgatgaaaatacagaagaaaatcattgtggagaaacttctagccagattccagatgacacactgaacaaaaaaacttctcctggagtaaaatcatgtgaaagcagtgtgtgtggagaagtcttcgtgggtcattcttcccttaataggcacattagagctgacactgcacacaagccgtctgagtatcaggaatatggacaggagccatataagtgtcaacaacgtaagaaagccttcagatgtcacccctcctttcaaatgcaagaaaaggctcacactggagaaaaactctatgattgtaaagaatgtggaaaaaccttcatatcccattcaagcattcaaagacacatgataatgcacaatggagatggaacttataaatgtaagttttgtgggaaagcctgcccttgtctcagcatatatcttatacatgaacgagttcacactggagagaaaccatataaatgtaaacaatgtggtaaagcctttagttattcaacttcccttcaaatacatgaaagaactcacactggagagaagccttatga

SEQ ID NO: 204013 - DNA, 4311 bp, Homo sapiens
  Payload ID: 20236
  Gene Name: zinc finger protein 845
  Uniprot ID: Q96IR2
  ENST ID: ENST00000458035
  CDS Start-End: 118-3030
aaacccggaagcggatcgcatggagtgatggtcccaccgcagcggattgacttctaaagactcttggtacgtgaggaagaaacccggaagaggaagaggaaagcaaaggagtcagggatggctctttctcagggtctattgacattcagggatgtggccatagaattctctcaggaagagtggaagtgcctggaccctgctcagaggactctatacagggacgtgatgctggagaattataggaacctggtctccctggatatctcttccaaatgcatgatgaaggagttctcatcaacagcacaaggcaatacagaagtgatccacacagggacattgcaaagacatgaacgtcatcacattggagatttttgcttccaggaaatggagaaagatattcatgattttgagtttcagtggaaagaagatgaaagaaatagccatgaagcacccatgacagaaatcaaacagttgacgggtagtacaaaccgacatgatcaaaggcatgctggaaacaagcctattaaagatcagcttggatcaagctttcattcgcatctgcctgaactccacatgtttcagaccgaagggaaaattggtaatcaagttgagaagtctatcaacagtgcttcgttggtttcaacatcccaaagaatttcttgtaggcctaaaacccacatttctaagaactatgggaataatttcctgaattcttcattactcacacaaaagcaggaagtacacatgagagaaaaatctttccaatgtaatgagagtggcaaagcctttaattatagctcagtcttaaggaaacatcagataatccatttaggagcgaaacaatataaatgtgatgtgtgtggcaaggtctttaatcaaaagcgatatcttgcatgtcatcgtagatgtcacactggcaagaaaccttacaagtgtaatgattgtggcaagaccttcagtcaggagttaacccttacatgccatcatagacttcatactggagagaaacattacaagtgcagtgagtgtggcaagaccttcagtcgaaattcagcccttgtaattcataaggcaattcatactggagagaaatcttacaagtgtaatgaatgtggcaagaccttcagtcaaacgtcataccttgtgtaccatcgtagacttcatactggagagaaaccttacaaatgtgaagaatgtgacaaagctttcagtttcaaatcaaaccttgaaagacataggaaaattcatactggagagaaaccttacaagtgtaatgaatgcagcaggacctttagtcggaagtcatcccttacacgccatcgtagacttcatactggagagaaaccttataagtgtaatgattgtggcaagaccttcagtcagatgtcatcccttgtataccatcgtagacttcatactggagagaaaccttacaaatgtgaagaatgtgatgaagctttcagtttcaaatcgaaccttgaaagacataggagaattcatactggagagaaaccttacaagtgtaatgattgtggcaagaccttcagtcagacatcatcccttgtataccatcgtagacttcatactggagagaaaccttacaaatgtgaagaatgtgatgaagctttcagtttcaaatcaaaccttgaaagacataggataattcatactggagagaaactttacaagtgtaatgaatgtggcaagacctttagtcggaagtcatcccttacacgccattgtagacttcatactggagagaaaccttaccagtgtaatgagtgtggcaaagcctttcgtgggcagtcagcacttatttaccatcaagcaatccatggtatagggaaactttacaaatgtaatgattgtcaccaagtctttagtaatgctacaaccattgcaaatcattggagaatccataatgaagagagatcgtacaagtgtaatagatgtggcaaatttttcagacatcgttcataccttgcagttcattggcgaactcatagtggagagaaaccttacaaatgtgaagaatgtgatgaagctttcagtttcaaatcaaaccttcaaagacataggagaattcatactggagagaaaccttacaggtgtaatgaatgtggcaagacctttagtcggaagtcataccttacatgccatcgtagacttcatactggagagaaaccttacaagtgtaatgagtgtggcaagaccttcggtcgaaattcagcccttataattcacaaggcaattcatactggagagaaaccttacaagtgtaatgagtgtggcaaggccttcagtcagaagtcatcccttacatgccatcttagacttcatactggagagaaaccttacaaatgtgaagaatgtgacaaagttttcagtcgcaaatcaagccttgaaaaacacaggagaattcatactggagagaaaccatacaaatgtaaggtttgtgacaaagcttttgggcgtgattcacacctggcacaacatactagaattcacactggagagaaaccttacaagtgtaatgaatgtggcaagaacttccgtcacaattcagcccttgtaattcataaggcaattcatagtggagagaaaccttacaagtgtaatgagtgtggcaagaccttccgtcacaattcagcccttgaaattcataaggcaattcatactggagaaaaaccttacaagtgtagtgaatgtggcaaggtttttaatagaaaagcaaacctttcacgtcatcatagacttcatactggagagaaaccttacaagtgtaataaatgtggtaaggtttttaatcaacaagcacaccttgcatgtcatcatagaattcatactggagagaaaccttacaagtgtaatgagtgtggcaaaaccttccgtcacaattcagtccttgtaattcataagacaattcatactggagagaaaccttacaagtgtaatgaatgtggcaaggtttttaatcgaaaagcaaaacttgcacgtcatcatagaattcatactggaaagaaacattagaaatatgaagaatgtgacaaagtttacagttgtaaatcaagtcttgaaagacaggagaattcatactggagagaaagcttacaaatgtaagagtttgtgacaagaatcttgggcgtgattcacacctggcccaacaaactagaagtcacactggagagaaaccttacaagtgtactgagtgtggcaaagcctttagtgggcagtcaacacttattcaccatcaggcaatccatggtatagggaaactttactaatgtaatgattatcacaaagtcttcagtaacactacaaccgtttcaaatcattggagaatccataatgagagattttgaaagtgtaataaatgtggcaaatttttcagacattgttcataccttgcagttcatcggtgaactcatgctggagagaaaccttacaaatgtcatgattgtggcaaggtcttcagtctagcttcatcttatgcaaaacaggagacttcatacaggagacaaacttcacaagtatgatgattgcagcaaagcctttacttcacgttcacacctaattagacatcagagaatccatactggacagaaatcttacaaatgtcatcagtgtggcaaggtcttcagtctgagatcaccccttaaggaacatcagaaaattcatttttgagatgattgttccaaatgcaatgagtatagcaaaccatcaagcattaattggcattagagtcaattcagcattgacttgagtttgaattgacttaacattgagttcaagcattaattgacattaaagtgtttatgttaagaagattgggccaggcggggtggctcacgcctgtaatcccagcactttgggaggccaagaccaatagatcacttgaggtcaggagtttgagaccagactggccaacagacatgagtcacttttcccaccctgtattttgtttctttaataaaaactgttacgggtttttatgggtatctgttgaatctaaatcacatttgtttgtataatcattcaacaatattaagacttccaatccatcaatatgggttgtatgtctatttagtttttttgatcaatgtagatttcaaggtacaagcttctcacctccttaattcagtttatttgtaagtattaagtttcatagcaaattgaagtgtgttcataagtttctttaaacattatttattgttaatgtaaggaaattcaactaattttgggtgctgattttgtattctgcaaatacattgagtgggtttattagtatcagtaaaatcttggttgattctt

SEQ ID NO: 204014 - DNA, 4090 bp, Homo sapiens
  Payload ID: 20236
  Gene Name: zinc finger protein 845
  Uniprot ID: Q96IR2
  ENST ID: ENST00000595091
  CDS Start-End: 220-3132
aaacccggaagcggatcgcatggagtgatggtcccaccgcagcgccatgcaggcgtctttcctgttcctgggccgaggttgctcctgcctcaaggcgttcatgtgggctgtccctctgctggaactcgctggcccctcagctgcaggattgacttctaaagactcttggtacgtgaggaagaaacccggaagaggaagaggaaagcaaaggagtcagggatggctctttctcagggtctattgacattcagggatgtggccatagaattctctcaggaagagtggaagtgcctggaccctgctcagaggactctatacagggacgtgatgctggagaattataggaacctggtctccctggatatctcttccaaatgcatgatgaaggagttctcatcaacagcacaaggcaatacagaagtgatccacacagggacattgcaaagacatgaacgtcatcacattggagatttttgcttccaggaaatggagaaagatattcatgattttgagtttcagtggaaagaagatgaaagaaatagccatgaagcacccatgacagaaatcaaacagttgacgggtagtacaaaccgacatgatcaaaggcatgctggaaacaagcctattaaagatcagcttggatcaagctttcattcgcatctgcctgaactccacatgtttcagaccgaagggaaaattggtaatcaagttgagaagtctatcaacagtgcttcgttggtttcaacatcccaaagaatttcttgtaggcctaaaacccacatttctaagaactatgggaataatttcctgaattcttcattactcacacaaaagcaggaagtacacatgagagaaaaatctttccaatgtaatgagagtggcaaagcctttaattatagctcagtcttaaggaaacatcagataatccatttaggagcgaaacaatataaatgtgatgtgtgtggcaaggtctttaatcaaaagcgatatcttgcatgtcatcgtagatgtcacactggcaagaaaccttacaagtgtaatgattgtggcaagaccttcagtcaggagttaacccttacatgccatcatagacttcatactggagagaaacattacaagtgcagtgagtgtggcaagaccttcagtcgaaattcagcccttgtaattcataaggcaattcatactggagagaaatcttacaagtgtaatgaatgtggcaagaccttcagtcaaacgtcataccttgtgtaccatcgtagacttcatactggagagaaaccttacaaatgtgaagaatgtgacaaagctttcagtttcaaatcaaaccttgaaagacataggaaaattcatactggagagaaaccttacaagtgtaatgaatgcagcaggacctttagtcggaagtcatcccttacacgccatcgtagacttcatactggagagaaaccttataagtgtaatgattgtggcaagaccttcagtcagatgtcatcccttgtataccatcgtagacttcatactggagagaaaccttacaaatgtgaagaatgtgatgaagctttcagtttcaaatcgaaccttgaaagacataggagaattcatactggagagaaaccttacaagtgtaatgattgtggcaagaccttcagtcagacatcatcccttgtataccatcgtagacttcatactggagagaaaccttacaaatgtgaagaatgtgatgaagctttcagtttcaaatcaaaccttgaaagacataggataattcatactggagagaaactttacaagtgtaatgaatgtggcaagacctttagtcggaagtcatcccttacacgccattgtagacttcatactggagagaaaccttaccagtgtaatgagtgtggcaaagcctttcgtgggcagtcagcacttatttaccatcaagcaatccatggtatagggaaactttacaaatgtaatgattgtcaccaagtctttagtaatgctacaaccattgcaaatcattggagaatccataatgaagagagatcgtacaagtgtaatagatgtggcaaatttttcagacatcgttcataccttgcagttcattggcgaactcatagtggagagaaaccttacaaatgtgaagaatgtgatgaagctttcagtttcaaatcaaaccttcaaagacataggagaattcatactggagagaaaccttacaggtgtaatgaatgtggcaagacctttagtcggaagtcataccttacatgccatcgtagacttcatactggagagaaaccttacaagtgtaatgagtgtggcaagaccttcggtcgaaattcagcccttataattcacaaggcaattcatactggagagaaaccttacaagtgtaatgagtgtggcaaggccttcagtcagaagtcatcccttacatgccatcttagacttcatactggagagaaaccttacaaatgtgaagaatgtgacaaagttttcagtcgcaaatcaagccttgaaaaacacaggagaattcatactggagagaaaccatacaaatgtaaggtttgtgacaaagcttttgggcgtgattcacacctggcacaacatactagaattcacactggagagaaaccttacaagtgtaatgaatgtggcaagaacttccgtcacaattcagcccttgtaattcataaggcaattcatagtggagagaaaccttacaagtgtaatgagtgtggcaagaccttccgtcacaattcagcccttgaaattcataaggcaattcatactggagaaaaaccttacaagtgtagtgaatgtggcaaggtttttaatagaaaagcaaacctttcacgtcatcatagacttcatactggagagaaaccttacaagtgtaataaatgtggtaaggtttttaatcaacaagcacaccttgcatgtcatcatagaattcatactggagagaaaccttacaagtgtaatgagtgtggcaaaaccttccgtcacaattcagtccttgtaattcataagacaattcatactggagagaaaccttacaagtgtaatgaatgtggcaaggtttttaatcgaaaagcaaaacttgcacgtcatcatagaattcatactggaaagaaacattagaaatatgaagaatgtgacaaagtttacagttgtaaatcaagtcttgaaagacaggagaattcatactggagagaaagcttacaaatgtaagagtttgtgacaagaatcttgggcgtgattcacacctggcccaacaaactagaagtcacactggagagaaaccttacaagtgtactgagtgtggcaaagcctttagtgggcagtcaacacttattcaccatcaggcaatccatggtatagggaaactttactaatgtaatgattatcacaaagtcttcagtaacactacaaccgtttcaaatcattggagaatccataatgagagattttgaaagtgtaataaatgtggcaaatttttcagacattgttcataccttgcagttcatcggtgaactcatgctggagagaaaccttacaaatgtcatgattgtggcaaggtcttcagtctagcttcatcttatgcaaaacaggagacttcatacaggagacaaacttcacaagtatgatgattgcagcaaagcctttacttcacgttcacacctaattagacatcagagaatccatactggacagaaatcttacaaatgtcatcagtgtggcaaggtcttcagtctgagatcaccccttaaggaacatcagaaaattcatttttgagatgattgttccaaatgcaatgagtatagcaaaccatcaagcattaattggcattagagtcaattcagcattgacttgagtttgaattgacttaacattgagttcaagcattaattgacattaaagtgtttatgttaagaagattgggccaggcggggtggctcacgcctgtaatcccagcactttgggaggccaagaccaatagatcacttgaggtcaggagtttgagaccagactggccaacagacatgagtcacttttcccaccctgtattttgtttctttaataaaaactgttacgggtt

SEQ ID NO: 204015 - DNA, 526 bp, Homo sapiens
  Payload ID: 20236
  Gene Name: zinc finger protein 845
  ENST ID: ENST00000601857
  CDS Start-End: 118-526
aaacccggaagcggatcgcatggagtgatggtcccaccgcagcggattgacttctaaagactcttggtacgtgaggaagaaacccggaagaggaagaggaaagcaaaggagtcagggatggctctttctcagggtctattgacattcagggatgtggccatagaattctctcaggaagagtggaagtgcctggaccctgctcagaggactctatacagggacgtgatgctggagaattataggaacctggtctccctggatatctcttccaaatgcatgatgaaggagttctcatcaacagcacaaggcaatacagaagtgatccacacagggacattgcaaagacatgaacgtcatcacattggagatttttgcttccaggaaatggagaaagatattcatgattttgagtttcagtggaaagaagatgaaagaaatagccatgaagcacccatgacagaaatcaaacagttgacgggtagtacaaaccgacatgatcaaaggcatgctggaaacaagcctatta

SEQ ID NO: 204016 - DNA, 2016 bp, Homo sapiens
  Payload ID: 20237
  Gene Name: zinc finger protein 846
  Uniprot ID: Q147U1
  ENST ID: ENST00000397902
  CDS Start-End: 415-2016
gtgacgctccggacttctgctaggtctgagacgcgccggcctcccgctgctgctccggagaagcggcgcctcctccccgccaggaccccgaggcggggggttcccgccttctcttctgagcgcctcttcccgctgcgcccgcatcagtctgggcctggcccagggtccccggtggagacgtgtttttttctccaaccaccgtgcccctctgtttaaaagcagccagtcaacctttgtgtcctttctccagaaggaaaagcatctcagctgttgtggaaaagggccccagcgtcctcttgtcaccgacagggcgattgcagtgcgttccggtcattttttccaggacactttctgtcttcatgacaggaacatcgagaagccaaggctagtggctgggttactgatggattactgatggattcttctcagcacttagtgacctttgaggatgtggctgtggactttacccaggaggagtggactttgttggatcaagcccagagagatctctacagagatgtgatgttggagaactacaagaatctcattatactagcagggtctgaattattcaaacgtagtctcatgtctggattggaacaaatggaagagctgaggacaggagtgacaggagttctgcaggaattggatttgcaactcaaaaccaaaggctccccactgctgcaagatatttctgcagaaagatcaccaaatggagtacaattggagagaagcaatactgcagagaaactgtatgactctaaccattctggaaaagtcttcaatgaacacccatttcttatgactcacatgataactcacattggagagaaaacttctgaggataatcagagtggaaaagccttaagaaagaactttcctcatagtttttacaagaaaagtcatgctgaggggaaaatgcctaagtgtgttaaacatgaaaaagccttcaaccagtttccaaatcttactaggcagaataaaactcacacacaagagaaattgtgtgaatgcaaagactgttggagaacttttcttaatcagtcatcccttaagttacatataagatctcacaatggagacaaacactatgtatgtaaggaatgtgggaaagccttcagtaattcctcacaccttataggacatggaagaattcacagtggagagaagccctatgtctgtaaagaatgtggtaaagctttcactcaatccacaggacttaaattacacatcagaactcacagtggagaaaaaccatataaatgtaaagagtgtgggaaagccttcacccattcttcataccttactgatcatacaagaatccacagtggaaagaagccctatgtatgtatggaatgtggaaaagccttcactagatccacaggacttattttacacatgcgaattcacactggagaaaagccatatgaatgtaaggagtgtggaaaagcttttattcattcctcataccttacaaaacatgtaaggattcacagtggagagaagctgtatttatgtaaggcatgtgggaaagcttttactcgttcctcaggacttgttttacacatgagaacacatactggagaaaagccctatgaatgtaaagaatgtgggaaagcctttaataattcctcaatgcttagtcaacatgtaaggattcacactggagagaagccatatgaatgcaaagaatgtgggaaagctttcactcaatcctcgggccttagtacccatttaagaactcacactggagaaaaggcctgtgaatgtaaggaatgcggtaaagcatttgctcgttccacaaatcttaatatgcacatgcgaacgcacacaggagaaaagccttatgcatgtaaagaatgtgggaaagccttcaggtattccacataccttaacgttcacacacgaactcacactggagcaaaaccatatgaatgtaagaaatgtgggaaaaacttcactcaatcttcagcacttgctaaacatctaagaactaaggcatgtgaaaaaacctga

SEQ ID NO: 204017 - DNA, 1943 bp, Homo sapiens
  Payload ID: 20237
  Gene Name: zinc finger protein 846
  Uniprot ID: Q147U1
  ENST ID: ENST00000588267
  CDS Start-End: 1012-1644
gtattccccgctctccagcagcttcctagctgggttttcacctcagccagcgctcatgctcaacctaggcagggcggggcaggagggcctagcgggaggcggagcgagggtcggagggtgacgctccggacttctgctaggtctgagacgcgccggcctcccgctgctgctccggagaagcggcgcctcctccccgccaggaccccgaggcggggggttcccgccttctcttctgagcgcctcttcccgctgcgcccgcatcagtctgggcctggcccagggtccccggtggagacgtgtttttttctccaaccaccgtgcccctctgtttaaaagcagccagtcaacctttgtgtcctttctccagaaggaaaagcatctcagctgttgtggaaaagggccccagcgtcctcttgtcaccgacagggcgattgcagtgcgttccggtcattttttccaggacactttctgtcttcatgacaggaacatcgagaagccaaggctagtggctgggttactgatggattactgatggattcttctcaggcaagtggaaagcagacctaacttcaaaatgttatgcttgtagccatcatcggtagccttaccttgttatcgtgtattcaagcatcttaaagaaatgatggtcctgctcaggaaataactccccagaacatcaaaggagatggtacttagctgaagctggcatgtatttaatggtttagcacttagtgacctttgaggatgtggctgtggactttacccaggaggagtggactttgttggatcaagcccagagagatctctacagagatgtgatgttggagaactacaagaatctcattatactagggtctgaattattcaaacgtagtctcatgtctggattggaacaaatggaagagctgaggacaggagtgacaggagttctgcagggagagaagcaatactgcagagaaactgtatgactctaaccattctggaaaagtcttcaatgaacacccatttcttatgactcacatgataactcacattggagagaaaacttctgaggataatcagagtggaaaagccttaagaaagaactttcctcatagtttttacaagaaaagtcatgctgaggggaaaatgcctaagtgtgttaaacatgaaaaagccttcaaccagtttccaaatcttactaggcagaataaaactcacacacaagagaaattgtgtgaatgcaaagactgttggagaacttttcttaatcagtcatcccttaagttacatataagatctcacaatggagacaaacactatgtatgtaaggaatgtgggaaagccttcagtaattcctcacaccttataggacatggaagaattcacagtggagagaagccctatgtctgtaaagaatgtggtaaagctttcactcaatccacaggacttaaattacacatcagaactcacagtggagaaaaaccatataaatgtaaagagtgtgggaaagccttcacccattcttcataccttactgatcatacaagaatccacagtggaaagaagccctatgtatgtatggaatgtggaaaagccttcactagatccacaggacttattttacacatgcgaattcacactggagaaaagccatatgaatagacgaagtttcatcatgttgtccaggctggtgtcaaactcctgacttcaggtgatccacccaccttggcctcccaaagtgctgggattatggacgtgagccaccacacccgcccttgaaatactgtttctaaaaggtatatggaagaacaataggcaaggataatcaagacccagctgataaaaaaggtggaagaacttgccctaatgaatatcaagattaaaactatagtaattaagatgctgttgcattgtacacagacaactagactattggtacaaaatagtctggaaatagtcac

SEQ ID NO: 204018 - DNA, 548 bp, Homo sapiens
  Payload ID: 20237
  Gene Name: zinc finger protein 846
  ENST ID: ENST00000592587
  CDS Start-End: 250-548
gccgaccctcccaccgcctcacgcctcggagaccgggtccagagccctcagccgcttccgagccccgagaggggaatcagaagtgcgcgtgatcagagcggcacccccttcccaggaaccgcagctgaaccaacggtttcccctgcaccagcctttgcgaccaggtcattttttccaggacactttctgtcttcatgacaggaacatcgagaagccaaggctagtggctgggttactgatggattactgatggattcttctcagcacttagtgacctttgaggatgtggctgtggactttacccaggaggagtggactttgttggatcaagcccagagagatctctacagagatgtgatgttggagaactacaagaatctcattatactagcagggtctgaattattcaaacgtagtctcatgtctggattggaacaaatggaagagctgaggacaggagtgacaggagttctgcaggaattggatttgcaactcaaaaccaaaggctccccactgctgcaagatatttctgcagaaagatcaccaaa

SEQ ID NO: 204019 - DNA, 1621 bp, Homo sapiens
  Payload ID: 20237
  Gene Name: zinc finger protein 846
  ENST ID: ENST00000586293
  CDS Start-End: 103-363
gattgcagtgcgttccggtcattttttccaggacactttctgtcttcatgacaggaacatcgagaagccaaggctagtggctgggttactgatggattactgatggattcttctcagcacttagtgacctttgaggatgtggctgtggactttacccaggaggagtggactttgttggatcaagcccagagagatctctacagagatgtgatgttggagaactacaagaatctcattatactagcagggtctgaattattcaaacgtagtctcatgtctggattggaacaaatggaagagctgaggacaggagtgacaggagttctgcagggagagaagcaatactgcagagaaactgtatgactctaaccattctggaaaagtcttcaatgaacacccatttcttatgactcacatgataactcacattggagagaaaacttctgaggataatcagagtggaaaagccttaagaaagaactttcctcatagtttttacaagaaaagtcatgctgaggggaaaatgcctaagtgtgttaaacatgaaaaagccttcaaccagtttccaaatcttactaggcagaataaaactcacacacaagagaaattgtgtgaatgcaaagactgttggagaacttttcttaatcagtcatcccttaagttacatataagatctcacaatggagacaaacactatgtatgtaaggaatgtgggaaagccttcagtaattcctcacaccttataggacatggaagaattcacagtggagagaagccctatgtctgtaaagaatgtggtaaagctttcactcaatccacaggacttaaattacacatcagaactcacagtggagaaaaaccatataaatgtaaagagtgtgggaaagccttcacccattcttcataccttactgatcatacaagaatccacagtggaaagaagccctatgtatgtatggaatgtggaaaagccttcactagatccacaggacttattttacacatgcgaattcacactggagaaaagccatatgaatgtaaggagtgtggaaaagcttttattcattcctcataccttacaaaacatgtaaggattcacagtggagagaagctgtatttatgtaaggcatgtgggaaagcttttactcgttcctcaggacttgttttacacatgagaacacatactggagaaaagccctatgaatgtaaagaatgtgggaaagcctttaataattcctcaatgcttagtcaacatgtaaggattcacactggagagaagccatatgaatgcaaagaatgtgggaaagctttcactcaatcctcgggccttagtacccatttaagaactcacactggagaaaaggcctgtgaatgtaaggaatgcggtaaagcatttgctcgttccacaaatcttaatatgcacatgcgaacgcacacaggagaaaagccttatgcatgtaaagaatgtgggaaagccttcaggtattccacataccttaacgttcacacacgaactcacactggagcaaaaccatatgaatgtaagaaatgtgggaaaaacttcactcaatcttcagcacttgctaaacatctaagaactaaggcatgtgaaaaaacctga

SEQ ID NO: 204020 - DNA, 683 bp, Homo sapiens
  Payload ID: 20237
  Gene Name: zinc finger protein 846
  ENST ID: ENST00000589412
  CDS Start-End: 157-683
tcctgccctttagccgccgctggcccaacggtttccccagcagtagcctctgcgaccaggtgcggcttcaggtcattttttccaggacactttctgtcttcatgacaggaacatcgagaagccaaggctagtggctgggttactgatggattactgatggattcttctcagcacttagtgacctttgaggatgtggctgtggactttacccaggaggagtggactttgttggatcaagcccagagagatctctacagagatgtgatgttggagaactacaagaatctcattatactagggtctgaattattcaaacgtagtctcatgtctggattggaacaaatggaagagctgaggacaggagtgacaggagttctgcaggaattggatttgcaactcaaaaccaaaggctccccactgctgcaagatatttctgcagaaagatcaccaaatggagtacaattggagagaagcaatactgcagagaaactgtatgactctaaccattctggaaaagtcttcaatgaacacccatttcttatgactcacatgataactcacattggagagaaaacttctgaggataatcagagtggaaaagccttaagaaagaactttcctcatagtttttacaagaaaagtcatgctgaggggaaaatgcctaagtgtgttaaacatgaaaa

SEQ ID NO: 204021 - DNA, 482 bp, Homo sapiens
  Payload ID: 20237
  Gene Name: zinc finger protein 846
  ENST ID: ENST00000586814
  CDS Start-End: 238-482
aactcctcaggcctccgaggccgggtccagagccctcagttccttctgaaaccctggagcggaatcagaagtgcgcgtggccacagcggcgcctcctgccctttagccgccgctggcccaacggtttccccagcagtagcctctgcgaccaggtcattttttccaggacactttctgtcttcatgacaggaacatcgagaagccaaggctagtggctgggttactgatggattactgatggattcttctcagcacttagtgacctttgaggatgtggctgtggactttacccaggaggagtggactttgttggatcaagcccagagagatctctacagagatgtgatgttggagaactacaagaatctcattatactagcagggtctgaattattcaaacgtagtctcatgtctggattggaacaaatggaagagctgaggacaggagtgacaggagttctgcagggagagaagcaatactg

SEQ ID NO: 204022 - DNA, 1580 bp, Homo sapiens
  Payload ID: 20237
  Gene Name: zinc finger protein 846
  ENST ID: ENST00000589453
  CDS Start-End: 415-675
gtgacgctccggacttctgctaggtctgagacgcgccggcctcccgctgctgctccggagaagcggcgcctcctccccgccaggaccccgaggcggggggttcccgccttctcttctgagcgcctcttcccgctgcgcccgcatcagtctgggcctggcccagggtccccggtggagacgtgtttttttctccaaccaccgtgcccctctgtttaaaagcagccagtcaacctttgtgtcctttctccagaaggaaaagcatctcagctgttgtggaaaagggccccagcgtcctcttgtcaccgacagggcgattgcagtgcgttccggtcattttttccaggacactttctgtcttcatgacaggaacatcgagaagccaaggctagtggctgggttactgatggattactgatggattcttctcagcacttagtgacctttgaggatgtggctgtggactttacccaggaggagtggactttgttggatcaagcccagagagatctctacagagatgtgatgttggagaactacaagaatctcattatactagcagggtctgaattattcaaacgtagtctcatgtctggattggaacaaatggaagagctgaggacaggagtgacaggagttctgcagggagagaagcaatactgcagagaaactgtatgactctaaccattctggaaaagtcttcaatgaacacccatttcttatgactcacatgataactcacattggagagaaaacttctgaggataatcagagtggaaaagccttaagaaagaactttcctcatagtttttacaagaaaagtcatgctgaggggaaaatgcctaagtgtgttaaacatgaaaaagccttcaaccagtttccaaatcttactaggcagaataaaactcacacacaagagaaattgtgtgaatgcaaagactgttggagaacttttcttaatcagtcatcccttaagttacatataagatctcacaatggagacaaacactatgtatgtaaggaatgtgggaaagccttcagtaattcctcacaccttataggacatggaagaattcacagtggagagaagccctatgtctgtaaagaatgtggtaaagctttcactcaatccacaggacttaaattacacatcagaactcacagtggagaaaaaccatataaatgtaaagagtgtgggaaagccttcacccattcttcataccttactgatcatacaagaatccacagtggaaagaagccctatgtatgtatggaatgtggaaaagccttcactagatccacaggacttattttacacatgcgaattcacactggagaaaagccatatgaattagagacggggtttcaccgttttagccgggatggtctcgatctcctgaccttgtgatccgcccgcttcggcctcccaaagtgctgggattacaggcgtgagccaccgcgcccggcctgagacgaagtttcatcatgttgtccaggctggtgtcaaactcctgacttcaggtgatccacccacctcggcctccgaagtgctgggattacaggcatgagccactgcaccccgc

SEQ ID NO: 204023 - DNA, 1206 bp, Homo sapiens
  Payload ID: 20237
  Gene Name: zinc finger protein 846
  Uniprot ID: Q147U1
  ENST ID: ENST00000592859
  CDS Start-End: 520-1152
attccccgctctccagcagcttcctagctgggttttcacctcagccagcgctcatgctcaacctaggcagggcggggcaggagggcctagcgggaggcggagcgagggtcggagggtgacgctccggacttctgctaggtctgagacgcgccggcctcccgctgctgctccggagaagcggcgcctcctccccgccaggaccccgaggcggggggttcccgccttctcttctgagcgcctcttcccgctgcgcccgcatcagtctgggcctggcccagggtccccggtggagacgtgtttttttctccaaccaccgtgcccctctgtttaaaagcagccagtcaacctttgtgtcctttctccagaaggaaaagcatctcagctgttgtggaaaagggccccagcgtcctcttgtcaccgacagggcgattgcagtgcgttccggagagaagcaatactgcagagaaactgtatgactctaaccattctggaaaagtcttcaatgaacacccatttcttatgactcacatgataactcacattggagagaaaacttctgaggataatcagagtggaaaagccttaagaaagaactttcctcatagtttttacaagaaaagtcatgctgaggggaaaatgcctaagtgtgttaaacatgaaaaagccttcaaccagtttccaaatcttactaggcagaataaaactcacacacaagagaaattgtgtgaatgcaaagactgttggagaacttttcttaatcagtcatcccttaagttacatataagatctcacaatggagacaaacactatgtatgtaaggaatgtgggaaagccttcagtaattcctcacaccttataggacatggaagaattcacagtggagagaagccctatgtctgtaaagaatgtggtaaagctttcactcaatccacaggacttaaattacacatcagaactcacagtggagaaaaaccatataaatgtaaagagtgtgggaaagccttcacccattcttcataccttactgatcatacaagaatccacagtggaaagaagccctatgtatgtatggaatgtggaaaagccttcactagatccacaggacttattttacacatgcgaattcacactggagaaaagccatatgaatagacgaagtttcatcatgttgtccaggctggtgtcaaactcctgacttcaggtgat

SEQ ID NO: 204024 - DNA, 1531 bp, Homo sapiens
  Payload ID: 20238
  Gene Name: zinc finger protein 85
  Uniprot ID: Q03923
  ENST ID: ENST00000300540
  CDS Start-End: 126-389
gctctaggtcttgttttccctgctttgtgttttctgctcgtggacgcccagcctctgtggccctgtggcctgcaggtattgggagatccacagctaagacgccgggaccccctggaagcctagaaatgggaccattgacatttagggatgtggccatagaattctctctgaaggagtggcaatgcctggacactgcacagcggaatttatatagaaatgtgatgttagagaactacagaaacctggtcttcctgggtattactgtttctaagccagacctgatcacttgtctggagcaagggaaagaggcctggagtatgaagagacatgagatcatggtggccaaacccacagaatcttactctgtcacccagtctggaatgcagtagcaagattttggcccactgcagcctcaaccttctggggtcaagtgattgttccacctcagcctcccgagtagcttggactacagacatgcagtactatgcctggctaattttttgattatttgtagagacagagtctcactttgttgcccagtctagtctcaaacttctggctccaaatgatcctcctaccttggtctcccaaagtgttgggattataggtatgagcctgttcacccagccagtattcttaaatttaataagatttgttatgtgtcctaacagaatacacaaggtgcaaataagaatgttgtgtattctcttgcttttgactgaaaagttttgtacatgtctgttaatcctagttggtctgtgatgtggtttagatgttcgtgttcttcaaatcttatgctgcaatgtaatcctcactgttggatgtggaacctggtgggagatgtttagatcatggggcaaatttctcatgaatggctttgtactatcctcttggtaatcaaaaagtttacactctgttaattcagatgagagctgcctcattaaaagaacctggccccttcacctcacatttggttctgtcttttactatgtgatatgtccagttactgttggccttccaccattgtggaagcttactgaaaccttccaccagaggcagatgccggcacacacttcttgtacagtctgcccaacgatgaaccaaacaagcctttttatttataaattatccactctcaggtattcctctatgtgcaaaataatatattctgtaacgttgtctaagttttctgttttcttattgatcttttgtctgaattttctatttattattaaaaatggggtcttgatgtctacaattattatgttgctatgtatttcttgtttcacttttgtcaatatttgctttacgtattttggagccctaatgttgtatatacatatacacataaataaataggcataatagttttagattcctggtaaattgatccattttactattgtataatatcagtctttgtctcatgctagtacttgacttaaagcatataatgtctaatataattatgagtgtcttactcaattgtggttatatttgcatgtaataaaaagtttttccattctgttac

SEQ ID NO: 204025 - DNA, 2296 bp, Homo sapiens
  Payload ID: 20238
  Gene Name: zinc finger protein 85
  Uniprot ID: Q03923
  ENST ID: ENST00000328178
  CDS Start-End: 114-1901
gttttccctgctttgtgttttctgctcgtggacgcccagcctctgtggccctgtggcctgcaggtattgggagatccacagctaagacgccgggaccccctggaagcctagaaatgggaccattgacatttagggatgtggccatagaattctctctgaaggagtggcaatgcctggacactgcacagcggaatttatatagaaatgtgatgttagagaactacagaaacctggtcttcctgggtattactgtttctaagccagacctgatcacttgtctggagcaagggaaagaggcctggagtatgaagagacatgagatcatggtggccaaacccacagttatgtgttctcattttgcccaagacctttggccggagcagaatataaaagattctttccaaaaagtgacactgaaaagatatggaaaatgtagacatgaaaatttaccattaagaaaaggctgtgaaagtatggatgagtgtaagatgcacaaaggaggttgtaatggacttaaccaatgtctcacagctacccagagcaaaatatttcaatgtgataaatatgtaaaagtcgctcataaattttcaaattcaaacagacatgagataagacatactaaaaagaaacctttcaaatgtacaaaatgtggcaaatcatttggcatgatttcatgcctaactgaacatagcagaattcatactagagtaaatttctacaaatgtgaagaatgtggaaaagcctttaactggtcctcaacccttactaaacataagagaattcatacgggagagaaaccttacaaatgtgaagaatgtggtaaagcctttaaccagtcctcaaaccttattaaacataagaaaattcatactggagagaaaccctacaaatgtgaagaatgtggcaaaacttttaaccgattctcaactcttactacccataagataattcatactggagagaaaccctacaaatgtaaagaatgtggtaaagcttttaaccgatcttcaacccttactacccatagaaaaattcatactggagagaaaccttacaaatgtgaagaatgtggcaaagcctttaagcagtcctcaaaccttactacacataagataattcatactggagagaaaccctacaaatgtaaaaaatgtggaaaagcctttaaccagtctgcacaccttaccacacatgaggtaattcatactggagagaaaccctacaaatgtgaaaaatgtggaaaagcctttaatcatttctcacaccttactacacataagataattcatactggagagaaaccttacaaatgtaaagaatgtggtaaagcttttaaacactcttcaacccttactaaacataagataattcatactggagagaagccttacaaatgtaaagaatgtgaaaaagcttttaaccaatcctcaaaacttactgaacataagaaaattcatactggagagaaaccctatgaatgtgaaaaatgtggcaaagcttttaaccagtcctcaaatcttactagacataagaaaagtcatacagaagagaaaccttacaaatgtgaagaatgtggcaaaggttttaaatggccctcaacccttactatccataagataattcatactggagagaaaccatacaaatgtgaagaatgtggcaaagcttttaaccaatcctcaaaacttaccaaacataagaaaattcatactggagagaaaccctacacatgtgaagaatgtggcaaagcctttaaccagtcctcaaaccttactaaacataagagaattcatactggagaaaaaccttacaaatgtgaagaatgtgacaaagcttttaaatggtcctcagtccttactaaacataagataattcataccggagaaaaattacaaatatgaaaattatggcaaagctttaatcaatttacaagtcttactaaacataagaaaatttatactggagagaaactactaacctgaaagatgtgacaataattttgacaacacctcagacttataaaagtaatcatactggtgagaaattctaaaaatgtgaagactatggcaaagtctttaaatggttgtcacactttaggtaagataattcatattggaacaaactacaagtgcaaacaatgtggcaaaacttaatttatgctcacaccttactgcacagaaaagaatttttagttgagaaaaagtatacaaatataaagaatgtggaaaagccgttaatatctgctcacatcttactcagcatcagaaagtacttaataaaagcattataaatggaa

SEQ ID NO: 204026 - DNA, 1689 bp, Homo sapiens
  Payload ID: 20238
  Gene Name: zinc finger protein 85
  Uniprot ID: Q03923
  ENST ID: ENST00000345030
  CDS Start-End: 1-1689
atgggaccattgacatttagggatgtggccatagaattctctctgaaggagtggcaatgcctggacactgcacagcggaatttatatagaaatgtgatgttagagaactacagaaacctggtcttcctggttatgtgttctcattttgcccaagacctttggccggagcagaatataaaagattctttccaaaaagtgacactgaaaagatatggaaaatgtagacatgaaaatttaccattaagaaaaggctgtgaaagtatggatgagtgtaagatgcacaaaggaggttgtaatggacttaaccaatgtctcacagctacccagagcaaaatatttcaatgtgataaatatgtaaaagtcgctcataaattttcaaattcaaacagacatgagataagacatactaaaaagaaacctttcaaatgtacaaaatgtggcaaatcatttggcatgatttcatgcctaactgaacatagcagaattcatactagagtaaatttctacaaatgtgaagaatgtggaaaagcctttaactggtcctcaacccttactaaacataagagaattcatacgggagagaaaccttacaaatgtgaagaatgtggtaaagcctttaaccagtcctcaaaccttattaaacataagaaaattcatactggagagaaaccctacaaatgtgaagaatgtggcaaaacttttaaccgattctcaactcttactacccataagataattcatactggagagaaaccctacaaatgtaaagaatgtggtaaagcttttaaccgatcttcaacccttactacccatagaaaaattcatactggagagaaaccttacaaatgtgaagaatgtggcaaagcctttaagcagtcctcaaaccttactacacataagataattcatactggagagaaaccctacaaatgtaaaaaatgtggaaaagcctttaaccagtctgcacaccttaccacacatgaggtaattcatactggagagaaaccctacaaatgtgaaaaatgtggaaaagcctttaatcatttctcacaccttactacacataagataattcatactggagagaaaccttacaaatgtaaagaatgtggtaaagcttttaaacactcttcaacccttactaaacataagataattcatactggagagaagccttacaaatgtaaagaatgtgaaaaagcttttaaccaatcctcaaaacttactgaacataagaaaattcatactggagagaaaccctatgaatgtgaaaaatgtggcaaagcttttaaccagtcctcaaatcttactagacataagaaaagtcatacagaagagaaaccttacaaatgtgaagaatgtggcaaaggttttaaatggccctcaacccttactatccataagataattcatactggagagaaaccatacaaatgtgaagaatgtggcaaagcttttaaccaatcctcaaaacttaccaaacataagaaaattcatactggagagaaaccctacacatgtgaagaatgtggcaaagcctttaaccagtcctcaaaccttactaaacataagagaattcatactggagaaaaaccttacaaatgtgaagaatgtgacaaagcttttaaatggtcctcagtccttactaaacataagataattcataccggagaaaaattacaaatatga

SEQ ID NO: 204027 - DNA, 556 bp, Homo sapiens
  Payload ID: 20238
  Gene Name: zinc finger protein 85
  ENST ID: ENST00000595854
  CDS Start-End: 117-556
cttgttttccctgctttgtgttttctgctcgtggacgcccagcctctgtggccctgtggcctgcaggtattgggagatccacagctaagacgccgggaccccctggaagcctagaaatgggaccattgacatttagggatgtggccatagaattctctctgaaggagtggcaatgcctggacactgcacagcggaatttatatagaaatgtgatgttagagaactacagaaacctggtcttcctgggtattactgtttctaagccagacctgatcacttgtctggagcaagggaaagaggcctggagtatgaagagacatgagatcatggtggccaaacccacaggtgaagtttcacgctgtcgcccaggctggagtacagagtgcaatggcgcgatctcggctcactgcagcctccgcctcctgggttcaagcaattctcctgcctcagcctctcaagtagctgagattacaggcatgcgccaccatgcccggctcatttttgtatttttagtggaggtggggtttcaccatgttggacacgctggtctcgaact

SEQ ID NO: 204028 - DNA, 1259 bp, Homo sapiens
  Payload ID: 20238
  Gene Name: zinc finger protein 85
  ENST ID: ENST00000596476
  CDS Start-End: 201-368
tgctcgtggacgcccagcctctgtggccctgtggcctgcaggtattgggagatccacagctaagacgccgggaccccctggaagcctagaaatggtgagagtgccagggaccattgacatttagggatgtggccatagaattctctctgaaggagtggcaatgcctggacactgcacagcggaatttatatagaaatgtgatgttagagaactacagaaacctggtcttcctgggtattactgtttctaagccagacctgatcacttgtctggagcaagggaaagaggcctggagtatgaagagacatgagatcatggtggccaaacccacagaatcttactctgtcacccagtctggaatgcagtagcaagattttggcccactgcagcctcaaccttctggggtcaagtgattgttccacctcagcctcccgagtagcttggactacagacatgcagtactatgcctggctaattttttgattatttgtagagacagagtctcactttgttgcccagtctagtctcaaacttctggctccaaatgatcctcctaccttggtctcccaaagtgttgggattataggtatgagcctgttcacccagccagtattcttaaatttaataagatttgttatgtgtcctaacagaatacacaaggtgcaaataagaatgttgtgtattctcttgcttttgactgaaaagttttgtacatgtctgttaatcctagttggtctgtgatgtggtttagatgttcgtgttcttcaaatcttatgctgcaatgtaatcctcactgttggatgtggaacctggtgggagatgtttagatcatggggcaaatttctcatgaatggctttgtactatcctcttggtaatcaaaaagtttacactctgttaattcagatgagagctgcctcattaaaagaacctggccccttcacctcacatttggttctgtcttttactatgtgatatgtccagttactgttggccttccaccattgtggaagcttactgaaaccttccaccagaggcagatgccggcacacacttcttgtacagtctgcccaacgatgaaccaaacaagcctttttatttataaattatccactctcaggtattcctctatgtgcaaaataatatattctgtaacgttgtctaagttttctgttttcttattgatcttttgtctgaattttctatttattattaaaaatggggtcttgatgtctacaattattatgttgctatgtatttc

SEQ ID NO: 204029 - DNA, 773 bp, Homo sapiens
  Payload ID: 20238
  Gene Name: zinc finger protein 85
  ENST ID: ENST00000595742
  CDS Start-End: 80-773
aaaagaggcaaaggcagaggagaacaaaggaaggagggagcaacttgtggatgctgagaaaggttgtctatcaaaaagaatgtcgtatgagctattgagaaaggtgtatatcctgatgttactgaggagtgttctctatgcctctgttagaattatgtgttctcattttgcccaagacctttggccggagcagaatataaaagattctttccaaaaagtgacactgaaaagatatggaaaatgtagacatgaaaatttaccattaagaaaaggctgtgaaagtatggatgagtgtaagatgcacaaaggaggttgtaatggacttaaccaatgtctcacagctacccagagcaaaatatttcaatgtgataaatatgtaaaagtcgctcataaattttcaaattcaaacagacatgagataagacatactaaaaagaaacctttcaaatgtacaaaatgtggcaaatcatttggcatgatttcatgcctaactgaacatagcagaattcatactagagtaaatttctacaaatgtgaagaatgtggaaaagcctttaactggtcctcaacccttactaaacataagagaattcatacgggagagaaaccttacaaatgtgaagaatgtggtaaagcctttaaccagtcctcaaaccttattaaacataagaaaattcatactggagagaaaccctacaaatgtgaagaatgtggcaaaacttttaaccgattctcaactcttactacccataagataattcatactggagaga

SEQ ID NO: 204030 - DNA, 483 bp, Homo sapiens
  Payload ID: 20238
  Gene Name: zinc finger protein 85
  ENST ID: ENST00000601284
  CDS Start-End: 117-483
cttgttttccctgctttgtgttttctgctcgtggacgcccagcctctgtggccctgtggcctgcaggtattgggagatccacagctaagacgccgggaccccctggaagcctagaaatgggaccattgacatttagggatgtggccatagaattctctctgaaggagtggcaatgcctggacactgcacagcggaatttatatagaaatgtgatgttagagaactacagaaacctggtcttcctgggtattactgtttctaagccagacctgatcacttgtctggagcaagggaaagaggcctggagtatgaagagacatgagatcatggtggccaaacccacaggttgtctatcaaaaagaatgtcgtatgagctattgagaaaggtgtatatcctgatgttactgaggagtgttctctatgcctctgttagaattatgtgttctcattttgcccaagacctttggccggagcagaatataa

SEQ ID NO: 204031 - DNA, 549 bp, Homo sapiens
  Payload ID: 20238
  Gene Name: zinc finger protein 85
  ENST ID: ENST00000599885
  CDS Start-End: 163-549
gttttctgctcgtggacgcccagcctctgtggccctgtggcctgcaggtattgggagatccacagctaagacgccgggaccccctggaagcctagaaatggtattactgtttctaagccagacctgatcacttgtctggagcaagggaaagaggcctggagtatgaagagacatgagatcatggtggccaaacccacagttatgtgttctcattttgcccaagacctttggccggagcagaatataaaagattctttccaaaaagtgacactgaaaagatatggaaaatgtagacatgaaaatttaccattaagaaaaggctgtgaaagtatggatgagtgtaagatgcacaaaggaggttgtaatggacttaaccaatgtctcacagctacccagagcaaaatatttcaatgtgataaatatgtaaaagtcgctcataaattttcaaattcaaacagacatgagataagacatactaaaaagaaacctttcaaatgtacaaaatgtggcaaatcatttggcatgatttcatgcctaactgaacatagc

SEQ ID NO: 204032 - DNA, 506 bp, Homo sapiens
  Payload ID: 20238
  Gene Name: zinc finger protein 85
  ENST ID: ENST00000601924
  CDS Start-End: 149-506
ctttgtctctcgctgcagcctgagctctaggtcttgttttccctgctttgtgttttctgctcgtggacgcccagcctctgtggccctgtggcctgcaggtattgggagatccacagctaagacgccgggaccccctggaagcctagaaatgggaccattgacatttagggatgtggccatagaattctctctgaaggagtggcaatgcctggacactgcacagcggaatttatatagaaatgtgatgttagagaactacagaaacctggtcttcctggacctgatcacttgtctggagcaagggaaagaggcctggagtatgaagagacatgagatcatggtggccaaacccacagttatgtgttctcattttgcccaagacctttggccggagcagaatataaaagattctttccaaaaagtgacactgaaaagatatggaaaatgtagacatgaaaatttaccattaagaaaaggctgtgaaagtatggatgagtgtaagatgc

SEQ ID NO: 204033 - DNA, 563 bp, Homo sapiens
  Payload ID: 20238
  Gene Name: zinc finger protein 85
  ENST ID: ENST00000597314
  CDS Start-End: 180-368
ggatagggcggcttccgggatgtggcggggcctttgtctctcgctgcagcctgagctctaggtcttgttttccctgctttgtgttttctgctcgtggacgcccagcctctgtggccctgtggcctgcaggtattgggagatccacagctaagacgccgggaccccctggaagcctagaaatgggaccattgacatttagggatgtggccatagaattctctctgaaggagtggcaatgcctggacactgcacagcggaatttatatagaaatgtgatgttagagaactacagaaacctggtcttcctggccagacctgatcacttgtctggagcaagggaaagaggcctggagtatgaagagacatgagatcatggtggccaaacccacagttatgtgttctcattttgcccaagacctttggccggagcagaatataaaagattctttccaaaaagtgacactgaaaagatatggaaaatgtagacatgaaaatttaccattaagaaaaggctgtgaaagtatggatgagtgtaagatgcacaaaggaggttgtaatggact

SEQ ID NO: 204034 - DNA, 782 bp, Homo sapiens
  Payload ID: 20238
  Gene Name: zinc finger protein 85
  ENST ID: ENST00000599064
  CDS Start-End: 79-782
acttagaactttctaaaagaggcaaaggcagaggagaacaaaggaaggagggagcaacttgtggatgctgagaaagttatgtgttctcattttgcccaagacctttggccggagcagaatataaaagattctttccaaaaagtgacactgaaaagatatggaaaatgtagacatgaaaatttaccattaagaaaaggctgtgaaagtatggatgagtgtaagatgcacaaaggaggttgtaatggacttaaccaatgtctcacagctacccagagcaaaatatttcaatgtgataaatatgtaaaagtcgctcataaattttcaaattcaaacagacatgagataagacatactaaaaagaaacctttcaaatgtacaaaatgtggcaaatcatttggcatgatttcatgcctaactgaacatagcagaattcatactagagtaaatttctacaaatgtgaagaatgtggaaaagcctttaactggtcctcaacccttactaaacataagagaattcatacgggagagaaaccttacaaatgtgaagaatgtggtaaagcctttaaccagtcctcaaaccttattaaacataagaaaattcatactggagagaaaccctacaaatgtgaagaatgtggcaaaacttttaaccgattctcaactcttactacccataagataattcatactggagagaaaccctacaaatgtaaagaatgtggtaaagcttttaaccgatcttcaacccttactacccatagaaaaattcatactggagagaa

SEQ ID NO: 204035 - DNA, 1661 bp, Homo sapiens
  Payload ID: 20238
  Gene Name: zinc finger protein 85
  ENST ID: ENST00000596534
  CDS Start-End: 135-1661
agaactttctaaaagaggcaaaggcagaggagaacaaaggaaggagggagcaacttgtggatgctgagaaagtgtctcactatgttgctcaggctgatcttcaactcctagtctcaagttgtctatcaaaaagaatgtcgtatgagctattgagaaaggtgtatatcctgatgttactgaggagtgttctctatgcctctgttagaattatgtgttctcattttgcccaagacctttggccggagcagaatataaaagattctttccaaaaagtgacactgaaaagatatggaaaatgtagacatgaaaatttaccattaagaaaaggctgtgaaagtatggatgagtgtaagatgcacaaaggaggttgtaatggacttaaccaatgtctcacagctacccagagcaaaatatttcaatgtgataaatatgtaaaagtcgctcataaattttcaaattcaaacagacatgagataagacatactaaaaagaaacctttcaaatgtacaaaatgtggcaaatcatttggcatgatttcatgcctaactgaacatagcagaattcatactagagtaaatttctacaaatgtgaagaatgtggaaaagcctttaactggtcctcaacccttactaaacataagagaattcatacgggagagaaaccttacaaatgtgaagaatgtggtaaagcctttaaccagtcctcaaaccttattaaacataagaaaattcatactggagagaaaccctacaaatgtgaagaatgtggcaaaacttttaaccgattctcaactcttactacccataagataattcatactggagagaaaccctacaaatgtaaagaatgtggtaaagcttttaaccgatcttcaacccttactacccatagaaaaattcatactggagagaaaccttacaaatgtgaagaatgtggcaaagcctttaagcagtcctcaaaccttactacacataagataattcatactggagagaaaccctacaaatgtaaaaaatgtggaaaagcctttaaccagtctgcacaccttaccacacatgaggtaattcatactggagagaaaccctacaaatgtgaaaaatgtggaaaagcctttaatcatttctcacaccttactacacataagataattcatactggagagaaaccttacaaatgtaaagaatgtggtaaagcttttaaacactcttcaacccttactaaacataagataattcatactggagagaagccttacaaatgtaaagaatgtgaaaaagcttttaaccaatcctcaaaacttactgaacataagaaaattcatactggagagaaaccctatgaatgtgaaaaatgtggcaaagcttttaaccagtcctcaaatcttactagacataagaaaagtcatacagaagagaaaccttacaaatgtgaagaatgtggcaaaggttttaaatggccctcaacccttactatccataagataattcatactggagagaaaccatacaaatgtgaagaatgtggcaaagcttttaaccaatcctcaaaacttaccaaacataagaaaattcatactggagagaaaccctacacatgtgaagaatgtggcaaagcctttaaccagtcctcaaaccttactaaacataagagaattcatact

SEQ ID NO: 204036 - DNA, 574 bp, Homo sapiens
  Payload ID: 20238
  Gene Name: zinc finger protein 85
  ENST ID: ENST00000598862
  CDS Start-End: 151-574
aaaagaggcaaaggcagaggagaacaaaggaaggagggagcaacttgtggatgctgagaaagtgtctcactatgttgctcaggctgatcttcaactcctagtctcaagttgtctatcaaaaagaatgtcgtatgagctattgagaaagttatgtgttctcattttgcccaagacctttggccggagcagaatataaaagattctttccaaaaagtgacactgaaaagatatggaaaatgtagacatgaaaatttaccattaagaaaaggctgtgaaagtatggatgagtgtaagatgcacaaaggaggttgtaatggacttaaccaatgtctcacagctacccagagcaaaatatttcaatgtgataaatatgtaaaagtcgctcataaattttcaaattcaaacagacatgagataagacatactaaaaagaaacctttcaaatgtacaaaatgtggcaaatcatttggcatgatttcatgcctaactgaacatagcagaattcatactagagtaaatttctacaaatgtgaagaatgtggaaaagcctttaactggtcctcaacccttacta

SEQ ID NO: 204037 - DNA, 2631 bp, Homo sapiens
  Payload ID: 20238
  Gene Name: zinc finger protein 85
  ENST ID: ENST00000612293
  CDS Start-End: 629-2239
agataaggaataggaacaggctatgacctaatgcttgcttggaccagtataagcatgccagggcaaatatttaggctaaaatgtgggagctaagaacacaaagtacattgatttctttatcacggctagcagatatctaagaatgtcagcacaggtgtttgaatacattttgcttctaagagaagttactatttattcctaattacacgaggaggaaagtccctttgaaaaggaacctctatttcacattttacgatgagcacaatatagttttgcattggtgtatatgaatttgaatgagcaaacagctcttcaagtttttggggtttttttgtttgttttgttttttgggtttttgttttttgtttttgagacggagtctcactctgtcatcaggctggagtgcagtggcacgatctcggctcactgcaacctccgcctcctgcgttcaagtattcccctgcctcagcctcccaagtagctgtgactaaagccgtgcaccacaacgtctggccaattttttgtattttagtagagacgaagtttcaccatattggccaggcgagtctcaaactcctgacctcgtgatccacccacctcagcctcccaaagtgcttggattatagacatgagcctcagcgcccagccctcttcaagtttttataaaccagtttcagaagttatgtgttctcattttgcccaagacctttggccggagcagaatataaaagattctttccaaaaagtgacactgaaaagatatggaaaatgtagacatgaaaatttaccattaagaaaaggctgtgaaagtatggatgagtgtaagatgcacaaaggaggttgtaatggacttaaccaatgtctcacagctacccagagcaaaatatttcaatgtgataaatatgtaaaagtcgctcataaattttcaaattcaaacagacatgagataagacatactaaaaagaaacctttcaaatgtacaaaatgtggcaaatcatttggcatgatttcatgcctaactgaacatagcagaattcatactagagtaaatttctacaaatgtgaagaatgtggaaaagcctttaactggtcctcaacccttactaaacataagagaattcatacgggagagaaaccttacaaatgtgaagaatgtggtaaagcctttaaccagtcctcaaaccttattaaacataagaaaattcatactggagagaaaccctacaaatgtgaagaatgtggcaaaacttttaaccgattctcaactcttactacccataagataattcatactggagagaaaccctacaaatgtaaagaatgtggtaaagcttttaaccgatcttcaacccttactacccatagaaaaattcatactggagagaaaccttacaaatgtgaagaatgtggcaaagcctttaagcagtcctcaaaccttactacacataagataattcatactggagagaaaccctacaaatgtaaaaaatgtggaaaagcctttaaccagtctgcacaccttaccacacatgaggtaattcatactggagagaaaccctacaaatgtgaaaaatgtggaaaagcctttaatcatttctcacaccttactacacataagataattcatactggagagaaaccttacaaatgtaaagaatgtggtaaagcttttaaacactcttcaacccttactaaacataagataattcatactggagagaagccttacaaatgtaaagaatgtgaaaaagcttttaaccaatcctcaaaacttactgaacataagaaaattcatactggagagaaaccctatgaatgtgaaaaatgtggcaaagcttttaaccagtcctcaaatcttactagacataagaaaagtcatacagaagagaaaccttacaaatgtgaagaatgtggcaaaggttttaaatggccctcaacccttactatccataagataattcatactggagagaaaccatacaaatgtgaagaatgtggcaaagcttttaaccaatcctcaaaacttaccaaacataagaaaattcatactggagagaaaccctacacatgtgaagaatgtggcaaagcctttaaccagtcctcaaaccttactaaacataagagaattcatactggagaaaaaccttacaaatgtgaagaatgtgacaaagcttttaaatggtcctcagtccttactaaacataagataattcataccggagaaaaattacaaatatgaaaattatggcaaagctttaatcaatttacaagtcttactaaacataagaaaatttatactggagagaaactactaacctgaaagatgtgacaataattttgacaacacctcagacttataaaagtaatcatactggtgagaaattctaaaaatgtgaagactatggcaaagtctttaaatggttgtcacactttaggtaagataattcatattggaacaaactacaagtgcaaacaatgtggcaaaacttaatttatgctcacaccttactgcacagaaaagaatttttagttgagaaaaagtatacaaatataaagaatgtggaaaagccgttaatatctgctcacatcttactcagcatcagaaagtacttaataaaagcattataaatg

SEQ ID NO: 204038 - DNA, 1531 bp, Homo sapiens; identical to SEQ ID NO: 204024
  Payload ID: 20238
  Gene Name: zinc finger protein 85
  Uniprot ID: Q03923
  ENST ID: ENST00000615882
  CDS Start-End: 126-389

SEQ ID NO: 204039 - DNA, 1689 bp, Homo sapiens; identical to SEQ ID NO: 204026
  Payload ID: 20238
  Gene Name: zinc finger protein 85
  Uniprot ID: Q03923
  ENST ID: ENST00000613159
  CDS Start-End: 1-1689

SEQ ID NO: 204040 - DNA, 2296 bp, Homo sapiens; identical to SEQ ID NO: 204025
  Payload ID: 20238
  Gene Name: zinc finger protein 85
  Uniprot ID: Q03923
  ENST ID: ENST00000615320
  CDS Start-End: 114-1901

SEQ ID NO: 204041 - DNA, 1259 bp, Homo sapiens; identical to SEQ ID NO: 204028
  Payload ID: 20238
  Gene Name: zinc finger protein 85
  ENST ID: ENST00000623537
  CDS Start-End: 201-368

SEQ ID NO: 204042 - DNA, 563 bp, Homo sapiens; identical to SEQ ID NO: 204033
  Payload ID: 20238
  Gene Name: zinc finger protein 85
  ENST ID: ENST00000623898
  CDS Start-End: 180-368

SEQ ID NO: 204043 - DNA, 549 bp, Homo sapiens; identical to SEQ ID NO: 204031
  Payload ID: 20238
  Gene Name: zinc finger protein 85
  ENST ID: ENST00000615413
  CDS Start-End: 163-549

SEQ ID NO: 204044 - DNA, 556 bp, Homo sapiens; identical to SEQ ID NO: 204027
  Payload ID: 20238
  Gene Name: zinc finger protein 85
  ENST ID: ENST00000624588
  CDS Start-End: 117-556

SEQ ID NO: 204045 - DNA, 483 bp, Homo sapiens; identical to SEQ ID NO: 204030
  Payload ID: 20238
  Gene Name: zinc finger protein 85
  ENST ID: ENST00000624369
  CDS Start-End: 117-483

SEQ ID NO: 204046 - DNA, 506 bp, Homo sapiens; identical to SEQ ID NO: 204032
  Payload ID: 20238
  Gene Name: zinc finger protein 85
  ENST ID: ENST00000625004
  CDS Start-End: 149-506

SEQ ID NO: 204047 - DNA, 7714 bp, Homo sapiens
  Payload ID: 20239
  Gene Name: zinc finger protein 850
  Uniprot ID: A8MQ14
  ENST ID: ENST00000591344
  CDS Start-End: 160-3432
gtttgctgtgccgatttagctgccgccgcgccttggagtcctgaggaacttggctaggctggccccgagcggaaccagagaatgctgaggctctaaccatggaatattcggaatgtcccattctatgaaggaggtttgctggctgcaacaggaatattcatgaacatggaggggttggtcatgttccaggatctgtctatagacttctctcaggaggaatgggagtgcctggacgctgctcagaaggacttatacagagatgtaatgatggagaactacagcagcctggtctcactaggtctctctatcccaaagcctgatgtgatttccttactggagcaagggaaagagccctggatggtttcaagggacgtgctgggaggatggtgccgagactcggagtttagatgtaagaccaaagattcatgtttgccaaaagaaatctatgaagtaacatcatctcagtgggtgagaatggaaaaatgtcatagccttgtgggctccagtgtcagagatgactgggaatgcaaaggccagtttcagcaccaagatataaatcaggagcgatatttggaaaaagcaataatgacttatgaaacaacaccaactttctgcctacagacatctctcactctgcatcatcggattcatcctggagagaaactgtataaatccacagaatgtatggcttttaagtatggctcagaacttacacaacagcaagaaacccatactggtgaaaaactctataaatgtaaggagtgtgggaaggcctttcatcacttttcctatcttgttaaacatcagagaattcatactggggaaaagccctgtgcatgtaaagaatatggaaaagcttttatttctggctcacatcttattcaacaccagaaaatgtatacagatgagagacctcatgagtgtcaggaatccgtgaaggcctttagaccgtctgcacatcttattcaacattggagaattcatactggtgacaaaccttatgaatgtaaagaatgtgggaaatcttttacttctggctcaacactaaatcaacatcagcaaattcacactggtgagaaaccctatcattgtaagcaatgtggaaaatcttttactgttggctcaacactaattcgacaccagcaaattcacactggtgagaaaccgtatgattgtaaggaatgtggaaaatcttttgcttcaggctcagcactaattcgacatcagcgaattcacactggtgagaaaccctatgactgtaaggaatgtggaaaatcttttacttttcactcagctctaattcgacatcagcgaattcacactggtgagaaaccctatgattgtaaggaatgtgggaaatcttttacttttcgctcagggttaattggacaccaggcaattcacactggtgagaaaccctatgattgtaaagaatgtggaaaatcttttactgctggctcaacactaattcaacatcagcgaattcacactggtgagaaaccctatgattgtaaggagtgtgggaaatcttttgcttcgggctcagcactacttcaacatcagcggattcacactggtgagaaaccctattgttgtaaggaatgtggaaaatcttttacttttcgctcaacacgcaatcgacaccagcgaatccacactggtgagaaaccctataattgtaaagaatgtggaaaatcttttgcttctggctcagcactacttcaacatcagcgaattcacactggtgagaaaccctatcattgtaaggaatgtggaaaatcttttacttttcgctcagggctaattggacatcaggcagttcacactggtgagaaaccctatgattgtaaagaatgtggaaaatcttttacttctcgctcagcactaattcaacatcagcgaattcacactggtgagaaaccctatcactgtaaggaatgtggaaaatcttttactgttggctcaacactacttcaacatcagcaaattcacactggtgagaaaccttatgattgtaaggaatgtgggaaggcctttagacttcgtttacgacttactcaacatcaacaaatccatactggtgagaaaccttatcaatgtcaggaatgtgggaaagcctttgtcagtgtctcaggactcacccaacatcacagaattcacactggtgagaaaccctatgaatgtccggactgtgggaaggcctttagacagcgtacataccttaatcaacatcggagaattcatactggtgagaaaccttatgaatgtaaagaatgtgggaaatcttttactttctgctcaggactaattcaacatcagcaaaatcacactgatgagaaaccctatgatggtaaggaatgtgggaaatcttttacttctcactcaacactaattcaacatcagcaaattcacactggtgagaaaccctatgattgtaaggaatgtgggaaatcttttacttctcactcaacactaattcaacatcagcaaatacacactggtgagaagctctatgattgtaaggaatgtgggaaatcttttacttctcattcaacactaattcaacatcagccacttcacactggtgagaaaccttatcattgcaaggaatgtgggaaatcttttactcttcgctcagcactaattcaacatcggccagttcacactggtgagaaacgctacagttgtaaagaatgtgggaaatcttttacttctcgctcaacactaattgaacatcagcgaattcacactggtgagaaaccctatcattgtaaggaatgtggaaaatcttttgcttttcgctcagcaataatccaacatcggcgaattcacactggtgagaaaccctatgattgtaaggaatgtggcaaggcctttagacgtcgttcaaaacttactcaacatcaacgaatccatactggtgagaaaccttatcgatgtcatgaatgtggaaaagcctttgtccgtttctcaggactcaccaaacatcacagtattcacactggcgagaaaccctatgaatgtaagacatgtgggaagtccttcagacagcgtacacaccttactctacatcagagaattcataccggtgacagaccttatgaatgtaaagaatgtgggaaatcttttacttgcggctcagaactaattcgacatcagcgaactcacactggtgagaaaccttatgattgtaaggaatgtgggaaggcctttagatgtccttcacaacttagtcaacataaacgaatccatactggtgagaaaacttatcaatgtccggaatgtgggaaagcctttttctatgcctcaggactcagccgacatcagagtgttcacactggcgagaaaccctatgaatgtaagacatgtgggaaggcctttaaacagcttacacagcttactcgacatcagagaattcatgacctaacataattaatgtaggaaactgttctcatgccatttgtcatggatcatcagcagattccatatgtgggtcaaatacaatggatgtgtattacttcatattcactttttccagaattacgacttttttttttttttttgagacggagtcttgctctgtcgcccaggctggagtgcagtggcgctatctcggctcactgcaagctctgcctcctgggttcatgccattctcctgcctcagcctccctagtagctgggactacaggtacctgccaccacgcctggctaatttttttgtttttgtatttttagtagagacagggtttcactgtgttagccaggatggtctcgatctcctgacctggtgatccacccaccaaaattaggacatttaatactgaaagaaattgataatgaatgtagatgagttttctatcatgattcaaagcttattgaagttatacaaattcatattagagaatgtggtcaatgacaaaagacaaccatttactacctacgtgacattaggctagttatgtaaattctctgtgccaaaattactaattgataaaatgttgatggcaatagttgtttttgtgtattttttgtttgtttgttttgttttgagacagagtcttgctctgttgcccaggctggagtgcagtggtgctatcttggctcactgcaacctctgcctcctgggttcaagtgattctcctgcctctgcctcctgagtagctcagattacaggcatgcaccaccatgcttggctaatttttgtatttttagtagagacggggtttcactgtgttggtcagggtggtctcaaacttttgacctcgtgatccccctacctcggcctcccaaagtgctgggattacaggtgtgagccaccacgcctggctagtaatagtttttttataataaataagtgtgactatatttttcatgtttgactactgactttgttttaagcttcgccttccctgtctatttccctgtctactttagcccataactgcaaaggtggctaagaaagtccttgctggaaagaaagcaagcaaaactaaagtctgtgcgcaccttctcctttggatccagtgggcaatttatattagaaattccaagccgggcgtggtggctcacgcctgtaatgccagcactttcggaggctgaggtgggtggatcacctgaggttaagagttcaagaccagcctggccaacatgttgaaaccccatctctactaaaaatacaaaatcagccagacatggtggcatatgcctgtaatcccagctattcaggaggcaaggctggagaatcgcttgaacctgggaggcggatgttgcagtgagccagtcagtggagcagtcagaacacacacagtgtttatcaattaagtttgtagtcagaacacacaccatgtttatcaattaagtttgctgtcttatatggacacagtttgtgatgccctaaaacaagtagtggtgcctaagataatcataggccaccataacagatataacaacaatgagaaagttgaaatattgttgggatcatccaaatatgacacagatacaaagtgagcacatgctggtgaataaatggagccaatagacttgttcactgcatggttacgtcagaggcgtgtaaaccagagcaacttcttcttgaataggagctgtgtaaagtaacactgaaacctactggactgcattcctagacagataagtcattctaagtcacaagatgagatatgaggtcagcataagatacaggtcataaagaccttgctgagaaaacatcttgcagtaaagaagtcggccaaatccaagatggtgacaagagtgacctctggtcgtcctcactgctatactcccagcagcaccatgacacccagctaagtttttattttttatttcagtagagttggagtcttgctttgttacccaggctggtcttgaattcctgtcttcaagcaatcttcccaccttatgaatataaagaatggcccaccttgtcctctcaaagtgctgggattacaatcatgagccactgcacctgggactttctttttcttttttcttttttttttttttgagatggagttttgctcttgttgcccaggctggagtgcaatggcacgatcttggctcactgcaacctccgcctcccaggttcaagcgattctcttgactcagcctcctgagtaactgggattacaggcatgctccaccatgcccgactaatttttgtattatttagtagagacggggtttctccatgttggtcaggctggtctctgaactctgggcaggactaatttagataaggtagtcaggaaaggcatttcttacaaggtggtatttgcatgaatgtagacatatggttgcattttattatatgtaaattacacttcaataaagttgatgaaaaaaatcttacctcatcgtctatgcacttcggattgttgtatttcattctatttaaattacacttgcgtttaaaaaatttaacacttctctaaaacatatctgttgatttgtacttttactaatatgcttatggatgatttatatacacacacacacacacacatatcttttaagaaggttattttaaggttaatcaattgaggctttgtctcaattgattttttttgagacagtctcgttctgtcgcccaggctggagtgcagtggcgtgatctcgactcactgcaagctccacctcccaggttcacgccattctcctgcctcagcctccctagtagctgtgactacaggtgcccgccaccacgcctggctaattttttgtatttgtagtagagacggaatttcaccatgttagccaggatggtctcaatctcctgacctcatgacccgcccacctcggcctcccaaagtgctgggattacaggcgtgagccaccccgcccggctcaattgattcttttgtctcaatttgtagtcagttgaggtttgtctcaatttatggaaacaaatcaaatgtttgttctcaaattcttactctgtcatttattattctccatgtttttgtaactgcttccttggagatatttaaacataaatatatacagagagggtgaagatggaggagtgctttttacagttcacagttgtctttttcatgtgtgacaggtttttgctgtgttgcccaggctggagtgcaatgccacaatcttggctcactgcagcctcaacttcccgggctcaatcgatcccccacctcagcctcccgagtagcaaggactacaggcgcacaccaccacacctagctaatttttgtatcttttgtagagacagggtttcaccatgttgtccaggctggtcttgaactcttgggctcaattggtcctagcacctcagcctcctaggtgctgggattacaggtgtgagccactgtgttcagccaatactcttaacgtttttacttttcacttttaaaaattaactctttttatgaaaaaagtagaattttttaaagagcagagaaaagcacaatgaagacagaaagatcacctgtatattcttattgaccaaagatgatctatttggggtaaatccttttttttttttttgagacgggagttttgctattgttgcccaggctggagtgcaatggcacgatctcggcttaccgcaacctctgcctcccaggtttaaacaattctcctgcctcagcctcctgagtagctgggattacaggcatgcaccaccacgcccggctaattttgtatttttaatagagacagggtttctccatgttgaggctgggcttgaactccagacctcaggtgatctgactgcctcggcctcccaaagtgctgggattacaggcaggatccacgtgcccggccggtaaatccttttaatagaggagtttcaatatttctcctctgccatagtattagaaagaaaagaatcattattgacatctttacgacattgagtttttctcttgtacctggtgtgtctttatttcagtaggtattcttttatgtgctttagtaagtctttatatttttagcataaaagtgtacacatttcttgttttacttatttctagatacttaatggcttttgtttataatatgattgggatattttttctgttgtgtaattgattactattactatgtactaaactgttggtttttgtctaaggattgtaacattgatgaactactttagtagatgaaatggtttcttcatgagattgaattgtctaaagagatgttggtattatttgtaaataaaagtatttgcctattc

SEQ ID NO: 204048 - DNA, 523 bp, Homo sapiens
  Payload ID: 20239
  Gene Name: zinc finger protein 850
  ENST ID: ENST00000589390
  CDS Start-End: 171-425
gtggcgggaccgtttgctgtgccgatttagctgccgccgcgccttggagtcctgaggaacttggctaggctggccccgagcggaaccagagaatgctgaggctctaaccatggaatattcggaatgtcccattctatgaaggaggtttgctggctgcaacaggaatattcatgaacatggaggggttggtcatgttccaggatctgtctatagacttctctcaggaggaatgggagtgcctggacgctgctcagaaggacttatacagagatgtaatgatggagaactacagcagcctggtctcactaggtctctctatcccaaagcctgatgtgatttccttactggagcaagggaaagagccctggatggtttcaagggacgtgctgggaggatggtgccgagacaggatgaagaaagcctgaaagaaatctattacaatggtgccaggtgcagtggctcaagcctgtaatcccagcactttgtgaggccgaggtgggcagatcacaaggtcaggagtttg

SEQ ID NO: 204049 - DNA, 7625 bp, Homo sapiens
  Payload ID: 20239
  Gene Name: zinc finger protein 850
  ENST ID: ENST00000614887
  CDS Start-End: 160-3336
gtttgctgtgccgatttagctgccgccgcgccttggagtcctgaggaacttggctaggctggccccgagcggaaccagagaatgctgaggctctaaccatggaatattcggaatgtcccattctatgaaggaggtttgctggctgcaacaggaatattcatgaacatggaggggttggtcatgttccaggatctgtctatagacttctctcaggaggaatgggagtgcctggacgctgctcagaaggacttatacagagatgtaatgatggagaactacagcagcctggtctcactagactcggagtttagatgtaagaccaaagattcatgtttgccaaaagaaatctatgaagtaacatcatctcagtgggtgagaatggaaaaatgtcatagccttgtgggctccagtgtcagagatgactgggaatgcaaaggccagtttcagcaccaagatataaatcaggagcgatatttggaaaaagcaataatgacttatgaaacaacaccaactttctgcctacagacatctctcactctgcatcatcggattcatcctggagagaaactgtataaatccacagaatgtatggcttttaagtatggctcagaacttacacaacagcaagaaacccatactggtgaaaaactctataaatgtaaggagtgtgggaaggcctttcatcacttttcctatcttgttaaacatcagagaattcatactggggaaaagccctgtgcatgtaaagaatatggaaaagcttttatttctggctcacatcttattcaacaccagaaaatgtatacagatgagagacctcatgagtgtcaggaatccgtgaaggcctttagaccgtctgcacatcttattcaacattggagaattcatactggtgacaaaccttatgaatgtaaagaatgtgggaaatcttttacttctggctcaacactaaatcaacatcagcaaattcacactggtgagaaaccctatcattgtaagcaatgtggaaaatcttttactgttggctcaacactaattcgacaccagcaaattcacactggtgagaaaccgtatgattgtaaggaatgtggaaaatcttttgcttcaggctcagcactaattcgacatcagcgaattcacactggtgagaaaccctatgactgtaaggaatgtggaaaatcttttacttttcactcagctctaattcgacatcagcgaattcacactggtgagaaaccctatgattgtaaggaatgtgggaaatcttttacttttcgctcagggttaattggacaccaggcaattcacactggtgagaaaccctatgattgtaaagaatgtggaaaatcttttactgctggctcaacactaattcaacatcagcgaattcacactggtgagaaaccctatgattgtaaggagtgtgggaaatcttttgcttcgggctcagcactacttcaacatcagcggattcacactggtgagaaaccctattgttgtaaggaatgtggaaaatcttttacttttcgctcaacacgcaatcgacaccagcgaatccacactggtgagaaaccctataattgtaaagaatgtggaaaatcttttgcttctggctcagcactacttcaacatcagcgaattcacactggtgagaaaccctatcattgtaaggaatgtggaaaatcttttacttttcgctcagggctaattggacatcaggcagttcacactggtgagaaaccctatgattgtaaagaatgtggaaaatcttttacttctcgctcagcactaattcaacatcagcgaattcacactggtgagaaaccctatcactgtaaggaatgtggaaaatcttttactgttggctcaacactacttcaacatcagcaaattcacactggtgagaaaccttatgattgtaaggaatgtgggaaggcctttagacttcgtttacgacttactcaacatcaacaaatccatactggtgagaaaccttatcaatgtcaggaatgtgggaaagcctttgtcagtgtctcaggactcacccaacatcacagaattcacactggtgagaaaccctatgaatgtccggactgtgggaaggcctttagacagcgtacataccttaatcaacatcggagaattcatactggtgagaaaccttatgaatgtaaagaatgtgggaaatcttttactttctgctcaggactaattcaacatcagcaaaatcacactgatgagaaaccctatgatggtaaggaatgtgggaaatcttttacttctcactcaacactaattcaacatcagcaaattcacactggtgagaaaccctatgattgtaaggaatgtgggaaatcttttacttctcactcaacactaattcaacatcagcaaatacacactggtgagaagctctatgattgtaaggaatgtgggaaatcttttacttctcattcaacactaattcaacatcagccacttcacactggtgagaaaccttatcattgcaaggaatgtgggaaatcttttactcttcgctcagcactaattcaacatcggccagttcacactggtgagaaacgctacagttgtaaagaatgtgggaaatcttttacttctcgctcaacactaattgaacatcagcgaattcacactggtgagaaaccctatcattgtaaggaatgtggaaaatcttttgcttttcgctcagcaataatccaacatcggcgaattcacactggtgagaaaccctatgattgtaaggaatgtggcaaggcctttagacgtcgttcaaaacttactcaacatcaacgaatccatactggtgagaaaccttatcgatgtcatgaatgtggaaaagcctttgtccgtttctcaggactcaccaaacatcacagtattcacactggcgagaaaccctatgaatgtaagacatgtgggaagtccttcagacagcgtacacaccttactctacatcagagaattcataccggtgacagaccttatgaatgtaaagaatgtgggaaatcttttacttgcggctcagaactaattcgacatcagcgaactcacactggtgagaaaccttatgattgtaaggaatgtgggaaggcctttagatgtccttcacaacttagtcaacataaacgaatccatactggtgagaaaacttatcaatgtccggaatgtgggaaagcctttttctatgcctcaggactcagccgacatcagagtgttcacactggcgagaaaccctatgaatgtaagacatgtgggaaggcctttaaacagcttacacagcttactcgacatcagagaattcatgacctaacataattaatgtaggaaactgttctcatgccatttgtcatggatcatcagcagattccatatgtgggtcaaatacaatggatgtgtattacttcatattcactttttccagaattacgacttttttttttttttttgagacggagtcttgctctgtcgcccaggctggagtgcagtggcgctatctcggctcactgcaagctctgcctcctgggttcatgccattctcctgcctcagcctccctagtagctgggactacaggtacctgccaccacgcctggctaatttttttgtttttgtatttttagtagagacagggtttcactgtgttagccaggatggtctcgatctcctgacctggtgatccacccaccaaaattaggacatttaatactgaaagaaattgataatgaatgtagatgagttttctatcatgattcaaagcttattgaagttatacaaattcatattagagaatgtggtcaatgacaaaagacaaccatttactacctacgtgacattaggctagttatgtaaattctctgtgccaaaattactaattgataaaatgttgatggcaatagttgtttttgtgtattttttgtttgtttgttttgttttgagacagagtcttgctctgttgcccaggctggagtgcagtggtgctatcttggctcactgcaacctctgcctcctgggttcaagtgattctcctgcctctgcctcctgagtagctcagattacaggcatgcaccaccatgcttggctaatttttgtatttttagtagagacggggtttcactgtgttggtcagggtggtctcaaacttttgacctcgtgatccccctacctcggcctcccaaagtgctgggattacaggtgtgagccaccacgcctggctagtaatagtttttttataataaataagtgtgactatatttttcatgtttgactactgactttgttttaagcttcgccttccctgtctatttccctgtctactttagcccataactgcaaaggtggctaagaaagtccttgctggaaagaaagcaagcaaaactaaagtctgtgcgcaccttctcctttggatccagtgggcaatttatattagaaattccaagccgggcgtggtggctcacgcctgtaatgccagcactttcggaggctgaggtgggtggatcacctgaggttaagagttcaagaccagcctggccaacatgttgaaaccccatctctactaaaaatacaaaatcagccagacatggtggcatatgcctgtaatcccagctattcaggaggcaaggctggagaatcgcttgaacctgggaggcggatgttgcagtgagccagtcagtggagcagtcagaacacacacagtgtttatcaattaagtttgtagtcagaacacacaccatgtttatcaattaagtttgctgtcttatatggacacagtttgtgatgccctaaaacaagtagtggtgcctaagataatcataggccaccataacagatataacaacaatgagaaagttgaaatattgttgggatcatccaaatatgacacagatacaaagtgagcacatgctggtgaataaatggagccaatagacttgttcactgcatggttacgtcagaggcgtgtaaaccagagcaacttcttcttgaataggagctgtgtaaagtaacactgaaacctactggactgcattcctagacagataagtcattctaagtcacaagatgagatatgaggtcagcataagatacaggtcataaagaccttgctgagaaaacatcttgcagtaaagaagtcggccaaatccaagatggtgacaagagtgacctctggtcgtcctcactgctatactcccagcagcaccatgacacccagctaagtttttattttttatttcagtagagttggagtcttgctttgttacccaggctggtcttgaattcctgtcttcaagcaatcttcccaccttatgaatataaagaatggcccaccttgtcctctcaaagtgctgggattacaatcatgagccactgcacctgggactttctttttcttttttcttttttttttttttgagatggagttttgctcttgttgcccaggctggagtgcaatggcacgatcttggctcactgcaacctccgcctcccaggttcaagcgattctcttgactcagcctcctgagtaactgggattacaggcatgctccaccatgcccgactaatttttgtattatttagtagagacggggtttctccatgttggtcaggctggtctctgaactctgggcaggactaatttagataaggtagtcaggaaaggcatttcttacaaggtggtatttgcatgaatgtagacatatggttgcattttattatatgtaaattacacttcaataaagttgatgaaaaaaatcttacctcatcgtctatgcacttcggattgttgtatttcattctatttaaattacacttgcgtttaaaaaatttaacacttctctaaaacatatctgttgatttgtacttttactaatatgcttatggatgatttatatacacacacacacacacacatatcttttaagaaggttattttaaggttaatcaattgaggctttgtctcaattgattttttttgagacagtctcgttctgtcgcccaggctggagtgcagtggcgtgatctcgactcactgcaagctccacctcccaggttcacgccattctcctgcctcagcctccctagtagctgtgactacaggtgcccgccaccacgcctggctaattttttgtatttgtagtagagacggaatttcaccatgttagccaggatggtctcaatctcctgacctcatgacccgcccacctcggcctcccaaagtgctgggattacaggcgtgagccaccccgcccggctcaattgattcttttgtctcaatttgtagtcagttgaggtttgtctcaatttatggaaacaaatcaaatgtttgttctcaaattcttactctgtcatttattattctccatgtttttgtaactgcttccttggagatatttaaacataaatatatacagagagggtgaagatggaggagtgctttttacagttcacagttgtctttttcatgtgtgacaggtttttgctgtgttgcccaggctggagtgcaatgccacaatcttggctcactgcagcctcaacttcccgggctcaatcgatcccccacctcagcctcccgagtagcaaggactacaggcgcacaccaccacacctagctaatttttgtatcttttgtagagacagggtttcaccatgttgtccaggctggtcttgaactcttgggctcaattggtcctagcacctcagcctcctaggtgctgggattacaggtgtgagccactgtgttcagccaatactcttaacgtttttacttttcacttttaaaaattaactctttttatgaaaaaagtagaattttttaaagagcagagaaaagcacaatgaagacagaaagatcacctgtatattcttattgaccaaagatgatctatttggggtaaatccttttttttttttttgagacgggagttttgctattgttgcccaggctggagtgcaatggcacgatctcggcttaccgcaacctctgcctcccaggtttaaacaattctcctgcctcagcctcctgagtagctgggattacaggcatgcaccaccacgcccggctaattttgtatttttaatagagacagggtttctccatgttgaggctgggcttgaactccagacctcaggtgatctgactgcctcggcctcccaaagtgctgggattacaggcaggatccacgtgcccggccggtaaatccttttaatagaggagtttcaatatttctcctctgccatagtattagaaagaaaagaatcattattgacatctttacgacattgagtttttctcttgtacctggtgtgtctttatttcagtaggtattcttttatgtgctttagtaagtctttatatttttagcataaaagtgtacacatttcttgttttacttatttctagatacttaatggcttttgtttataatatgattgggatattttttctgttgtgtaattgattactattactatgtactaaactgttggtttttgtctaaggattgtaacattgatgaactactttagtagatgaaatggtttcttcatgagattgaattgtctaaagagatgttggtattatttgtaaataaaagtatttgcctattcctttcta

SEQ ID NO: 204050 - DNA, 1968 bp, Homo sapiens
  Payload ID: 20240
  Gene Name: zinc finger protein 852
  Uniprot ID: Q6ZMS4
  ENST ID: ENST00000436261
  CDS Start-End: 162-1793
gcaactggggaagctgggaggtaggcgcggggcggtcggctgcggtggcggcgtttggatgattgtctctcggcggcggagtcgctcaatgtacttctccagttcctacccttcctcaagtggggaactcaggagaccaagcaggggcaactgtacttcggatggtcaggccccaggatactgtggcgtatgaggacctgtctgaggactatactcagaagaaatggaaaggtctcgcactcagtcagagagccctgcactggaacatgatgctggaaaatgaccgtagcatggcttctttgggtaggaacatgatggagagttcagagctgactccgaagcaggaaatttttaaaggatcagagtcatctaatagcacatcagggggactctttggggtggttcctgggggaacagagactggagatgtttgtgaagataccttcaaagagttagaaggacaaccctcaaatgaagaagggagcagactagaaagtgatttcttggaaataatagatgaggataagaaaaaatccacaaaagacagatatgaggaatataaggaagttgaggaacatccacctctgtcttccagtcctgttgaacatgaaggagttttaaagggacagaaatcctatcgatgtgatgaatgtggcaaagctttttattggagttcgcacctcattggtcatcggagaatccacactggagagaaaccctatgagtgtaatgagtgtgggaagaccttcaggcaaacctcccagctcattgttcatctcagaacccacacaggggaaaagccctatgaatgcagtgagtgtggaaaggcctataggcacagctcccatctcattcaacaccagagactccataatggggagaaaccctataaatgtaatgaatgtgcaaaagcttttaatcagagctccaaactcttcgaccaccagagaacccatactggggagaaaccttatgaatgtaaggagtgtggggcggcctttagtcggagtaaaaatcttgttcgacatcagtttctgcacactggtaagaaaccttataagtgtaatgaatgtgggagagcattctgttccaatagaaatctcattgaccatcagagaacccacactggggagaagccttataaatgtaatgaatgtggcaaagccttcagtcggagtaaatgtcttattcgacatcagagcctccacactggggaaaagccatacaaatgtagtgaatgtgggaaagccttcaatcagatctctcaacttgttgaacatgagcgaattcatactggagaaaaaccatttaagtgtagtgagtgtggtaaggcattcggtctgagtaaatgtcttattcggcaccagaggcttcacacaagtgaaaagccctataaatgcaatgagtgtggaaaatccttcaatcaaaactcatacctcattatacaccagagaattcacactggtgagaaaccctatgaatgtaatgagtgtgggaaggtcttcagttataattctagtcttatggtacatcagagaacccatactggggaaaaaccctataaatgcaatagttgtgggaaagcctttagtgacagctcacagcttactgtgcaccagagagtccacactggagagaaaaaccttatgaatgtattgagtgtgggaaagcctttagtcagcgttccacttttaatcaccaccagcgaactcatgctggagagaagccctcaggtctggctcggtcatcttcttaaggcatggttttctgagacagacagcaaagacctttgagttaagctgtctttataagaaggatgttcatcatggtctccttggagaccactaatcacagtggagaccatacctacttgcttttccttgggtcactaaggtgggagagtaggtgcaacttagtctgatccttacttagtaggaaattggggattacatctgtcattaacttgta

SEQ ID NO: 204051 - DNA, 1755 bp, Homo sapiens
  Payload ID: 20240
  Gene Name: zinc finger protein 852
  ENST ID: ENST00000616809
  CDS Start-End: 166-1755
gtgcgcaactggggaagctgggaggtaggcgcggggcggtcggctgcggtggcggcgtttggatgattgtctctcggcggcggagtcgctcaatgtacttctccagttcctacccttcctcaagtggggaactcaggagaccaagcaggggcaactgtacttcggatggtcaggccccaggatactgtggcgtatgaggacctgtctgaggactatactcagaagaaatggaaaggtctcgcactcagtcagagagccctgcactggaacatgatgctggaaaatgaccgtagcatggcttctttgggtaggaacatgatggagagttcagagctgactccgaagcaggaaatttttaaaggatcagagtcatctaatagcacatcagggggactctttggggtggttcctgggggaacagagactggagatgtttgtgaagataccttcaaagagttagaaggacaaccctcaaatgaagaagggagcagactagaaagtgatttcttggaaataatagatgaggataagaaaaaatccacaaaagacagatatgaggaatataaggaagttgaggaacatccacctctgtcttccagtcctgttgaacatgaaggagttttaaagggacagaaatcctatcgatgtgatgaatgtggcaaagctttttattggagttcgcacctcattggtcatcggagaatccacactggagagaaaccctatgagtgtaatgagtgtgggaagaccttcaggcaaacctcccagctcattgttcatctcagaacccacacaggggaaaagccctatgaatgcagtgagtgtggaaaggcctataggcacagctcccatctcattcaacaccagagactccataatggggagaaaccctataaatgtaatgaatgtgcaaaagcttttaatcagagctccaaactcttcgaccaccagagaacccatactggggagaaaccttatgaatgtaaggagtgtggggcggcctttagtcggagtaaaaatcttgttcgacatcagtttctgcacactggtaagaaaccttataagtgtaatgaatgtgggagagcattctgttccaatagaaatctcattgaccatcagagaacccacactggggagaagccttataaatgtaatgaatgtggcaaagccttcagtcggagtaaatgtcttattcgacatcagagcctccacactggggaaaagccatacaaatgtagtgaatgtgggaaagccttcaatcagatctctcaacttgttgaacatgagcgaattcatactggagaaaaaccatttaagtgtagtgagtgtggtaaggcattcggtctgagtaaatgtcttattcggcaccagaggcttcacacaagtgaaaagccctataaatgcaatgagtgtggaaaatccttcaatcaaaactcatacctcattatacaccagagaattcacactggtgagaaaccctatgaatgtaatgagtgtgggaaggtcttcagttataattctagtcttatggtacatcagagaacccatactggggaaaaaccctataaatgcaatagttgtgggaaagcctttagtgacagctcacagcttactgtgcaccagagagtccacactggagagccttatgaatgtattgagtgtgggaaagcctttagtcagcgttccacttttaatcaccaccagcgaactcatgctggagagaagccctcaggtctggctcggtcatcttcttaa

SEQ ID NO: 204052 - DNA, 1968 bp, Homo sapiens; identical to SEQ ID NO: 204050
  Payload ID: 20240
  Gene Name: zinc finger protein 852
  Uniprot ID: Q6ZMS4
  ENST ID: ENST00000628759
  CDS Start-End: 162-1793

SEQ ID NO: 204053 - DNA, 1755 bp, Homo sapiens; identical to SEQ ID NO: 204051
  Payload ID: 20240
  Gene Name: zinc finger protein 852
  ENST ID: ENST00000630640
  CDS Start-End: 166-1755

SEQ ID NO: 204054 - DNA, 3857 bp, Homo sapiens
  Payload ID: 20241
  Gene Name: zinc finger protein 853
  Uniprot ID: P0CG23
  ENST ID: ENST00000457543
  CDS Start-End: 559-2538
gcccggccagcggcccgcacggacgcactcccgggcgggcgggcgagcccagggggacccggccttgccgcggcgcccgccccgcccccgccccggcccccgcgcggcccggcccaggccgcccgcaggctccgggcacctgtagcccccgaggacccgcgtcgcctggccgccgccgaccccaggcggggccaccccgtggtgccgaccccgggcgccggcctggatcccgctgcccgcgatggtcccggggggccggccctgagccccgcgcgggattcggggccctgcctcccgccccagcccccgccggagagtctccaccaacttctgctcggccgctcctctcagccccttcccttggcccagggcgacctcggcagcccagagggcgtggaccctccggagtgcccagaaagcccccggggtggccctgcgcctcctggctctttctggatggaggcgcctccggaaggagccggctgcacgccgtggccttcacctcgcagcctctgctgaccacacctccctagcgcagaggctgcccgggagcaggaaatgctccaccagccgactcccgggaatcggggtctgaccgccaggatggaagtggggccagccaccgagaccttcgtgctggaacttcaatgtcttgaggatgggggcccagggcctgacaccctctcaggtggcagcggtgggagcgagagtcaggaggaggaagagcctcaggagaggaacagcagtccacagcggccagcagtctcggccccagtgggggccagtgaaatcgctgaggaaacccggccgggacaacgagagttgcaactgcagcagttagaacagcagcccgagccgcagcaacagccgcaacacgagcagctgcaacagccgcagccacacctagaactgcaacagcagccgcagcaagatgggcaacaacagctatctcaactacaacaggaaaaacaccaatccgtgcaccatcaggaactgaaaccagaactgcagctaatgcaccagcagcaacagttacagccacagcaagtgcaagagcaacagcggttgcagcagcagcaggagcagttacagacgcagcaagcacaagagcaacaggtattgcagcagcaggaacagctacagcagcaagtgcaagagcaacagctgttacagcaacagcaggaacagttacagcagcagcagctgctacaacagcaggaacagttacagcagcaacagtttcaacagcagcaggaacagttacagcagcagcagcagctactattgctgcagcagcagggacagttacagcagcaactgttgcagcagcagcaggcacagttacaacagcagctgctggaacagcagcaggcacagttacagcagcagctactgctgcagcagcaggaacagttacagcagcagcagcaacagcagctgttgcaacagcagcaggaacaattgcagcagcaacaactgcagcctcctcccctggagcccgaggaggaggaagaggtggagctggagctcatgccggtggacctggggtcagagcaggagctggagcagcagcggcaggagttggagcggcagcaggagctggaacggcagcaggagcagcggcagctgcagctcaaactgcaggaggagctgcagcagctggagcaacagctggagcagcagcagcagcagctggagcagcaggaggtgcagctggagctgaccccggtggagctaggcgcccagcagcaggaggtgcagctggagctgacccccgtgcagccggagctgcagctggaactggtgccagccgcagggggcggcggagcggcggtcccgggggctccggccgcggtcgtggtggctcccccgggctacgtggtggtgcaggagctcatggtgctgcccgccgtggcagcgccggccgtggtggccatcccgggcccggcaggcagcgcggcgttgacccctgcacggcagcggcggcggcggcgcgctcgggaccggccgaccatctgcggggagtgcggcaagggcttcagccgcagcacggacctggtgcgccaccaggccacgcacacgggtgagcggccacaccgctgcggcgagtgcggcaagggcttctcgcagcactcgaatctggtgacgcaccaacgcatccacacgggcgagaaaccctacgcctgctcctactgcgccaagcgcttcagcgagagctcggcgctcgtgcagcaccagcgcacgcacaccggggagcgaccctacgcctgcggggactgtggcaagcgcttcagcgtctcctccaacctgctgcgccaccggcgcacgcactcgggcgagcggccctacgtgtgcgaggactgtggcgagcgcttccgacacaaggtgcagatccgccgccacgagcgccagctgcacggcgcgggccgctccaggggcctcggcctgctgcgcgcctcgcggccggcggccctcggtggcccagcccgcgcggagcaggccgctacagccactgcgcccgcagacaaggcgctgtgagggccgtgatcggggctgcctggccgggaggggaccccccacccgcctccacctgaaaagctccttgacccgggttcatgggcgctggaggcgtcctggaatatccctggagtaaaaggcttccaccatcatcatcatcatcatcttccggattccctgagaaaataccaggttcacagatttcaccgccagaaaaatccatccgccaaaagagaagtggaccggggctgaaacagcacacgggacacgtttgtctgccctttgaggggtctgccaaaggttttccctccgggaaaactggacttactacgaacgaggaaaaacccccagtggcgagacgattaatgacactggccgaggactggacacccaccagggaatcaagacgtggtgagacacacgtggaaaatcttcgatcctggtgaaaatgatcgcaaggagaaattcggggaggaagcaaacttgtttgcactatgtagaaactgaccaaggcatcgaatcgtcctcagaggcatttgccttgaaaatactttccaagatgaaaattcatcagggtgggtataattctgatgaaaacgcctgtgttcatcaacacagggtcagagcgctcaccgggtcgatgtgcaaatccaagccaggaagtcctgctccgggtggaaggtaaaaccttccctccagggaaccaggggctccggcgggcatcggaggcagcttcttggcctctgctgctgtgtcccccagtccccccagcccgcattaatgtcctctggaataagagcctgtggctgaagcagagggccttctgggagagctctccaaggtctggaaggagggtcccccagaaggagctccggggtagccccactgtggcccccctggactccaccagcttcatgcttctcagatgctacccaggggccggcccggggagaccagggcagatttctcccgcaccaggctgtggaggtttggagggctgcctgagcagacactgtgccattgctggggctggggaaagaatatctgagacgacgtttgggagcaatgctctttaccacgttcaccaagtcgtctggggcaggggttgtgagctgcagcagttgctggtgccttgtgggaaggtggggcagggaggaggctgcccgccacctctgcccccagtcacttcctgcttgacctgactcttcacatgtggctgcttaattcctgcccctctccccccagctgcttctcctttactaacacacctgctacattttacacatgtgttggtaagtgagaaacagaaacgaaaaataaattaaaatgcagaaatacaa

SEQ ID NO: 204055 - DNA, 3098 bp, Homo sapiens
  Payload ID: 20242
  Gene Name: zinc finger protein 860
  Uniprot ID: A6NHJ4
  ENST ID: ENST00000360311
  CDS Start-End: 550-2448
gcacacgatgctgcgccagacgctcctacacagtaacctggaaattatcaccggcggagcaaagtcacagctcagggaggccctccgcgttgtctggcggaggaggggagtggcaggtgatcctcacagtcactctaggaaagccagctgccatgacataaggatactcaggccaccaatggatagcccaggcaggaggcatgaaggtgtgccagccactgtgtcagtcaccttataagcagattttctgagacctgctaacagccatgtgagtgaccttggaagtaggttgtcaccagtcaagccttgagatgactgcagccatgacccacagcttgactacaacccagagagacactgagccaggaacacccagctgaagtgcctccaaaccccgacccacagcgactgtgagataatcagtgtttgttgccttaagccacgaagtttgtgataatttgtttctcggaaacagataactaatacagagcaggaagcagatcgcctcagtgaaggtcacactgcagcactattgatttctaaagactcatgttacgtgaggaagcagctcagaagaggaaagaaaaggagccaggcatggctcttcctcagggacacttgacttttagggatgtggctatagaattctctttggaggagtggaaatgcctggaccctacgcagagggctttatacagggccatgatgttggagaactacaggaacctgcattctgtggatatctcttccaaatgcatgatgaagaagttctcatcaacagcgcaaggcaatacagaagtggacacagggacattagaaagacatgaaagtcatcacattggagatttttgcttccagaaaattgggaaagatattcatgactttgagtttcaatggcaagaagacaaaagaaatagccatgaagcaactatgacacaaatcaaaaagttgactggtagcaccgacagatatgatcgaaggcatcctggaaacaagcctatcaaagatcagcttggattaagctttcattcgcatcttcctgaactccacatatttcagaccaaagggaaagttggtaatcaagttgagaagtctatcaacgatgcttcctcagttctaacgtcccaaagaatttcttctaggcccaaaatccatatttctaataactatgaaaataatttcttccattcatcattactcacactaaaacaggaagtacacataagagaaaaatctttccaatgtaatgagagtggcaaagcctttaattgtagctcactcttaaggaaacatcagataatctatttaggagggaaacaatataaatgtgatgtatgtggcaaggtctttaatcagaagcgataccttgcatgccatcatagatgtcacactggtgagaaaccttacaagtgtaatgaatgtggcaaggtttttaatcaacaatcaaaccttgcaagtcatcatagacttcatactggagagaaaccttacaaatgtgaagaatgtgacaaagtttttagtcgcaaatcaaatcttgaaagacataggagaattcatactggagagaaaccatacaaatgtaaggtttgtgaaaaggctttcaggcgtgattcacacctcacacaacacactagaattcacactggagagaaaccttacaagtgtaatgagtgtggcaaagcctttagtgggcagtcaacacttattcaccatcaagcaatccatggtatagggaaactttataaatgtaatgattgtcacaaagtcttcagtaatgctacaaccattgcaaatcattggagaatccataatgaagagagatcttacaagtgtaataaatgtggcaaattttttagacgtcgttcatatctcgtagttcattggcgaactcatactggagagaaaccttacaagtgtaatgagtgtggcaagaccttccatcacaattcagcccttgtaattcataaggcaattcatactggagagaaaccttacaagtgtaatgagtgtggcaagaccttccgtcacaattcagcccttgtaattcataaggcaattcatactggagagaaaccttacaagtgtaatgaatgtggcaaggtttttaatcaacaagcaacccttgcacgtcatcatagacttcatactggagagaaaccttacaaatgtgaagaatgtgacacagttttcagtcgcaaatcacaccatgaaacacataagagaattcatactggagagaaaccttacaaatgtgatgattttgacgaggccttcagtcaagcttcatcttatgcaaaacaaaggagaattcatatgggagagaaacatcacaagtgtgatgattgtggcaaagcctttacttcacattcacatcgcattagacatcagagaatccataccggacagaaatcttacaaatgtcataagcgtggcaaggtcttcagttagaggtcactccttgcaaaacatcagaaaattcattcctgagataattgttccaaatgcaatgagtatagcaaaccatcaagcattaattgacattagagtcaattcagcattgacttgagtttcagttgacttgacattgagttcaagcattaattgacattaaagtgtttacgttaagaggattgggctgggcagggtggcttatacctgtaatcccagcactgtgggaggtcaagacggatagatcacttgaggtcaggagtttgagaccatcctggccaaaagacgtgagccacttttcctagcctgttttttgtttctgatagggatttttatgggtattgtgttgaatctaaatcacattgggttatataatcatttaacaatattaatctttccaatccatcaatatgggtcatatctctatttatataagtttttaatcattttgatcaatgtttgtagatttcaaggtacaaacttctcacctttttacgtttattcctaaatatttcttactgtaagttctctagcaaatggaagtgttttcttaattttcttttaacattgtttattgttaatgtatggaaatttaactaatttttggtactgatattgtattctgcaaatacactgtgtttattagcttc

SEQ ID NO: 204056 - DNA, 6950 bp, Homo sapiens
  Payload ID: 20243
  Gene Name: zinc finger protein 862
  Uniprot ID: O60290
  ENST ID: ENST00000223210
  CDS Start-End: 246-3755
ggctgggcagtgaccgtaaagctgttcgctcggtgcgacgcaagtctcagctcagcgcgcttatcctgggtccaccggcgctaccgccccccgacgtgagagagcgaagttcttgggccgcgctccctccctacctgggtgccctccccctccgggagcctgggtccccggggcggtcgcggcggctgcatcctcaggccaggccgcggggggagggggcggcacgggcctccgaaagcggggccatggagcccagagagtcggggaaggctcctgtgacgtttgatgacatcactgtgtacttactccaggaggaatgggtgctgctgagccagcaacagaaggagctctgtggttccaacaagctggtggcaccactgggaccaactgttgccaatcctgagctgttccgcaagttcggacgagggccagagccatggcttggcagcgtccagggccagaggagccttctggagcatcacccaggaaaaaaacagatgggctacatgggagaaatggaggtgcaaggtcccaccagggagagtggacagtccctcccgcctcagaagaaagcctacctttcccacctcagtacaggcagtggacacatcgagggagactgggccggaagaaacaggaaacttctgaagccccggtccatccagaagtcgtggtttgtgcagtttccgtggctgatcatgaatgaggagcagacggctctgttctgctctgcttgccgagaatacccctccatcagggacaaacggtcaagactaatagaaggttatacaggaccattcaaggtggagactctcaaataccacgcgaagagcaaggcccacatgttctgtgtcaatgccttggcagcgagggaccccatctgggcagcccggttccggagcatcagagacccacctggagatgttctggccagcccggagccgctcttcactgcagattgccccatattctaccccccagggcctctgggaggatttgatagcatggctgagctcctgccaagttcaagagctgaactagaggaccctgggggggatggagcaattcctgcaatgtatctagactgcatttcagatttgaggcaaaaagaaatcactgatggcatccacagctcctcagacattaatattttatataatgatgcagtagaatcctgcattcaggacccttctgcagaggggctgtcggaggaggttcctgtggtgtttgaggagctgccggtggtgttcgaggatgtggcagtgtatttcacccgggaggagtggggcatgctagacaagcggcagaaggagctgtacagagacgtgatgcggatgaactacgagctgttggcatccttgggacctgccgctgccaagccagacttgatctccaaactggagcggagggctgcaccctggatcaaggacccaaatgggccaaagtgggggaaaggtcgtcctccagggaacaagaagatggtggcagtgagagaggcagacacacaggcctcggctgcagactccgcgttgcttccaggctctcccgtggaggcccgtgcctcctgctgcagttccagcatttgtgaggaaggagatggacctaggagaatcaagaggacatacaggccccgttccattcagaggtcatggtttgggcagttcccatggttagtaattgaccccaaagagaccaaactcttctgctcagcctgcatagaaagacctaatctccatgataaatcatctcggttagtcagaggttacacggggccttttaaagtggagactttaaaataccatgaagtcagcaaagcgcacaggctctgtgtcaacacggttgaaatcaaggaagacacccctcacactgccctcgttccagagatctccagcgacctcatggccaacatggagcactttttcaatgccgcctactccattgcataccactcaaggcccctgaatgactttgagaagatcctgcagctcctccaaagcacggggaccgtgatattaggcaagtaccgcaatcgcacggcgtgcactcagttcatcaagtacatctcagagaccctgaagagggagatcctggaggacgtgcggaactcgccctgtgtgagcgtgctgctggacagctccaccgacgcctccgagcaggcctgcgtggggatttacatccgctacttcaagcagatggaggtgaaagagtcctacatcactctggcccctctctacagtgagacagcagatgggtacttcgagaccatcgtttctgccctggatgagctggacatccccttccggaagcctggctgggtggtggggctggggacggatggctcagccatgttgagctgcagaggaggccttgtggaaaagttccaggaggtcatcccgcagctgctgcctgtccactgcgtggcccaccggctgcacctggctgtggtggacgcctgcgggagcatcgatctggtgaagaagtgtgaccggcacatccgcaccgtcttcaagttttatcagtcctcaaacaagaggctgaacgagctgcaggaaggtgcggcgcctctggagcaggagatcatccgcctgaaggatctgaatgcggtccgctgggtggccagcaggaggcgcacgctgcacgcgctgctcgtgagctggcccgccctggccaggcacctccagagggtggcagaggctgggggccagattgggcaccgggccaaagggatgctgaagctcatgcgcggcttccactttgtcaagttctgccacttcctgttggacttcctgagcatctacaggcctctgtccgaggtgtgccagaaggagatcgtgctgattacagaggtgaacgccacgctgggccgcgcctacgtggcactggagagcctccgtcaccaggcagggcccaaagaggaagaattcaacgccagcttcaaggatgggcggctccacggcatctgcttggacaaactggaggtagcggaacagcggttccaggcggatagggagaggacagtcctgacggggattgagtacctccagcagaggtttgacgcagaccgacccccacagctgaagaacatggaggtgtttgacaccatggcctggccaagtgggattgaacttgccagttttgggaatgatgacattctcaacctggccaggtatttcgagtgctccctcccaacaggatacagtgaggaagctctgctggaggagtggctgggcctgaaaaccattgcccagcacctcccgttctccatgctctgcaaaaacgccctggcccagcactgccgcttccccctgctaagcaagctcatggccgtggtggtctgtgtgcccatctccacctcttgctgtgagcgggggttcaaggccatgaaccgaatcaggaccgatgagaggaccaagctctccaacgaggtgctcaacatgctcatgatgacagctgtgaacggcgtggccgtcacggagtacgacccccagcccgccatccagcactggtacctgacctcctcaggccggcgtttcagccatgtctacacctgtgcccaggtgccagcccgctcccctgcaagcgccaggctcaggaaggaggagatgggagccctctatgtggaggagcccaggacccagaagccacccatcctgccctccagggaagcagcggaggttctgaaggactgcatcatggagcctcccgagagactcctgtatccccacaccagccaggaggcccccgggatgtcctgagggacagggagtccttgggactgccttggagacgcctctgtgatcactgggacaggctctgcagattctaggctgccctaggatcttctgctggtggcgatggtctctaagcaccaggaagtgggcagtggcatcccagagcagcaggggtatcaggaggtgcatgacctgtttcctgaggccccactcagcacagccatgcctcacagcacacaaatgtgccagaaggttctatatctcaagttcatttttaaggtgctgcagaaaataaccccatcatgaaaggtttcagcccctgagttttggtggcaagaggagtgtcctggtaggggagactgttggacatccctggggaatgttccagggaggctgcccacagtctaagtgggaatgggaaagaccaccttgttagagggggaggttgcccctgctctagggacagctggcctggctgcaagagcccccagaggcattgttctgggacttcctaccctggctcccacagcagaagcagtgaggccgtggtctcgtgcggaactctacctcttcccagggcttcctttagggcgaaacaatcacaagccctttgcacagagcacccaagaaagttctcttcctgcagctccagatggtggagctgggctcttctggcagggggtctggtgcttcccggagagccgagccgcgtttaacccgtggcatgcccggcccggtttacccaggagaggatgggacgaagttggagttgggaggcttgggatgcagccccagctctgctgcaggcagtggtctgattaatcccttcctctttgtgcctcagtttccctctccatgaagtggcagcagagatccaagtgcctgctgactccccatctgccctaggattagtgaatgagagcctcgagctccctcaaagacctctggctgcagtgtggacttagctgccatctgccccatcctcgtccttagtgggacaggtaggaatttgtctccaaagtccttgttgtaggagttgctctctgaatgcaccatctgcacgacaggctagtccactcttctctgagctgccctggggactctgcaccaggatctccagggcccactgagacatccccgaatgggcgctcagtgacaagggctttgaacaacctcctccagggactttgggcctgctctagcttcagaaccacagaaccaccgccctagaggcacagaggggcttctggcactgctaggttcacaccctcctcgccccgatcttccttccacctaaagtgaagcacttttccttccaagggcagctccgtcttggcaggctcaggaggccgcttatcaggaggaggatgattttgtctaggttctgccttccttaaccatgggcaggaaatgaggcaagtcagcaggcagggtttctctgccctgcctgatacttgttttaaacaggcaggaagtgggcgccatccatcccagcttgcttgctgcctggctcaggcaggtcctgtgctgtgctgcaggcccctgtgggtgggccctttctccatagtctgccgcttcccattcccagggtagatgctggcatctgagcacctgagtacccttcctattcccagggtagaagctgctgtctgagtacccttcccattcccagggtagatgctggcatctgagcacctgagtacccttcctattcccagggtagaagctgctgtctgagtacccttcccattcccagggtagatgctggcgtccgagcccctccctggtaccgcaggtaccctggtaccccacctgccctttcatccccaccccagtacttagccttagcactgttgctttcgtgtcattttcagttctagtcaggaattcctttcttgctttctgcctttgacctgtggaaatgtctcccagccctgtgggtctggcggtcagagggaccccacaggcctgtggtgcgggagctctgggaggtgttactatctgcgtggctaaggcacacacaggcctccttctccccatcaccgtctccatgggcgttcaggaacttgcccaggtcaggcactgtggatgtgaactcgtggaaagggagggagaaaggcttttttaggtggggctatagcctctgccctacccacagggattccacatcaaggtgctgttccagcacacatgcttcctgcggcctcttcatccttgaagaatccctcagagcaggaggccatcctgtgagcagccgtgagtgggtctctgtgggagtagttctggagctgaggtggaagctaggggaagcaactcgccctctccacgtcagcatcagcgtgctccgaggacaccggccagtgccttccttaggtggtgggaaaggggggtccctgtgcagcggggccactgagaatgctgtttgtcataaaatttgcactacccgatttctcaaggggcacaggcctgctccgttcccctttgtcagccaatggccaagaaggaagaagatgactgccatcttattcctgaacttcctcattcaggacccccgtggaaacacagtgagcatccttatcagaggccctggcccaggctggcccctttgctttgtttggagaggctggctgagtttcagcccctagtgctggagacccccttgttggagaggcttcctgtttatgcctcacaagaagaaaaaccacagggctctgggaggggaagaagcatgcactcccgctttggctggagtcccagcgcttgtcgccaccctcctccttgcctgtagtcttgacagcatccgtatgtacgtgtcctggcatttcccctccctctccctgatgactgatacccaccgggtctgacattccaagtaaccagtatgtaactggtagtttgatcccaatagccatagcgactccaggtgggagtgagggagcccagccccctgtcctggaagataccttagagtatgtgaccgcgctccagacccttgcttctctctcctgcagaggatgagtttctagggtgctaagtacctatcagaacagtgtggaggggcgggtccctcatacaggtgtgtgcttagccaaatacagtaactgtgactggcccagggatgttctctcctctattttcaaagatgaaaggaggttttaaaaaccatgtttgattcctaaccttttgctacctgaataaagcagagtctatttcaacaca

SEQ ID NO: 204057 - DNA, 594 bp, Homo sapiens
  Payload ID: 20243
  Gene Name: zinc finger protein 862
  ENST ID: ENST00000460379
  CDS Start-End: 316-594
agtgaccgtaaagctgttcgctcggtgcgacgcaagtctcagctcagcgcgcttatcctgggtccaccggcgctaccgccccccgacgctcctgtgacgtttgatgacatcactgtgtacttactccaggaggaatgggtgctgctgagccagcaacagaaggagctctgtggttccaacaagctggtggcaccactgggaccaactgttgccaatcctgagctgttccgcaagttcggacgagggccagagccatggcttggcagcgtccagggccagaggagccttctggagcatcacccaggaaaaaaacagatgggctacatgggagaaatggaggtgcaaggtcccaccagggagagtggacagtccctcccgcctcagaagaaagcctacctttcccacctcagtacaggcagtggacacatcgagggagactgggccggaagaaacaggaaacttctgaagccccggtccatccagaagtcgtggtttgtgcagtttccgtggctgatcatgaatgaggagcagacggctctgttctgctctgcttgccgagaatacccctccatcagggacaaacggtcaagacta

SEQ ID NO: 204058 - DNA, 4005 bp, Homo sapiens
  Payload ID: 20244
  Gene Name: zinc finger protein 865
  Uniprot ID: P0CJ78
  ENST ID: ENST00000568956
  CDS Start-End: 355-3534
aagaggcgggcattcaaagcgcaggcgcacctggctcagttcgcccaccggaatcggcccgggctttcactgctcgcgtccccgagtcagtgcgcaagcgcatttcccccctcctggtccccgccaccgcctcctctttccgatcctccacgccggcgcctcgggaacgggcgcgacttccgcttccgggcgggcgggcaggcgggcggtgcggggctgccggggaggggggagggggcggcacttccggtcgggccctcgggtctccccggagcggcggcgcctcctccgcctcctcggcctcctcccggcggagaccccggcgccgggtctcccgtctcccacccgccggagatggaggcgaacccagcgggcagcggcgccgggggtggcgggagcagcggcatcgggggcgaggacggggtgcacttccagagctaccccttcgacttcctggaattcctcaaccaccagcgcttcgagcccatggaactgtatggggaacacgccaaggcggtggcggccctgccctgcgcccccggccccccgccgcagcccccgccgcagccccctcccccgcagtatgactacccgccccagtccaccttcaagcccaaggcggaggtgccctcctcgtcctcgtcctcgtcctcctcctcctcctcttcgtcctcctcgtcgtcatcttcgtcctcttcctcttcccaagccaagaagcccgatccgcccctgccgcccgccttcggggcgccccctcctcccctctttgacgctgctttccccactccgcagtggggcatcgtggacctctcggggcaccagcacttgtttgggaacctgaagcgaggagggcccgcgtccgggccgggggtgacgcctgggctgggcgctcccgcgggggccccagggccgcttcctgccccctcgcagaccccgccaggaccccccgcggcggcggcctgcgaccccaccaaggacgacaagggctacttccggagactgaagtacctgatggagcggcgcttcccctgcggcgtgtgccagaagtccttcaagcagtcctcgcacctggtccagcacatgctggtgcactcgggggagaggccctacgaatgcggcgtctgcggccgcacctacaaccacgtgtccagcctcatccgccaccgccgctgccacaaggacgtgccaccggccgcggggggcccgccccagcccggcccccacctcccgccgctgggcctcccagcacccgctgccagcgccgccaccgccgccgccccctccacggtgtcctcgggccctccagccacgcccgtggcgcctgccccctccgcagacgggagcgccgcccctgctggtgttggggtgccccctcctgccaccgggggtggcgatggcccgttcgcctgcccactctgctggaaggttttcaagaagcccagtcacctccaccagcaccagatcatccacacgggcgagaagcccttctcctgctccgtgtgcagcaaaagcttcaaccgcagggagagtctgaagcgccacgtgaagacgcactcggccgacctcctgcgcctgccctgcggcatctgcgggaaggccttccgcgacgcctcctacctcctcaagcaccaggcggcccacgcgggggcgggcgccggggggcctcggcccgtgtacccctgcgacctgtgcggcaagtcctactcggctccgcagagcctgctccgccacaaggccgcccacgccccgcccgctgccgctgcggaggcgcccaaggacggggcggcctcggccccgcagcccccgcccaccttccccccgggcccgtacctcctgccccccgaccctcccaccacagacagcgagaaggcggcggcggccgcggcggcggtggtgtacggcgctgtgcccgtcccgctcctgggcgcccacccgctgctgctcggcggcgcggggaccagcggggcgggaggctcgggcgccagcgtcccaggaaagacgttctgctgcggcatctgcgggcgcggcttcgggcgccgcgagaccctgaagcgccatgagcgcatccacacgggcgagaagccccaccagtgccccgtgtgtgggaagcgcttccgcgaatccttccacttgagcaagcatcacgtggtgcacacgcgcgagcggccctacaagtgcgagctctgcggcaaggtcttcggctacccgcagagcctcacccgccaccgccaggtgcaccggctccagctgccctgcgccctggccggggcagccggcctcccctccacccaaggcacaccgggggcctgtgggcccggggcctcgggcacgtctgcagggcccaccgatgggctgagctacgcctgctcggactgcggcgagcacttcccggatctctttcacgtcatgagtcacaaggaggtccacatggcagagaagccatacggctgcgacgcctgcggcaagaccttcggcttcatcgagaacctcatgtggcacaagctggtccaccaggccgcccccgagcgcctgctcccgcccgcacccggcggcctgcagcccccggacggctccagcggcacggatgcggccagcgtgctggacaacgggctggcgggggaggtgggggcggccgtggcggcactggcaggggtgtctgggggtgaggacgcaggcggggcggcggtggcaggtgctggcgggggtgccagttccggccccgagcgcttcagctgtgccacgtgcggccagagtttcaagcacttcctgggcctcgtgactcacaagtacgtgcacctggtgcgacggaccctgggctgcggcctctgcggccagagcttcgcgggcgcctacgacttgctcctacaccgccgcagccatcggcagaagcggggtttccgctgcccggtgtgcgggaagcgcttctgggaggcggccctgctgatgcgccaccagcgctgccacacggaacagcggccgtaccgatgtggcgtgtgcggccgaggcttcctgcgctcctggtacctgcggcagcaccgcgtggtgcacactggcgagcgggccttcaagtgcggcgtgtgcgccaagcgcttcgcgcagtcgtccagcctggcagagcaccggcggctgcacgctgtggcccggccccagcgctgcagcgcctgtggcaagaccttccgctaccgctccaacctgctggagcaccagcggctgcacctgggcgagcgcgcctaccgctgtgagcactgcggcaagggcttcttctacctgagctccgtgctgcgccaccagcgcgcccatgagccgccgcggcccgagctccgctgccccgcctgcctcaaggccttcaaggatcccggctacttccgtaagcacctggctgcccaccagggcggccggcccttccgctgctcctcctgcggcgagggcttcgccaacacctacggcctcaagaaacaccgcctggcgcacaaggccgagaacctcggggggcctggagcaggggcgggcaccttggccgggaaggatgcctgaccgaggggttcccatcccactcccatcaaaagcccccttctggactcccacctcccaggactgatcagactcttcccccctcctcgctgttgccccatccttcagaacttcacacggactggcgaccttcagggcgcacgcccgacaggctcaagactgaatcactcccatcctcgacctctctgccctcccctcatcccatcagacactgaaccctatcctccgtccaaccctcgtttgtgacccgcatcagcccccgccccagcagcactctgcccccagtaagttttggcggagatgggtctgaaccgcccctccccctcctttggaatctggctggacagtggagtatgagcagagttgggagggcacaagggagtgctgggtgctttttggggtgggggggtggggggcggggtggcagacgcggcttgtacagagcggagaataataaatcttaccatgagggcc

SEQ ID NO: 204059 - DNA, 99 bp, Homo sapiens
  Payload ID: 20244
  Gene Name: zinc finger protein 865
  ENST ID: ENST00000630143
  CDS Start-End: 1-99
ccagttccggccccgagcgcttcagctgtgccacgtgcggccagacgctgcagcgcctgtggcaagaccttccgctaccgctccaacctgctggagcac

SEQ ID NO: 204060 - DNA, 1734 bp, Homo sapiens
  Payload ID: 20245
  Gene Name: zinc finger protein 878
  Uniprot ID: C9JN71
  ENST ID: ENST00000547628
  CDS Start-End: 139-1734
gttaaggtctggggctttcttgctccgagagggaccagttacttccgccgtagctgctgttgctctgtcgactgcgctgtgacctgcactgttcacgggacctttagagaggacgccagaatacctggaagccaggaaatggattcggtggcctttgaggatgtggctgtgaacttcacccaggaggagtgggctttgctggatccttcccagaaaaatctctacagggaagtgatgcaggaaaccttgaggaacctgacctccataggaaaaaaatggaacaaccagtacattgaagatgagcaccaaaatcctaggagaaacctaagaagacttataggggagagactctctgaaagtaaagaaagtcatcagcatggagaagttttgacacaggttccagatgacacactgaagaagaaaactcctggagtacaatcatatgaaagcagtgtgtgtggagaaatcggcataggtctttcatcccttaataggcacctcagagcctttagttattccagtagccttgcaatacatggaagaactcacactggggaaaagccttatgaatgtaaggaatgtgggaaagcattcaggtttcccagttctgttcgtagacatgaaagaatccactctgcaaaaaaaccctatgaatgtaagcagtgtgggaaagcattcagttttcccagttctgttcgtagacatgaaagaatccactctgcaaaaaaaccctatgaatgtaagcagtgtgggaaagcattatcttatcttgtaagctttcagacacacatgagaatgcacactggagagagacctcataaatgtaacatatgtgggaaagcctttttttctcccagttcgttaaaaagacacgagaaaagtcacactggagagaaacgctataaatgcaagcaatgtgataaagccttcaattgtcccagttcctttcaatatcatgaaaggactcacagtggagagaaaccctatgagtgtacacaatgtaggaaagccttcagatctgtcaagtacctgcgagtacatgaaagaaaacacactggagagaaaccctatgagtgtaagctatgtggtaagggatttatttcttccacttcctttcgctatcatgaaaagactcacactggagagaaaccttatgaatgtaaaaaatgtgtgaaagccttcagttttgtcaaggatcttcgaatacatgaaaggacacacactggagagaaaccctttgaatgtaaacaatgtgggaaaaccttcacttcttccaattcctttcactatcatgaaaggactcacactggagagaaaccctatgagtgtaagcaatgtgggaaagccttcagatctgcctcagtccttcaaaagcacatacgaactcacacaggagagaaaccctatggatgtaagcaatgtggtaaagtctttagagttgcctcacaacttaaaatgcatgaaaggactcacacaggagagaaaccctatgagtgtaagcaatgtggaaaagccttcatttcttctaattctattcgctatcataaaaggactcacactggagagaaaccctataaatgtaaacagtgtgggaaagccttcatttcttccaactcttttctctaccatgaaaggattcatactggagagaaaccctatgagtgtaagcaatgtggtaaagcctttagatctgcctcaatccttcaaaagcatgtaaggactcacgctggctag

SEQ ID NO: 204061 - DNA, 3304 bp, Homo sapiens
  Payload ID: 20246
  Gene Name: zinc finger protein 879
  Uniprot ID: B4DU55
  ENST ID: ENST00000444149
  CDS Start-End: 189-1880
acaaacgctgcggttcagccagggaaacccgtcggctctccggcgcgcaggcgcagttgcgcccggcagcgacgggaaacgtctctgaattaggtgttccgctcgcctcttgtgcggtgtggagctgcgcgccccccgccgaggcgggcccaggtgccttctccaagagaggcagcagggagggagaaatggcaaggaggttgctgccagcccatgtacaggagtccgtgacgttcagggatgtggccgtgttcttcagccaggacgagtggttgcacctggactctgcccagagagccttgtaccgggaggtgatgctggagaactacagcatcctggtctcactggggattctcttttccaagccaaaggtcatctcccagttagagcaaggagaagacccctggatggtggagagtggagttccccaaggcgcacatctcggatgggaaagcttgtttggaaccatagtttctaaagaagaaaatcaggaagtcatgaaaaaactcataattgatggcacatttgacttcaagttggagaagacctacataaatgaagataagttagagaagcaacaaggcaaaaagaacagacttttcagtaaagtgttagttaccatcaaaaaagtctacatgaaggagaggagctttaaaggtgttgaatttgggaaaaatcttggtctaaaatcatcgcttattagaaaaccgagaatagtttccagaggaaggagaccccgttcacagcagtattcagttctctttaaacaactgggggtcaacacagtgcgtaaatgttataaatgtaatatctgtgggaaaatcttcctccacagttcctccctgagtaaacaccagagaatccacactggagagaagctctataaatgtaaggaatgtaggaaagccttcagccaaagctcatccctaactcagcacttgagggttcatacaggagagaaaccttatatatgtagtgaatgtggaaaagccttcagtttcaccacatctcttattggacaccagagaatgcatactggagagagaccttataaatgcaaggaatgtggaaaaacatttaaaggtagttcatctcttaataatcaccagcgaattcacacaggagagaagccctataagtgtaatgaatgtgggagggccttcagtcagtgctcatctctcattcagcaccacagaattcatactggggagaaaccgtatgaatgtactcagtgtgggaaagccttcacttcaatatcgcggctaagtaggcaccatcgaattcatactggagagaaaccctttcattgtaacgagtgtggaaaagtattcagctatcactcagcccttatcatacatcagagaattcacactggtgagaaaccatatgcatgcaaagaatgtgggaaagccttcagccaaagctcagctctcatacaacatcaaagaattcacactggagaaaaaccctacaaatgtaatgaatgtgggaaagccttctcttggatttcacggcttaatatacatcacagaattcacactggagagaaaccatataattgtaaggaatgtggaaaagccttcagttcccactcaggcgttaatactcatcgaaaaattcatactggagaaaaaccttataaatgtaatgactgtgagaaagccttcaaccaaagctcagctctaattcagcaccagagaattcatactggagagaaaccatataattgtaaagtgtgtgggaaagccttcagacagagttcatcccttatgacacacatgagaattcatacaggggaaaaaccttataaatgtaaagaatgtgggaaggcttttagtcagagctcatctcttactaatcatcaaaggactcataattgagaaaaactgtataaatgcatgtaggaactgaagttatattccatactgagtatcaaaaaattcattgtggggagaaagtgatgaagagtagttaatcataggtaaaacttcagcattagacctcatcacacatcagagacttcatgatgcagggtaaccttgggaatgctagaaaagcttctataaaatgtttattcatatgttcttaagttattaccatgaaatggagaatttttaagattgcagggttagtatttgattgtctagtgatgtacgataacagccaccagctttcctgagcatcactgggaagcctgctgtttatgtacaagtacagccataaaatccagacacagataaatctaggaatctattttttgaaactattatgcaagccagtggtactagaaagaatgttttagaaaagaaatatgtacaggtgacccatagctacctcactgtcactaaaatgttttttaataatcttaaagcagattctgcacttcatggtaaagactttgaattgtttctctgctttctaagccattcacctgagaagaaaatcactccataaactatgcagacgtactgtctttgcgttttcttcctgactacttgttccaaactctgagtcagatctaaagtcactttaagtcacagaacgcatggtatttcacttgtttttctcattaaaagtgattacctttgctgtattaaattgataagtaaaggtcattcagacaaccactgcttttgcaatttactgaaaaatgttataaattatctcagaatgtagccaatagcaagcacagctcagctcccagggtctgcctgcttctgtgagctttctggttaccagccaccagaaggcccaggaacaatgtagaactcaggtcatcatccttggaggtaaaatgaaccagatgattttcacccttacttccactttttcgccttcatcagacaaggttcactttctccccacactctaaaggtcactgggcaaatatttaggctctgagttcagatactctttcttccagcaaatggacttacactcttcaacaagtgatttagctcatttcagcatttctaaaatgtgaatcataagattagcaagctaaaaacagttatctcacaagtcaaaattgttgggctttacagaggctaacatctagtttagccaagtttatcaggagggggcaagcacttaagggctgaaacgacccatttcataaagtgctaagtttttctgccaaggaactttaaaaaatagaaaactggctgggtgcagtggctcacgcctgtaatcccggcactttgggaggccaagacgggcagatcatgaggtcaggagatcgagaccatcctggctaacatggtgaaaccacgtctccactaaaaatacaaaaaaaaaaaaaaaa

SEQ ID NO: 204062 - DNA, 553 bp, Homo sapiens
  Payload ID: 20246
  Gene Name: zinc finger protein 879
  ENST ID: ENST00000522442
  CDS Start-End: 150-553
gcagttgcgcccggcagcgacgggaaacgtctctgaattaggtgttccgctcgcctcttgtgcggtgtggagctgcgcgccccccgccgaggcgggcccaggtacaggctgccggtgccttctccaagagaggcagcagggagggagaaatggcaaggaggttgctgccagcccatgtacaggagtccgtgacgttcagggatgtggccgtgttcttcagccaggacgagtggttgcacctggactctgcccagagagccttgtaccgggaggtgatgctggagaactacagcatcctggtctcactggggattctcttttccaagccaaaggtcatctcccagttagagcaaggagaagacccctggatggtggagagtggagttccccaaggcgcacatctcggatgggaaagcttgtttggaaccatagtttctaaagaagaaaatcaggaagtcatgaaaaaactcataattgatggcacatttgacttcaagttggagaagacctacataaatgaagataagttagagaagcaacaaggcaaaaagaa

SEQ ID NO: 204063 - DNA, 543 bp, Homo sapiens
  Payload ID: 20246
  Gene Name: zinc finger protein 879
  ENST ID: ENST00000519896
  CDS Start-End: 137-460
gcagttgcgcccggcagcgacgggaaacgtctctgaattaggtgttccgctcgcctcttgtgcggtgtggagctgcgcgccccccgccgaggcgggcccaggtgccttctccaagagaggcagcagggagggagaaatggcaaggaggttgctgccagcccatgtacagtcctggatgaacaggagtgggtttgccattccaggagtccgtgacgttcagggatgtggccgtgttcttcagccaggacgagtggttgcacctggactctgcccagagagccttgtaccgggaggtgatgctggagaactacagcatcctggtctcactggggattctcttttccaagccaaaggtcatctcccagttagagcaaggagaagacccctggatggtggagagtggagttccccaaggcgcacatctcggatgggaaagcttgtttggaaccatagtttctaaagaagaaaatcaggaagtcatgaaaaaactcataattgatggcacatttgacttcaagttggagaagacctacataaatgaag

SEQ ID NO: 204064 - DNA, 690 bp, Homo sapiens
  Payload ID: 20246
  Gene Name: zinc finger protein 879
  ENST ID: ENST00000521285
  CDS Start-End: 568-690
ttttcttgcgcccttgtttttttggggccagggagaatgggtaacgctacctttaagcagctttgataactgtttttgataaaggaagtaaatcttacaagaggaagaaaagaggactaatttttggttggctgttcctaaaaaagagcatcagttcttcaactgctgtttttcgtattgaacaacatccaagtgcagatgtgtggaatattgtgtcatttcctattactttatctgaatgagccttgcctgattctgcccttgaccctgttaaggcacggcagatggtcttcatcccttcgctcctttcgtctttatcgtaaagcactggcagaaaggtagcaggcccggtgactctgaacctgcttcccacactggtttaagtggccggacttagggcccctctggcctgggcagttccaggctccttctctgcaggtgctcagcttatggcttctaacctggtctggcctaatgagggtgggcatgcaggctggatgaaaagacctcacagcttttttctccattccaggtgccttctccaagagaggcagcagggagggagaaatggcaaggaggttgctgccagcccatgtacaggagtccgtgacgttcagggatgtggccgtgttcttcagccaggacgagtggttgcacctggactctgcccagagagccttgtaccgggag

SEQ ID NO: 204065 - DNA, 496 bp, Homo sapiens
  Payload ID: 20247
  Gene Name: zinc finger protein 880
  Uniprot ID: Q6PDB4
  ENST ID: ENST00000344085
  CDS Start-End: 28-324
ggaagcagattacgtggagtgacggtcatgctgcggcgtggacacttggcattcagggacgtggccatagaattccctcaggaggagtggaaatgtctggaccctgctcagaggactttatacagggaagtgatggtggagaactacaggaacctggtctttctgggaatctgtcttcctgacctgagtgttatctccatgttggagcaaaggagagatccccggaatctgcagagtgaagtgaaaatagcaaacaatccagggtcttgctctgtcacccaggctgtcgtagagtggcaatcatcagtggcaatcgtggcttaactcatagcctcaaactcctggtctcaagtgatcctccttcctctgcttccgaaagtggtgggattacaagcatgagccactgtaccctgcaaaaccacactttgagtttctgtttgggagctctctgcaagtgagagaattctttgggaaaataaaagtttaaatcctgtga

SEQ ID NO: 204066 - DNA, 2230 bp, Homo sapiens
  Payload ID: 20247
  Gene Name: zinc finger protein 880
  Uniprot ID: Q6PDB4
  ENST ID: ENST00000422689
  CDS Start-End: 16-1749
cgtggagtgacggtcatgctgcggcgtggacacttggcattcagggacgtggccatagaattccctcaggaggagtggaaatgtctggaccctgctcagaggactttatacagggaagtgatggtggagaactacaggaacctggtctttctgggaatctgtcttcctgacctgagtgttatctccatgttggagcaaaggagagatccccggaatctgcagagtgaagtgaaaatagcaaacaatccaggtggcagggagtgcatcaaaggtgtgaacgcagagagcagctctaaattgggaagcaatgccggaaacaagtctcttaaaaatcaacttggattaacctttcagttacatctgagtgaactgcagctatttcaagctgaaaggaatatttctggatgtaaacatgtcgaaaaacctatcaacaattccttagtttcaccacttcaaaaaatttattctagtgtcaaatcccacattttaaataaatacagaaatgattttgatgattctccatttctcccacaagaacaaaaagcacaaataagggaaaaaccgtgtgaatgtaatgagcatggcaaagcctttagagtgtcttcaagacttgctaacaatcaagtaatccacactgcagataacccttacaaatgtaatgaatgtgacaaggtcttcagtaacagttcaaaccttgtacaacatcaaagaattcatactggagagaagccttacaagtgtcatgaatgtggcaagctcttcaatcgaatttcactccttgcacgacatcagagaatacatactggagagaaaccttacaaatgtcatgagtgtggcaaagtcttcactcaaaattctcaccttgcaaatcatcacagaatccacactggagagaaaccttacaaatgtaatgagtgtggcaaggtcttcaacagaaatgcacaccttgcacgacatcagaaaattcatagtggagagaaaccttacaaatgtaaggaatgtggcaaagcattttcagggggttcaggccttactgctcatcttgtaattcacactggagagaaactttacaaatgtaataaatgtggcaaggtcttcaatcgaaatgcacaccttaccagacatcaaagaatccatactggagagaaaccttatgaatgtaaagaatgtggcaaggtcttcaggcacaagttttgtctaaccaatcatcatagaatgcacacgggagagcaaccttacaaatgtaatgaatgtggcaaagcatttagagactgttcaggccttactgcccatctactaattcacactggagagaaaccttacaaatgtaaagaatgtgccaaggtcttcaggcatagattatccctaagcaatcatcagagatttcatactggagagaaaccttacagatgtgatgaatgtggcaaggacttcactcgaaattcaaaccttgcaaatcatcacagaatccatactggagagaaaccttacaaatgcagtgaatgtcacaaagtctttagtcacaattcacaccttgcacgacataggcaaattcatactggagagaagtcttacaaatgcaatgaatgtggcaaggtcttcagccacaagttatacctaaaaaaacatgagagaattcatactggggagaaaccgtacagatgtcatgaatgtggtaaggacttcactcgaaattcaaacctggcaaatcatcacagaatccatactggagagaaaccgtacagatgaaatgtgtgtggtaagatctttagtaataattcacaccttgcacagcatgagataattcattcatgagagagttcttacaaactgagtatggcaaactcttcatgctaagttctagcattaatcaacatcagagattccatactaaagagaaatcatagcaatgtatgtgaatcaggtctcttgaggcctgccaaatgactagatatcaaaacatacatcttggatgaaaccatacagatggattatgtatgctgaggctattattcaaggaccattactatggaacatgataagatttacacaagcgataattcagtctctagttctccaatatttatgatactgcatgctgcagaaaagtcacagctccaaatacgttgaatctcatgacgcgatgcatgtcgaaggtccaagggcatgtggaaatggtcagttatattcaggcaattaaaaaacctaattatatggggttttttgaaaa

SEQ ID NO: 204067 - DNA, 558 bp, Homo sapiens
  Payload ID: 20247
  Gene Name: zinc finger protein 880
  ENST ID: ENST00000424032
  CDS Start-End: 50-427
gcgcgcagtttcctggagacccggaagcagattacgtggagtgacggtcatgctgcggcgtggacacttggcattcagggacgtggccatagaattccctcaggaggagtggaaatgtctggaccctgctcagaggactttatacagggaagtgatggtggagaactacaggaacctggtctttctgggaatctgtcttcctgacctgagtgttatctccatgttggagcaaaggagagatccccggaatctgcagagtgaagtgaaaatagcaaacaatccaggtggcagggagtgcatcaaaggtgtgaacgcagagtctcgctctgtcacccaggctggagtgcaatgccgcgatctcggctcactgcaaccttcgcttcctggattcaagcaattcttctgcatcggcctccccaagtgctaggattacaggcagagcagctctaaattgggaagcaatgccggaaacaagtctcttaaaaatcaacttggattaacctttcagttacatctgagtgaactgcagctatttcaagctgaaaggaatatttctgg

SEQ ID NO: 204068 - DNA, 953 bp, Homo sapiens
  Payload ID: 20247
  Gene Name: zinc finger protein 880
  ENST ID: ENST00000600321
  CDS Start-End: 31-408
cccggaagcagattacgtggagtgacggtcatgctgcggcgtggacacttggcattcagggacgtggccatagaattccctcaggaggagtggaaatgtctggaccctgctcagaggactttatacagggaagtgatggtggagaactacaggaacctggtctttctgggaatctgtcttcctgacctgagtgttatctccatgttggagcaaaggagagatccccggaatctgcagagtgaagtgaaaatagcaaacaatccaggtggcagggagtgcatcaaaggtgtgaacgcagagtctcgctctgtcacccaggctggagtgcaatgccgcgatctcggctcactgcaaccttcgcttcctggattcaagcaattcttctgcatcggcctccccaagtgctaggattacaggcgtgagcctccgcgcctggcctcatttttaatttttttagagacagggtttcactctgctgcccaggctagatggcagtggtgcagttttaggtcgctgcatccttgactttgagggcagaactgctcttcccagctcaggtgatccacccgcctcagcctcccaaagttctgggattacaggcatgagtcactgtacccggctctgatatttttaataatgcttcaatgaacatgggtttctaaatatctctttaagctgctatcttagttcttttgtatatatacccagatgaggaattgttgcctatactggtaatttgattttggattatttgagaaaatgtcatacttatttttttttttattattattttcgagacagggtttcactctgtcacccaggatagagtgtggtatacaatctcagttcactgcaacctccgtctcccaggttcaagtgattcttgtacctcagcctcccaagtagctgggattacaggcgtgtgcctccatacccatctaatttttgtactt

SEQ ID NO: 204069 - DNA, 491 bp, Homo sapiens
  Payload ID: 20247
  Gene Name: zinc finger protein 880
  ENST ID: ENST00000597976
  CDS Start-End: 21-374
gattacgtggagtgacggtcatgctgcggcgtggacacttggcattcagggacgtggccatagaattccctcaggaggagtggaaatgtctggaccctgctcagaggactttatacagggaagtgatggtggagaactacaggaacctggtctttctgggaatctgtcttcctgacctgagtgttatctccatgttggagcaaaggagagatccccggaatctgcagagtgaagtgaaaatagcaaacaatccaggtggcagggagtgcatcaaaggtgtgaacgcaggtaagagcttggatggccagagtggaggccccataattttttttttttttaaacagggtcttgctctgtcacccaggctgtcgtagagtggcaatcatcagtggcaatcgtggcttaactcatagcctcaaactcctggtctcaagtgatcctccttcctctgcttccgaaagtggtgggattacaagcatgagccactgtac

SEQ ID NO: 204070 - DNA, 15455 bp, Homo sapiens
  Payload ID: 20248
  Gene Name: zinc finger protein 891
  Uniprot ID: A8MT65
  ENST ID: ENST00000537226
  CDS Start-End: 354-1988
gttcaggccacgctccgcccccagcccgtcagccgcgcgccccgggaccctagagccggcgattcgtcgccggcgccgcagccgccactctgtgccggaccctgcgggccttcggcccagagcgcgtccgtgacgcacagaccaggcccctctgcggggcggcgcaggagctcctgggaaacgtagttcggcctcgcgtccccctcgggcgggaccgcggacgcctggaggcaggcactgaggacggggagaacttcgggtgaaatgcatccctcctgtgactggattggagacacaagaacagaaacatcctgatctctctactctactgtgcaggcttatgtactcataaaatggcagttatggacctatcctccccatgggctttaactaaacaggactctgcctgtttccatctgagaaatgctgaagaggaaaggatgattgctgtatttctgacaacctggttacaggaaccaatgactttcaaagatgtagctgtggagttcactcaggaggagtggatgatgctggattctgctcaaagaagtctgtacagagatgtgatgttggaaaactatagaaatctcacctccgtggaatatcagttgtacaggcttactgtgatctccccattggatcaagaagagataaggaatatgaaaaagagaattccccaagccatctgtccagaccagaagattcaacctaaaaccaaagaatcaactgtgcagaaaattttgtgggaggaaccatccaatgcagtgaaaatgataaaactcacaatgcataattggtcctccacattaagagaagactgggaatgccataagatcagaaaacagcataagattccagggggacattggaggcaaatgatatatgccccaaagaaaacagtacctcaggagctattccgtgactatcatgaattagaggaaaactctaaacttggatcaaaacttattttttcacagagcattttcaccagtaaacattgccaaaaatgttactcagagattggatgtttgaaacacaattcaatcataaacaattatgtgaaaaactctataagtgagaagctctatgaaagtcatgaatgtgatacaactctatggcattttcagagaaatcaaacagtacaaaaagagtacacatattctaaacatggaatgcacttcacacataatatgtttcctgtacctaacaatttgcatatggcacagaatgcctgtgaatgtaataaagatgaaacgctgtgtcatcaatcatcccttaagaaacaaggacaaactcatactgaaaagaaacatgaatgcaatcaatgtggaaaagccttcaaaaggatttctaatcttactttatacaagaaaagtcacatgggtgagaaacaatatgaatgtaaagaatgtggtaaagtgttcaatgattcctcaaccttaaggagacatgtaagaactcacactggagagaaaccctatgaatgtaatcaatgtggaaaagctttcagtcaaaaaacatcccttaaggctcacatgagaactcacactggagagaaaccttatgaatgtaatcagtgtggaaaatcctttggcacaagctcttaccttatagtgcacaagagaatacacactggagaaaaactctatgaatgcagtgagtgtggaaaagccttcaacacgagctctcaccttaaagttcataagaaaattcataccggagagaatgtttatgaatgcagtgactgtgggaaagttttcagtggggtctcatcccttagaatgcatataagaactcacactggagagaaaccctatgaatgtaaggaatgtaggaaagccttcagtgtttcctcttcccttaggaggcatgtgagaattcacactggagagaaaccctatgaatgtattcaatgtggaaaagccttcagtcagagctcttcacttattatacacaagagaattcatactgagagagaaaccctgtaagtgttatgaatgtggaattgctgttttcattgtcttaaggtggattccaagctccttgtctcagtctttgttctctaaaagaacgatttaaggttacaaatggctctttttttaatataacattttctgtaaatactaattatgactttttttgatccatggctgtttagaattaggtatttttaatatgtgaggtaggtatattttcagttatctttttattgttggtttctaggttaattccattgtgttcagagaatctggactatattttactgctttgttggtgtttttataaaagttgttttctggcccagtgagactggtattgctagcagccaaccaaacatttgagctcatctttccttactaatgaattccatcttagccaagaacaataaggtctctggttatagaacgcttctttgacttcttgtagctaagggtagccatatcattcattcttgctgattcaaaaatagacatatcactgggatcagaactatctatcttgtcctctactttttgcacttcatctttgtccctatgaattggccattcctgaagctgctgaaagagctatcttgtgatcatgaaaatgacagctgtagccaagggatgaagtagaagaaagagatccctgttcctcaaagaaatctttaaatagttgtaccagccctgcactacttgtatctggatatgttcctacatgagaaaaataaggttttttgtttgttttttgagatggagtctcggtatgttgcccaggctggagtgcagtggcacaatctcagctcactgcaacctccacctcccaggttcaggtgattctcctgcctcagcctcctgagtagctgggattacaggcaccaccgccatgcctggctaattttagtatttttaatagagacggggtttcaccatgttggccaggttggtctcaaactcctgacctcaggtgatccacccacctaggcgtcccaaagtgttggcattacaggcgtgagccactgtgcccggccaagaaaaatatgttaattgattttttctttttttttttcaatttttcagacagagtctctgtctctcaggctagaatgcagtggtgtggtcatggctcattgcaacctcgacctcctgggctcaggtgatccaccacagtctcctcagtagttgggatcacaaatgcatgccaccatgcctggctaattttaaaaatatatattttgtagagacaggctcttcctacattgctcagactggtctgaaactcctgggctcaagcagtcctcctgcctttgcctcccaaagtgctaggattccaggcatgagttaccatgcctggctcttactgattttttttaaagcactacataaatacagtcaacgcagtcaccatattgtagaaaaacagaagtatatacagttaaatgttttatgttggatgtacacatttgaagaggaacatagaaaaaaagtatggaaaaggaatgttgaccgagcttttatgcttaagcagcagatgaagatagaaccaagatcactgaaagcaagtgtttagaacagcaaaaagagtatcccaacatttcagcattggaactacagaaagttttcagacagaggggaagttaccaattttaaatgctaagtaaagcatgagattttgctgcttgatcttgcagatactgaccagattagttctaacaaaatatggaaggagtggcatacggtggaagaaagaaggcagtagctgctgttgtagttattcatgttagcctcagaggatggtgagacatccagatgaagaggttggtacgcaattctagaattgaggaggtgtctagatagagatataaattgtagtgacatcagtaaagagacaataacaggctttggaaggtgagtaagaatgaaaagggaaggtctgccacctaccctgaagacatacatttaaaggaactatagtagagagataagaggaaaacaagaagagtggagtttcactgaaccaagacaaacaagtttcaaaaaggaaggtgaagttggccaggtgtggtggttcacgcctgtaatcctggcactttgagaggctgaggcaggcggatcacaaggtcagatcgagaccatcctggccaacatggtgaaaccctggttctactaaaatacaaaaattagccgggtgtggtggcacatgcctgtagtcccagctactcaggagctgaggcagaagaatcacttgaacctgggaggcagaggttgcagtgagatgagatctcaccactgcactccagcctggtgacagagcaggacttcatctcaaaaaaaaaaaaaaaaaaaggaaggtgaaggtaaatgtttttagtgttacttagggatccaattagatgaagtctaaaaaggtaaacatatacagccaagtgaagatcatttgtgattgtagttggaaataacatagtggtacataatgaagatggttgctagattgggctgactttaggaatcaataaagggcaaagaagtaaagactggatgtagacaagtttgaataataggagaaagggtagtagctggagagatttggagtaaagagataatatgtttaaaatatgaaaaactagaacatgtttgaattctaatgtgatgaatgtagtatggtgaggtttaatatgcagcataataaagtttaatataagcttctgagaatggggtgtagatgtttagagcacaaacaaaagtattggtgtttgccatgaggcggagggatactcccaccattctttcaggagtagaaaaatgggtgggttggtttaaattacttgtttatttatttacacctaactgtactaagcagtgatcagaatatgtgaactatataatgttttgtgtttcctaagaactgtgtggcagccactgctaattactaaccaaatatatatattttttattctttatgaatagatcttcagttttgctaacagtagtattgtatttagctacaaaactacttatcccaacctctttgtagccttgatgccatttctactgttcctggccagtaaaatatagatatatgattataggtttcatggtaagattatctgctaagaggaaggtggatgaaattctgcaaggaggttttagtgaagaagatctctatgtatttgaaagtccttccaagttatcaatagagccatcagtggagaagacagcaaagcaagtagcaaagtctatgtgattgaggagaggtcatttaaataaaagatagcaaggaagagagggagaaagtggtataactagatggtatgaacttcaaaggaaggagtggttttctccaggctgcaatggttagaagcagtgttagggagtaaggaagatactgatcccacttccaacctgtggatatgtggaatacatgagaataagcccccttgtgatgtgattgttgtcaggtaggtgttttttccttcccagggaacagccaagtttaaattaatgaaaggaaatgttcagggaaatagttgaggatattaagggagtttattaagggaatctcagagggcaccatgaaagagtctccagaagggcaggggtttagggtttctggctttggcctgaggaatacagaagattgtaatgacattattgatagaggaaaaaagaccagatcaggggctatgaccagtgaaaacaaaatttagagggagtataggttaaatcccagcagtctgtaagaagatgatgggtatttaggtctactgggattcatttgtagcttggaaaggagagcctgcagtcatgctgtgaaaccaagtggtttcaggtgttagcagccctggtgggtatagcactagccatcagtagttagaaaatggtcccaactggccgggtgcagtggctcacgcttctaatcccagcactttgggaggccgaggcaggcggatcacgaggtcaggagattgagaccatcctggctaacatgatgaaacctcgtctctactaaaaatacaaaaaattagccaagtgtggtggtgggcgcctgtagtaccagctactcgggaggctgaggcaggagaatgctgtgaacccgggaggcagaggttgtggtaagccgagatcgcaccactgcattccggcctaggtgacagagcaagactccgtctcaagaaaatcgtcccaactgcatgtggtccttgggtgagatcatcttaaggagtactcagcaagggattgtactttgcttggttaggactggaatttacactctaattttggcccagtgatcttggaacagattgagcatctcaaatctgaaaatctgaaattcagaatgctccaaaacctgaaaccttgtgcgccgatgtgactttcaaaagaaatgctcattggagcatttaaaattttggattttcagatttgtgatgctcaactagtaggtataatgcaaatattccaaaatccaaaacagttctggtcccaagtgttttgaataaggaatactcatcctgtacaccaggaggtagactcaggcacagtctcgcccagcatctcacctggattttattgcaatagcctcctaactggtttctctgacttgaatcatactttcctttagtatgttttctatgcagctgccatggtatcctattaaaaaacaaaacaaaacaaaacaaaaactttgtggtttttaataataaaactaatacatgcataggagaaaacaatgtaaataacttctgccctacacagaaggaaaccctggattctactgccttaaaaaattaatatcgtaggtgaatgtgcattctgtcagactttatgtacatacaaacattttataaaaattgagttataccttttatcccacatcttttttttttttttttttttttttttgagaaggagttttgctttttcccaggctggagtgcagtggcacgttctcggctcacagcaacctctgcctcctgggttcaagcaattctcctgcctcagcctcccaagtagctgggattacaggcatgtgccaccactcctggctaattttgtatttttagtagagacagggtttctccatgttggtcaggctggtctcaaactcctaacctcaggtgatccgcctgcctcagcctcccaaattgttgggattgtgaggccatcgcccccagcctatccaacatctttttaaacatctttccatgtcagtgcatgtagttctatttcatttgtaatagctgcttagtatttgattatatgcttgtaccataatgtatttgatccatttgcctccagagtttttataacaatactgcaatcaataatattgtttatatattgtgctttcctatcaactgttctctacacttcccagggtgatccatctaaagtactaacctgatcacataacatttcacgtttaatcttcttctggcctttttctccagttaagataaaatctttttacaagaccttgctcaaactcttgccttttcaggccttatctctggttattccctttatcttcactgtctccctaatttaacctgtcctatttatcctttaggtattgtgtccttcatctgctttaacaatacttgtcacactttcacactgtattgcctgtttgtgtattgtgccctctacactgtaagttttggtaaggtgggaactttgtctaaatttttcattgttttattacttggcccagtgtaggtgttcagttaaatatttacggttcttcagcaaattttgtgccttttcttttacttaccattctagtggaagtttaacttaaaagctatttaagtgattgtaaggtaaaagttgcaaggaggtgggtgcaatggcctgtgcctgtagtcctatctgctctggaggctgacgtgggaggattgcttgagcccaggagtttgagaccagcctgagtaacatgagactccattatagtaaaaatgcatggaattaatttttcttctaggtataggaaaatgttgcaccataacaggtgtgcagaaactaagactgttaggacaacagcagtttaatgttatttatattatgtccctctcctagtccttctcctctcttccctcatcccactcaccaccaccccattcactacacagacttattttttgtagagcaagtgttcatattctgttccattatgtattataatatgaaaagggatgagttgaccaagtattggtgggtgtgtcgtatacttgctttagactaccaatggaagcgtaaattagtacaaacttactgggtgggtgtggtggctcacatctgtaatcccagcactttgagaggctgaggtgagtagattgcttgagcccaggagtttgaaaccagcctaggcaacatggcaaaaccccatctctaccaaaaaaaaaaaattacccatggtgtcatgaatctgtggtcccagccactagggatgctggggtaggaggatcacttgagctgcagtggggttgagtctgcagtgagctgtgtgcaccactgcactccagcctgggtgacagagtaagaccctgtctaaaaacaaaaacaaaccaaaaaaaacttgggacagtaaagcaataaatgtccaaagctggaatatttataacctttaaatatttaaaacccagcaattttaaactgagattttataaaaggatttttcatgtataagtaacaatattcacctgtttcatgccctagtgaaaaactggaaaattcctaaattcccagtaacagtcaataaaatggaatataatgcagtcattaaaatgtatttgtgtggattgacatgtggagatatatttgatacattatgaattttaaacagtcacaaaatatggtatgactttttaatgcatgttataaatatgtgtgtgtgcattgaaaatatggaaagacataacaccaaagttttatcaatggttatgtcataatttttttcttttgtctttttttaagatgtctagtttagtgaacagagctgtggtctatttcttaaaaataattctatcattaactttttaataaatactttttaaagcatgattttaatatcttcaaagttgtaaagtaaataatttgcttaggctgttgttggacacatagattcttttcatttttttaaataccagattaaaaaaattgaaaaatatatttttttatattttataaatatatttttaataaataaatataaatatatatatatatattttttgagacagagtcttgctctgtcgcccaggctgtagtgcagtggcacgatctctgctcaccgcaagctccacctcctgggttcatgccattctcctgcctcagcctcccgagtagctgggactacaggcgcacgccaccatgcccagctaattttttgtatttttagtagagacagggtttcaccgtattagccaggatggtctcgatctcctgacctcgtgatctgcccgtctcggcctcccaaagtgctggggaaaatatattttttaacttaccatttctatctcctactttttaaaggcaaactttttgaaagtgttgataaagggtgtggatactttttagacttcctcttactctaggcagaattcaaaatatgaaggatacaaataagtttctctgataagaacagggaattgtgttagaaaaagcagtcagggctaggcgcagtggcgcacgcctgtaatcccagtgttttcgggaggcagaggtgggtggattgcctgagctcaagagttcaagaccagcctgggcaacatggtgaaaccccatgtctactaaaaatacaaaaactagctgggcgtggtggcacacacctgtagtcccagctactgggaggctgaggcaggagaatcacttgaacccaggaggcggaggttgcagtgagccaagatagtgccactgcactccagcctgggtgacagagcaagactgtgtctcaaaaaaaaaaaagaaggtctccatgagaaaataacatttaacttgaaatacgaagttaaagaaggagtagggagctccttcttctggctccatgggcagagggtggagggacagaggaagagctttctaaatagaacagcaagagcaaaaagactcatcaggatttgacatatttgtggaacagaaagtaagtccagtaaatggaaaactgttaggcaaaggggtaaggagaagagtatgtgaaaccagattgaaaggaggcaggggccagataaagaccttgctagctatgacatgagtttatactttatttgaagagttatgaggaactatttaagtttttcagagattgaaattatttgttttaaaaagatcacatttttgtataaaaaaatcttgagagactaggaagctatttgcaatagttcatgtatgaaatttgaatgccaaaaactaatttccttagcattcacttttttatttatttttctttattttttaattttctgtaagttactgggtttcctttttaatttttccataagttgcattcactttttaaaagacaatgagatttgttttagcataaacaggaaattcatggctaatacatgtcatgacttaaattcacctctaacttaagaaatgcatgtcaaatacataaaattatattttctacctatgagcacagtttcatgggagttttgatttttctaaaatattttttgatgcaatatccatttttttccatgcaattttgtcctttgtgatattgagggtgttcatgatgcagaatttattttaaaaaattatttctgtaatatttatttctccctttttttgagacagtgtctcactcttgcccagactggagtgtagtggcacaatctcagctcactgccacctcaaccttctgggctcatgtgatcctcctacctcagcctcctcagttgtggggaccacaggcatgtgctattacacctggataatttttttatttgtattttttgtagaaatggggtctcactgcattgcccaggctggtatcaaactcctgggctcaagcaatctttctgccttggcctcccaaagtgctgggttacataatttatttttttttgttttgtttccttaaaagaattgttaacataccagataattttttacactttttgccactttttctatgtcctgccttttaaaggcagactttttgaatgagttgctaaggactcagactctttcttccaaatcaatcatacccaataggcaggttttgctacctctctttgctctgaaatttcttggatctcttcagagggatttaacaaatttcctgtcctttttctcttttctttttcttttgttggttttgttttgttttgttgagatggaatcttgctttgtcgcccaggctggaatacagtagcgtgatctcggctcactgcaacctccacctcctgggttcaagtgattctccatgcctcagcctccatgagtagcttggattacaggcatgcaccgccacacccaactaattttttgtatttttagtagcaatggggtttcaccatgttggccaggctgattttaaactcttgacctcaagtgatctgcctgcctcagcctcccatgctgggatcatgctgggattacaggcacaagtcacttagccccctgccttacatacattgatgtatgatagaaaattcttttgggcacatcacagcaacaaaagttaacccagctttacctatttgtgagtatcttaagtctcccaaagcatttgattgttgctttccaagaaaatacagaattgtggtcattctcccatgactattctttactaatattgattgcatctgttgttctgtcgcctttctgcattcatagtaacttctttttccaatgctgaagattagttttaataaccttttgggagacttcttttaaaaaacttttttttcctgaagaataatacataaaggcatgcagctttatgaatttccccaaatagaacacacttaaccagtccccagatcatgagagccaaattaatacttttactacttttgcaatattcctagactcatcttttaaacgtctccctcctttcttgtgctattgtcgtgctatttacttcggtgtattttataatccaccagatattgttatgaaagtaaatatttatatcagagttgacaaactttgtctgaaggtcctgagagtaaataaatattctaggttttctttttttttgagacggagtctcgctctgtcacccaggctggagtacagtggcgcaatctcagctcactgcaagctccgcctcccaggttcacgccattcttctgcttcagcctctcaagcagctgggactacaggcgtctgccaccacgcccggccaatattctaggttttgcaggccatatatggtaactgttgcatattcttatttttctaagcagctttttaaagatgttaaaatcattcttagctcaaaggccttgatttggtccatagaccataatttcccaacacctgacttgtatttatcaacatatttacccctccagtgttatttatttctgcatttccaagtttctaagatcatttcatactgcctgaaaaattatttcttttagcataagaatgctaccgtaaatttcctctatttttattctgaaacatctttatttctgaaggatattttagctcagtatgaaaagaggttagcagtttttcacagtgtacatatgagccccccgtcccccactgcaatagtttttcttaaagggacctgcctctcccttagttgagaatatttaagtgaacttgagaatatttaagtgaactggcttcaaccatatgtcaagtagtatgtttgtgggctatcaatttatttctaggaaccctatgatcatttagccattgccacctatatggttaaaattctcattaacagtgcatcccttggactcttgtgcagattttacccaacccctcccatgccaagatcctatgatctctactgaaattgggatcttactttcattatagaagttctgcatcatctacagtctagagagggtgggtaccacagagttgtccaaggatggtggtaaactcctcaccaatgtatttcttaataccctgacgggaatgtcttttggcctttctctggctaagggaaaaaatgaacataataattcattgatagttacatctccctctaaagcagaggtgtccaatcttttggcttccctgggctacaccagaagaagaattttcttgagccacaataactgatagctatcattagtgttcacgtattttatatgtggcccaagacaattcttccaatgtggcccagggatgccaaaagattggacactggattccatccagtatgacttttcagatatctaagaagattttgctacacttattacaatggtagttttcccacagtgtaattctctgatataggtttgaaatattgcagaaattcactctacattcatttatacagttgctttttctcctacaagagtattaaaatttaagtattgcattgtaattgaaggcattcccaaatcactgtgtttgtatcactttggttaattggagattgctccaaagtaaacgttctcaatgttggctgcactcaacaaaaactagagggcaaagatttgatgtagtcaggggttggccaagtttttctgtaaagggctagatagtaaatgtttaacctttatggctgtatattaaactcttcagttatagaggtaaggagccatagactatgtaaatgaatacctggcccatgggctgtagcttgatgacctctgatatagttcatgaggtgcatccccacagagtaaacagtaggaaggaaagtggatgtggagcagataatgggagaaattgagtatactcttaaataaataaataatgaatttttcatatcctaattttgctgacagggtaacttgatttttaccctgatacaaaccattcctgcctgagaaaaccaaatcagatactagatacccatatgtaataaggcatgctgcttgaggacaccaaatcagatattaaatacccatatgtaataaggcatgctgcttgagaaaatcaaatcagatattagatacccatacgtagtaaggcatgctgcttgtattcgagtcagactgtacactattgtaagataaatcagcctctctgaaacaactcttatggaaacttgagaagcttctaaatgtatgtaccaatatggcatgccaatggcaggtttgaggaaatacacttctgataatgtatttagaactctagtacatgtaaataaggtgtttttgggctaaaacttttataaatttcacctcttacaaaattacttatatttatctaataacacctcctacaaatgtgccctcaatgcagccattacattaatgctcactaaattcattcctattcatattctctacctctctttctacaaaataaaattgcttaccttcctgattaaggcaaactaaccctgatggtgtgacctttgtcagctgggcaggtggtaatgccagaacagttttaaatacctgcttacaaaagaacggttttcaccgtacatggaacaaaacaggaagaataccttggtaattttctgtgatgtatcttatatttgtttcacactgaataacaaatgtctatagtcagattcaaggataactgtcagcattaccttaaatccaaactctgtctgaaagttaaaatcataaaacacctaaaaacactttgttatgtttgtatgtttcaacaagaaaaactactgtttattttttatgtcaatattgtagttacattttcagaatcacatgctgtgggaaaaaatcagcaagcagaaggtttataataaaccaaaagatttatttataacattttctgaattcacttaaaaaacaaaaaggaatcccccttccctcaaaatagaaccgtttcctacagattccatccagtatgacttttcagatatctaaggagattttgctacacttattacaatggtagttttcccacagtgtaattctctgatataggtttgaaatattgcagaaagtcactctacattcatttatacagttgctttttctcctacaagagtattaaaatgtaagtattgcattgtaaatgaaggcattcccaaatcactgtgtttgtatcactttgcttaaatatgaattttctgatctccaaagtgcatcatctttgtaaagctcatcccttgtccatgctttctgtcctggttgacagatgcggaatgagggctaatctctggctttctccaatctattggatatgtattctttcctggtaggaatttacacacgtaaagtaagggactcctaccaaatgaagtcttctcaacattaccagatggaagaatcttctcaacaatattgatttcaccttgttattgcaaaaaaataaaagagtggttattaatggcttttccacata

SEQ ID NO: 204071 - DNA, 2310 bp, Homo sapiens
  Payload ID: 20249
  Gene Name: zinc finger protein 90
  Uniprot ID: Q03938
  ENST ID: ENST00000418063
  CDS Start-End: 113-1918
ggtgctccaaatctggtcttagctgcttcgtgtcttcttctccagcctctgtggccctgtgacctgcaggtattgggagatccacagctgagggacccccggaagcctagaaatgggaccattggaatttagagatgtggccatagaattctctctggaggagtggcattgcctggacactgcacagcagaatttatatagggatgtgatgttagagaactacagacacctggtcttccttggtattgttgtcactaagccagacctgatcacctgtctggagcaaggaaaaaaacccttcactgtgaagagacatgagatgattgccaaatccccagttatgtgttttcattttgcccaagacctttgtccagagcagagcctaaaagattccttccaaaaagtgatagtgacaagatatgaaaaacgtgaatatggcaatttagagttaaaaaaaggttgtgaaagtgtggatgagggtaaagtacacaaaagaggttataatggacttaaccaatgtttgacagctacccagagcaaagtatttcaatgtgatacatatgtgaaagtctctcatatattttcaaattcaaacagacataagataagagatactggaaaaaaacctttcaaatgtatagaatgtggcaaagctttcaaccagtcctcaacccttgctacacataagaaaattcatactggagagataacctgcaaatgtgaagaatgtggcaaagccttcaacaggtcctcacaccttacttcacataagagaattcatactggagagaaacggtacaaatgtgaagattgtggcaaagaattaaagtattcctctacccttactgcacataagagaattcatactggagagaaacggtacaaatgtgaagattgtggcaaagaattaaagtattcctctacccttactgcacataagagaattcatactggagagaaaccctacaagtgtgataaatgtggcagagcatttatttcatcctcgatcctttatgtacataagataagtcatactgaagagaaaccctacaaatgtgaagaatgtggcaaagccttcaagctctcctcaatccttagtacacataagagaatccatactggagagaaaccctacaaatgtgaagaatgtggcaaagccttcaggcgctccttagtccttcgtacacataagagaattcatactggagagaaaccctacaagtgtgataaatgtggcaaagcatttatttcatcctcactcctttataaacataagataagtcatagtgaaaagaaaccctacaaatgtgaagaatgtggcaaagccttcaagcgctcctcaacacttactatacataagataagtcatactgaagagaaaccctacaaatgtcaagaatgtgacaaagtcttcaaacgctcctcagcccttagcacacataagataattcatagtggagagaaaccctacaaatgtgaagaatgtggcaaagccttcaagcgctcctcaaaccttactacacataagataagtcatactgaagagaaactctacaaatgtcaagaatgtgacaaagccttcaagtactcctcagcccttagcacacataagataattcacagtggagagaatccctacaaatgtgaagaatgtggcaaagccttcaagcgctcctcagtccttagtaaacataagataattcatactggagcgaaaccctacaaatgtgaagaatgtggcaaagcctttaagcgctcctcacagcttactagtcataagataagtcatactggagagaaaccctacaaatgtgaagaatgtggcaaagcttttaacttgtcctcagaccttaatacacataagaggattcatattggacagaaagcctacatagtgaagaacatggcaaatctttgaaatattcctcaacccttaataaacataagataattcatactggagagaaaccgtataaatgtgatgactgttggaaagcctttgaccacccctctactcttactaaatatgagaatttatatgaaacataactcctacaaaaataaagaatgtgacaaatcattttaaggaagttctcaacccttactacacataattcatactggacggaaactctacaggtgtgaaaaatgcagcaaagcctataacaagttctcaattctttttttttttttttaagaaggagtttcatgcttctcacccagcctggagtgcaatggcacgatctctgctcactgcaacctcttcctcctggttcaagccattaacctgcttcagcctccaccaccatg

SEQ ID NO: 204072 - DNA, 756 bp, Homo sapiens
  Payload ID: 20249
  Gene Name: zinc finger protein 90
  ENST ID: ENST00000473524
  CDS Start-End: 129-359
gtctcttgctgcagctggtgctccaaatctggtcttagctgcttcgtgtcttcttctccagcctctgtggccctgtgacctgcaggtattgggagatccacagctgagggacccccggaagcctagaaatgggaccattggaatttagagatgtggccatagaattctctctggaggagtggcattgcctggacactgcacagcagaatttatatagggatgtgatgttagagaactacagacacctggtcttccttggtattgttgtcactaagccagacctgatcacctgtctggagcaaggaaaaaaacccttcactgtgaagagacatgagatgattgccaaatccccaggctgaatatccttcaggactttgctctgtagggcagacactagggcatgtttttgcagtcgggtctgcatatggtgggccttgtatcaggatgtggatgagtatggctctgactgagtaccagacagcatttcctcagttatgtgttttcattttgcccaagacctttgtccagagcagagcctaaaagattccttccaaaaagtgatagtgacaagatatgaaaaacgtgaatatggcaatttagagttaaaaaaaggttgtgaaagtgtggatgagggtaaagtacacaaaagaggttataatggacttaaccaatgtttgacagctacccagagcaaagtatttcaatgtgatacatatgtgaaagtctctcatatattttcaaattcaaacagacata

SEQ ID NO: 204073 - DNA, 1918 bp, Homo sapiens
  Payload ID: 20249
  Gene Name: zinc finger protein 90
  ENST ID: ENST00000469078
  CDS Start-End: 140-478
cgcggccatttgtctcttgctgcagctggtgctccaaatctggtcttagctgcttcgtgtcttcttctccagcctctgtggccctgtgacctgcaggtattgggagatccacagctgagggacccccggaagcctagaaatgggaccattggaatttagagatgtggccatagaattctctctggaggagtggcattgcctggacactgcacagcagaatttatatagggatgtgatgttagagaactacagacacctggtcttccttggtattgttgtcactaagccagacctgatcacctgtctggagcaaggaaaaaaacccttcactgtgaagagacatgagatgattgccaaatccccagatggagtccactttctcatccaggctggagtgcagcagcgcaatctctgtgtgatcattgcaaccttcacctcccaagttcaagcgattctcctgcctcagtctcccaagtagcaaggactacagcgccgcgcggtgaggttctctagtccacgctcgcagccatgccgtccaagggcccgctgcaatcggtgcaagtcttcggacgcaagaagacagccacagctgtggcgcactgcagacgcggcaatggtctcatcaaggtgaacgggcagcccctggagatgactgagccgcgcatgctacaatacgagctgctggagccagttctgcttcttggcaaggagcgatttgctggtgtggacatccgtgtccgtgtgaagggtggtgctcatgtggcccagatttatgctatccgtcagtccacctccaaagccctggtggcctattaccagaaatatgtggatgaggcttccaagaaggagatcaaagacatcctcatccagtatgaccggaccctgctggtagctgatccccgtcgctgcaagtccaaaaagtttggaggtcctggtgcccgtgcttgctaccagaaatcctaccgataagcccatcatgactatcaaaattcacctgtataataaacagtttttgagggattttaaagtttccaggaaaaaaaaagttcattagctttttatgaaggatttatccttttttttcagtgtgctgtttattgctgagaagtggctgccctgccagaaaactgctattctcagctgtaaccacattgactaatagtgagtggaagtgcagtggataaaaagcaaatgtgtcttctctgtatcttttttcatttattggctgaagaacaggaggatgcggaagatggaagaaaatataatctctgaaagataatgaagaagctctcctaaatagaagaaaacctcataggggatttttttttcatcattttactctctgcttctatgcgtttaaattttttttttttttttttgagacagtctcgctctgttgaccaggccagagtgcagcggcatgatcccgactaactgctccctccacctcctgggttcaagcgattctgcctcagccttctgagtagctgggattacaggtgtgtgccaccacgcctgactaatttttgcatttttagttgtggtgcggtttcctcatgttggtgaggctggtctcgagctcctggcctcgtgatttgttcaccttggccttccaaagtgctgggattacgtgcatgagcccctgcacctgatggagtctcattctgtcgctcaagctgaagggcagtgccgtgatcttgacccactgcaacctccgcctccaaggttcaagcaattctagtgcctcagcattccaagtagctgagattacaggtgtgcaccaccaaacccggctaatttttgtatttttagtagaggcaggctttcaccatgttgaccaggctgattagtttgtatatttctttcttcctttccttttttatttctagaagcatgttaattttaaaatataaattat

SEQ ID NO: 204074 - DNA, 491 bp, Homo sapiens
  Payload ID: 20249
  Gene Name: zinc finger protein 90
  ENST ID: ENST00000434475
  CDS Start-End: 47-436
ggttgcagcgccgcgcggtgaggttctctagtccacgctcgcagccatgccgtccaagggcccgctgcaatcggtgcaagtcttcggacgcaagaagacagccacagctgtggcgcactgcagacgcggcaatggtctcatcaagctgctggagccagttctgcttcttggcaaggagcgatttgctggtgtggacatccgtgtccgtgtgaagggtggtgctcatgtggcccagatttatgctatccgtcagtccacctccaaagccctggtggcctattaccagaaatatgtggatgaggcttccaagaaggagatcaaagacatcctcatccagtatgaccggaccctgctggtagctgatccccgtcgctgcaagtccaaaaagtttggaggtcctggtgcccgtgcttgctaccagaaatcctaccgataagcccatcatgactatcaaaattcacctgtataataaacagtttttgagggatttt

SEQ ID NO: 204075 - DNA, 5489 bp, Homo sapiens
  Payload ID: 20250
  Gene Name: zinc finger protein 91
  Uniprot ID: Q05481
  ENST ID: ENST00000300619
  CDS Start-End: 207-3782
atctaatcagggacgctgggctgggaactgtccaatcaggcacaaagctggagcggacagggcggcttccgggatgtggctgggcctttgtctctcgctgccgccggagtttccaggtctcgacttcactgctctgtgtcctctgctccaggaggcccagcctgtgtggccctgtgacctgcaggtattggagagccacagctaagatgccaggaacccctggaagcctagaaatgggactgttgacatttagggatgtggccatagaattctctccggaggagtggcaatgtctggacactgcacagcagaatttatataggaatgtgatgttagagaactacagaaacctggccttcctgggtattgctctctctaagccagacctgattacttatctggagcaaggaaaagagccctggaatatgaagcaacatgagatggtggatgaacccacaggtatatgtcctcattttcctcaagacttttggccagagcagagcatggaagattcttttcaaaaagtattactgagaaaatatgaaaaatgtggacatgagaatttacagttaagaaaaggttgtaaaagtgtggatgagtgtaaggtgcacaaagaaggttataataaacttaaccagtgtctcacaactgcccagagcaaagtatttcaatgtgggaaatatttgaaagtcttctataaatttttaaattcaaacagacatacgataagacatactggaaagaaatgcttcaaatgtaaaaaatgtgtcaagtcattttgcatccgtttacacaaaacccaacataaatgcgtttatattacagagaagtcctgtaaatgtaaagaatgtgaaaaaacctttcattggtcctcaacccttactaatcataaggaaattcatactgaagataaaccctacaaatgtgaagaatgtggcaaagcttttaagcagctctcaacccttactacacataaaataatctgtgctaaagagaaaatctacaagtgtgaagaatgtggcaaagcatttctatggtcctcaaccctaactagacataagaggatacacactggagagaaaccctacaaatgtgaagaatgtggcaaagcttttagccattcttcaacccttgctaaacataagagaattcatactggagagaaaccctacaaatgtgaagaatgtggcaaagcttttagccgttcttcaacccttgctaaacataagagaattcatactggagagaaaccctacaaatgtaaagaatgtggcaaagcttttagcaattcctcaacccttgctaatcataagataactcatactgaagagaaaccctacaaatgtaaagaatgtgacaaagcttttaagcgactctcaacccttactaaacataaaataatacatgctggagagaaactctacaaatgtgaagaatgtggcaaagcttttaatcgatcttcaaatcttactatacataagtttattcatactggagagaaaccttacaagtgtgaagaatgtggcaaagcatttaactggtcctcaagccttactaaacataaaagatttcatactagagagaaacccttcaaatgtaaagaatgtggcaaagcatttatatggtcttcaaccctaactagacataagaggatacacactggagagaagccctacaaatgtgaagaatgtggcaaagcttttaggcaatcctcaacccttactaaacataagataattcatactggagagaaaccctacaaatttgaagaatgtggcaaagcttttagacaatccttaacccttaataaacataagataattcatagtagagagaaaccctacaaatgtaaagaatgtggcaaagcttttaagcaattctcaacccttactacacataaaataattcatgctggaaagaaactctacaaatgtgaagaatgtggcaaagcttttaatcattcctcaagtctttctacacataagataattcatactggagagaagtcttacaagtgtgaagaatgtggcaaagcatttctatggtcctcaaccctaagaagacataagaggatacacactggagagaaaccctacaaatgtgaagaatgtggcaaagcttttagccattcttcagcccttgctaaacataagagaattcatactggagagaaaccctacaaatgtaaagaatgtggcaaagcttttagcaattcctcaacccttgctaatcataagataactcatactgaagagaaaccctacaaatgtaaagaatgtgacaaaacttttaagcgactctcaacccttactaaacataaaataatacatgctggagagaaactctacaaatgtgaagaatgtggcaaagcttttaatcgatcttcaaatcttactatacataagtttattcatactggagagaaaccttacaagtgtgaagaatgtggcaaagcatttaactggtcctcaagccttactaaacataaaagaattcatactagagagaaacccttcaaatgtaaagaatgtggcaaagcatttatatggtcttcaaccctaactagacataagaggatacacactggagagaagccctacaaatgtgaagaatgtggcaaagcttttagccgttcctcaacccttactaagcataagacaattcatactggagagaaaccctacaaatgtaaagaatgtggcaaagcttttaagcactcctcagcccttgctaaacataaaataatacatgctggagagaaactctacaaatgtgaggaatgtggcaaagcttttaatcaatcttcaaatcttacgacacataagataattcatactaaagagaaaccttccaagagtgaagaatgtgacaaagcatttatctggtcctcaacccttactgaacataagagaattcataccagagagaaaacctacaaatgtgaagaatgtggcaaagcatttagccagccttcacaccttactacacataagaggatgcacactggagagaaaccctacaaatgtgaagaatgtggcaaagcttttagccaatcctcaacccttactacacataagataattcatactggagagaaaccctacaaatgtgaagaatgtggcaaagcttttaggaaatcttcaactcttactgaacataagataattcatactggagagaaaccctacaaatgtgaagaatgtggcaaagcatttagccaatcctcaaccctaactagacatacgaggatgcacactggagagaaaccatacaaatgtgaagaatgtggcaaagcttttaatcgatcctcaaagcttactacacataagataattcatactggagagaaaccttacaagtgtgaagaatgtggcaaagcatttatatcatcctcaaccctaaatggacataagagaattcatactagagagaaaccctacaaatgtgaagaatgtggcaaagcatttagccaatcttcaaccctaactagacataagaggttgcacaccggagagaaaccctacaaatgtggagaatgtggcaaagcctttaaagagtcctcagctcttactaaacataagataattcacactggagagaaaccctacaaatgtgaaaaatgtggcaaagcctttaaccagtcttcaatccttactaaccataagaaaattcatactatcacacctgtaatcccactactttgggaggccgaggcgggcggatcacgaggtcaggagatggagaccatcctggctaacacagtgaaaccccttctctactaaaaaatacaaaaaattagccgggcgtggtggcgggcgcctgtagtcccagctatgcgagaggctgaggcaggagaatggcgtgaacccgggaggcggagcttgcagtgagccgagatcacgccactgcactcaagcctgggcgacagagcgagactccgtctcaaaaaaaaaaaaaagaaaattcatactagagagaaaccctacaaatataaagaatgtggcaaatcttttaaccggtcttcaacctttactaaacataaggtaattcatactggagtaaaactctacaaatgtgaagaatgtggcaaatcctttttctggtcctcagccctaaccagacataagaaaattcatactggacagcaaccctacaaacaggaaaaatttggcaaagcctttaaccagttttcacaccttactacagataagataactcatattggagagaaatcttacaagtgtgaataatgtggtaaagtctataaaaagtcctgaattcttaacagacataatattattcatactggagagaaactctacaaacctgaaagatgtgccaacgcttttgacaagtcaaacttttctaaacatcaagaaaatcatgctgctgagaaatcctagaaatgtgaagaatgtgacaaagcctctaaatgattgtcacacttgatcgtaggtaagataattcatactggagaaaactaccagtgtgaacaatgtggccaagctttgaactaatgctcacaccttaatgcataggaaagcatttatgcttgagaaaaagtgaacaaatatagacaaaaagccattaatacctgctcacatcgtactcaaattcagagcgttcatactaaataagaagtgtaattactgtcaaacgactgatcagaaaatatgtctttaaagtacagaagagtattttgaaaaagcattacaaatatgaagaggcattatttatgaccttttctatggaaaggtaaggacattaaaaatgtaagatgcatgatgaaaatttaagtagagaggatctttatggttaacttataatatcgagtgatgcatgaggtagatgttcagattaatattctgcattattatgaaagaaaaacattcttaattttagttaaagtttagtatgatttattgtatttttatgaaatatatgtagcatatttttaaattataaattgcatgtgaacttttcaaccaaacagttttaacatgttaaatactatcatgaattcaatgaagtgttattatgccagtaactttaacctattccaccttactcaagggtgtaggtaaaagatggtaaaaatacactatttggtaagataatggactgacatctctagtgattttttttgccagtgagttttaattgccattaagttaaagaatattgttcccataggctaaatttttatttttattttctcatttaaatgtatttgacttaatttttgtggatacctaatatgtgtacatattatgccatatgtggcatattttgatacggacacacaatatataacaatcgcattagactaaatgcggtctccattacctctagcatttattctttgtattacaaataattcaattctacagttttagttatttttaaatgtacaattaaattgttgttgactacaggattatttttatggtcataataaaacttatatacaaacataagtaaaatccata

SEQ ID NO: 204076 - DNA, 3572 bp, Homo sapiens
  Payload ID: 20250
  Gene Name: zinc finger protein 91
  Uniprot ID: Q05481
  ENST ID: ENST00000397082
  CDS Start-End: 93-3572
aggtctcgacttcactgctctgtgtcctctgctccaggaggcccagcctgtgtggccctgtgacctgcaggtattggagagccacagctaagatgccaggaacccctggaagcctagaaatgggactgttgacatttagggatgtggccatagaattctctccggaggagtggcaatgtctggacactgcacagcagaatttatataggaatgtgatgttagagaactacagaaacctggccttcctgggtatatgtcctcattttcctcaagacttttggccagagcagagcatggaagattcttttcaaaaagtattactgagaaaatatgaaaaatgtggacatgagaatttacagttaagaaaaggttgtaaaagtgtggatgagtgtaaggtgcacaaagaaggttataataaacttaaccagtgtctcacaactgcccagagcaaagtatttcaatgtgggaaatatttgaaagtcttctataaatttttaaattcaaacagacatacgataagacatactggaaagaaatgcttcaaatgtaaaaaatgtgtcaagtcattttgcatccgtttacacaaaacccaacataaatgcgtttatattacagagaagtcctgtaaatgtaaagaatgtgaaaaaacctttcattggtcctcaacccttactaatcataaggaaattcatactgaagataaaccctacaaatgtgaagaatgtggcaaagcttttaagcagctctcaacccttactacacataaaataatctgtgctaaagagaaaatctacaagtgtgaagaatgtggcaaagcatttctatggtcctcaaccctaactagacataagaggatacacactggagagaaaccctacaaatgtgaagaatgtggcaaagcttttagccattcttcaacccttgctaaacataagagaattcatactggagagaaaccctacaaatgtgaagaatgtggcaaagcttttagccgttcttcaacccttgctaaacataagagaattcatactggagagaaaccctacaaatgtaaagaatgtggcaaagcttttagcaattcctcaacccttgctaatcataagataactcatactgaagagaaaccctacaaatgtaaagaatgtgacaaagcttttaagcgactctcaacccttactaaacataaaataatacatgctggagagaaactctacaaatgtgaagaatgtggcaaagcttttaatcgatcttcaaatcttactatacataagtttattcatactggagagaaaccttacaagtgtgaagaatgtggcaaagcatttaactggtcctcaagccttactaaacataaaagatttcatactagagagaaacccttcaaatgtaaagaatgtggcaaagcatttatatggtcttcaaccctaactagacataagaggatacacactggagagaagccctacaaatgtgaagaatgtggcaaagcttttaggcaatcctcaacccttactaaacataagataattcatactggagagaaaccctacaaatttgaagaatgtggcaaagcttttagacaatccttaacccttaataaacataagataattcatagtagagagaaaccctacaaatgtaaagaatgtggcaaagcttttaagcaattctcaacccttactacacataaaataattcatgctggaaagaaactctacaaatgtgaagaatgtggcaaagcttttaatcattcctcaagtctttctacacataagataattcatactggagagaagtcttacaagtgtgaagaatgtggcaaagcatttctatggtcctcaaccctaagaagacataagaggatacacactggagagaaaccctacaaatgtgaagaatgtggcaaagcttttagccattcttcagcccttgctaaacataagagaattcatactggagagaaaccctacaaatgtaaagaatgtggcaaagcttttagcaattcctcaacccttgctaatcataagataactcatactgaagagaaaccctacaaatgtaaagaatgtgacaaaacttttaagcgactctcaacccttactaaacataaaataatacatgctggagagaaactctacaaatgtgaagaatgtggcaaagcttttaatcgatcttcaaatcttactatacataagtttattcatactggagagaaaccttacaagtgtgaagaatgtggcaaagcatttaactggtcctcaagccttactaaacataaaagaattcatactagagagaaacccttcaaatgtaaagaatgtggcaaagcatttatatggtcttcaaccctaactagacataagaggatacacactggagagaagccctacaaatgtgaagaatgtggcaaagcttttagccgttcctcaacccttactaagcataagacaattcatactggagagaaaccctacaaatgtaaagaatgtggcaaagcttttaagcactcctcagcccttgctaaacataaaataatacatgctggagagaaactctacaaatgtgaggaatgtggcaaagcttttaatcaatcttcaaatcttacgacacataagataattcatactaaagagaaaccttccaagagtgaagaatgtgacaaagcatttatctggtcctcaacccttactgaacataagagaattcataccagagagaaaacctacaaatgtgaagaatgtggcaaagcatttagccagccttcacaccttactacacataagaggatgcacactggagagaaaccctacaaatgtgaagaatgtggcaaagcttttagccaatcctcaacccttactacacataagataattcatactggagagaaaccctacaaatgtgaagaatgtggcaaagcttttaggaaatcttcaactcttactgaacataagataattcatactggagagaaaccctacaaatgtgaagaatgtggcaaagcatttagccaatcctcaaccctaactagacatacgaggatgcacactggagagaaaccatacaaatgtgaagaatgtggcaaagcttttaatcgatcctcaaagcttactacacataagataattcatactggagagaaaccttacaagtgtgaagaatgtggcaaagcatttatatcatcctcaaccctaaatggacataagagaattcatactagagagaaaccctacaaatgtgaagaatgtggcaaagcatttagccaatcttcaaccctaactagacataagaggttgcacaccggagagaaaccctacaaatgtggagaatgtggcaaagcctttaaagagtcctcagctcttactaaacataagataattcacactggagagaaaccctacaaatgtgaaaaatgtggcaaagcctttaaccagtcttcaatccttactaaccataagaaaattcatactatcacacctgtaatcccactactttgggaggccgaggcgggcggatcacgaggtcaggagatggagaccatcctggctaacacagtgaaaccccttctctactaa

SEQ ID NO: 204077 - DNA, 662 bp, Homo sapiens
  Payload ID: 20250
  Gene Name: zinc finger protein 91
  ENST ID: ENST00000599743
  CDS Start-End: 104-472
ccggagtttccaggtctcgacttcactgctctgtgtcctctgctccaggaggcccagcctgtgtggccctgtgacctgcaggtattggagagccacagctaagatgccaggaacccctggaagcctagaaatgggactgttgacatttagggatgtggccatagaattctctccggaggagtggcaatgtctggacactgcacagcagaatttatataggaatgtgatgttagagaactacagaaacctggccttcctgggtattgctctctctaagccagacctgattacttatctggagcaaggaaaagagccctggaatatgaagcaacatgagatggtggatgaacccacagacggagtcttgctccatcgccaggctggagtgcagtggcgcgatctcgtcccactgctcactgcaacctctgcctcccctattgaagtgattctcctgtctcagcctcctgagtagctgggactacaggcacacaccaccacgctcagctaatttttgtattttcagaagagacggggtttcatcatattcaccaggctggtcttgatctcttgacctcgtgataccctcacctcaccctcccaaagtgctgggactacaggcgtgagccaccgcacccaaccaaatctatacatttcaatgaagg

SEQ ID NO: 204078 - DNA, 695 bp, Homo sapiens
  Payload ID: 20250
  Gene Name: zinc finger protein 91
  ENST ID: ENST00000595533
  CDS Start-End: 139-695
ctgctccaggaggcccagcctgtgtggccctgtgacctgcaggtattggagagccacagctaagatgccaggaacccctggaagcctagaaatggtatatgtcctcattttcctcaagacttttggccagagcagagcatggaagattcttttcaaaaagtattactgagaaaatatgaaaaatgtggacatgagaatttacagttaagaaaaggttgtaaaagtgtggatgagtgtaaggtgcacaaagaaggttataataaacttaaccagtgtctcacaactgcccagagcaaagtatttcaatgtgggaaatatttgaaagtcttctataaatttttaaattcaaacagacatacgataagacatactggaaagaaatgcttcaaatgtaaaaaatgtgtcaagtcattttgcatccgtttacacaaaacccaacataaatgcgtttatattacagagaagtcctgtaaatgtaaagaatgtgaaaaaacctttcattggtcctcaacccttactaatcataaggaaattcatactgaagataaaccctacaaatgtgaagaatgtggcaaagcttttaagcagctctcaacccttactacacataaaataatctgtgctaaagagaaaatctacaagtgtgaagaatgtggcaaagcatttctatggtcctcaaccctaactagacataa

SEQ ID NO: 204079 - DNA, 3210 bp, Homo sapiens
  Payload ID: 20251
  Gene Name: zinc finger protein 92
  Uniprot ID: Q03936
  ENST ID: ENST00000328747
  CDS Start-End: 200-1960
aatcaggcacgcaactggagcggacagcacagcttccgggatttggcggggcctttgtctctcgctgcagccggcgctccacgtctagtcttcactgctctgcgtcctgtgctgataaaggctcgccgctgtgaccctgttacctgcaagaacttggaggttcacagctaagacgccaggaccccctggaagcctagaaatgggaccactgacatttagggatgtgaaaatagaattctctctagaggaatggcaatgcctggacactgcgcagcggaatttatatagagatgtgatgttagagaactacagaaacctggtcttccttggtattgctgtctctaagccagacctgatcacctggctggagcaaggaaaagagccctggaatctgaagagacatgagatggtagacaaaaccccagttatgtgttctcattttgcccaagatgtttggccagagcacagcataaaagattctttccaaaaagtgatactgagaacatatggaaaatatggacatgagaatttacagctaagaaaagaccataaaagtgtggatgcatgtaaggtgtacaaaggaggttataatggacttaaccagtgtttgacaactactgacagcaagatatttcagtgtgataaatatgtgaaagtctttcataaatttccaaatgtaaatagaaataagataagacatactggaaagaaacctttcaaatgtaaaaaccgtggcaaatcattttgcatgctttcacaattaactcaacataagaaaattcatactagagagtattcttacaaatgtgaagaatgtggtaaagcctttaactggtcctcaacccttactaaacataagataattcatactggagaaaaaccctacaaatgtgaagaatgtggcaaagcttttaaccggtcctcaaatcttactaaacataaaataattcatactggagagaaaccctacaaatgtgaagaatgtggcaaagcttttaaccggtcctcaacccttactaaacataaaagaattcatacagaagagaaaccctacaaatgtgaagaatgtggcaaggcctttaaccagttctcgattcttaataaacataagagaattcatatggaagataaaccctacaaatgtgaagaatgtggcaaagcctttagagtattctcaattcttaaaaaacataagataatccatactggggaaaaaccatacaaatgtgaagaatgtggcaaagcctttaaccagttctcaaaccttactaaacataagataattcatactggagagaaaccctacaaatgtgatgaatgtggcaaagcctttaaccagtcctcaacccttactaaacataaaagaattcatacgggagaaaaaccctacaaatgtgaagaatgtggcaaagcttttaaacagtcctcaacccttactgaacataagataattcatactggagagaaaccctacaaatgtgaaaaatgtggcaaggcctttagctggtcctcagcttttactaaacataagagaaatcatatggaagataaaccctacaaatgtgaagaatgtggcaaagcctttagtgtattctcaacccttactaaacataaaataattcatactagagaaaaaccctacaaatgtgaagaatgtggcaaagcctttaaccagtcctcaatttttactaaacataagataattcacactgaagggaaatcctacaaatgtgaaaaatgtggcaatgcttttaaccagtcctcaaaccttactgcacgtaagataatttatactggagagaaaccctacaaatatgaagaatgtgacaaagcctttaacaagttctcaacccttattacacatcagataatttatactggagagaaaccctgcaaacatgaatgtggcagagcctttaacaaatcctcaaattatactaaagagaaactacaaacctgaaagatgtgacaatgattttcactacacctcaaacttttctaaacataaaccatattggtgccctagaaatgtgaggaatatgacaaggactttaaatggttgtcacgcttgattgtaggtaagataatttatattggagaaaaatcctccaagtatgaagaatgtggcaaacttttaaccaatcctcacaccttattgcacaggaaagcatttatacttgagaaaaattgtataaagaatatggaaaagccatttatatctgctcacatgtaaaaacatcagttcatacttaataaaatgcaattaccgtcaaatctttcagaaaatataagcctttaatacgaggaagagtattcttaagatgaacattacaaatagaaagagggttgtagtacctttagttttatgatagatcttattgtacacattttgtaccagaggaaaaccctaaagcattagttgctcaaactttgttcgacatcagggaatttgtattggagaaaaaccctgcaaatgtaataaatatggaaaaacattttttcaaaaactacagcttggaaaacatcagagagttcatactaaaatatatttttgcagatgcagtaaatatgaaaaatatttaatcccaaattaagtctatgtaaatatcagaattcacagtagaaatcataaggcataaggcactgatacttcagacattacactaaattagagtgttgagtataggagatccaaaactaaaattgttaggtaagttatttatatataactttaaaagaagtagaagattttttggagatttataattacattcaaagtatacttttttcttgaaaaaaattacagattttttgaaaagcaattgatgtaatttaactctcaaattcatgtttttcttcattcctattatattcacatgtgaaagcaagtgatctgttgttgctgaatcagagatatgagagattcttttttataggtgggcattatttatgcccctttctgtggaagagtaagaaaattaaaatacaagatgcatgaggaaaatgtagagatgctctttgtgattaacttagaatattaagtgctacttgaggtacatgttcagactaacattcttttgcagtatagtgagaaaaaaacattttaaaattaattatcattttgttgattgtgcttttatgtaataaaatgcagtactttaaaacatttagattgtgtgtgaacttaattttgtaattaaacattttttt

SEQ ID NO: 204080 - DNA, 3124 bp, Homo sapiens
  Payload ID: 20251
  Gene Name: zinc finger protein 92
  Uniprot ID: Q03936
  ENST ID: ENST00000357512
  CDS Start-End: 200-1864
aatcaggcacgcaactggagcggacagcacagcttccgggatttggcggggcctttgtctctcgctgcagccggcgctccacgtctagtcttcactgctctgcgtcctgtgctgataaaggctcgccgctgtgaccctgttacctgcaagaacttggaggttcacagctaagacgccaggaccccctggaagcctagaaatgggaccactgacatttagggatgtgaaaatagaattctctctagaggaatggcaatgcctggacactgcgcagcggaatttatatagagatgtgatgttagagaactacagaaacctggtcttccttgttatgtgttctcattttgcccaagatgtttggccagagcacagcataaaagattctttccaaaaagtgatactgagaacatatggaaaatatggacatgagaatttacagctaagaaaagaccataaaagtgtggatgcatgtaaggtgtacaaaggaggttataatggacttaaccagtgtttgacaactactgacagcaagatatttcagtgtgataaatatgtgaaagtctttcataaatttccaaatgtaaatagaaataagataagacatactggaaagaaacctttcaaatgtaaaaaccgtggcaaatcattttgcatgctttcacaattaactcaacataagaaaattcatactagagagtattcttacaaatgtgaagaatgtggtaaagcctttaactggtcctcaacccttactaaacataagataattcatactggagaaaaaccctacaaatgtgaagaatgtggcaaagcttttaaccggtcctcaaatcttactaaacataaaataattcatactggagagaaaccctacaaatgtgaagaatgtggcaaagcttttaaccggtcctcaacccttactaaacataaaagaattcatacagaagagaaaccctacaaatgtgaagaatgtggcaaggcctttaaccagttctcgattcttaataaacataagagaattcatatggaagataaaccctacaaatgtgaagaatgtggcaaagcctttagagtattctcaattcttaaaaaacataagataatccatactggggaaaaaccatacaaatgtgaagaatgtggcaaagcctttaaccagttctcaaaccttactaaacataagataattcatactggagagaaaccctacaaatgtgatgaatgtggcaaagcctttaaccagtcctcaacccttactaaacataaaagaattcatacgggagaaaaaccctacaaatgtgaagaatgtggcaaagcttttaaacagtcctcaacccttactgaacataagataattcatactggagagaaaccctacaaatgtgaaaaatgtggcaaggcctttagctggtcctcagcttttactaaacataagagaaatcatatggaagataaaccctacaaatgtgaagaatgtggcaaagcctttagtgtattctcaacccttactaaacataaaataattcatactagagaaaaaccctacaaatgtgaagaatgtggcaaagcctttaaccagtcctcaatttttactaaacataagataattcacactgaagggaaatcctacaaatgtgaaaaatgtggcaatgcttttaaccagtcctcaaaccttactgcacgtaagataatttatactggagagaaaccctacaaatatgaagaatgtgacaaagcctttaacaagttctcaacccttattacacatcagataatttatactggagagaaaccctgcaaacatgaatgtggcagagcctttaacaaatcctcaaattatactaaagagaaactacaaacctgaaagatgtgacaatgattttcactacacctcaaacttttctaaacataaaccatattggtgccctagaaatgtgaggaatatgacaaggactttaaatggttgtcacgcttgattgtaggtaagataatttatattggagaaaaatcctccaagtatgaagaatgtggcaaacttttaaccaatcctcacaccttattgcacaggaaagcatttatacttgagaaaaattgtataaagaatatggaaaagccatttatatctgctcacatgtaaaaacatcagttcatacttaataaaatgcaattaccgtcaaatctttcagaaaatataagcctttaatacgaggaagagtattcttaagatgaacattacaaatagaaagagggttgtagtacctttagttttatgatagatcttattgtacacattttgtaccagaggaaaaccctaaagcattagttgctcaaactttgttcgacatcagggaatttgtattggagaaaaaccctgcaaatgtaataaatatggaaaaacattttttcaaaaactacagcttggaaaacatcagagagttcatactaaaatatatttttgcagatgcagtaaatatgaaaaatatttaatcccaaattaagtctatgtaaatatcagaattcacagtagaaatcataaggcataaggcactgatacttcagacattacactaaattagagtgttgagtataggagatccaaaactaaaattgttaggtaagttatttatatataactttaaaagaagtagaagattttttggagatttataattacattcaaagtatacttttttcttgaaaaaaattacagattttttgaaaagcaattgatgtaatttaactctcaaattcatgtttttcttcattcctattatattcacatgtgaaagcaagtgatctgttgttgctgaatcagagatatgagagattcttttttataggtgggcattatttatgcccctttctgtggaagagtaagaaaattaaaatacaagatgcatgaggaaaatgtagagatgctctttgtgattaacttagaatattaagtgctacttgaggtacatgttcagactaacattcttttgcagtatagtgagaaaaaaacattttaaaattaattatcattttgttgattgtgcttttatgtaataaaatgcagtactttaaaacatttagattgtgtgtgaacttaattttgtaattaaacattttttttagcatgcta

SEQ ID NO: 204081 - DNA, 2957 bp, Homo sapiens
  Payload ID: 20251
  Gene Name: zinc finger protein 92
  Uniprot ID: Q03936
  ENST ID: ENST00000450302
  CDS Start-End: 198-1751
gtctagtcttcactgctctgcgtcctgtgctgataaaggctcgccgctgtgaccctgttacctgcaagaacttggaggttcacagctaagacgccaggaccccctggaagcctagaaatggtattgctgtctctaagccagacctgatcacctggctggagcaaggaaaagagccctggaatctgaagagacatgagatggtagacaaaaccccagttatgtgttctcattttgcccaagatgtttggccagagcacagcataaaagattctttccaaaaagtgatactgagaacatatggaaaatatggacatgagaatttacagctaagaaaagaccataaaagtgtggatgcatgtaaggtgtacaaaggaggttataatggacttaaccagtgtttgacaactactgacagcaagatatttcagtgtgataaatatgtgaaagtctttcataaatttccaaatgtaaatagaaataagataagacatactggaaagaaacctttcaaatgtaaaaaccgtggcaaatcattttgcatgctttcacaattaactcaacataagaaaattcatactagagagtattcttacaaatgtgaagaatgtggtaaagcctttaactggtcctcaacccttactaaacataagataattcatactggagaaaaaccctacaaatgtgaagaatgtggcaaagcttttaaccggtcctcaaatcttactaaacataaaataattcatactggagagaaaccctacaaatgtgaagaatgtggcaaagcttttaaccggtcctcaacccttactaaacataaaagaattcatacagaagagaaaccctacaaatgtgaagaatgtggcaaggcctttaaccagttctcgattcttaataaacataagagaattcatatggaagataaaccctacaaatgtgaagaatgtggcaaagcctttagagtattctcaattcttaaaaaacataagataatccatactggggaaaaaccatacaaatgtgaagaatgtggcaaagcctttaaccagttctcaaaccttactaaacataagataattcatactggagagaaaccctacaaatgtgatgaatgtggcaaagcctttaaccagtcctcaacccttactaaacataaaagaattcatacgggagaaaaaccctacaaatgtgaagaatgtggcaaagcttttaaacagtcctcaacccttactgaacataagataattcatactggagagaaaccctacaaatgtgaaaaatgtggcaaggcctttagctggtcctcagcttttactaaacataagagaaatcatatggaagataaaccctacaaatgtgaagaatgtggcaaagcctttagtgtattctcaacccttactaaacataaaataattcatactagagaaaaaccctacaaatgtgaagaatgtggcaaagcctttaaccagtcctcaatttttactaaacataagataattcacactgaagggaaatcctacaaatgtgaaaaatgtggcaatgcttttaaccagtcctcaaaccttactgcacgtaagataatttatactggagagaaaccctacaaatatgaagaatgtgacaaagcctttaacaagttctcaacccttattacacatcagataatttatactggagagaaaccctgcaaacatgaatgtggcagagcctttaacaaatcctcaaattatactaaagagaaactacaaacctgaaagatgtgacaatgattttcactacacctcaaacttttctaaacataaaccatattggtgccctagaaatgtgaggaatatgacaaggactttaaatggttgtcacgcttgattgtaggtaagataatttatattggagaaaaatcctccaagtatgaagaatgtggcaaacttttaaccaatcctcacaccttattgcacaggaaagcatttatacttgagaaaaattgtataaagaatatggaaaagccatttatatctgctcacatgtaaaaacatcagttcatacttaataaaatgcaattaccgtcaaatctttcagaaaatataagcctttaatacgaggaagagtattcttaagatgaacattacaaatagaaagagggttgtagtacctttagttttatgatagatcttattgtacacattttgtaccagaggaaaaccctaaagcattagttgctcaaactttgttcgacatcagggaatttgtattggagaaaaaccctgcaaatgtaataaatatggaaaaacattttttcaaaaactacagcttggaaaacatcagagagttcatactaaaatatatttttgcagatgcagtaaatatgaaaaatatttaatcccaaattaagtctatgtaaatatcagaattcacagtagaaatcataaggcataaggcactgatacttcagacattacactaaattagagtgttgagtataggagatccaaaactaaaattgttaggtaagttatttatatataactttaaaagaagtagaagattttttggagatttataattacattcaaagtatacttttttcttgaaaaaaattacagattttttgaaaagcaattgatgtaatttaactctcaaattcatgtttttcttcattcctattatattcacatgtgaaagcaagtgatctgttgttgctgaatcagagatatgagagattcttttttataggtgggcattatttatgcccctttctgtggaagagtaagaaaattaaaatacaagatgcatgaggaaaatgtagagatgctctttgtgattaacttagaatattaagtgctacttgaggtacatgttcagactaacattcttttgcagtatagtgagaaaaaaacattttaaaattaattatcattttgttgattgtgcttttatgtaataaaatgcagtactttaaaaca

SEQ ID NO: 204082 - DNA, 2947 bp, Homo sapiens
  Payload ID: 20251
  Gene Name: zinc finger protein 92
  ENST ID: ENST00000431504
  CDS Start-End: 165-1697
atttggcggggcctttgtctctcgctgcagccggcgctccacgtctagtcttcactgctctgcgtcctgtgctgataaaggctcgccgctgtgaccctgttacctgcaagaacttggaggttcacagctaagacgccaggaccccctggaagcctagaaatgttatgtgttctcattttgcccaagatgtttggccagagcacagcataaaagattctttccaaaaagtgatactgagaacatatggaaaatatggacatgagaatttacagctaagaaaagaccataaaagtgtggatgcatgtaaggtgtacaaaggaggttataatggacttaaccagtgtttgacaactactgacagcaagatatttcagtgtgataaatatgtgaaagtctttcataaatttccaaatgtaaatagaaataagataagacatactggaaagaaacctttcaaatgtaaaaaccgtggcaaatcattttgcatgctttcacaattaactcaacataagaaaattcatactagagagtattcttacaaatgtgaagaatgtggtaaagcctttaactggtcctcaacccttactaaacataagataattcatactggagaaaaaccctacaaatgtgaagaatgtggcaaagcttttaaccggtcctcaaatcttactaaacataaaataattcatactggagagaaaccctacaaatgtgaagaatgtggcaaagcttttaaccggtcctcaacccttactaaacataaaagaattcatacagaagagaaaccctacaaatgtgaagaatgtggcaaggcctttaaccagttctcgattcttaataaacataagagaattcatatggaagataaaccctacaaatgtgaagaatgtggcaaagcctttagagtattctcaattcttaaaaaacataagataatccatactggggaaaaaccatacaaatgtgaagaatgtggcaaagcctttaaccagttctcaaaccttactaaacataagataattcatactggagagaaaccctacaaatgtgatgaatgtggcaaagcctttaaccagtcctcaacccttactaaacataaaagaattcatacgggagaaaaaccctacaaatgtgaagaatgtggcaaagcttttaaacagtcctcaacccttactgaacataagataattcatactggagagaaaccctacaaatgtgaaaaatgtggcaaggcctttagctggtcctcagcttttactaaacataagagaaatcatatggaagataaaccctacaaatgtgaagaatgtggcaaagcctttagtgtattctcaacccttactaaacataaaataattcatactagagaaaaaccctacaaatgtgaagaatgtggcaaagcctttaaccagtcctcaatttttactaaacataagataattcacactgaagggaaatcctacaaatgtgaaaaatgtggcaatgcttttaaccagtcctcaaaccttactgcacgtaagataatttatactggagagaaaccctacaaatatgaagaatgtgacaaagcctttaacaagttctcaacccttattacacatcagataatttatactggagagaaaccctgcaaacatgaatgtggcagagcctttaacaaatcctcaaattatactaaagagaaactacaaacctgaaagatgtgacaatgattttcactacacctcaaacttttctaaacataaaccatattggtgccctagaaatgtgaggaatatgacaaggactttaaatggttgtcacgcttgattgtaggtaagataatttatattggagaaaaatcctccaagtatgaagaatgtggcaaacttttaaccaatcctcacaccttattgcacaggaaagcatttatacttgagaaaaattgtataaagaatatggaaaagccatttatatctgctcacatgtaaaaacatcagttcatacttaataaaatgcaattaccgtcaaatctttcagaaaatataagcctttaatacgaggaagagtattcttaagatgaacattacaaatagaaagagggttgtagtacctttagttttatgatagatcttattgtacacattttgtaccagaggaaaaccctaaagcattagttgctcaaactttgttcgacatcagggaatttgtattggagaaaaaccctgcaaatgtaataaatatggaaaaacattttttcaaaaactacagcttggaaaacatcagagagttcatactaaaatatatttttgcagatgcagtaaatatgaaaaatatttaatcccaaattaagtctatgtaaatatcagaattcacagtagaaatcataaggcataaggcactgatacttcagacattacactaaattagagtgttgagtataggagatccaaaactaaaattgttaggtaagttatttatatataactttaaaagaagtagaagattttttggagatttataattacattcaaagtatacttttttcttgaaaaaaattacagattttttgaaaagcaattgatgtaatttaactctcaaattcatgtttttcttcattcctattatattcacatgtgaaagcaagtgatctgttgttgctgaatcagagatatgagagattcttttttataggtgggcattatttatgcccctttctgtggaagagtaagaaaattaaaatacaagatgcatgaggaaaatgtagagatgctctttgtgattaacttagaatattaagtgctacttgaggtacatgttcagactaacattcttttgcagtatagtgagaaaaaaacattttaaaattaattatcattttgttgattgtgcttttatgtaataaaatgcagtactttaaaacatttagattgtgtgtgaacttaattttgtaattaaacattttttt

SEQ ID NO: 204083 - DNA, 2648 bp, Homo sapiens
  Payload ID: 20252
  Gene Name: zinc finger protein 93
  Uniprot ID: P35789
  ENST ID: ENST00000343769
  CDS Start-End: 29-1891
agacaccaggacccctggaagcctagaaatgggaccattgcaatttagagatgtggccatagaattctctctggaggagtggcattgcctggacactgcacagcggaatctatataggaatgtgatgttagagaactacagtaacctggtcttccttggtattgttgtctctaagccagacctgatcgcccatctggagcaaggaaaaaaacctttgactatgaagagacatgagatggtagccaacccctcagttatatgttctcattttgcccaagatctttggccagagcagaacataaaagattctttccaaaaagtgatactgagaagatatgaaaaacgtggacatggaaatttacagttaataaaaaggtgtgaaagtgtagatgagtgtaaggtgcacacaggaggttataatggacttaaccagtgtagtacaactacccagagcaaagtatttcaatgtgataaatatgggaaagtctttcataaattttcaaattcaaatagacataatataagacatactgaaaaaaaacctttcaaatgcatagaatgtggcaaagcttttaaccagttctcaacccttataacacataagaaaattcatactggagagaaaccctacatttgtgaagaatgtggcaaagcctttaagtactcctctgcccttaatacacataagagaattcatactggagagaaaccatacaagtgtgataaatgtgacaaagcctttattgcatcctcaacccttagtaaacatgagatcattcatactggaaagaaaccctacaagtgtgaagaatgtggcaaagcttttaaccaatcctcgacacttactaaacataagaaaattcatactggagagaaaccctacaaatgtgaagaatgtggcaaagcttttaaccaatcctcaacacttactaaacataagaaaattcatactggagagaagccctacgtttgtgaagaatgtggcaaagcctttaagtactcccgtatccttactacacataagagaattcatactggagagaaaccatacaagtgtaataaatgtggcaaagcctttattgcatcctcaacccttagtagacatgagttcattcatatgggaaagaaacattacaaatgtgaagaatgtggcaaagccttcatttggtcctcagtcctaactagacataagagagttcatactggagagaagccctacaaatgtgaagaatgtggcaaagcctttaagtactcctctacccttagttcacataagagaagtcatactggagagaaaccctacaaatgtgaagaatgtggcaaagcctttgttgcatcctcaacccttagtaaacatgagatcattcatactggaaagaaaccctacaagtgtgaagaatgtggcaaagcttttaaccagtcctcatcccttactaaacataagaaaattcatactggagagaaaccctacaaatgtgaagaatgtggcaaagcttttaaccagtcctcttcccttactaaacataagaaaattcatactggagagaaaccctacaaatgtgaagaatgtggcaaagcttttaaccagtcctcaacccttattaaacataagaaaattcatactagagagaaaccctacaaatgtgaagaatgtggcaaagcttttcacctatccacacaccttactacacataagatacttcatactggagagaaaccttatagatgtagagaatgtggcaaagcttttaaccattctgcaaccctttcttcacataagaaaatccattctggagagaaaccatacgagtgtgataaatgtggcaaagcctttatttcaccctcaagccttagtagacatgagataattcatactggggagaaaccctagaagtgtgaagaatgtggcaaagccttcaagtggtcctcacaccttactatacactgagagttctgaacttactctgtaaccatcccaaactcctcccaggcacagtctggcagaggtcctgccatttcggagacctggaggaagtggcccatttacagccatgtaggcaggcctgcagaccttggcctttactacggtacctgaagtggttcaatgactcagtttcagttacctgagccacagcttaaggtcagttctgcctatatagaaacccacacagttaacctgaggaaatgctctctggtactcactgaaagccacactcatccacatcctgatacaaggcccaccatatgcagacctgactgccaaaacatgccctagtgtctgccgtacagagtgaagtcctgaaggatatttagtctgtccaaaactaaaatgaagatttcaactccccaaccccctctaacaagccagctaaaggtggactatagtgcagacccagcaaccttgtgaccaggctaaaacccctcatcactacaaattcagagggcatctcatcaccctaagggcccaacgaaagatctttaccttctaacatcagtttatgaaaacttgaaaaggtgtttgctccatcaaattcagacaccagtacaaaactatattatgcccattgtctggttctattttaatgtagcactggaagtgtgtggcagaagaattagtcaaagaaataaaaatagccattgaaattgaa

SEQ ID NO: 204084 - DNA, 1334 bp, Homo sapiens
  Payload ID: 20252
  Gene Name: zinc finger protein 93
  ENST ID: ENST00000592160
  CDS Start-End: 119-490
ggtctcctcttcactactctgtgtcctgtgctcctacaggcccagcctctgtggccctgtgacctgcaggtattgggagatccacagctaagacaccaggacccctggaagcctagaaatgggaccattgcaatttagagatgtggccatagaattctctctggaggagtggcattgcctggacactgcacagcggaatctatataggaatgtgatgttagagaactacagtaacctggtcttccttggtattgttgtctctaagccagacctgatcgcccatctggagcaaggaaaaaaacctttgactatgaagagacatgagatggtagccaacccctcaggtgcacgcctgttatcccagcactttgggaggccaaggtgggtggatcccgaggtcaggagatcgagaccatctggccaacatggtgaaatcccatctctactaaaatacaaaaaattagccaggcatggtggcccatgcctgtagtacgagctactcaggaggttgaggcaggggaatcactagaacccaggaggcactccagcctgggagacagagtgagactccatctcaaaatatatatatatttccaaatattcagtttggtcttattatattgacattgttatgcaacatatcactagagtgttttttatcttgcaaagctaaatctcagtacacagtaaataactaccaatcctttgtattttgtggttcttttcaaacaccactctgttttctgtttctaagagtataactgctttatatatctcatccaatctctgtctttttgcggctgggtcactttattttgcataatgtcatcaatatttatcttaatagttgttacagtattttctgctttttgaaaactgagtgataattcctgtacttttgtgtctactgaatgatttggtgacacaaatttcgattacttttacctagtggcttgcagtaacaatgctacaataattatgtgaaagttaatgtaatatatttgctgcattctgttttattagtctactttttcacctttatactcataccaaattattttaattctgtagctttttgatgtgttttgaaatcagaaatggtattgcctgtaacattgttcctgtttttgaagattgctgggtactttattgtctgtttggattccatatacttttaaatttgttgtttttatttctttgaaaatgctgtgagtcatttgaaagacattgcattaaatctgtagattaaattgagcagtaaagacatcttcaaaatattgtttttcaattgtttgtttttgagatggagttaaatttacctgccttaccagtta

SEQ ID NO: 204085 - DNA, 570 bp, Homo sapiens
  Payload ID: 20252
  Gene Name: zinc finger protein 93
  ENST ID: ENST00000588146
  CDS Start-End: 209-570
gtctctcggtgcagccggagctccaggtctcctcttcactactctgtgtcctgtgctcctacaggcccagcctctgtggccctgtgacctgcaggtattgggagatccacagctaagacaccaggacccctggaagcctagaaatggtattgttgtctctaagccagacctgatcgcccatctggagcaaggaaaaaaacctttgactatgaagagacatgagatggtagccaacccctcagttatatgttctcattttgcccaagatctttggccagagcagaacataaaagattctttccaaaaagtgatactgagaagatatgaaaaacgtggacatggaaatttacagttaataaaaaggtgtgaaagtgtagatgagtgtaaggtgcacacaggaggttataatggacttaaccagtgtagtacaactacccagagcaaagtatttcaatgtgataaatatgggaaagtctttcataaattttcaaattcaaatagacataatataagacatactgaaaaaaaacctttcaaatgcatagaatgtggcaaagcttttaaccagtt

SEQ ID NO: 204086 - DNA, 590 bp, Homo sapiens
  Payload ID: 20252
  Gene Name: zinc finger protein 93
  ENST ID: ENST00000591366
  CDS Start-End: 162-521
tggtttggcgggtcctttgtctctcggtgcagccggagctccaggtctcctcttcactactctgtgtcctgtgctcctacaggcccagcctctgtggccctgtgacctgcaggtattgggagatccacagctaagacaccaggacccctggaagcctagaaatgggaccattgcaatttagagatgtggccatagaattctctctggaggagtggcattgcctggacactgcacagcggaatctatataggaatgtgatgttagagaactacagtaacctggtcttccttggtattgttgtctctaagccagacctgatcgcccatctggagcaaggaaaaaaacctttgactatgaagagacatgagatggtagccaacccctcagggccaggtgtggttgtggtgctcatgtgtaatcccaggattttgggaggtcaagccaagaggatccctggagcccaaaagtttgagaacagcctgggcaacatatggagacccctctctatgaaaaaaatttaataatagccaggcatggtggtgtgcagctgtggtcccagctacttgggagattgaagggagtcaaaattg

SEQ ID NO: 204087 - DNA, 583 bp, Homo sapiens
  Payload ID: 20252
  Gene Name: zinc finger protein 93
  ENST ID: ENST00000586021
  CDS Start-End: 144-398
gtctctcggtgcagccggagctccaggtctcctcttcactactctgtgtcctgtgctcctacaggcccagcctctgtggccctgtgacctgcaggtattgggagatccacagctaagacaccaggacccctggaagcctagaaatgggaccattgcaatttagagatgtggccatagaattctctctggaggagtggcattgcctggacactgcacagcggaatctatataggaatgtgatgttagagaactacagtaacctggtcttccttggtattgttgtctctaagccagacctgatcgcccatctggagcaaggaaaaaaacctttgactatgaagagacatgagatggtagccaacccctcagatggagtcaatctctgtcatccaggctagcgtgcagtggtgcggtcttggctcactgcaacctccacctccaggttcaagccattctcgtgcctcagtctcccaagtagatgggattacagttatatgttctcattttgcccaagatctttggccagagcagaacataaaagattctttccaaaaagtgatactgagaagatatgaaaaacgtg

SEQ ID NO: 204088 - DNA, 2338 bp, Homo sapiens
  Payload ID: 20253
  Gene Name: zinc finger protein 98
  Uniprot ID: A6NK75
  ENST ID: ENST00000357774
  CDS Start-End: 123-1841
gtctttgtctctcgctgcagccggagttcctggtctcgtcttcgcccttctgtgtcctctgctcgtagaggcccagcctctgtggccctgtgacctgcaggtattgggaatccacagctaagatgccaggaccccttggaagcctagaaatgggagtgttgacatttagggatgtggccttagaattctctctggaggagtggcaatgcctggacaccgcacagcagaatttatataggaatgtgatgttagagaactacagaaacctggtctttgtgggtattgctgcctctaagccagacctgatcacctgtctggagcaaggaaaagaaccttggaatgtgaagagacatgagatggtaactgaacccccagttgtatattcttattttgcccaagacctttggccaaagcagggcaaaaaaaattatttccaaaaagtgatactgagaacatataaaaaatgtggacgtgaaaatttacagttaagaaaatactgtaaaagcatggatgagtgtaaggtgcacaaagaatgttacaatggacttaaccagtgtttgacaactacccagaacaaaatatttcaatatgacaaatatgtgaaagtctttcataaattttcaaattcaaacagacataagataggacatactggaaagaaatctttcaagtgtaaagaatgtgaaaagtcattttgcatgctttcacacttagctcaacataaaagaattcatagtggagagaaaccctacaaatgtaaagaatgtgggaaagcctataatgaggcctcaaacctttctacacataaaagaattcatactggaaagaaaccctacaaatgcgaagagtgtggaaaagcctttaaccggctctcacaccttactacacataagataattcatactggaaagaaaccctacaaatgtgaggagtgtggcaaagcttttaaccaatctgcaaaccttactacacataagagaattcatactggagagaaaccctacaaatgtgaagaatgtggcagagcttttagccagtcctcaacccttactgcacataagataattcatgctggagagaaaccttacaaatgtgaagaatgtggcaaagcttttagccagtcctcaacccttactacacataagataattcatactggagagaaattctacaaatgtgaagaatgtggtaaggcctttagccggttatcccaccttactacacataagagaattcattctggagagaaaccctacaagtgtgaagaatgtggcaaagcttttaaacaatcctcaacccttactacacataagagaattcatgctggagagaaattctacaaatgtgaagtatgtagcaaagcctttagccggttctcacaccttactacacataagagaattcatactggagagaagccctacaaatgtgaagaatgtggcaaagcttttaacctatcatcacaacttactacacataagataattcatactggagagaaaccctacaaatgtgaagaatgtggcaaagcttttaaccagtcctcaactctttctaaacataaggtaattcatactggagagaagccctacaaatgtgaagaatgtggcaaagcttttaaccagtcctcacaccttactacacataagatgattcatactggagagaaaccctacaagtgtgaagaatgcggcaaagcctttaacaactcctctattcttaacagacataagatgattcatactggagagaaactctacaaacctgaaagttgtaacaatgcttgtgacaacattgcaaagatttccaaatataaaagaaattgtgctggtgagaaataatagaaatatgaatgtgacaaagcctttaaatggttatcacactggattgtaggtaaggtaattcattctggagaaaacttctacaagtgtgaacagtgtggcaaaacttacacaatgctcaaaccttattgcacaggaaagcctttatacttgatgagaacaaatgtacaaatataaagaaagtaaaaaagtgattaatatctgcacacatcttattcagcatcagagaatttatacttaatagcattaaaggtgcaattactgtcaaaagagttcagaaaatataagcatttaaagtgctgaagaggatttattttgaagacaaacattacaaatataaacgaagttgtggtaactttacttgtaacacagatcttgttgtattcattctgtattagagcaaaccctgaggcaattgctcaaactttgttcaacatcagagaatttatatcaaagaaaaaccctgtaaatgtaataaatttagaaaaaaacattta

SEQ ID NO: 204089 - DNA, 566 bp, Homo sapiens
  Payload ID: 20253
  Gene Name: zinc finger protein 98
  ENST ID: ENST00000601553
  CDS Start-End: 131-394
gtggcggggtctttgtctctcgctgcagccggagttcctggtctcgtcttcgcccttctgtgtcctctgctcgtagaggcccagcctctgtggccctgtgacctgcaggtattgggaatccacagctaagatgccaggaccccttggaagcctagaaatgggagtgttgacatttagggatgtggccttagaattctctctggaggagtggcaatgcctggacaccgcacagcagaatttatataggaatgtgatgttagagaactacagaaacctggtctttgtgggtattgctgcctctaagccagacctgatcacctgtctggagcaaggaaaagaaccttggaatgtgaagagacatgagatggtaactgaacccccaggtttacagtgacagccaagacagccctcttcatggcacataagagactgtgaaatctgactgctttttcattgtttttgaaaacacatagataatctgcataattttgagaaactctatgttaaactgtttttcaagttctgtttttacatcatgtcctaaatgtgtgagagcagtggtttct

SEQ ID NO: 204090 - DNA, 595 bp, Homo sapiens
  Payload ID: 20253
  Gene Name: zinc finger protein 98
  ENST ID: ENST00000593657
  CDS Start-End: 205-595
gatgtggcggggtctttgtctctcgctgcagccggagttcctggtctcgtcttcgcccttctgtgtcctctgctcgtagaggcccagcctctgtggccctgtgacctgcagggagtgttgacatttagggatgtggccttagaattctctctggaggagtggcaatgcctggacaccgcacagcagaatttatataggaatgtgatgttagagaactacagaaacctggtctttgtgggtattgctgcctctaagccagacctgatcacctgtctggagcaaggaaaagaaccttggaatgtgaagagacatgagatggtaactgaacccccagttgtatattcttattttgcccaagacctttggccaaagcagggcaaaaaaaattatttccaaaaagtgatactgagaacatataaaaaatgtggacgtgaaaatttacagttaagaaaatactgtaaaagcatggatgagtgtaaggtgcacaaagaatgttacaatggacttaaccagtgtttgacaactacccagaacaaaatatttcaatatgacaaatatgtgaaagtctttcataaattttcaaattcaaacagac

SEQ ID NO: 204091 - DNA, 493 bp, Homo sapiens
  Payload ID: 20253
  Gene Name: zinc finger protein 98
  ENST ID: ENST00000593802
  CDS Start-End: 100-493
agtcgcacagttgcgcggtggccgacaggaattgttccccagtggtaagccgcaatctagctgacgtggccccaaccccacattccttcctgccctgcaatgtctgaagaaaccctacagagcaaattggcggctgcaaagaaaaagctgccttggggtgcggtgcaggggtccagagccatgtcggacctgttactgttactactggacctgactctgttactgctgctgatgctgctgggctttgccgggtactcagggcagttggctggggtggcagtgagtgccggctcaccccccatccctacaagttccatgtggagccctatggtgagactgggtggcttctcaccagagctgcagcatctcccccaaactctgctccatcgctgtccactaggacaaccctgcatgggagtgttgacatttagggatgtggccttagaattctctctggaggagtggcaatgcctggacaccgcacagcagaatt

SEQ ID NO: 204092 - DNA, 3114 bp, Homo sapiens
  Payload ID: 20254
  Gene Name: zinc finger protein 99
  ENST ID: ENST00000397104
  CDS Start-End: 1-3114
atgtctttttggtctgaaaaatgtacaagacttattctgtatgatttaaaaatagcactcaaaaatggatcgttgacattttgggatgtgaccatagaattcgctctggaggagtggcaatgcctggacatggctcagcagaatttatataggaatgttatgttagagaactacagaaacctggtcttcctgggtatcgctgtctctaagctagacttgataacttgtctgaagcaagggaaagagccttggaatatgaagagacatgagatggtaactaaacccccagttattagttctcattttacacaagacttttggccagatcagagcataaaagattctttccaagaaataatattgagaacatatgcaagatgtggacataagaatttacgattaagaaaagattgtgaaagtgtcaatgagggtaagatgcacgaagaagcttataataaacttaaccaatgttggacaactacccagggaaaaatatttcagtgtaacaaatatgtgaaagtctttcataaatattcaaattcaaatagatataagataattcatactgggaagaaaccatataaatgtgaagaatgtggcaaagcttttaagcaatcctcacaccttactagacataaagcaattcatactggagagaaaccctacaaatgcgaagaatgtggcaaagcttttaaccatttctcagcccttagaaaacatcagataattcatactggaaagaaaccctacaaatgtgaagaatgtggcaaagcttttagccagtcctcaacccttagaaaacatgagataattcatactgaagagaaaccctacaaatatgaagaatgcggcaaagcttttagcaatttgtcagcccttagaaaacatgagataattcatactggacagaaaccctacaaatgtgaagaatgtggtaaagcttttaagtggtcctcaaaacttactgtacataaggtaattcatactgcagagaaaccctgcaaatgtgaagaatgtggcaaagcttttaagcgtttctcagcccttagaaaacataagataattcatactggaaagcaaccctacaaatgtgaagaatgcagcaaagcttttagcaatttttcagcccttagaaaacatgagataattcatactggagagaaaccctacaaatgtgaagaatgtggtaaagcttttaagtggtcctcaaaacttactgtacataaggtaattcatatggaagagaaaccttgcaaatgtgaagaatgtggcaaagcttttaagcatttctcagcccttagaaaacataagataattcatactggaaagaaaccctacaaatgtgaagaatgtggcaaagcttttaacaattcctcaacccttatgaaacataagataattcatactgggaagaaaccatacaaatgtgaagaatgtggcaaagcttttaagcaatcttcacatcttactagacataaagcaattcatactggggagaaaccctacaaatgtgaagaatgtggcaaagcttttaaccacttctcagcccttagaaaacatcagataattcatactggaaagaaaccctacaaatgtgaagaatgtggcaaagcttttagccagtcctcaacccttagaaaacatgagataattcatactggagagaaaccctacaaatgtgaagaatgtggtaaagcttttaagtggtcctcacaccttactagacataaagtaattcatactgaagagaaaccctacaaatgtgaagaatgtggcaaggcttttaaccatttctcagcccttaggaaacataagataattcatactggaaagaaaccctacaaatgtgaagaatgtggcaaagcttttagccagtcctcaactcttagaaaacatgagataattcatactggagagaaaccctacaaatgtgaagaatgtggtaaagcttttaagtggtcctcaaaacttactgtacataaggtaattcatactgcagagaaaccctgcaaatgtgaagaatgtggcaaagcttttaagcatttctcagcccttagaaaacataagataattcatactggaaagaaaccctataaatgtgaagaatgtggcaaagcttttaacaattcctcaacccttagaaaacatgagataattcatactggagagaaatcctacaaatgtgaagaatgtgcccttagaaaacatgagataattcatactggaaagaaaccctacaaatgtgaagaatgtggcaaagcttttaacaattcctcaacccttaggaaacataagataatttatactgggaagaaaccatacaaatgtgaagaatgtggcaaagcttttaagcagtcctcacaccttactagacataaagcagttcatactggggagaagccctacaaatgtggagaatgtggaaaagcttttaacaattcctcaacccttaagaaacataagctaattcatactagggagaaatcgtacaaatgtgaagaatgtggcaaagcttttagcaatttctcagcccttaggaaacataagataattcatactggggagaaaccatacaaatgtgaagaatgtgaatgtggcaaagcttttaacaattcctcaacccttatgaaacataagataattcatactggggagaaaccgtacaaatgtgaagaatgtggcaaaggttttaacaatttctcgacccttatgaaacataagataattcatactggggagaaaccgtacaaatgtgaagaatgtggcaaagcttttaagcaatcctcacaccttactaaacataaatcaattcatactggagagaaaccctacaaatgtgaagaacgtggcaaagcttttagccatttctcacgccttactaaacataggataattcatactggaaagaaaccctacaaatgtgaagagtgtggagagaaaccctacaaatgtgaagaatgtggcaaagcctttaaccagtcctcacaccttactcaacataaaacaattcatactggagggaaaacctacaaatgtgaagaatgtggcaaagcttttaaccatctttcagcccttactaaacataagataattcatactggggagaagccctaa

SEQ ID NO: 204093 - DNA, 7817 bp, Homo sapiens
  Payload ID: 20254
  Gene Name: zinc finger protein 99
  Uniprot ID: A8MXY4
  ENST ID: ENST00000596209
  CDS Start-End: 92-2686
ctgctctgtgtccttagcctctgtggccctgtgacctgtaggtatttggagatccacagctaggacgccaggaccccctggaagcttagaaatgggatcgttgacattttgggatgtgaccatagaattcgctctggaggagtggcaatgcctggacatggctcagcagaatttatataggaatgttatgttagagaactacagaaacctggtcttcctgggtatcgctgtctctaagctagacttgataacttgtctgaagcaagggaaagagccttggaatatgaagagacatgagatggtaactaaacccccagttattagttctcattttacacaagacttttggccagatcagagcataaaagattctttccaagaaataatattgagaacatatgcaagatgtggacataagaatttacgattaagaaaagattgtgaaagtgtcaatgagggtaagatgcacgaagaagcttataataaacttaaccaatgttggacaactacccagggaaaaatatttcagtgtaacaaatatgtgaaagtctttcataaatattcaaattcaaatagatataagattagacacactaaaaagaaaactttcaaatgtatgaaatgtagcaaatcatttttcatgctttcacacttaattcaacataagagaattcatactagagagaatatctacaaatgtgaagaacgtggcaaagcctttaaatggttctcaacccttattaaacataagataattcatactgaagacaaaccctacaaatataagaaatgtggcaaagcttttaacatctcttcaatgttcactaaatgtaagataattcatactggaaagaaaccctgcaaatgtgaagaatgtggcaaagtttttaacaattcctcaacccttatgaaacataagataattcatactgggaagaaaccatataaatgtgaagaatgtggcaaagcttttaagcaatcctcacaccttactagacataaagcaattcatactggagagaaaccctacaaatgcgaagaatgtggcaaagcttttaaccatttctcagcccttagaaaacatcagataattcatactggaaagaaaccctacaaatgtgaagaatgtggcaaagcttttagccagtcctcaacccttagaaaacatgagataattcatactgaagagaaaccctacaaatatgaagaatgcggcaaagcttttagcaatttgtcagcccttagaaaacatgagataattcatactggacagaaaccctacaaatgtgaagaatgtggtaaagcttttaagtggtcctcaaaacttactgtacataaggtaattcatactgcagagaaaccctgcaaatgtgaagaatgtggcaaagcttttaagcgtttctcagcccttagaaaacataagataattcatactggaaagcaaccctacaaatgtgaagaatgcagcaaagcttttagcaatttttcagcccttagaaaacatgagataattcatactggagagaaaccctacaaatgtgaagaatgtggtaaagcttttaagtggtcctcaaaacttactgtacataaggtaattcatatggaagagaaaccttgcaaatgtgaagaatgtggcaaagcttttaagcatttctcagcccttagaaaacataagataattcatactggaaagaaaccctacaaatgtgaagaatgtggcaaagcttttaacaattcctcaacccttatgaaacataagataattcatactgggaagaaaccatacaaatgtgaagaatgtggcaaagcttttaagcaatcttcacatcttactagacataaagcaattcatactggggagaaaccctacaaatgtgaagaatgtggcaaagcttttaaccacttctcagcccttagaaaacatcagataattcatactggaaagaaaccctacaaatgtgaagaatgtggcaaagcttttagccagtcctcaacccttagaaaacatgagataattcatactggagagaaaccctacaaatgtgaagaatgtggtaaagcttttaagtggtcctcacaccttactagacataaagtaattcatactgaagagaaaccctacaaatgtgaagaatgtggcaaggcttttaaccatttctcagcccttaggaaacataagataattcatactggaaagaaaccctacaaatgtgaagaatgtggcaaagcttttagccagtcctcaactcttagaaaacatgagataattcatactggagagaaaccctacaaatgtgaagaatgtggtaaagcttttaagtggtcctcaaaacttactgtacataaggtaattcatactgcagagaaaccctgcaaatgtgaagaatgtggcaaagcttttaagcatttctcagcccttagaaaacataagataattcatactggaaagaaaccctataaatgtgaagaatgtggcaaagcttttaacaattcctcaacccttagaaaacatgagataattcatactggagagaaatcctacaaatgtgaagaatgtggtaaagcttttcagtggtcctcaaaacttactttacataaggtaattcatatggagagaaaccctgcaaatgtgaagaatgtggcaaagcttttaaacatttctcagcccttagaaaacatgagataattcatactggaaagaaaccctacaaatgtgaagaatgtggcaaagcttttaacaattcctcaacccttaggaaacataagataatttatactgggaagaaaccatacaaatgtgaagaatgtggcaaagcttttaagcagtcctcacaccttactagacataaagcagttcatactggggagaagccctacaaatgtggagaatgtggaaaagcttttaacaattcctcaacccttaagaaacataagctaattcatactagggagaaatcgtacaaatgtgaagaatgtggcaaagcttttagcaatttctcagcccttaggaaacataagataattcatactggggagaaaccatacaaatgtgaagaatgtggtaaagcttttaagtggtctcaaaacttatggaacataaggtaattcatactgtagagaaaccctacaaatgtgaagaatgtggcaaagcttttaagcatttctcagcccttagaaaacatgagataattatactggaaagaaaccctacaaatgtgaagaatgtggcaaagcttttaacaattcctcaacccttatgaaacataagataattcatactggggagaaaccgtacaaatgtgaagaatgtggcaaaggttttaacaatttctcgacccttatgaaacataagataattcatactggggagaaaccgtacaaatgtgaagaatgtggcaaagcttttaagcaatcctcacaccttactaaacataaatcaattcatactggagagaaaccctacaaatgtgaagaacgtggcaaagcttttagccatttctcacgccttactaaacataggataattcatactggaaagaaaccctacaaatgtgaagagtgtggtaaagcatttagtcctcaaaccttactaaacataagataattcattctggagagaaaccctacaaatgtgaagaatgtggcaaagcctttaaccagtcctcacaccttactcaacataaaacaattcatactggagggaaaacctacaaatgtgaagaatgtggcaaagcttttaaccatctttcagcccttactaaacataagataattcatactggggagaagccctaaaaatgtgaagaatgtgtcaaagctttcaaccattttacaaaccttaatacacataagataatttatactagagacagaccctccatatgtgaagaatgtggcaaagcttttaaccagtcctcaagccttaataggcagaaaacaattcatgctggagagaaaccccacaaatgtaaagaatgtggcaaagcctttaaccagtcctcacaccttaaatacacataaaataattgatactggaggaaaaccctacaaatataataaaggtgacaaagcttttaaccattgctcagctgttactcaaaatgagagaattcctaaagaagataaactccacaaatgtgaataatatggcaaagcttttaactggtcctcaaatcttactgaatgtaagataattcatactgaagataaacccttcaaatgtgaggaatgtggcaaagcttttaatcagtcctcaaatcttactgaacataagataattcatagtagagacaaacactgcaaatatgaagaatgggcaaagcttttaaccagtcctcaaactttactcaacataaaataatttatcttggagaggaacactacaaatttaaagaatttggcaaaacttttaactgcttctcaaaacttactgaacataagataattcatactggagagatactttacaaatgtgaagaatgtggcaaagcttctaacgggttctcagatcttactgaatataagataaattagagagaaacccgcctcatgtgaagagtgtggcaaaacttttaactggtcctcaaaccttactgaacataagataattcatactgaagagaaaccctacaaatatgaaaactgtggcaaagcttttaactggttttcagaccttactcaacagaaaatagttgatactgaagacaaactctagaaatgtgaagaatgtggcaatgcttttaatcagttaaactttattagacataagaaaattcgtactggagaaaaaccctacaaatgtgaagaaagtggcaatgcttttagccagtcctcaactcttgctaaacaacataattcaatgggagagaaaccctacaaatgtgaataatgccataagcattcttcaatttttttttttttttttttgaaacagagtttcgccctagttgcccaggctctggagtgcagtggcacaatctcggctcactgcaacctccgcctcctgggttttcaagcgattctcctgcctcagcctcccgagtagcagggactataggcatgtgccaccacgcccacctaattttgtatttttagtagagacggggtttctccatgttggtcaagctggtctcgaactcccgacctctggtgatctgcccgcctcggcctcccaaagtgctgggattaaaggcgtgagccaccgtgcccagcctaattcttcaattcttaataaacaatttatactgaagagaaaccctacaaacgtgaagaatgttgcaaagcttttaacgtcctcaaaccttactgaacataagataattcataatggaaactagccctacaaatatgaagaatgtggcaaacactgtaaccatttctcacatcttaccacacattaagataattcatactgaagagaaacccgacaaatgtgaagaatgtaacaaagtctttaactggtcttcaactcatactaaatataagagaattcatacagaagataaattttataaatatgaagaatgtgacaaaagctttaaaaacatttcaacccttattacacataagataatttatgttgtagagaaattctacaaatgtgaagaatgtggcaaagttttttttttttttttgaaatggagtctcactctgtcgcccaaattggagtgcaatggtgcaatctcagttcattgcaacctccgcctcctgggttcaagcgattctctggcctcaacctcccaagcagctgggattgcaggcgcctgccaccacgcccagctaatttttgtatttttagtagagacggggtttcaccattttgaccaggctggttttgaactcctgacctcaagtgatccacccgccttggcctcccaaagtgccccaaagtgctgggattacaagcatgagccattgagcccggtcgaatgtggcaaagtttttaataagttatcaaatcatactggagagaagctctacaaacctaaaagacatgacagtgctcttgagaacaccttaaacttttctaaacataaaagaaatcatagtgtcaagaagccctagatgtgagtcatgtcacaaagcctttaaatggttgtcacacttgagtataagctaatttatcctagagaaaactatgaagaatgtggcaaaatatttaaccaatactcacaccttatcgcataggaaagcatttatacttgaaaaaaaatgtacacctatgaagaatgtggaaaagccattaatatctgctcacatcttaacatcacagagtttatacttaaaacaaatattaaaaatgcaattactgtgagaatatcttttagaaaatataaaccttagaatggtgaagagtatttcttttgatgacaaacattacaaatataaagacggttgtagtactatatttgtatcacagatcttattgtgcatattttgtgctagagaaaaaccctaaagttgctcaaactttgttcaatatcagggaatgtataatagagaaaaaaacctgcaaatgtaataaatttggaaaaaagtttataaactacagcttagaaaacagagtaagttttttttgtagatgcagtaaatatgaaaaatattcaatccaaaattaactctgtaaatgtcagagaattcacagtagaaatgataaggcactggcacttcagactacactaaatcagagtgttgagtaaaaaaaataatttcaatctaaaatttagataagttatttgcatataacttaaaaaagaggaggtgattttttggagaattataattacatttgaagtatactttttgtatacttcaaatatcaaaaaaattaacatcacaatattgaaaaaaattacagactctgaaaagcaaataaggatgtaattcaactctcaagttacttcatgctcttcattcctactttatttacatgtgaaagcatgcgatcaattgttgctgcatcagagatatgaaagattcttttttattagatgggcattatttatgacctttttcataaaagagaaaggatattaaaatataaaatgcatgataaaaatctaaatggagaggctttttgtggttaacttaaaatattgagtgatgtatgaggtaggtgttctgaggaatatatttttgtgcattatagtgagaaaaacattttaaaattttagttaaaattaaaattaaattagtgatgtattatattagttgtgcttttatgtaatgtagtacattcataaatttttagattatatgtaaacttaattttttaaacattttttgacatgttaagtctgttgtacattcaatgaagtgttattatgccactcgctttaacctatcccaccttactcaagggtgtaggtaagagatggcaacagtttactatttggtaagagtggaataacatctctagtaatctctttttttcagtggctttaacctgcaaataaattaaagaatattgttctcgtaggttacatttttatacttttaatcttatttaaacttctttttttttttgccttgacaaatttaaacttatttttcttaacttttatgggtacatagtgtgtagatatatttctgccatatatagcatattttgataccagcataaaatatgtaataatcacgtcagggtaaatgagggattcttcaccttcaacatttattccttgaattacaagcaatccaaatctacacttttagtcactttgaaatataaaactaaattgttatctttattatagcgtcatttttgtggtcataataaaaatcatataggaatgtaaataaaatctatacatatctgg

SEQ ID NO: 204094 - DNA, 2510 bp, Homo sapiens
  Payload ID: 20255
  Gene Name: zinc finger protein interacting with K protein 1
  ENST ID: ENST00000307468
  CDS Start-End: 98-187
gggttctaagggtcggcggcggcggggttgacggctttgcctaggtccctccgcccgtagctgtcgggtcccggccccgctctgcccacagactccgatggctgcggccgcgctgagggccccgactcaggttgtggccatggaacagaggatgaagagacaccttctgaccagaatgtttctgtaggagtgtcacagtcaaaggcaggttcatccacacagaagactcaatcctgtgagatgtgtgtcccagtcctgaaagatattttgcatctagctgatctccctgggcagaaaccatacttggttggagaatgtacaaaccatcaccagcaccagaagcatcacagtgcaaagaaatccttgaagagggacatggacagagcctcatatgtgaagtgctgcctattctgtatgtcattgaagccctttcgcaaatgggaggttggaaaggaccttccagccatgttgcggcttctgaggtccctggtctttcctggaggcaagaaacccggcacaattactgaatgtggggaggacattcgcagtcaaaaaagtcattacaagtcaggtgaatgtgggaaggcttccaggcacaaacacactcctgtttaccatccaagagtctacactggaaaaaagctttatgagtgtagcaaatgtgggaaagccttccgtggcaagtactcacttgttcagcaccagagagtccatactggagaaaggccttgggagtgcaatgaatgtggaaaattctttagccaaacctcccacctgaatgatcatcggagaatccacaccggagaaaggccttatgagtgcagcgaatgtggaaaattatttagacaaaactccagccttgttgaccaccagaaaatacacactggagcaaggccttatgagtgtagccagtgtgggaaatcctttagccaaaaagccacccttgttaaacaccaaagagttcacactggagaaaggccttataagtgtggtgaatgtgggaattcctttagtcaaagtgccattcttaatcaacaccgaagaattcacactggagcaaagccttatgagtgtggccagtgtgggaaatcctttagtcaaaaagctaccctcattaaacaccagagagttcacactggagaaaggccttataagtgtggtgactgtgggaaatcctttagtcaaagctccatccttattcaacaccggagaattcatactggagcaaggccttatgagtgtggccagtgtggaaagtcctttagccaaaagtctggtctcattcaacaccaagtggttcacactggagaaaggccttatgagtgcaacaaatgtgggaattcctttagccaatgctccagcctcatacatcaccaaaaatgtcataacacatagaggcctcatgaatgcagcaaatgtggaagcgccttcaactcaagatctatcatcatttagctcctgaaagtccacacttaagtagagccttagacctacagggaaagtgctgtctctgtagtattgtagcagtagagagcctttgtgagggagccatctgcctgaagttgaacctcattcttccttgtttctctggtagaaaccatctaccctctaccaccttgcacagtgggcactggtcactcctatgtgctaagacaaggcagacatctgtgtgttctcttaagtctttggaggaaatcttgagcagtctaagcctttagagaaaattcattcttttttctgactgatcacagcatacgtgtgacccagtttgggtcaggagggcccagccttggttctgctggacacttatgtgcaaggattcccttcatgtaaattcttggtctcacatgacacttggtcattcttccagcctccatgtcaccacgtggtgaatggctgcctcacattgctccagtttgtgcactaataaaagccttatatttgaatctacctgtagtcttggggttctgtttactgtgtggggtggctgggagacagacttcaactctatatgaaggaatggatggcttttgtgggcctctgcaggaaagtaagatgacagagtaattctaattctggttttggtcatacttgctttgctacctaaaatctcctaggaaaaaatgcaaggttttggttattctaatttgtggcctggatccctattctttctgtgagactagaggtcatcctgaggagaggccagctgttatgacaagcatgtgtgcttcagggaataggacaattttattccattgtttccagaggatgtcatatgatgcccagtgctgctgagaagcttttcatggggttctataaggaggcatgccctgatatcaaacattccataggccgatgtcacgcagaagacaacgcgagtcacatgtgaactgtaattggtacagaaatacctgggtatttctgtactgtgtgtactgtagcaaactagttggaatgtgcctcttataaaagtacatttacaaatcttcccgtgactgtggctttgagca

SEQ ID NO: 204095 - DNA, 4144 bp, Homo sapiens
  Payload ID: 20255
  Gene Name: zinc finger protein interacting with K protein 1
  ENST ID: ENST00000536878
  CDS Start-End: 218-1642
acttcagtggcggtcatttttgcagcgcttgggtgcatccagaccgtcagagctttgggagcgctttgtttggcgacagtcggaaggcgcgaggggaggggtcctcccgctgaacagtgggggttctaagggtcggcggcggcggggttgacggctttgcctaggtccctccgcccgtagctgtcgggtcccggccccgctctgcccacagactccgatggctgcggccgcgctgagggccccgactcagggctgtgtgacctttgaggacatcgccatttacttctcacaggacgagtggggacttcttgatgaggctcagagactcctgtaccttgaagtgatgctggagaactttgcccttgtagcctcactgggttgtggccatggaacagaggatgaagagacaccttctgaccagaatgtttctgtaggagtgtcacagtcaaaggcaggttcatccacacagaagactcaatcctgtgagatgtgtgtcccagtcctgaaagatattttgcatctagctgatctccctgggcagaaaccatacttggttggagaatgtacaaaccatcaccagcaccagaagcatcacagtgcaaagaaatccttgaagagggacatggacagagcctcatatgtgaagtgctgcctattctgtatgtcattgaagccctttcgcaaatgggaggttggaaaggaccttccagccatgttgcggcttctgaggtccctggtctttcctggaggcaagaaacccggcacaattactgaatgtggggaggacattcgcagtcaaaaaagtcattacaagtcaggtgaatgtgggaaggcttccaggcacaaacacactcctgtttaccatccaagagtctacactggaaaaaagctttatgagtgtagcaaatgtgggaaagccttccgtggcaagtactcacttgttcagcaccagagagtccatactggagaaaggccttgggagtgcaatgaatgtggaaaattctttagccaaacctcccacctgaatgatcatcggagaatccacaccggagaaaggccttatgagtgcagcgaatgtggaaaattatttagacaaaactccagccttgttgaccaccagaaaatacacactggagcaaggccttatgagtgtagccagtgtgggaaatcctttagccaaaaagccacccttgttaaacaccaaagagttcacactggagaaaggccttataagtgtggtgaatgtgggaattcctttagtcaaagtgccattcttaatcaacaccgaagaattcacactggagcaaagccttatgagtgtggccagtgtgggaaatcctttagtcaaaaagctaccctcattaaacaccagagagttcacactggagaaaggccttataagtgtggtgactgtgggaaatcctttagtcaaagctccatccttattcaacaccggagaattcatactggagcaaggccttatgagtgtggccagtgtggaaagtcctttagccaaaagtctggtctcattcaacaccaagtggttcacactggagaaaggccttatgagtgcaacaaatgtgggaattcctttagccaatgctccagcctcatacatcaccaaaaatgtcataacacatagaggcctcatgaatgcagcaaatgtggaagcgccttcaactcaagatctatcatcatttagctcctgaaagtccacacttaagtagagccttagacctacagggaaagtgctgtctctgtagtattgtagcagtagagagcctttgtgagggagccatctgcctgaagttgaacctcattcttccttgtttctctggtagaaaccatctaccctctaccaccttgcacagtgggcactggtcactcctatgtgctaagacaaggcagacatctgtgtgttctcttaagtctttggaggaaatcttgagcagtctaagcctttagagaaaattcattcttttttctgactgatcacagcatacgtgtgacccagtttgggtcaggagggcccagccttggttctgctggacacttatgtgcaaggattcccttcatgtaaattcttggtctcacatgacacttggtcattcttccagcctccatgtcaccacgtggtgaatggctgcctcacattgctccagtttgtgcactaataaaagccttatatttgaatctacctgtagtcttggggttctgtttactgtgtggggtggctgggagacagacttcaactctatatgaaggaatggatggcttttgtgggcctctgcaggaaagtaagatgacagagtaattctaattctggttttggtcatacttgctttgctacctaaaatctcctaggaaaaaatgcaaggttttggttattctaatttgtggcctggatccctattctttctgtgagactagaggtcatcctgaggagaggccagctgttatgacaagcatgtgtgcttcagggaataggacaattttattccattgtttccagaggatgtcatatgatgcccagtgctgctgagaagcttttcatggggttctataaggaggcatgccctgatatcaaacattccataggccgatgtcacgcagaagacaacgcgagtcacatgtgaactgtaattggtacagaaatacctgggtatttctgtactgtgtgtactgtagcaaactagttggaatgtgcctcttataaaagtacatttacaaatcttcccgtgactgtggctttgagcagtcataggacctagaaatctgtgtatgtccaatagctgaggttattttcagcaaaaataattaaagggttttattttttaattcttgttggttttctaggttgttcacctcaagtgcattgctgtagaggcagaaaaaggaggataaagataacagaagtcctataggccagggatgtattgatagctcttgtgatttccaccagtgttgctgttgtctcaaattgccacagccttcattgcttgccaacatttcctgcatggagggactcatggttgcccttccccaggcctgaagagagagtgcagtcaacatgagattgctaggcattctggtttctgaaagttgggtgatcagatactttattgtgaaacatgttttacaaactttcttgatgtgtaagtgacatgccatagtttacatccatttatggtgtataatttgaagagtttgtcatacaagcctgtgaaaccataatcatgatcatgaacatattcatgattcacctcttgctgttttacaatctctgcgtgtactttccaggccttcaggagtcctgtcatttactttccctacaggagaatagtttgtgttttctaggattttatgtgaattgaaacgtaaaatacttactccatttttcctgatgatgcacaattttttttttttttttgagatggagtctcagtctgtcaccaggctggagtgcagtggcatgatcttggctcactccaacctcctcctgggttccagcgattctcctgcctcagcctcctgagaagctaggactacaggcatgcactaccacgcccaactaatttttgtatttttagtagagatgtggttttaccatgtttgccaggatggtcttgatctcttgacctcgtgatccgcccgcctcagcctcccgaagtgctgggattacaggcgtaagccaccacaccagctgatgcacaattacttttaagatttatcaatattgcttatgtgaatagttcatttgtattgctgagaaatagtctgtggatatgtcacaatttggataaacagttggatgctttccagttttgggctgttgcaaataatgctactatgaacataggcatataactcttaatatgcagaaatgctttatttctcctgtgtcagtagtacagtgtacgtgaatgcgtcacttttaaagacaaggccagactataacctaactgtaccatttgcattctcatcaacagtatgtgaaccttcttatttctctacattcttgccatacttggtatggttagtctttttaattttagttgttttaatagctgtataatagcatctgtctgtgattttattgcatttttctggtattttatggtattgaacatttgaacatcttgta

SEQ ID NO: 204096 - DNA, 2860 bp, Homo sapiens
  Payload ID: 20255
  Gene Name: zinc finger protein interacting with K protein 1
  Uniprot ID: Q3SY52
  ENST ID: ENST00000599456
  CDS Start-End: 447-1745
gggttctaagggtcggcggcggcggggttgacggctttgcctaggtccctccgcccgtagctgtcgggtcccggccccgctctgcccacagactccgatggctgcggccgcgctgagggccccgactcaggtgagcgctgcctctactgggcctcaccctccatccccaaattagtgccttcttgggtcactacggtcgagatcctcatgtccagtacagtgggggctcgtgggtggggtccctatttccagaacttgggtgatggggcacggaagagggttacaggcaaagggaccagcgtttctaaactcttggagacacagtgaagaaggttcatacctggagtgccaagggctgtgtgacctttgaggacatcgccatttacttctcacaggacgagtggggacttcttgatgaggctcagagactcctgtaccttgaagtgatgctggagaactttgcccttgtagcctcactgggttgtggccatggaacagaggatgaagagacaccttctgaccagaatgtttctgtaggagtgtcacagtcaaaggcaggttcatccacacagaagactcaatcctgtgagatgtgtgtcccagtcctgaaagatattttgcatctagctgatctccctgggcagaaaccatacttggttggagaatgtacaaaccatcaccagcaccagaagcatcacagtgcaaagaaatccttgaagagggacatggacagagcctcatatgtgaagtgctgcctattctgtatgtcattgaagccctttcgcaaatgggaggttggaaaggaccttccagccatgttgcggcttctgaggtccctggtctttcctggaggcaagaaacccggcacaattactgaatgtggggaggacattcgcagtcaaaaaagtcattacaagtcaggtgaatgtgggaaggcttccaggcacaaacacactcctgtttaccatccaagagtctacactggaaaaaagctttatgagtgtagcaaatgtgggaaagccttccgtggcaagtactcacttgttcagcaccagagagtccatactggagaaaggccttgggagtgcaatgaatgtggaaaattctttagccaaacctcccacctgaatgatcatcggagaatccacaccggagaaaggccttatgagtgcagcgaatgtggaaaattatttagacaaaactccagccttgttgaccaccagaaaatacacactggagcaaggccttatgagtgtagccagtgtgggaaatcctttagccaaaaagccacccttgttaaacaccaaagagttcacactggagaaaggccttataagtgtggtgaatgtgggaattcctttagtcaaagtgccattcttaatcaacaccgaagaattcacactggagcaaagccttatgagtgtggccagtgtgggaaatcctttagtcaaaaagctaccctcattaaacaccagagagttcacactggagaaaggccttataagtgtggtgactgtgggaaatcctttagtcaaagctccatccttattcaacaccggagaattcatactggagcaaggccttatgagtgtggccagtgtggaaagtcctttagccaaaagtctggtctcattcaacaccaagtggttcacactggagaaaggccttatgagtgcaacaaatgtgggaattcctttagccaatgctccagcctcatacatcaccaaaaatgtcataacacatagaggcctcatgaatgcagcaaatgtggaagcgccttcaactcaagatctatcatcatttagctcctgaaagtccacacttaagtagagccttagacctacagggaaagtgctgtctctgtagtattgtagcagtagagagcctttgtgagggagccatctgcctgaagttgaacctcattcttccttgtttctctggtagaaaccatctaccctctaccaccttgcacagtgggcactggtcactcctatgtgctaagacaaggcagacatctgtgtgttctcttaagtctttggaggaaatcttgagcagtctaagcctttagagaaaattcattcttttttctgactgatcacagcatacgtgtgacccagtttgggtcaggagggcccagccttggttctgctggacacttatgtgcaaggattcccttcatgtaaattcttggtctcacatgacacttggtcattcttccagcctccatgtcaccacgtggtgaatggctgcctcacattgctccagtttgtgcactaataaaagccttatatttgaatctacctgtagtcttggggttctgtttactgtgtggggtggctgggagacagacttcaactctatatgaaggaatggatggcttttgtgggcctctgcaggaaagtaagatgacagagtaattctaattctggttttggtcatacttgctttgctacctaaaatctcctaggaaaaaatgcaaggttttggttattctaatttgtggcctggatccctattctttctgtgagactagaggtcatcctgaggagaggccagctgttatgacaagcatgtgtgcttcagggaataggacaattttattccattgtttccagaggatgtcatatgatgcccagtgctgctgagaagcttttcatggggttctataaggaggcatgccctgatatcaaacattccataggccgatgtcacgcagaagacaacgcgagtcacatgtgaactgtaattggtacagaaatacctgggtatttctgtactgtgtgtactgtagcaaactagttggaatgtgcctcttataaaagtacatttacaaatcttcccgtgactgtggctttgagca

SEQ ID NO: 204097 - DNA, 534 bp, Homo sapiens
  Payload ID: 20255
  Gene Name: zinc finger protein interacting with K protein 1
  ENST ID: ENST00000598689
  CDS Start-End: 213-534
agtggcggtcatttttgcagcgcttgggtgcatccagaccgtcagagctttgggagcgctttgtttggcgacagtcggaaggcgcgaggggaggggtcctcccgctgaacagtgggggttctaagggtcggcggcggcggggttgacggctttgcctaggtccctccgcccgtagctgtcgggtcccggccccgctctgcccacagactccgatggctgcggccgcgctgagggccccgactcaggacgagtggggacttcttgatgaggctcagagactcctgtaccttgaagtgatgctggagaactttgcccttgtagcctcactgggttgtggccatggaacagaggatgaagagacaccttctgaccagaatgtttctgtaggagtgtcacagtcaaaggcaggttcatccacacagaagactcaatcctgtgagatgtgtgtcccagtcctgaaagatattttgcatctagctgatctccctgggcagaaaccatacttggttggagaatgtacaaaccatcaccagc

SEQ ID NO: 204098 - DNA, 584 bp, Homo sapiens
  Payload ID: 20255
  Gene Name: zinc finger protein interacting with K protein 1
  ENST ID: ENST00000597219
  CDS Start-End: 493-584
agtggcggtcatttttgcagcgcttgggtgcatccagaccgtcagagctttgggagcgctttgtttggcgacagtcggaaggcgcgaggggaggggtcctcccgctgaacagtgggggttctaagggtcggcggcggcggggttgacggctttgcctaggtccctccgcccgtagctgtcgggtcccggccccgctctgcccacagactccgatggctgcggccgcgctgagggccccgactcaggtgagcgctgcctctactgggcctcaccctccatccccaaattagtgccttcttgggtcactacggtcgagatcctcatgtccagtacagtgggggctcgtgggtggggtccctatttccagaacttgggtgatggggcacggaagagggttacaggcaaagggaccagcgtttctaaactcttggagacacagtgaagaaggttcatacctggagtgccaaggttactgtgtctccagaaacacatatggacctcacaaagggctgtgtgacctttgaggacatcgccatttacttctcacaggacgagtggggacttcttgatgaggctcagagact

SEQ ID NO: 204099 - DNA, 720 bp, Homo sapiens
  Payload ID: 20255
  Gene Name: zinc finger protein interacting with K protein 1
  ENST ID: ENST00000600053
  CDS Start-End: 391-720
gggggcgcggcccccacgtggcctcccgggacacgtgcccacagcgcgacacctaagtcgctcctttcacagaatagccttggccccggcacggcctcgaacgccttgaccccgcaagggaggggcacgaggctcctttgctcccgcaggagcgtcgaatacgtatggaatacgcgtcggtgtggatctggcctcagcttcctgagcctgaatcaatgcttctaatcacgtgggcgctcagccgcgacgggaccacagaaatcgaccagcggcctgtttaaggagcgacaaggcccagccctctcctgcattgtggcgacgccatttccctgcgcccccagcgcggccgcttggcttttgtttgaggttactgtgtctccagaaacacatatggacctcacaaagggctgtgtgacctttgaggacatcgccatttacttctcacaggacgagtggggacttcttgatgaggctcagagactcctgtaccttgaagtgatgctggagaactttgcccttgtagcctcactgggttgtggccatggaacagaggatgaagagacaccttctgaccagaatgtttctgtaggagtgtcacagtcaaaggcaggttcatccacacagaagactcaatcctgtgagatgtgtgtcccagtcctgaaagatattttgcatctagctgatctccctgggcagaaaccatacttggttggagaatgt

SEQ ID NO: 204100 - DNA, 4181 bp, Homo sapiens
  Payload ID: 20255
  Gene Name: zinc finger protein interacting with K protein 1
  Uniprot ID: Q3SY52
  ENST ID: ENST00000597850
  CDS Start-End: 216-1679
ttcagtggcggtcatttttgcagcgcttgggtgcatccagaccgtcagagctttgggagcgctttgtttggcgacagtcggaaggcgcgaggggaggggtcctcccgctgaacagtgggggttctaagggtcggcggcggcggggttgacggctttgcctaggtccctccgcccgtagctgtcgggtcccggccccgctctgcccacagactccgatggctgcggccgcgctgagggccccgactcaggttactgtgtctccagaaacacatatggacctcacaaagggctgtgtgacctttgaggacatcgccatttacttctcacaggacgagtggggacttcttgatgaggctcagagactcctgtaccttgaagtgatgctggagaactttgcccttgtagcctcactgggttgtggccatggaacagaggatgaagagacaccttctgaccagaatgtttctgtaggagtgtcacagtcaaaggcaggttcatccacacagaagactcaatcctgtgagatgtgtgtcccagtcctgaaagatattttgcatctagctgatctccctgggcagaaaccatacttggttggagaatgtacaaaccatcaccagcaccagaagcatcacagtgcaaagaaatccttgaagagggacatggacagagcctcatatgtgaagtgctgcctattctgtatgtcattgaagccctttcgcaaatgggaggttggaaaggaccttccagccatgttgcggcttctgaggtccctggtctttcctggaggcaagaaacccggcacaattactgaatgtggggaggacattcgcagtcaaaaaagtcattacaagtcaggtgaatgtgggaaggcttccaggcacaaacacactcctgtttaccatccaagagtctacactggaaaaaagctttatgagtgtagcaaatgtgggaaagccttccgtggcaagtactcacttgttcagcaccagagagtccatactggagaaaggccttgggagtgcaatgaatgtggaaaattctttagccaaacctcccacctgaatgatcatcggagaatccacaccggagaaaggccttatgagtgcagcgaatgtggaaaattatttagacaaaactccagccttgttgaccaccagaaaatacacactggagcaaggccttatgagtgtagccagtgtgggaaatcctttagccaaaaagccacccttgttaaacaccaaagagttcacactggagaaaggccttataagtgtggtgaatgtgggaattcctttagtcaaagtgccattcttaatcaacaccgaagaattcacactggagcaaagccttatgagtgtggccagtgtgggaaatcctttagtcaaaaagctaccctcattaaacaccagagagttcacactggagaaaggccttataagtgtggtgactgtgggaaatcctttagtcaaagctccatccttattcaacaccggagaattcatactggagcaaggccttatgagtgtggccagtgtggaaagtcctttagccaaaagtctggtctcattcaacaccaagtggttcacactggagaaaggccttatgagtgcaacaaatgtgggaattcctttagccaatgctccagcctcatacatcaccaaaaatgtcataacacatagaggcctcatgaatgcagcaaatgtggaagcgccttcaactcaagatctatcatcatttagctcctgaaagtccacacttaagtagagccttagacctacagggaaagtgctgtctctgtagtattgtagcagtagagagcctttgtgagggagccatctgcctgaagttgaacctcattcttccttgtttctctggtagaaaccatctaccctctaccaccttgcacagtgggcactggtcactcctatgtgctaagacaaggcagacatctgtgtgttctcttaagtctttggaggaaatcttgagcagtctaagcctttagagaaaattcattcttttttctgactgatcacagcatacgtgtgacccagtttgggtcaggagggcccagccttggttctgctggacacttatgtgcaaggattcccttcatgtaaattcttggtctcacatgacacttggtcattcttccagcctccatgtcaccacgtggtgaatggctgcctcacattgctccagtttgtgcactaataaaagccttatatttgaatctacctgtagtcttggggttctgtttactgtgtggggtggctgggagacagacttcaactctatatgaaggaatggatggcttttgtgggcctctgcaggaaagtaagatgacagagtaattctaattctggttttggtcatacttgctttgctacctaaaatctcctaggaaaaaatgcaaggttttggttattctaatttgtggcctggatccctattctttctgtgagactagaggtcatcctgaggagaggccagctgttatgacaagcatgtgtgcttcagggaataggacaattttattccattgtttccagaggatgtcatatgatgcccagtgctgctgagaagcttttcatggggttctataaggaggcatgccctgatatcaaacattccataggccgatgtcacgcagaagacaacgcgagtcacatgtgaactgtaattggtacagaaatacctgggtatttctgtactgtgtgtactgtagcaaactagttggaatgtgcctcttataaaagtacatttacaaatcttcccgtgactgtggctttgagcagtcataggacctagaaatctgtgtatgtccaatagctgaggttattttcagcaaaaataattaaagggttttattttttaattcttgttggttttctaggttgttcacctcaagtgcattgctgtagaggcagaaaaaggaggataaagataacagaagtcctataggccagggatgtattgatagctcttgtgatttccaccagtgttgctgttgtctcaaattgccacagccttcattgcttgccaacatttcctgcatggagggactcatggttgcccttccccaggcctgaagagagagtgcagtcaacatgagattgctaggcattctggtttctgaaagttgggtgatcagatactttattgtgaaacatgttttacaaactttcttgatgtgtaagtgacatgccatagtttacatccatttatggtgtataatttgaagagtttgtcatacaagcctgtgaaaccataatcatgatcatgaacatattcatgattcacctcttgctgttttacaatctctgcgtgtactttccaggccttcaggagtcctgtcatttactttccctacaggagaatagtttgtgttttctaggattttatgtgaattgaaacgtaaaatacttactccatttttcctgatgatgcacaattttttttttttttttgagatggagtctcagtctgtcaccaggctggagtgcagtggcatgatcttggctcactccaacctcctcctgggttccagcgattctcctgcctcagcctcctgagaagctaggactacaggcatgcactaccacgcccaactaatttttgtatttttagtagagatgtggttttaccatgtttgccaggatggtcttgatctcttgacctcgtgatccgcccgcctcagcctcccgaagtgctgggattacaggcgtaagccaccacaccagctgatgcacaattacttttaagatttatcaatattgcttatgtgaatagttcatttgtattgctgagaaatagtctgtggatatgtcacaatttggataaacagttggatgctttccagttttgggctgttgcaaataatgctactatgaacataggcatataactcttaatatgcagaaatgctttatttctcctgtgtcagtagtacagtgtacgtgaatgcgtcacttttaaagacaaggccagactataacctaactgtaccatttgcattctcatcaacagtatgtgaaccttcttatttctctacattcttgccatacttggtatggttagtctttttaattttagttgttttaatagctgtataatagcatctgtctgtgattttattgcatttttctggtattttatggtattgaacatttgaacatcttgta

SEQ ID NO: 204101 - DNA, 5380 bp, Homo sapiens
  Payload ID: 20256
  Gene Name: zinc finger protein, FOG family member 1
  Uniprot ID: Q8IX07
  ENST ID: ENST00000319555
  CDS Start-End: 323-3343
cgccgctcgccgcccgcgggttccattgagaaaagccgagcggccgcggcggcggcggcgagtgcgcgggagcggaggagccggcacccgcccgtcgggcagtccgcgcgcccgcaacgcaggaccgtggcctctcgggcctccgcggcagctccagcggctccggggctgggcgcgcgggctgggggcgcgggccggggcggccgcggagaccgggggccgggggcatgagcggccccgcggccccgccgcgcccccgccgcccgccgccgcccgcccggggctagaggcggccgccgggagggcgcgcggcgccggagacatgtccaggcggaaacagagcaacccccggcagatcaagcgttccctcggagacatggaggccagagaggaggtgcagttggtgggtgccagccacatggagcaaaaggccacggcacctgaagccccgagccctcccagcgcagatgttaactcacccccaccgctgccgccccccacatccccaggaggccccaaggagctggaaggacaggaaccagaacccaggcccacggaggaagagccgggcagtccctggagcgggccagacgagctggagccggtggtgcaggatgggcagaggcgcatacgggcccgactcagcctcgccacgggcctgtcctggggcccgttccatgggagtgtccagaccagagcctcatcccccaggcaggcggagccgagcccagccctgaccctgctgctggtggacgaggcctgctggctgaggacgctgccccaggccctgactgaggccgaggccaacacagagatccacaggaaggatgacgcactctggtgcagggtcaccaagccggtgcctgcggggggactcctgagcgtgctcctcacggccgagccccacagcacccccggccaccctgtgaagaaggagccagcagagcccacgtgcccggcccctgcacacgacctccagctcctgccccagcaggccgggatggcctccatccttgccaccgcagtgatcaacaaagacgtcttcccctgcaaggactgtggcatctggtaccgcagcgagcgcaacctgcaggcgcacctgctctactactgcgccagccgccagggcaccggctccccggccgcagccgccacagacgagaagcccaaagagacctaccccaacgagcgcgtctgccccttcccccagtgccgcaagagctgccccagcgccagctccctggagatccacatgcgcagccacagcggagagcggcccttcgtgtgcctgatctgcctgtcggccttcaccaccaaggccaactgcgagcggcacctcaaggtgcacacggacacgctgagcggtgtctgccacagctgtggcttcatctccaccacaagggacatcctctacagccacttggtcaccaaccacatggtctgccagcctggctccaagggtgagatctactcgccaggggccggacacccagcaaccaagctgcccccagacagtctgggcagcttccagcagcagcacacggccctgcaaggccccctggcctccgcggacctgggcctggcgcccaccccatcgccaggactggacagaaaggccctggccgaggccaccaacggagaggccagagcggagcctctggcccagaatggaggcagcagcgagcccccggcggcccccaggagcatcaaggtggaggcggtggaggagccggaggcggcccccatcctgggccccggagagcctgggccccaggccccgtcgcggacgccgtcgccgcgcagccccgccccggccagggtcaaggccgagctgtccagccccacgccgggctccagcccggtgcccggcgagctgggcctggccggggccctgttccttccgcagtacgtgttcgggcccgacgcggcgccccccgcctcggagatcctggccaagatgtccgagctggtgcacagccggctgcagcagggcgcgggcgcgggcgccggcggcgcgcagaccgggctcttccccggggcccccaagggcgctacgtgcttcgagtgcgagatcaccttcagcaacgtcaacaactactacgtgcacaagcgcctctactgttcaggccgccgtgcgcccgaggacgcgcctgccgcgcgcaggcccaaggcgccccccggcccggcccgcgcgccccccggccagcccgccgaacccgacgcgccgcgctcgtccccgggccccggagcgcgcgaggagggggctgggggcgcggccacgcccgaggacggcgcgggcggccggggcagcgagggcagccagagcccgggtagctccgtggacgacgcggaggacgaccccagccgcacgctgtgcgaggcctgcaacatccgcttcagccgccacgagacctacaccgtgcacaagcggtactactgcgcctcgcgccacgacccgccgccgcgccgaccggccgcgcccccgggaccccctgggccggccgcgcccccggccccctctcccgccgcgcctgtgcgcacgcgcagacgccgcaagctctacgagctgcacgcggccggcgccccgccccccccgccgcccggccacgcccccgcgcccgagtcgccgcggcccggaagcggaagcggaagcggccccggcctcgcccctgcgcgctcgcccggccccgcggccgacggccccatcgacctgagcaagaagccgcggcgcccgctccccggagccccggcaccggcgctggccgactaccacgagtgcacggcctgccgcgtgagcttccacagcctcgaggcctacctggcgcacaagaagtactcgtgccccgctgcgccaccgcccggcgcgctcggcctgcccgccgccgcctgcccctactgccccccgaacggcccggtgcgcggggacctgctggagcatttccgcctggcgcacggcctgctgctcggcgcgcccctggccggcccgggggtcgaggcccggacgccggccgaccgcggcccctcgcccgctcccgcccccgccgcctccccgcagcccgggtcccgtggcccccgggacggcctcggcccggagccccaggagccgccgcccggcccgcccccgtccccggccgccgcgcccgaggccgtgccgcccccgccggcgcccccctcctactcggacaagggcgtccagactcccagcaagggcacgccggcgccgctgcccaacggcaaccaccggtactgccgtctttgcaacatcaagttcagcagcctgtccaccttcatcgcccacaagaagtattactgctcctcgcacgccgccgagcacgtgaagtgagcgcccacactacagccgcagacgctttgcacgccccgctgcgatgcggggagggggccgcccccaggccgcacggactgccgctcctgggaaccccgccacgcacaggcctcggcggagggggccgcagggggcagcgcccgcctggacccttggcacttaataaagaagttcagtttgatgagcatggtggtgggccagcctagttctctgagccagcaggcacacgcagccagtgtcacatccagccctgctgtgtacacaggccactgcggcccggagtggctgggcccctgccggagttacaccactgggtgctaagagctagaccgagcgtcaggtcggaggccacagcacacactgaaccactgcagggccagccgctctgggcctaccccaccccagccctgtccatacccccctagggagagcagcctccacactgctgaccctctccacggtctacttggccgccagacacggaagagaggggcactgacctggctggccatcccccaaccctgcatggtcctgggggtccgatgtcccccatccagtcacagaccaccagggatggcaggggtgggggcgccctggggaggatgaagccctgtggtggccaaggctgggggaagaacaggcgagtaggtggacaggagagggagaccgaggccgaagcattccctggcctcgagggggtcctgatgctcactggtgggtgcatctctccctcagagccagggctgaggacaaccgtgtggtggagtcacctgtggtggctgagtcggtgcaagggtcagggcacccccaccccccgtcttccctgccctgctgggctgtatgggccggccacactgagggagtacttggctgaccgcgttcagccacggtgtcaccgtgccgtttgcagctgggtggctgtgggcagcctccagcgtgctttctcactggagaacaaaaacactcttctattcccaacgtcactttatttttttatttttgggtctcactctcttgcccaggctggagtccctgggatactcacggctcattgcagccttgacctcgtgagctcaagtgatcttcccacctcagtttcctcagtagctggggctacaggtgtacaccaccatgcccagctagtttttgtgttttttgtagaaatggtgtctccctatgttgcccaggctgggcaaccctatattttttagagctaaggtcttgttcggttccccaggctgaagttcagtggcacgatcataagtcactgcagcctcaaactcctgagctgaaaccatcttcctgcctcagcctcccaagtagctgggactacaggcttgacccaccacacctggctaacttttaaaacatttttatagagacagggtcttcctgtgttgcccaagatggtctcaaactcctgacctccagtgctcctgcagcctcagcctcccagaacattaggatgacaggcgcgagctaccattcccagcccatttccaactctacttgaactagctgcatttttttcagctttgcccagcagccctggtgagtgcaggcaaagaaggcagcggcctcttgcctcagaagcccgaggcacttcccagccagtccagggctcgctctcctgcccgcagctcgtgggcctgggtctgcagcgctttcagtggtctctgatgtctttgtccacctgcccactagggtctggccagatggggcccgtagccaaggccaatggacagacatggcttccaccccctcccagggacctgagctccagggaaggcaagcagccttttcctcacagacaccccttctgttgaagaccaggtgatagcggggacgggaggcacggacccctcaagtctgctcatcatttgcattgttgtgcatgaatttgcgtggagggttcaggaggctctgcccccaagtcctccccaggtgcgggcgcagggtacaagatgttctaaaaaatagaaacctggtggggggttgtcactgtgtgtacatttaaaagtaaactgtttaaaggtg

SEQ ID NO: 204102 - DNA, 502 bp, Homo sapiens
  Payload ID: 20256
  Gene Name: zinc finger protein, FOG family member 1
  ENST ID: ENST00000562437
  CDS Start-End: 13-468
ggcgccggagacatgtccaggcggaaacagagcaacccccggcagatcaagcgttccctcggagacatggaggccagagaggaggtgcagttggtgggtgccagccacatggagcaaaaggccacggcacctgaagccccgagccctcccagcgcagatgttaactcacccccaccgctgccgccccccacatccccaggaggccccaaggagctggaaggacaggaaccagaacccaggcccacggaggaagagccgggcagtccctggagcgggccagacgagctggagccggtggtgcaggatgggcagaggcgcatacgggcccgactcagcctcgccacgggcctgtcctggggcccgttccatgggagtgtccagaccagagcctcatcccccaggcaggcggagccgcgaggcgctatctccgccttggcgccgagtgtccagacacaccgtacaagatgattgatttcttcaagatatgcacgcctttccgata

SEQ ID NO: 204103 - DNA, 563 bp, Homo sapiens
  Payload ID: 20256
  Gene Name: zinc finger protein, FOG family member 1
  ENST ID: ENST00000569086
  CDS Start-End: 15-491
gcggcgccggagacatgtccaggcggaaacagagcaacccccggcagatcaagcgttccctcggagacatggaggccagagaggaggtgcagttggtgggtgccagccacatggagcaaaaggccacggcacctgaagccccgagccctcccagcgcagatgttaactcacccccaccgctgccgccccccacatccccaggaggccccaaggagctggaaggacaggaaccagaacccaggcccacggaggaagagccgggcagtccctggagcgggccagacgagctggagccggtggtgcaggatgggcagaggcgcatacgggcccgactcagcctcgccacgggcctgtcctggggcccgttccatgggagtgtccagaccagagcctcatcccccaggcaggcggagccgatgagaaaactgaggctccaagatgttaagtcaattgcccaaatacccaggatcaaacagcagagggagaaatagaacccacatctgcctatccccggagaccctcgcaagctccttaatgaattaaatccttgattaacccttatc

SEQ ID NO: 204104 - DNA, 808 bp, Homo sapiens
  Payload ID: 20256
  Gene Name: zinc finger protein, FOG family member 1
  ENST ID: ENST00000563351
  CDS Start-End: 13-366
ggcgccggagacatgtccaggcggaaacagagcaacccccggcagatcaagcgttccctcggagacatggaggccagagaggaggtgcagttggtgggtgccagccacatggagcaaaaggccacggcacctgaagccccgagccctcccagcgcagacgagctggagccggtggtgcaggatgggcagaggcgcatacgggcccgactcagcctcgccacgggcctgtcctggggcccgttccatgggagtgtccagaccagagcctcatcccccaggcaggcggagccgatgagaaaactgaggctccaagatgttaagtcaattgcccaaatacccaggatcaaacagcagagggagaaatagaacccacatctgcctatccccggagaccctcgcaagctccttaatggtagggctgaggggctggcaccggcccaggagtcatccccacgggctgccctttgccctagctgcagtcacccctccctgtccgcctgcctccgcatttagtcctgctctggcctagggcacaggccatcctggggatacgggcacggggttagaaacgctcccaagtggggagataacgtctgggggcacaaggggagccaaggccagaggagccgctggggctctgtggggagcccggggaggaaggagcccccgctccactcttccctcctctgctttatctcctgcagaattaaatccttgattaacccttatctccccagcgaggcgctatctccgccttggcgccgagtgtccagacacaccgtacaagatgattgatttcttcaagata

SEQ ID NO: 204105 - DNA, 4700 bp, Homo sapiens
  Payload ID: 20257
  Gene Name: zinc finger protein, FOG family member 2
  Uniprot ID: Q8WW38
  ENST ID: ENST00000407775
  CDS Start-End: 251-3706
ctctccccctcccctcctcactgtcacactctctgtgcccccgtctctcttctctcatttgcttgctcatctccgaacgtgaatccgcggctcccggaggagcccagcgcccggagcacctggagtccggccggcggcgggccgagcctggccagcggcggcggcggcggcggcggcggcgggagccgagggagcggcagccgcgaccgcgggcaccgcgggagccccagcggcagcagccgccgccgagatgtcccggcgaaagcaaagcaaaccccggcagatcaaacggccgcttgaagatgccattgaagatgaggaagaagaatgtccatcagaggaaacagacatcatctccaaaggagactttccattggaggaaagcttttccacagaatttgggcctgaaaatctgagctgcgaagaagtggaatacttttgtaacaaaggtgatgatgaaggaatccaggagacagcagaatcagatggggacacacagtcagagaaaccggggcaacctggagttgagacagacgactgggatggaccaggagagctggaggtgtttcagaaagatggggaacgaaaaattcagagtcgacagcaacttccagtgggaacaacctgggggccgtttcctgggaagatggacttgaataataattctttgaagacaaaggctcaggtcccaatggtgctgactgctggtcccaagtggttgctggatgtgacttggcaaggagtggaagacaacaaaaacaactgcattgtgtacagcaaagggggtcagctttggtgtacaactacgaaggccatctctgagggtgaagagctaattgcctttgtggtggattttgactcaaggctacaagctgccagtcagatgactctcacagaagggatgtaccctgcacgcctgctggactcaattcagctgcttcctcagcaagctgccatggcttctattttgcccacagctattgtcaataaggatatattcccttgcaagtcctgtggcatctggtatcggagtgagcggaatctgcaggcccatttgatgtactactgcagtgggaggcaaagagaagctgctccggtgtcagaggaaaatgaagacagtgcccatcagatttccagcctgtgccccttcccacagtgcaccaagagcttttcaaatgctcgagctctagaaatgcacctgaattcacacagtggagtgaaaatggaagaattcctgccccctggtgctagtctaaaatgcaccgtctgtagctacactgctgattccgtgatcaactttcaccaacacctgttctcccatctcactcaagctgccttccgatgtaatcactgccatttcggcttccagactcagagggagttattgcagcaccaggagctccatgtccctagcggcaaacttcccagagaaagtgacatggaacactctccaagtgcaactgaagacagcttacagccagccacagacttattgaccagaagcgaacttccccagagccaaaaggccatgcagactaaagatgcgagctctgacacagagctggacaagtgtgagaaaaagactcagctctttctcacgaaccagagaccagagatacagcctacaacaaataaacaaagcttttcttacacaaaaataaagtctgagccctctagcccaagacttgcctcatctccagttcagcctaatattgggccttctttccctgtgggccctttcctatctcagttttctttcccccaagatatcaccatggtccctcaagcttcagagatcttagctaagatgtctgaactggtgcatcggcgactgaggcatggcagtagtagctaccctcccgtcatttacagccctttgatgcccaagggggctacttgttttgagtgtaacataacattcaataatttggataattatctagtgcacaaaaagcattattgcagcagccgatggcagcagatggctaagtccccagagttccctagtgtgtcagaaaagatgcctgaagctttgagtcccaacactggccaaacctccataaaccttctcaacccagctgctcattctgctgatcctgagaatccacttcttcaaacatcttgcatcaattcttccactgtcttagatttaattgggccaaatgggaagggccatgacaaggacttttccactcaaactaagaagctctccacctccagtaacaatgatgacaaaattaatggaaaacctgttgatgtgaaaaatcccagtgtccccttagtggatggggaaagtgacccaaataagactacctgtgaagcttgcaacattaccttcagccggcacgaaacatacatggtccacaaacagtattactgtgctacacgccacgaccctccactgaagaggtctgcttccaacaaagtgcctgccatgcagagaaccatgcgcacacgcaagcgcagaaagatgtatgagatgtgcctacctgagcaggaacaaaggcctccactggttcagcagagatttcttgacgtagccaacctcaataatccttgtacctccactcaagaacccacagaagggctaggagagtgctaccacccaagatgtgatatctttccaggaattgtctctaaacacttggaaacttctctgacgatcaacaagtgtgttccagtttccaaatgtgatactactcattccagtgtttcctgcctagagatggacgtgcccatagatctcagcaaaaagtgtttatctcagtctgagcggacgaccacgtctcccaaaaggctgctggactatcacgagtgcactgtgtgcaagatcagtttcaataaggtagaaaactatctggcccacaagcagaatttctgcccggttactgcacatcagcgtaatgacctgggtcaactggacggcaaagtgtttccgaatccagaaagcgaacgaaacagccctgatgtcagctacgaaagaagcataataaaatgtgagaaaaatgggaatttgaagcagccttcccccaatggaaacttattttcatcccacctagcaaccctgcaaggcttgaaggtctttagtgaagctgctcagctcattgctacaaaagaagaaaacagacatttgtttcttccacaatgcctttaccctggagcaataaagaaagcaaaaggagccgaccagctttctccatattatggaatcaagccaagtgattatatttctggttctcttgtcatccataacactgacatcgagcaaagcagaaatgcagaaaatgaatctcctaaaggccaggcttcctcaaatgggtgtgctgcgctgaagaaagattctctgccattgttgcccaaaaatcgaggaatggtaatagtgaatggtggactgaaacaagatgagagacctgctgccaacccacagcaagagaacatttcccagaatcctcagcacgaagacgaccacaaatctccctcgtggatctctgagaacccattagctgccaatgagaatgtctcaccaggaattccctcagcagaggaacagttgtctagtatagcaaaaggtgtgaatggttccagccaggctccaaccagtgggaaatattgccggctatgtgatatccagttcaacaacctttcaaactttataactcacaagaagttttattgctcatcacatgcagcagaacatgtcaaatgaactaactaaacatcagtcacctttggtatcagtgtttagtatgttgttctaaccagtccagaaaaaaaaataagctgtttgaattacatctgggcaatcaggagataattcattatggctgagttgaagacttaaggtgtaatttcattacagtccattagtaaagtgtattattggtgccattttcaaaaaaattaatttattttaccagcagtattcatagctgtggttatgttattttttatttaaaaactttatattaaagtcatttgtaatgttattgtatagttattgtgtagcacatatggtttgcactgtatagtagcttttaaagaaaatagtcacaatacagaaaagcattttagaaatagcttcaaaagcacttgtgtatcttgattttttcttatatgctgttgcagatatatgtatatgctaaaatataacttgcaaagatgttctaaatacacatgctataagttcgccttaagatttcaattcttggataatcaggctctgtttgcactttatattttagcagatacagtctcttagtcactaggctttgcatttgtatgtagctgtatgtttccgtccattttcttaatcctgaacctgtatgttaaatgaagatggcaatttttttcttgtatagtacttgtattttctttcgctgatgcagctctgtctcaatttttaaacctttgctgttaaatgcaatactttataaagaatgaacaaaattactggaagcagtattgtaagtaatgaggtagtattaatcagttttatcttttgaaaggcacagtctaaatcgaaaccctaaactcaatgctgcaagtatgaatttaattcatatataagatctatttaaatataagagtagcaatactgcacctggtgatcacaaagataatgttctacttctgatagaaataatttctcaacaaatgttgttactatgcatgtatatggatggaataaaattccagattgt

SEQ ID NO: 204106 - DNA, 594 bp, Homo sapiens
  Payload ID: 20257
  Gene Name: zinc finger protein, FOG family member 2
  ENST ID: ENST00000520027
  CDS Start-End: 517-594
agtgctaatcaaagtgtggtcagtgcacggaccaaagctatcaacatgacttcgaagctggttagcaaagcagaatggtgggatttgcctcagacccactgacacagaatctctgtgtgtggatcctaggatgctgtggagtaagtaacaggttccccagggccgcttgaagatgccattgaagatgaggaagaagaatgtccatcagaggaaacagacatcatctccaaaggagactttccattggaggaaagcttttccacagaatttgggcctgaaaatctgagctgcgaagaagtggaatacttttgtaacaaaggtgatgatgaaggaatccaggagacagcagaatcagatggggacacacagtcagagaaaccggggcaacctggagttgagacagacgactgggatggaccaggagagctggaggtgtttcagaaagatggggaacgaaaaattcagagtcgacagcaacttccagtgggaacaacctgggggccgtttcctgggaagatggacttgaataataattctttgaagacaaaggctcaggtcccaatggtgctgactgctggtcccaagtggttgctg

SEQ ID NO: 204107 - DNA, 3300 bp, Homo sapiens
  Payload ID: 20257
  Gene Name: zinc finger protein, FOG family member 2
  ENST ID: ENST00000517361
  CDS Start-End: 182-3241
agattcttagaagacccttcagagtctgaagtaaagaaagttttgaacctgttttttcattctactgtagggcttctgaaaacaaggagagctggaggtgtttcagaaagatggggaacgaaaaattcagagtcgacagcaacttccagtgggaacaacctgggggccgtttcctgggaagatggacttgaataataattctttgaagacaaaggctcaggtcccaatggtgctgactgctggtcccaagtggttgctggatgtgacttggcaaggagtggaagacaacaaaaacaactgcattgtgtacagcaaagggggtcagctttggtgtacaactacgaaggccatctctgagggtgaagagctaattgcctttgtggtggattttgactcaaggctacaagctgccagtcagatgactctcacagaagggatgtaccctgcacgcctgctggactcaattcagctgcttcctcagcaagctgccatggcttctattttgcccacagctattgtcaataaggatatattcccttgcaagtcctgtggcatctggtatcggagtgagcggaatctgcaggcccatttgatgtactactgcagtgggaggcaaagagaagctgctccggtgtcagaggaaaatgaagacagtgcccatcagatttccagcctgtgccccttcccacagtgcaccaagagcttttcaaatgctcgagctctagaaatgcacctgaattcacacagtggagtgaaaatggaagaattcctgccccctggtgctagtctaaaatgcaccgtctgtagctacactgctgattccgtgatcaactttcaccaacacctgttctcccatctcactcaagctgccttccgatgtaatcactgccatttcggcttccagactcagagggagttattgcagcaccaggagctccatgtccctagcggcaaacttcccagagaaagtgacatggaacactctccaagtgcaactgaagacagcttacagccagccacagacttattgaccagaagcgaacttccccagagccaaaaggccatgcagactaaagatgcgagctctgacacagagctggacaagtgtgagaaaaagactcagctctttctcacgaaccagagaccagagatacagcctacaacaaataaacaaagcttttcttacacaaaaataaagtctgagccctctagcccaagacttgcctcatctccagttcagcctaatattgggccttctttccctgtgggccctttcctatctcagttttctttcccccaagatatcaccatggtccctcaagcttcagagatcttagctaagatgtctgaactggtgcatcggcgactgaggcatggcagtagtagctaccctcccgtcatttacagccctttgatgcccaagggggctacttgttttgagtgtaacataacattcaataatttggataattatctagtgcacaaaaagcattattgcagcagccgatggcagcagatggctaagtccccagagttccctagtgtgtcagaaaagatgcctgaagctttgagtcccaacactggccaaacctccataaaccttctcaacccagctgctcattctgctgatcctgagaatccacttcttcaaacatcttgcatcaattcttccactgtcttagatttaattgggccaaatgggaagggccatgacaaggacttttccactcaaactaagaagctctccacctccagtaacaatgatgacaaaattaatggaaaacctgttgatgtgaaaaatcccagtgtccccttagtggatggggaaagtgacccaaataagactacctgtgaagcttgcaacattaccttcagccggcacgaaacatacatggtccacaaacagtattactgtgctacacgccacgaccctccactgaagaggtctgcttccaacaaagtgcctgccatgcagagaaccatgcgcacacgcaagcgcagaaagatgtatgagatgtgcctacctgagcaggaacaaaggcctccactggttcagcagagatttcttgacgtagccaacctcaataatccttgtacctccactcaagaacccacagaagggctaggagagtgctaccacccaagatgtgatatctttccaggaattgtctctaaacacttggaaacttctctgacgatcaacaagtgtgttccagtttccaaatgtgatactactcattccagtgtttcctgcctagagatggacgtgcccatagatctcagcaaaaagtgtttatctcagtctgagcggacgaccacgtctcccaaaaggctgctggactatcacgagtgcactgtgtgcaagatcagtttcaataaggtagaaaactatctggcccacaagcagaatttctgcccggttactgcacatcagcgtaatgacctgggtcaactggacggcaaagtgtttccgaatccagaaagcgaacgaaacagccctgatgtcagctacgaaagaagcataataaaatgtgagaaaaatgggaatttgaagcagccttcccccaatggaaacttattttcatcccacctagcaaccctgcaaggcttgaaggtctttagtgaagctgctcagctcattgctacaaaagaagaaaacagacatttgtttcttccacaatgcctttaccctggagcaataaagaaagcaaaaggagccgaccagctttctccatattatggaatcaagccaagtgattatatttctggttctcttgtcatccataacactgacatcgagcaaagcagaaatgcagaaaatgaatctcctaaaggccaggcttcctcaaatgggtgtgctgcgctgaagaaagattctctgccattgttgcccaaaaatcgaggaatggtaatagtgaatggtggactgaaacaagatgagagacctgctgccaacccacagcaagagaacatttcccagaatcctcagcacgaagacgaccacaaatctccctcgtggatctctgagaacccattagctgccaatgagaatgtctcaccaggaattccctcagcagaggaacagttgtctagtatagcaaaaggtgtgaatggttccagccaggctccaaccagtgggaaatattgccggctatgtgatatccagttcaacaacctttcaaactttataactcacaagaagttttattgctcatcacatgcagcagaacatgtcaaatgaactaactaaacatcagtcacctttggtatcagtgtttagtatgttgttctaaccagtcc

SEQ ID NO: 204108 - DNA, 3960 bp, Homo sapiens
  Payload ID: 20257
  Gene Name: zinc finger protein, FOG family member 2
  ENST ID: ENST00000520492
  CDS Start-End: 569-3628
gtaaaagttcgcgcctctgcggcgggcggccgtgcgtctctgccctgcgggcgcgggctggtggctggcaggtcgtgtcctgggacttcgggcgggtccggctcacgccgccaggacgctcagccgagcggggattcgggtggtgtctggccctggtggcgcgcggagtcctccctgggaggggccgccagtcacttcccagcgcggaagctggccgcttgaagatgccattgaagatgaggaagaagaatgtccatcagaggaaacagacatcatctccaaaggagactttccattggaggaaagcttttccacagaatttgggcctgaaaatctgagctgcgaagaagtggaatacttttgtaacaaaggtgatgatgaaggaatccaggagacagcagaatcagatggggacacacagtcagagaaaccggggcaacctggagttgagacagacgactgggatggaccaggagagctggaggtgtttcagaaagatggggaacgaaaaattcagagtcgacagcaacttccagtgggaacaacctgggggccgtttcctgggaagatggacttgaataataattctttgaagacaaaggctcaggtcccaatggtgctgactgctggtcccaagtggttgctggatgtgacttggcaaggagtggaagacaacaaaaacaactgcattgtgtacagcaaagggggtcagctttggtgtacaactacgaaggccatctctgagggtgaagagctaattgcctttgtggtggattttgactcaaggctacaagctgccagtcagatgactctcacagaagggatgtaccctgcacgcctgctggactcaattcagctgcttcctcagcaagctgccatggcttctattttgcccacagctattgtcaataaggatatattcccttgcaagtcctgtggcatctggtatcggagtgagcggaatctgcaggcccatttgatgtactactgcagtgggaggcaaagagaagctgctccggtgtcagaggaaaatgaagacagtgcccatcagatttccagcctgtgccccttcccacagtgcaccaagagcttttcaaatgctcgagctctagaaatgcacctgaattcacacagtggagtgaaaatggaagaattcctgccccctggtgctagtctaaaatgcaccgtctgtagctacactgctgattccgtgatcaactttcaccaacacctgttctcccatctcactcaagctgccttccgatgtaatcactgccatttcggcttccagactcagagggagttattgcagcaccaggagctccatgtccctagcggcaaacttcccagagaaagtgacatggaacactctccaagtgcaactgaagacagcttacagccagccacagacttattgaccagaagcgaacttccccagagccaaaaggccatgcagactaaagatgcgagctctgacacagagctggacaagtgtgagaaaaagactcagctctttctcacgaaccagagaccagagatacagcctacaacaaataaacaaagcttttcttacacaaaaataaagtctgagccctctagcccaagacttgcctcatctccagttcagcctaatattgggccttctttccctgtgggccctttcctatctcagttttctttcccccaagatatcaccatggtccctcaagcttcagagatcttagctaagatgtctgaactggtgcatcggcgactgaggcatggcagtagtagctaccctcccgtcatttacagccctttgatgcccaagggggctacttgttttgagtgtaacataacattcaataatttggataattatctagtgcacaaaaagcattattgcagcagccgatggcagcagatggctaagtccccagagttccctagtgtgtcagaaaagatgcctgaagctttgagtcccaacactggccaaacctccataaaccttctcaacccagctgctcattctgctgatcctgagaatccacttcttcaaacatcttgcatcaattcttccactgtcttagatttaattgggccaaatgggaagggccatgacaaggacttttccactcaaactaagaagctctccacctccagtaacaatgatgacaaaattaatggaaaacctgttgatgtgaaaaatcccagtgtccccttagtggatggggaaagtgacccaaataagactacctgtgaagcttgcaacattaccttcagccggcacgaaacatacatggtccacaaacagtattactgtgctacacgccacgaccctccactgaagaggtctgcttccaacaaagtgcctgccatgcagagaaccatgcgcacacgcaagcgcagaaagatgtatgagatgtgcctacctgagcaggaacaaaggcctccactggttcagcagagatttcttgacgtagccaacctcaataatccttgtacctccactcaagaacccacagaagggctaggagagtgctaccacccaagatgtgatatctttccaggaattgtctctaaacacttggaaacttctctgacgatcaacaagtgtgttccagtttccaaatgtgatactactcattccagtgtttcctgcctagagatggacgtgcccatagatctcagcaaaaagtgtttatctcagtctgagcggacgaccacgtctcccaaaaggctgctggactatcacgagtgcactgtgtgcaagatcagtttcaataaggtagaaaactatctggcccacaagcagaatttctgcccggttactgcacatcagcgtaatgacctgggtcaactggacggcaaagtgtttccgaatccagaaagcgaacgaaacagccctgatgtcagctacgaaagaagcataataaaatgtgagaaaaatgggaatttgaagcagccttcccccaatggaaacttattttcatcccacctagcaaccctgcaaggcttgaaggtctttagtgaagctgctcagctcattgctacaaaagaagaaaacagacatttgtttcttccacaatgcctttaccctggagcaataaagaaagcaaaaggagccgaccagctttctccatattatggaatcaagccaagtgattatatttctggttctcttgtcatccataacactgacatcgagcaaagcagaaatgcagaaaatgaatctcctaaaggccaggcttcctcaaatgggtgtgctgcgctgaagaaagattctctgccattgttgcccaaaaatcgaggaatggtaatagtgaatggtggactgaaacaagatgagagacctgctgccaacccacagcaagagaacatttcccagaatcctcagcacgaagacgaccacaaatctccctcgtggatctctgagaacccattagctgccaatgagaatgtctcaccaggaattccctcagcagaggaacagttgtctagtatagcaaaaggtgtgaatggttccagccaggctccaaccagtgggaaatattgccggctatgtgatatccagttcaacaacctttcaaactttataactcacaagaagttttattgctcatcacatgcagcagaacatgtcaaatgaactaactaaacatcagtcacctttggtatcagtgtttagtatgttgttctaaccagtccagaaaaaaaaataagctgtttgaattacatctgggcaatcaggagataattcattatggctgagttgaagacttaaggtgtaatttcattacagtccattagtaaagtgtattattggtgccattttcaaaaaaattaatttattttaccagcagtattcatagctgtggttatgttattttttatttaaaaactttatattaaagtcatttgtaatgttattgtatagttattgtgtagcacatatggtttgcactgtatagtagcttttaa

SEQ ID NO: 204109 - DNA, 2996 bp, Homo sapiens
  Payload ID: 20258
  Gene Name: zinc finger protein, X-linked
  Uniprot ID: P17010
  ENST ID: ENST00000304543
  CDS Start-End: 255-2672
gtccggttcttgctatattgccccaggctggtctcgaactcctgggctcaagccgttctcccgcctcccactgcccgcctgtcactgccgtctgttccctgagctgtgctttacgctgggaaagacatagaagaactattaagaagatagaattgttttgctgcgcagtacagcaacagtggatgttcaagattaagattagagtcaagttgtgtgattaagacaggagctgtgactgatgagaattaaaggccatggatgaagatgggcttgaattacaacaagagccaaactcattttttgatgcaacaggagctgatggtacacacatggatggtgatcaaattgttgtggaagtacaagaaactgtttttgtttcagatgttgtggattcagacataactgtgcataactttgttcctgatgacccagattcagttgtaatccaagatgttattgaggacgttgttatagaagatgttcagtgcccagatatcatggaagaagcagatgtgtctgaaacggtcatcattcctgagcaagtgctggactcagatgtaactgaagaagtttctttagcacattgcacagtcccagatgatgttttagcttctgacattacttcagcctcaatgtctatgccagaacacgtcttgacgggtgattctatacatgtgtctgacgttggacatgttggacatgttggacatgttgaacatgtggttcatgatagtgtagtggaagcagaaattgtcactgatcctctgactaccgacgtagtttcagaagaagtattggtagcagactgtgcctctgaagcagtcatagatgccaatgggatccctgtggaccagcaggatgatgacaaaggcaactgtgaggactaccttatgatttccttggatgatgctggcaaaatagaacacgatggttcttctggaatgaccatggacacagagtcggaaattgatccttgtaaagtggatggcacttgccctgaggtcatcaaggtgtacatttttaaagctgaccctggagaagatgacttaggtggaactgtagacattgtggagagtgagcctgagaatgatcatggagttgaactgcttgatcagaacagcagtattcgtgttcccagggaaaagatggtttatatgactgtcaatgactctcagccagaagatgaagatttaaatgttgctgaaatcgctgacgaagtttatatggaagtgatcgtaggagaggaggatgctgcagcagcagcggcagccgccgccgtgcacgagcagcaaatggatgacaatgaaatcaaaaccttcatgccgattgcatgggcagcagcttatggtaataattctgatggaattgaaaaccggaatggcactgcaagtgccctcttgcacatagatgagtctgctggcctcggcagactggctaaacaaaaaccaaagaaaaggagaagacctgattccaggcagtaccaaacagcaataattattggccctgatggacatcctttgactgtctatccttgcatgatttgtgggaagaagtttaagtcgagaggttttttgaaaaggcacatgaaaaaccatcccgaacaccttgccaagaagaaataccgctgtactgactgtgattacactaccaacaagaagataagtttacacaaccacctggagagccacaagctgaccagcaaggcagagaaggccattgaatgcgatgagtgtgggaagcatttctctcatgcaggggctttgtttactcacaaaatggtgcataaggaaaaaggagccaacaaaatgcacaagtgtaaattctgtgaatacgagacagctgaacaagggttattgaatcgccacctcttggcagtccacagcaagaactttcctcatatttgtgtggagtgtggtaagggttttcgtcacccgtcagagctcaaaaagcacatgagaatccatactggggagaagccgtaccaatgccagtactgcgaatataggtctgcagactcttctaacttgaaaacgcatgtcaaaactaagcatagtaaagagatgccattcaagtgtgacatttgtcttctgactttctcggataccaaagaggtgcagcaacatgctcttatccaccaagaaagcaaaacacaccagtgtttgcattgcgaccacaagagttcgaactcaagtgatttgaaacgacacataatttcagttcacacgaaagactacccccataagtgtgacatgtgtgataaaggctttcacaggccttcagaactcaagaaacacgtggctgcccacaagggcaaaaaaatgcaccagtgtagacattgtgactttaagattgcagatccatttgttctaagtcgccatattctctcagttcacacaaaggatcttccatttaggtgcaagagatgtagaaagggatttaggcaacagagtgagcttaaaaagcatatgaagacacacagtggcaggaaagtgtatcagtgtgagtactgtgagtatagcactacagatgcctcaggctttaaacggcacgttatttccattcacacgaaagactatcctcaccggtgtgagtactgcaagaaaggcttccgaagaccttcagaaaagaaccagcacataatgcgacatcataaagaagttggcctgccctaacaatacttctacagaacgtttgtagagatattggccttgaagcagaaaattcattttaaagccaatcagtctcattcacatacaatactgtatattgatttatgctgtgtacaaatagaattattacttctagttgacttttttttaaatatacattttgctcagtagtgtgttctgaattctattcagtttgtttaataaatagggaaaactggcaacatgctagttacttttaataaagtaatccctgattctataccgaagttttatatcttagaattttatatttatttaaatatttaccttgcttaccttgatggtact

SEQ ID NO: 204110 - DNA, 2906 bp, Homo sapiens
  Payload ID: 20258
  Gene Name: zinc finger protein, X-linked
  ENST ID: ENST00000338565
  CDS Start-End: 29-2296
gagctgtgactgatgagaattaaaggccatggatgaagatgggcttgaattacaacaagagccaaactcattttttgatgcaacaggagctgatggtacacacatggatggtgatcaaattgttgtggaagtacaagaaactgtttttgtttcagatgttgtggattcagacataactgtgcataactttgttcctgatgacccagattcagttgtaatccaagatgttattgaggacgttgttatagaagatgttcagtgcccagatatcatggaagaagcagatgtgtctgaaacggtcatcattcctgagcaagtgctggactcagatgtaactgaagaagtttctttagcacattgcacagtcccagatgatgttttagcttctgacattacttcagcctcaatgtctatgccagaacacgtcttgacgggtgattctatacatgtgtctgacgttggacatgttggacatgttggacatgttgaacatgtggttcatgatagtgtagtggaagcagaaattgtcactgatcctctgactaccgacgtagtttcagaagaagtattggtagcagactgtgcctctgaagcagtcatagatgccaatgggatccctgtggaccagcaggatgatgacaaaggcaactgtgaggactaccttatgatttcctgtggaactgtagacattgtggagagtgagcctgagaatgatcatggagttgaactgcttgatcagaacagcagtattcgtgttcccagggaaaagatggtttatatgactgtcaatgactctcagccagaagatgaagatttaaatgttgctgaaatcgctgacgaagtttatatggaagtgatcgtaggagaggaggatgctgcagcagcagcggcagccgccgccgtgcacgagcagcaaatggatgacaatgaaatcaaaaccttcatgccgattgcatgggcagcagcttatggtaataattctgatggaattgaaaaccggaatggcactgcaagtgccctcttgcacatagatgagtctgctggcctcggcagactggctaaacaaaaaccaaagaaaaggagaagacctgattccaggcagtaccaaacagcaataattattggccctgatggacatcctttgactgtctatccttgcatgatttgtgggaagaagtttaagtcgagaggttttttgaaaaggcacatgaaaaaccatcccgaacaccttgccaagaagaaataccgctgtactgactgtgattacactaccaacaagaagataagtttacacaaccacctggagagccacaagctgaccagcaaggcagagaaggccattgaatgcgatgagtgtgggaagcatttctctcatgcaggggctttgtttactcacaaaatggtgcataaggaaaaaggagccaacaaaatgcacaagtgtaaattctgtgaatacgagacagctgaacaagggttattgaatcgccacctcttggcagtccacagcaagaactttcctcatatttgtgtggagtgtggtaagggttttcgtcacccgtcagagctcaaaaagcacatgagaatccatactggggagaagccgtaccaatgccagtactgcgaatataggtctgcagactcttctaacttgaaaacgcatgtcaaaactaagcatagtaaagagatgccattcaagtgtgacatttgtcttctgactttctcggataccaaagaggtgcagcaacatgctcttatccaccaagaaagcaaaacacaccagtgtttgcattgcgaccacaagagttcgaactcaagtgatttgaaacgacacataatttcagttcacacgaaagactacccccataagtgtgacatgtgtgataaaggctttcacaggccttcagaactcaagaaacacgtggctgcccacaagggcaaaaaaatgcaccagtgtagacattgtgactttaagattgcagatccatttgttctaagtcgccatattctctcagttcacacaaaggatcttccatttaggtgcaagagatgtagaaagggatttaggcaacagagtgagcttaaaaagcatatgaagacacacagtggcaggaaagtgtatcagtgtgagtactgtgagtatagcactacagatgcctcaggctttaaacggcacgttatttccattcacacgaaagactatcctcaccggtgtgagtactgcaagaaaggcttccgaagaccttcagaaaagaaccagcacataatgcgacatcataaagaagttggcctgccctaacaatacttctacagaacgtttgtagagatattggccttgaagcagaaaattcattttaaagccaatcagtctcattcacatacaatactgtatattgatttatgctgtgtacaaatagaattattacttctagttgacttttttttaaatatacattttgctcagtagtgtgttctgaattctattcagtttgtttaataaatagggaaaactggcaacatgctagttacttttaataaagtaatccctgattctataccgaagttttatatcttagaattttatatttatttaaatatttaccttgcttaccttgatggtactcttctaagaccattaacttaaggtaactttatattggtaactctgaaagtattcatgttgactcatttttttccccatacatttctcacaataaaattgtcagagacatctactaatataaatgggagattttacagtcaggtctaattatcataacatggaagtcatttacttgtcttgcttaatattttcagaccacttgacagtgaaagtttccatttgagctgttgcgtccctggctttgctgagtaaagagcagtggctgggttcgtgtttacttttcaaa

SEQ ID NO: 204111 - DNA, 7558 bp, Homo sapiens
  Payload ID: 20258
  Gene Name: zinc finger protein, X-linked
  Uniprot ID: P17010
  ENST ID: ENST00000379177
  CDS Start-End: 428-2845
gccggcctgcagcacccgccaccgtcgccggccgcccgcacgtccgtccggttcttgctatattgccccaggctggtctcgaactcctgggctcaagccgttctcccgcctcccactgcccgcctgtcactgccgtctgttccctgagctgtgctttacgctgggaaagacatagaagaactattaagaagatagaattgttttgctgcgcagtacagcaacagtggatgttcaagattaagattagagtcaagttgtgtgattaagacagacagtcttcctctgtcatccaggctggaatgcagtgcagtggtgcaaatttggctcactgcagcctctgccttctgtgttcaagtgattcttcttctgcctcagcctctcgagtagctgggattacaggagctgtgactgatgagaattaaaggccatggatgaagatgggcttgaattacaacaagagccaaactcattttttgatgcaacaggagctgatggtacacacatggatggtgatcaaattgttgtggaagtacaagaaactgtttttgtttcagatgttgtggattcagacataactgtgcataactttgttcctgatgacccagattcagttgtaatccaagatgttattgaggacgttgttatagaagatgttcagtgcccagatatcatggaagaagcagatgtgtctgaaacggtcatcattcctgagcaagtgctggactcagatgtaactgaagaagtttctttagcacattgcacagtcccagatgatgttttagcttctgacattacttcagcctcaatgtctatgccagaacacgtcttgacgggtgattctatacatgtgtctgacgttggacatgttggacatgttggacatgttgaacatgtggttcatgatagtgtagtggaagcagaaattgtcactgatcctctgactaccgacgtagtttcagaagaagtattggtagcagactgtgcctctgaagcagtcatagatgccaatgggatccctgtggaccagcaggatgatgacaaaggcaactgtgaggactaccttatgatttccttggatgatgctggcaaaatagaacacgatggttcttctggaatgaccatggacacagagtcggaaattgatccttgtaaagtggatggcacttgccctgaggtcatcaaggtgtacatttttaaagctgaccctggagaagatgacttaggtggaactgtagacattgtggagagtgagcctgagaatgatcatggagttgaactgcttgatcagaacagcagtattcgtgttcccagggaaaagatggtttatatgactgtcaatgactctcagccagaagatgaagatttaaatgttgctgaaatcgctgacgaagtttatatggaagtgatcgtaggagaggaggatgctgcagcagcagcggcagccgccgccgtgcacgagcagcaaatggatgacaatgaaatcaaaaccttcatgccgattgcatgggcagcagcttatggtaataattctgatggaattgaaaaccggaatggcactgcaagtgccctcttgcacatagatgagtctgctggcctcggcagactggctaaacaaaaaccaaagaaaaggagaagacctgattccaggcagtaccaaacagcaataattattggccctgatggacatcctttgactgtctatccttgcatgatttgtgggaagaagtttaagtcgagaggttttttgaaaaggcacatgaaaaaccatcccgaacaccttgccaagaagaaataccgctgtactgactgtgattacactaccaacaagaagataagtttacacaaccacctggagagccacaagctgaccagcaaggcagagaaggccattgaatgcgatgagtgtgggaagcatttctctcatgcaggggctttgtttactcacaaaatggtgcataaggaaaaaggagccaacaaaatgcacaagtgtaaattctgtgaatacgagacagctgaacaagggttattgaatcgccacctcttggcagtccacagcaagaactttcctcatatttgtgtggagtgtggtaagggttttcgtcacccgtcagagctcaaaaagcacatgagaatccatactggggagaagccgtaccaatgccagtactgcgaatataggtctgcagactcttctaacttgaaaacgcatgtcaaaactaagcatagtaaagagatgccattcaagtgtgacatttgtcttctgactttctcggataccaaagaggtgcagcaacatgctcttatccaccaagaaagcaaaacacaccagtgtttgcattgcgaccacaagagttcgaactcaagtgatttgaaacgacacataatttcagttcacacgaaagactacccccataagtgtgacatgtgtgataaaggctttcacaggccttcagaactcaagaaacacgtggctgcccacaagggcaaaaaaatgcaccagtgtagacattgtgactttaagattgcagatccatttgttctaagtcgccatattctctcagttcacacaaaggatcttccatttaggtgcaagagatgtagaaagggatttaggcaacagagtgagcttaaaaagcatatgaagacacacagtggcaggaaagtgtatcagtgtgagtactgtgagtatagcactacagatgcctcaggctttaaacggcacgttatttccattcacacgaaagactatcctcaccggtgtgagtactgcaagaaaggcttccgaagaccttcagaaaagaaccagcacataatgcgacatcataaagaagttggcctgccctaacaatacttctacagaacgtttgtagagatattggccttgaagcagaaaattcattttaaagccaatcagtctcattcacatacaatactgtatattgatttatgctgtgtacaaatagaattattacttctagttgacttttttttaaatatacattttgctcagtagtgtgttctgaattctattcagtttgtttaataaatagggaaaactggcaacatgctagttacttttaataaagtaatccctgattctataccgaagttttatatcttagaattttatatttatttaaatatttaccttgcttaccttgatggtactcttctaagaccattaacttaaggtaactttatattggtaactctgaaagtattcatgttgactcatttttttccccatacatttctcacaataaaattgtcagagacatctactaatataaatgggagattttacagtcaggtctaattatcataacatggaagtcatttacttgtcttgcttaatattttcagaccacttgacagtgaaagtttccatttgagctgttgcgtccctggctttgctgagtaaagagcagtggctgggttcgtgtttacttttcaaatatacttcttttggctttctttggattatttacatcttttgtcagcgtagcaaacttttagaaaaccttattgaaaaactgtgcttgctcatgttgtattttgattattctgtctgtgcggcttcatcttggaatggttgtgtgctacaaatgacacttactgaggactgcattttggaatctcctagaggtaactcatggcttataggatcttttgcaactttatgtatgtaaatgtaccctgaattatatatatacacatatatatcatgtacctgtgtgtattgcttattttacatatttatacacacaaccccaagtagtagttgtttaaaatctataatgaaaagtattaaatttacaataacatgaaagatccagggatgcatgagagagcattttgtaagtcatgctcttcagagagactactcaggtgaagaattagaaggaaaataaggacactagtatttttaaagagtaaagatattttcttttaaatatctttggtaattgaaacatagaggttaagatgtttctaggtagaatgttttcatacaatttcacctccatgtctttatgtttttctgaaaagcaaatgagtatccagacatgactcccacagttctctttgagaagcctgagagggaactctgtcttacctagtgagggggatggaaaagaagtgatggctctgtggaccagagaacgggtgctaattatgacttcacactcggcaagttcaggctgatctgttatttctcagttacagttagcaaactttaaaaacttaacactcaagttggctttgattaaaaggtaaagatgtgttttaagtggataaggaaagtctgaggccttatttggaacatcactaagtcttccacaggttttttgtttgtttgtttttttttgttgtttttttttcttaagacggagtcttgctctgttgcccaggctggactgcagtggtgtgatcactgcaacctctgcagctcactgcaacctctgcttcctgggttcaagcaattatctgcctcagcctctcgagtagctgggattacaggcgcccaccaccacgcccggctaattttttgtatttttaatagagatggggtttcaccatcttggccaggctggtcttgaaccctgacctcgtgatccacctgcctcggccttccatagtgctgggtttacaggcgtgagccaccgtgcccagacaccacataggtctgaatcagtgtcatacattcataaaacaaactcggttaattagaacttggttatgttaagacgaatctgggagaacagaaaacagtttttggggtcccttcagttggctattggtccgtatgcatctagcacattgtaggagatttagaaattgtcttcccacccgatagctgccttgtcacctcattatggtgctccatcccctgtgtgcttaggtttttacctttcatctttctctttgccattgatgtttgtattcaagagttatatttttagggttagaaatcaaaatatttggtgtttggcaaacctctgaagtgctagactgatttagtctagttttaaaccaagtgctttaggcaggtgtgaactccagcccaaatgccagtcaaagtcaaggcatgggttttcctagcctatcttataggaaattcctgtaccttcttggcccccataatgtgttttttttttttttttttttttaaactaacttacaattttgtgatccgtgattcattgccctgcgattcttgaaagctctgtctgtttttttgtgagaacctttaaaatctcccttaatttttattttcccagaaataatgtaaaaacacttaaatgaaagtggaaatgtattaattttaaatcctataaaattaatacagaaaatataaatgattgggtcatttaactatatttttttaaataaactgaaagataaagaacacaacacttcacacattttatatttctcttacatactccggaatcatacacagttctttttaaagcacaacattaaaacctttaaaaggtatttaagggtttggtcaagtgaatatgataaaacatacttgtctgtataaagagaaaatgaaattgtagtcactgttatgtactgacattagttacaacctagttttaattcttaaaacaattttgattagcaaagctaaaaaaaaatggatgtttcagttaaatgttttaaagaggtacagatttttacaaggacataatataagttattgttctgtagaaatatcctattaaatattgtatgtccctccctctgtacactttgtaaagaaagtaaaatacataaaaagaaaatcatatagggatgtgtgacattattgtaattgtgtacttgagaataacgtgcaaaaataaaaatcagaatattttcctgttattgaatgtttagtctatttgataccagtactaagttaatgctttttctcaaggaaaaaaaatgtacagtttttgtaaacctaataaacatcaaaagcagtggattattttcatccccccatttcttaatttctttttcacagcagtggaatgcaaagtgcttgattgctttgaattttgtgactcggatgcaaatactggtaatatttcagttctgtgaatttgcaagtaatatttcagagaagttaagaggtgattggtgagtcctttgatgagcatgtccttggaattcattttttcttttatcttcataaaggatttgttttattagcatctccaattcccctgagataaattactcatgcataaagtggtttttgagagcacttaaagttcatttcagtattaatttacagcatatttaatcagtggggactgttaccacctccacaacagaaatcatgccctcgagttaccccactgcgcccagtttagaggactagtagatgctaacatactagggaatggtcattgccacagttaaaaatcggcagttaagtaaatgtcaggagtcaaaagagatagagttgtgccatctttgattttatagacaagattctgcagttcttccaactgtatgaacaaacgtttgcctaatagttgaaacaataaattaaaattttaggtaaatgacgaagggaatgtggtgaatgtcactgtccagagccataaatcagacaaaaccatacatagcatgctgaaaaacttttgtaatggaacacccaacaaatgacacctaacctgtctgtgatccaacaagtccgataacatgctgctgtatttgtattctctgggaatctcagtattaataatttcatttcccacaaattctagcattcatgtaaggaaaaacatggctaatcaatatcttaaaggggcaatctttcagagcagtggttttcaaagtatggccggacagcattggcagcatcttaatctcctgggactttgttaaaaatgcaaattctcagccccaccctagtcctactgaattgggaaactggcgtgggacccagcagtctttgttttaacatgttctccaagtgattctgatgcctgttcaaacttgggaaacacttttagagcacttgaggaacctaaaagatgactggttcagcattttgtgtggtagataagaaagaaattatcacaaaaaatcagaaatgaacagtgagagaaaaataggaccccagacagtttataccttccatttgctgttttaaaagtgtgagcctgccaagtcaacaagtatgcctttagcgcacatgtaaatagcctgcacttcctaaatctcgtgtggcctcccatggttacattcttcaaaggtaaactgagttgagaggaagattcagcatttaaaagagaagggttgaaaaagattgtgtgtgtgtgtgtgtgtgtttaattggcccagggttacttaaataaatcataaccattttgccacattctgtaactgtttagctaaggtcaaattaagtttaccctatggattttgtttcatcttttgtttcgtgtatatactgtttgcctttttcataaaaatcttggatttgttatatattgttcctgttatttttgacatctttgctattgtaaataaattactattttgttttaagtta

SEQ ID NO: 204112 - DNA, 7513 bp, Homo sapiens
  Payload ID: 20258
  Gene Name: zinc finger protein, X-linked
  Uniprot ID: P17010
  ENST ID: ENST00000379188
  CDS Start-End: 100-2634
ggcccagtgctccagagaaaggccggcctgcagcacccgccaccgtcgccggccgcccgcacgtccgtccggagctgtgactgatgagaattaaaggccatggatgaagatgggcttgaattacaacaagagccaaactcattttttgatgcaacagacagggtctcgttctgtcacccaggctggagcacagtggcgccatctgggtccactgcaacctccgcctcccaggctcaagtgatctgctcagcttcccgagtaactggggctacaggagctgatggtacacacatggatggtgatcaaattgttgtggaagtacaagaaactgtttttgtttcagatgttgtggattcagacataactgtgcataactttgttcctgatgacccagattcagttgtaatccaagatgttattgaggacgttgttatagaagatgttcagtgcccagatatcatggaagaagcagatgtgtctgaaacggtcatcattcctgagcaagtgctggactcagatgtaactgaagaagtttctttagcacattgcacagtcccagatgatgttttagcttctgacattacttcagcctcaatgtctatgccagaacacgtcttgacgggtgattctatacatgtgtctgacgttggacatgttggacatgttggacatgttgaacatgtggttcatgatagtgtagtggaagcagaaattgtcactgatcctctgactaccgacgtagtttcagaagaagtattggtagcagactgtgcctctgaagcagtcatagatgccaatgggatccctgtggaccagcaggatgatgacaaaggcaactgtgaggactaccttatgatttccttggatgatgctggcaaaatagaacacgatggttcttctggaatgaccatggacacagagtcggaaattgatccttgtaaagtggatggcacttgccctgaggtcatcaaggtgtacatttttaaagctgaccctggagaagatgacttaggtggaactgtagacattgtggagagtgagcctgagaatgatcatggagttgaactgcttgatcagaacagcagtattcgtgttcccagggaaaagatggtttatatgactgtcaatgactctcagccagaagatgaagatttaaatgttgctgaaatcgctgacgaagtttatatggaagtgatcgtaggagaggaggatgctgcagcagcagcggcagccgccgccgtgcacgagcagcaaatggatgacaatgaaatcaaaaccttcatgccgattgcatgggcagcagcttatggtaataattctgatggaattgaaaaccggaatggcactgcaagtgccctcttgcacatagatgagtctgctggcctcggcagactggctaaacaaaaaccaaagaaaaggagaagacctgattccaggcagtaccaaacagcaataattattggccctgatggacatcctttgactgtctatccttgcatgatttgtgggaagaagtttaagtcgagaggttttttgaaaaggcacatgaaaaaccatcccgaacaccttgccaagaagaaataccgctgtactgactgtgattacactaccaacaagaagataagtttacacaaccacctggagagccacaagctgaccagcaaggcagagaaggccattgaatgcgatgagtgtgggaagcatttctctcatgcaggggctttgtttactcacaaaatggtgcataaggaaaaaggagccaacaaaatgcacaagtgtaaattctgtgaatacgagacagctgaacaagggttattgaatcgccacctcttggcagtccacagcaagaactttcctcatatttgtgtggagtgtggtaagggttttcgtcacccgtcagagctcaaaaagcacatgagaatccatactggggagaagccgtaccaatgccagtactgcgaatataggtctgcagactcttctaacttgaaaacgcatgtcaaaactaagcatagtaaagagatgccattcaagtgtgacatttgtcttctgactttctcggataccaaagaggtgcagcaacatgctcttatccaccaagaaagcaaaacacaccagtgtttgcattgcgaccacaagagttcgaactcaagtgatttgaaacgacacataatttcagttcacacgaaagactacccccataagtgtgacatgtgtgataaaggctttcacaggccttcagaactcaagaaacacgtggctgcccacaagggcaaaaaaatgcaccagtgtagacattgtgactttaagattgcagatccatttgttctaagtcgccatattctctcagttcacacaaaggatcttccatttaggtgcaagagatgtagaaagggatttaggcaacagagtgagcttaaaaagcatatgaagacacacagtggcaggaaagtgtatcagtgtgagtactgtgagtatagcactacagatgcctcaggctttaaacggcacgttatttccattcacacgaaagactatcctcaccggtgtgagtactgcaagaaaggcttccgaagaccttcagaaaagaaccagcacataatgcgacatcataaagaagttggcctgccctaacaatacttctacagaacgtttgtagagatattggccttgaagcagaaaattcattttaaagccaatcagtctcattcacatacaatactgtatattgatttatgctgtgtacaaatagaattattacttctagttgacttttttttaaatatacattttgctcagtagtgtgttctgaattctattcagtttgtttaataaatagggaaaactggcaacatgctagttacttttaataaagtaatccctgattctataccgaagttttatatcttagaattttatatttatttaaatatttaccttgcttaccttgatggtactcttctaagaccattaacttaaggtaactttatattggtaactctgaaagtattcatgttgactcatttttttccccatacatttctcacaataaaattgtcagagacatctactaatataaatgggagattttacagtcaggtctaattatcataacatggaagtcatttacttgtcttgcttaatattttcagaccacttgacagtgaaagtttccatttgagctgttgcgtccctggctttgctgagtaaagagcagtggctgggttcgtgtttacttttcaaatatacttcttttggctttctttggattatttacatcttttgtcagcgtagcaaacttttagaaaaccttattgaaaaactgtgcttgctcatgttgtattttgattattctgtctgtgcggcttcatcttggaatggttgtgtgctacaaatgacacttactgaggactgcattttggaatctcctagaggtaactcatggcttataggatcttttgcaactttatgtatgtaaatgtaccctgaattatatatatacacatatatatcatgtacctgtgtgtattgcttattttacatatttatacacacaaccccaagtagtagttgtttaaaatctataatgaaaagtattaaatttacaataacatgaaagatccagggatgcatgagagagcattttgtaagtcatgctcttcagagagactactcaggtgaagaattagaaggaaaataaggacactagtatttttaaagagtaaagatattttcttttaaatatctttggtaattgaaacatagaggttaagatgtttctaggtagaatgttttcatacaatttcacctccatgtctttatgtttttctgaaaagcaaatgagtatccagacatgactcccacagttctctttgagaagcctgagagggaactctgtcttacctagtgagggggatggaaaagaagtgatggctctgtggaccagagaacgggtgctaattatgacttcacactcggcaagttcaggctgatctgttatttctcagttacagttagcaaactttaaaaacttaacactcaagttggctttgattaaaaggtaaagatgtgttttaagtggataaggaaagtctgaggccttatttggaacatcactaagtcttccacaggttttttgtttgtttgtttttttttgttgtttttttttcttaagacggagtcttgctctgttgcccaggctggactgcagtggtgtgatcactgcaacctctgcagctcactgcaacctctgcttcctgggttcaagcaattatctgcctcagcctctcgagtagctgggattacaggcgcccaccaccacgcccggctaattttttgtatttttaatagagatggggtttcaccatcttggccaggctggtcttgaaccctgacctcgtgatccacctgcctcggccttccatagtgctgggtttacaggcgtgagccaccgtgcccagacaccacataggtctgaatcagtgtcatacattcataaaacaaactcggttaattagaacttggttatgttaagacgaatctgggagaacagaaaacagtttttggggtcccttcagttggctattggtccgtatgcatctagcacattgtaggagatttagaaattgtcttcccacccgatagctgccttgtcacctcattatggtgctccatcccctgtgtgcttaggtttttacctttcatctttctctttgccattgatgtttgtattcaagagttatatttttagggttagaaatcaaaatatttggtgtttggcaaacctctgaagtgctagactgatttagtctagttttaaaccaagtgctttaggcaggtgtgaactccagcccaaatgccagtcaaagtcaaggcatgggttttcctagcctatcttataggaaattcctgtaccttcttggcccccataatgtgttttttttttttttttttttttaaactaacttacaattttgtgatccgtgattcattgccctgcgattcttgaaagctctgtctgtttttttgtgagaacctttaaaatctcccttaatttttattttcccagaaataatgtaaaaacacttaaatgaaagtggaaatgtattaattttaaatcctataaaattaatacagaaaatataaatgattgggtcatttaactatatttttttaaataaactgaaagataaagaacacaacacttcacacattttatatttctcttacatactccggaatcatacacagttctttttaaagcacaacattaaaacctttaaaaggtatttaagggtttggtcaagtgaatatgataaaacatacttgtctgtataaagagaaaatgaaattgtagtcactgttatgtactgacattagttacaacctagttttaattcttaaaacaattttgattagcaaagctaaaaaaaaatggatgtttcagttaaatgttttaaagaggtacagatttttacaaggacataatataagttattgttctgtagaaatatcctattaaatattgtatgtccctccctctgtacactttgtaaagaaagtaaaatacataaaaagaaaatcatatagggatgtgtgacattattgtaattgtgtacttgagaataacgtgcaaaaataaaaatcagaatattttcctgttattgaatgtttagtctatttgataccagtactaagttaatgctttttctcaaggaaaaaaaatgtacagtttttgtaaacctaataaacatcaaaagcagtggattattttcatccccccatttcttaatttctttttcacagcagtggaatgcaaagtgcttgattgctttgaattttgtgactcggatgcaaatactggtaatatttcagttctgtgaatttgcaagtaatatttcagagaagttaagaggtgattggtgagtcctttgatgagcatgtccttggaattcattttttcttttatcttcataaaggatttgttttattagcatctccaattcccctgagataaattactcatgcataaagtggtttttgagagcacttaaagttcatttcagtattaatttacagcatatttaatcagtggggactgttaccacctccacaacagaaatcatgccctcgagttaccccactgcgcccagtttagaggactagtagatgctaacatactagggaatggtcattgccacagttaaaaatcggcagttaagtaaatgtcaggagtcaaaagagatagagttgtgccatctttgattttatagacaagattctgcagttcttccaactgtatgaacaaacgtttgcctaatagttgaaacaataaattaaaattttaggtaaatgacgaagggaatgtggtgaatgtcactgtccagagccataaatcagacaaaaccatacatagcatgctgaaaaacttttgtaatggaacacccaacaaatgacacctaacctgtctgtgatccaacaagtccgataacatgctgctgtatttgtattctctgggaatctcagtattaataatttcatttcccacaaattctagcattcatgtaaggaaaaacatggctaatcaatatcttaaaggggcaatctttcagagcagtggttttcaaagtatggccggacagcattggcagcatcttaatctcctgggactttgttaaaaatgcaaattctcagccccaccctagtcctactgaattgggaaactggcgtgggacccagcagtctttgttttaacatgttctccaagtgattctgatgcctgttcaaacttgggaaacacttttagagcacttgaggaacctaaaagatgactggttcagcattttgtgtggtagataagaaagaaattatcacaaaaaatcagaaatgaacagtgagagaaaaataggaccccagacagtttataccttccatttgctgttttaaaagtgtgagcctgccaagtcaacaagtatgcctttagcgcacatgtaaatagcctgcacttcctaaatctcgtgtggcctcccatggttacattcttcaaaggtaaactgagttgagaggaagattcagcatttaaaagagaagggttgaaaaagattgtgtgtgtgtgtgtgtgtgtttaattggcccagggttacttaaataaatcataaccattttgccacattctgtaactgtttagctaaggtcaaattaagtttaccctatggattttgtttcatcttttgtttcgtgtatatactgtttgcctttttcataaaaatcttggatttgttatatattgttcctgttatttttgacatctttgctattgtaaataaattactattttgttttaagttaccctagtggagtgttggctatagacaaggtatatactcgaaacgaggagacttaaatcacacagttaatgaattcccaacttgtttgaagctggaggtgattcgactcccttcagtggttcaacactaataatagcaccaaggaacatgtcactggtgcatatagg

SEQ ID NO: 204113 - DNA, 600 bp, Homo sapiens
  Payload ID: 20258
  Gene Name: zinc finger protein, X-linked
  ENST ID: ENST00000428571
  CDS Start-End: 195-600
gacggcgggcccgtgccggggagctgggccgctttttgtcagctccgagctcggcccctcctccctccctccgcccgccccaccagccggagcccggcccagtgctccagagaaaggccggcctgcagcacccgccaccgtcgccggccgcccgcacgtccgtccggagctgtgactgatgagaattaaaggccatggatgaagatgggcttgaattacaacaagagccaaactcattttttgatgcaacaggagctgatggtacacacatggatggtgatcaaattgttgtggaagtacaagaaactgtttttgtttcagatgttgtggattcagacataactgtgcataactttgttcctgatgacccagattcagttgtaatccaagatgttattgaggacgttgttatagaagatgttcagtgcccagatatcatggaagaagcagatgtgtctgaaacggtcatcattcctgagcaagtgctggactcagatgtaactgaagaagtttctttagcacattgcacagtcccagatgatgttttagcttctgacattacttcagcctcaatgtctatgccagaacacgtcttgacgg

SEQ ID NO: 204114 - DNA, 300 bp, Homo sapiens
  Payload ID: 20258
  Gene Name: zinc finger protein, X-linked
  ENST ID: ENST00000419690
  CDS Start-End: 206-300
agtgctccagagaaaggccggcctgcagcacccgccaccgtcgccggccgcccgcacgtccgtccgctgggaaagacatagaagaactattaagaagatagaattgttttgctgcgcagtacagcaacagtggatgttcaagattaagattagagtcaagttgtgtgattaagacaggagctgtgactgatgagaattaaaggccatggatgaagatgggcttgaattacaacaagagccaaactcattttttgatgcaacaggagctgatggtacacacatggatggtgatcaaattgt

SEQ ID NO: 204115 - DNA, 6801 bp, Homo sapiens
  Payload ID: 20258
  Gene Name: zinc finger protein, X-linked
  Uniprot ID: P17010
  ENST ID: ENST00000539115
  CDS Start-End: 192-1922
cggggagctgggccgctttttgtcagctccgagctcggcccctcctccctccctccgcccgccccaccagccggagcccggcccagtgctccagagaaaggccggcctgcagcacccgccaccgtcgccggccgcccgcacgtccgtccgtggatgatgctggcaaaatagaacacgatggttcttctggaatgaccatggacacagagtcggaaattgatccttgtaaagtggatggcacttgccctgaggtcatcaaggtgtacatttttaaagctgaccctggagaagatgacttaggtggaactgtagacattgtggagagtgagcctgagaatgatcatggagttgaactgcttgatcagaacagcagtattcgtgttcccagggaaaagatggtttatatgactgtcaatgactctcagccagaagatgaagatttaaatgttgctgaaatcgctgacgaagtttatatggaagtgatcgtaggagaggaggatgctgcagcagcagcggcagccgccgccgtgcacgagcagcaaatggatgacaatgaaatcaaaaccttcatgccgattgcatgggcagcagcttatggtaataattctgatggaattgaaaaccggaatggcactgcaagtgccctcttgcacatagatgagtctgctggcctcggcagactggctaaacaaaaaccaaagaaaaggagaagacctgattccaggcagtaccaaacagcaataattattggccctgatggacatcctttgactgtctatccttgcatgatttgtgggaagaagtttaagtcgagaggttttttgaaaaggcacatgaaaaaccatcccgaacaccttgccaagaagaaataccgctgtactgactgtgattacactaccaacaagaagataagtttacacaaccacctggagagccacaagctgaccagcaaggcagagaaggccattgaatgcgatgagtgtgggaagcatttctctcatgcaggggctttgtttactcacaaaatggtgcataaggaaaaaggagccaacaaaatgcacaagtgtaaattctgtgaatacgagacagctgaacaagggttattgaatcgccacctcttggcagtccacagcaagaactttcctcatatttgtgtggagtgtggtaagggttttcgtcacccgtcagagctcaaaaagcacatgagaatccatactggggagaagccgtaccaatgccagtactgcgaatataggtctgcagactcttctaacttgaaaacgcatgtcaaaactaagcatagtaaagagatgccattcaagtgtgacatttgtcttctgactttctcggataccaaagaggtgcagcaacatgctcttatccaccaagaaagcaaaacacaccagtgtttgcattgcgaccacaagagttcgaactcaagtgatttgaaacgacacataatttcagttcacacgaaagactacccccataagtgtgacatgtgtgataaaggctttcacaggccttcagaactcaagaaacacgtggctgcccacaagggcaaaaaaatgcaccagtgtagacattgtgactttaagattgcagatccatttgttctaagtcgccatattctctcagttcacacaaaggatcttccatttaggtgcaagagatgtagaaagggatttaggcaacagagtgagcttaaaaagcatatgaagacacacagtggcaggaaagtgtatcagtgtgagtactgtgagtatagcactacagatgcctcaggctttaaacggcacgttatttccattcacacgaaagactatcctcaccggtgtgagtactgcaagaaaggcttccgaagaccttcagaaaagaaccagcacataatgcgacatcataaagaagttggcctgccctaacaatacttctacagaacgtttgtagagatattggccttgaagcagaaaattcattttaaagccaatcagtctcattcacatacaatactgtatattgatttatgctgtgtacaaatagaattattacttctagttgacttttttttaaatatacattttgctcagtagtgtgttctgaattctattcagtttgtttaataaatagggaaaactggcaacatgctagttacttttaataaagtaatccctgattctataccgaagttttatatcttagaattttatatttatttaaatatttaccttgcttaccttgatggtactcttctaagaccattaacttaaggtaactttatattggtaactctgaaagtattcatgttgactcatttttttccccatacatttctcacaataaaattgtcagagacatctactaatataaatgggagattttacagtcaggtctaattatcataacatggaagtcatttacttgtcttgcttaatattttcagaccacttgacagtgaaagtttccatttgagctgttgcgtccctggctttgctgagtaaagagcagtggctgggttcgtgtttacttttcaaatatacttcttttggctttctttggattatttacatcttttgtcagcgtagcaaacttttagaaaaccttattgaaaaactgtgcttgctcatgttgtattttgattattctgtctgtgcggcttcatcttggaatggttgtgtgctacaaatgacacttactgaggactgcattttggaatctcctagaggtaactcatggcttataggatcttttgcaactttatgtatgtaaatgtaccctgaattatatatatacacatatatatcatgtacctgtgtgtattgcttattttacatatttatacacacaaccccaagtagtagttgtttaaaatctataatgaaaagtattaaatttacaataacatgaaagatccagggatgcatgagagagcattttgtaagtcatgctcttcagagagactactcaggtgaagaattagaaggaaaataaggacactagtatttttaaagagtaaagatattttcttttaaatatctttggtaattgaaacatagaggttaagatgtttctaggtagaatgttttcatacaatttcacctccatgtctttatgtttttctgaaaagcaaatgagtatccagacatgactcccacagttctctttgagaagcctgagagggaactctgtcttacctagtgagggggatggaaaagaagtgatggctctgtggaccagagaacgggtgctaattatgacttcacactcggcaagttcaggctgatctgttatttctcagttacagttagcaaactttaaaaacttaacactcaagttggctttgattaaaaggtaaagatgtgttttaagtggataaggaaagtctgaggccttatttggaacatcactaagtcttccacaggttttttgtttgtttgtttttttttgttgtttttttttcttaagacggagtcttgctctgttgcccaggctggactgcagtggtgtgatcactgcaacctctgcagctcactgcaacctctgcttcctgggttcaagcaattatctgcctcagcctctcgagtagctgggattacaggcgcccaccaccacgcccggctaattttttgtatttttaatagagatggggtttcaccatcttggccaggctggtcttgaaccctgacctcgtgatccacctgcctcggccttccatagtgctgggtttacaggcgtgagccaccgtgcccagacaccacataggtctgaatcagtgtcatacattcataaaacaaactcggttaattagaacttggttatgttaagacgaatctgggagaacagaaaacagtttttggggtcccttcagttggctattggtccgtatgcatctagcacattgtaggagatttagaaattgtcttcccacccgatagctgccttgtcacctcattatggtgctccatcccctgtgtgcttaggtttttacctttcatctttctctttgccattgatgtttgtattcaagagttatatttttagggttagaaatcaaaatatttggtgtttggcaaacctctgaagtgctagactgatttagtctagttttaaaccaagtgctttaggcaggtgtgaactccagcccaaatgccagtcaaagtcaaggcatgggttttcctagcctatcttataggaaattcctgtaccttcttggcccccataatgtgttttttttttttttttttttttaaactaacttacaattttgtgatccgtgattcattgccctgcgattcttgaaagctctgtctgtttttttgtgagaacctttaaaatctcccttaatttttattttcccagaaataatgtaaaaacacttaaatgaaagtggaaatgtattaattttaaatcctataaaattaatacagaaaatataaatgattgggtcatttaactatatttttttaaataaactgaaagataaagaacacaacacttcacacattttatatttctcttacatactccggaatcatacacagttctttttaaagcacaacattaaaacctttaaaaggtatttaagggtttggtcaagtgaatatgataaaacatacttgtctgtataaagagaaaatgaaattgtagtcactgttatgtactgacattagttacaacctagttttaattcttaaaacaattttgattagcaaagctaaaaaaaaatggatgtttcagttaaatgttttaaagaggtacagatttttacaaggacataatataagttattgttctgtagaaatatcctattaaatattgtatgtccctccctctgtacactttgtaaagaaagtaaaatacataaaaagaaaatcatatagggatgtgtgacattattgtaattgtgtacttgagaataacgtgcaaaaataaaaatcagaatattttcctgttattgaatgtttagtctatttgataccagtactaagttaatgctttttctcaaggaaaaaaaatgtacagtttttgtaaacctaataaacatcaaaagcagtggattattttcatccccccatttcttaatttctttttcacagcagtggaatgcaaagtgcttgattgctttgaattttgtgactcggatgcaaatactggtaatatttcagttctgtgaatttgcaagtaatatttcagagaagttaagaggtgattggtgagtcctttgatgagcatgtccttggaattcattttttcttttatcttcataaaggatttgttttattagcatctccaattcccctgagataaattactcatgcataaagtggtttttgagagcacttaaagttcatttcagtattaatttacagcatatttaatcagtggggactgttaccacctccacaacagaaatcatgccctcgagttaccccactgcgcccagtttagaggactagtagatgctaacatactagggaatggtcattgccacagttaaaaatcggcagttaagtaaatgtcaggagtcaaaagagatagagttgtgccatctttgattttatagacaagattctgcagttcttccaactgtatgaacaaacgtttgcctaatagttgaaacaataaattaaaattttaggtaaatgacgaagggaatgtggtgaatgtcactgtccagagccataaatcagacaaaaccatacatagcatgctgaaaaacttttgtaatggaacacccaacaaatgacacctaacctgtctgtgatccaacaagtccgataacatgctgctgtatttgtattctctgggaatctcagtattaataatttcatttcccacaaattctagcattcatgtaaggaaaaacatggctaatcaatatcttaaaggggcaatctttcagagcagtggttttcaaagtatggccggacagcattggcagcatcttaatctcctgggactttgttaaaaatgcaaattctcagccccaccctagtcctactgaattgggaaactggcgtgggacccagcagtctttgttttaacatgttctccaagtgattctgatgcctgttcaaacttgggaaacacttttagagcacttgaggaacctaaaagatgactggttcagcattttgtgtggtagataagaaagaaattatcacaaaaaatcagaaatgaacagtgagagaaaaataggaccccagacagtttataccttccatttgctgttttaaaagtgtgagcctgccaagtcaacaagtatgcctttagcgcacatgtaaatagcctgcacttcctaaatctcgtgtggcctcccatggttacattcttcaaaggtaaactgagttgagaggaagattcagcatttaaaagagaagggttgaaaaagattgtgtgtgtgtgtgtgtgtgtttaattggcccagggttacttaaataaatcataaccattttgccacattctgtaactgtttagctaaggtcaaattaagtttaccctatggattttgtttcatcttttgtttcgtgtatatactgtttgcctttttcataaaaatcttggatttgttatatattgttcctgttatttttgacatctttgctattgtaaataaattactattttgttttaagttaccctagtggagtgttggctatagacaaggtatatactcgaaacgaggagacttaaatcacacagttaatgaattcccaacttgtttgaagctggaggtgattcgactcccttcagtggttcaacactaataatagcaccaaggaacatgtcactggtgcatatagg

SEQ ID NO: 204116 - DNA, 5239 bp, Homo sapiens
  Payload ID: 20259
  Gene Name: zinc finger protein, Y-linked
  Uniprot ID: P08048
  ENST ID: ENST00000155093
  CDS Start-End: 322-2727
gcctagtgcgcgcgcagtaacctgtttgtggcctggtcggcgtcccgtagggcgccctcccgcgctaggccggccggcgtggcgctcggcgccgaacaggccccgaggaggccgcagttaggcctagtgattatccagttgccctgagcggctgcggaggtgcgctccataagcgggcagggtgggaaaagttcgcccgtttgtccggaaggcagttgatggacctggggtcgacaccactgcggacgcagggcacggcacgggggcgagaaggcgaaggctgcaggcgtgaggagctgtgactaatgagaattaaaggccatggatgaagatgaatttgaattgcagccacaagagccaaactcattttttgatggaataggagctgatgctacacacatggatggtgatcagattgttgtggaaatacaagaagcagtttttgtttctaatattgtggattctgacataactgtgcataactttgttcctgatgacccagactcagttgtaatccaagatgttgttgaagatgttgtcatagaggaggatgttcagtgctcagatatcttagaagaggcagatgtatctgaaaatgtcatcattcctgagcaagtgctggactcagatgtaactgaagaagtttctttaccacactgcacagtcccagatgatgttttagcttctgacattacttcaacctcaatgtctatgccagaacatgttttaacgagtgaatccatgcatgtgtgtgacattggacatgttgaacatatggtgcatgatagtgtagtggaagcagaaatcattactgatcctctgacgagtgacatagtttcagaagaagtattggtagcagactgtgcccctgaagcagtcatagatgccagcgggatctcagtggaccagcaagataatgacaaagccagctgtgaggactacctaatgatttcgttggatgatgctggcaaaatagaacatgatggttccactggagtgaccatcgatgcagaatcagaaatggatccttgtaaagtggatagcacttgtcctgaagtcatcaaggtgtacatttttaaagctgaccctggagaagatgacttaggtggaactgtagacattgtggagagtgaacctgaaaatgatcatggagttgaactacttgatcagaacagcagtattcgtgttcccagggaaaagatggtttatatgactgtcaatgactctcaacaagaagatgaagatttaaatgttgctgaaattgctgatgaagtttatatggaagtgatcgtaggagaggaggatgctgctgttgcagcagcagcagctgctgtgcatgagcagcaaattgatgaggatgaaatgaaaaccttcgtaccaattgcatgggcagcagcttatggtaataattctgatggaattgaaaaccggaatggcactgcaagtgccctcttgcacatagatgagtctgctggccttggcagactggctaaacagaaaccaaagaaaaagagaagacctgattccaggcagtaccaaacagcaataattattggccctgatggtcatcctttgactgtctatccttgcatgatttgtgggaagaagtttaagtcgaggggttttttgaaaagacacatgaaaaaccatcctgaacaccttgccaagaagaagtaccactgtactgactgtgattacactaccaataagaagataagtttacataaccacctggagagccacaagctgaccagcaaggcagagaaggccattgaatgtgatgagtgtgggaagcatttttctcatgcaggggctttgtttactcacaaaatggtgcataaggaaaaaggggccaacaaaatgcacaagtgtaaattctgtgaatatgagacagctgaacaggggttattgaatcgccacctcttggcagtccacagcaagaactttcctcatatttgtgtggagtgtggtaaaggtttccgacacccgtcggaactgagaaagcacatgcgaatccataccggcgagaagccataccaatgccagtactgtgaatataggtctgcagactcttctaacttgaaaacacatataaaaacaaagcatagtaaagagatgccattcaagtgtgacatttgtcttctgactttctcagataccaaagaagtgcagcaacatactcttgtccaccaagaaagcaaaacacatcagtgtttgcattgcgaccacaagagttcaaactcaagtgatttgaaacgacatgtaatttcagttcatacgaaagactatcctcataagtgtgagatgtgcgagaaaggctttcacaggccttcagaacttaagaaacatgtggctgtccacaaaggtaaaaaaatgcaccaatgtagacattgtgactttaagattgcagacccatttgttctaagtcgccatattctctcagttcacacaaaggatcttccatttaggtgtaagagatgtagaaagggatttaggcaacaaaatgagcttaaaaagcatatgaagacacacagtggcaggaaagtatatcagtgtgagtactgtgagtatagcactacagatgcctcaggctttaaacggcacgttatttccattcatacaaaagactatcctcatcggtgtgagtactgcaagaaaggcttccgaagaccttcagaaaagaaccagcacataatgagacaccataaagaagttggtctgccctaacagtgtgtctacaagcttgtaaagatgttggccttgaagcagaaaattcattttttaaagccagtcttgttcacatccattactatacattgaattatgctgtgtaaaaatagaattattgcttctagtccacttttctttacattttattcaatacgctgtcctgaatcctattcagtttctttaatagatgaggaaaaatagcaacaagcaagttgcttataataaaataatttgtgattctatactgaattttcagtcataaaagctttactatttatttacatatttattcatgttcatggtactcttctaagacaaaatcagattgataactatgaaagtaacatttttgacccatttcctcctacacaagtgtttcacattggagacatctgctaatataaatgggaggttttactgtcaagtccaattagcaaaacgtggtaataatttttttgtcagtattttcagattacatgataaaattttacatttgagcttctagcattgattaatataggatattgaccacgtttatgtttaaatttcattttgttcagcagacaaaatgtacttcccttaactttcattaatagtgtttacatcttttgtcagcacagcaaacttttagaaagtaatagttttacttatttttatcttctgttttctctttgtactgctttgtcttgcattgtgttccaacacatgagacttactgctcactgaattttggagtcttttagaggtaaattgtggactcaggattttttgaaacttggtgtgtaactctaaatcttgtatatgcatctttgttgcttattacatatttacacacacaaccacaaattttaaacttatgatgaaaatttacaataacctgaaagatccagagatgtatgagagcattttgtaacttgttattcagttactaaatttgaggtgaataattaaaaagaaaaggacattaggagagtgaaaatcttctcttcaaataatctttgatagataaaaatggaaggtaagatgtttctagatagaatgttttcatacaatttcagcttcatatcataaatttttctggaaagctatttcagacatagatttcatagtatttttctgagaatcctgtgaaggaacgctgtctctttgcaaagtaaggaggactaagggaaaatgatggtaccatgtaacagaatgagagctaattccaaattagcaacttcatcctgctttctattttacattgagtaaagttttaaaaagacaacagtcaagttgattttgattagaagataaaagtacataatgaaaatccatggccttatttggaatatatatcactttccaaattttattatttatttgagagttaataagttaatgttattaagcagttaataatttatatgtatggatataatataaaatgaattcatataattaaaaagaatttggttaataagaatttggagaatggaaaatacatttttaggttccttaatttggctgttggtacctgtgtatttggaatattttaggggattcgaattttttttaacccacattacagctaccttctagctttagtatggtagtgcttcattcaacttttgctgtcaggtttttattttcacctttttctgtgccaccaattcaaaagttataggattaggaaatataaatttatatttggtgattggcagcctctgaaatgttagattaatttgatctagttctaaagtgctttagtcatatatgaatttaaacctagtaccatccaaaaccatgtaatggattttaagaatctgttaggccttcttagcctttatacatgtccctacctgatttttactgtccttcatgatcctgttcttgaaaacttcagtttgtatttgagaatcctttaaatctccttccaatttgttttctccctgaagtaatataaaaggaagtatttaagtgaaagtttaagagttttaaaacattctttaaaattaatacagatagttagctatttatcttttaaaaataaactaaggtaaaaaacgtgacactttacatatttcatatttttcatatagtctggaggtatacacagttgttttgtttttaaccacggtattgaaacctttaaaaggtaattaagcatttggtcaagtaaatatagaacatttgtataaagaaagaaatgaaattgtgcttaatgttatatactgttattatttgcaggctggttttaattcttaatttgattagcaaagctaaaaaagtggatgttgaagttgaaagttttaaagaggtacaaaatcttacaaggacataaattattatttggttgaaaaatagcctattagatattgtatgtcccttcctctgtacaaattgtaaaatacttaaaataactatgaagaattcatataggaagtgtgatactattgtaaatgtgtatttgagaatatgcaaaaataaaaataatattttactgttaataaatgtttacttgtatatg

SEQ ID NO: 204117 - DNA, 5113 bp, Homo sapiens
  Payload ID: 20259
  Gene Name: zinc finger protein, Y-linked
  Uniprot ID: P08048
  ENST ID: ENST00000383052
  CDS Start-End: 195-2600
gacggcgggcccgtgccggggagctgggccgctttttgtcagctccgaactcggcccctcctccctccctccgcccgccctaccagccggagcccggcccagtgctccagagaaaggccgtcctgcagcacccgccgctgtcgccgaccgcccgcacatccgtcgggagctgtgactaatgagaattaaaggccatggatgaagatgaatttgaattgcagccacaagagccaaactcattttttgatggaataggagctgatgctacacacatggatggtgatcagattgttgtggaaatacaagaagcagtttttgtttctaatattgtggattctgacataactgtgcataactttgttcctgatgacccagactcagttgtaatccaagatgttgttgaagatgttgtcatagaggaggatgttcagtgctcagatatcttagaagaggcagatgtatctgaaaatgtcatcattcctgagcaagtgctggactcagatgtaactgaagaagtttctttaccacactgcacagtcccagatgatgttttagcttctgacattacttcaacctcaatgtctatgccagaacatgttttaacgagtgaatccatgcatgtgtgtgacattggacatgttgaacatatggtgcatgatagtgtagtggaagcagaaatcattactgatcctctgacgagtgacatagtttcagaagaagtattggtagcagactgtgcccctgaagcagtcatagatgccagcgggatctcagtggaccagcaagataatgacaaagccagctgtgaggactacctaatgatttcgttggatgatgctggcaaaatagaacatgatggttccactggagtgaccatcgatgcagaatcagaaatggatccttgtaaagtggatagcacttgtcctgaagtcatcaaggtgtacatttttaaagctgaccctggagaagatgacttaggtggaactgtagacattgtggagagtgaacctgaaaatgatcatggagttgaactacttgatcagaacagcagtattcgtgttcccagggaaaagatggtttatatgactgtcaatgactctcaacaagaagatgaagatttaaatgttgctgaaattgctgatgaagtttatatggaagtgatcgtaggagaggaggatgctgctgttgcagcagcagcagctgctgtgcatgagcagcaaattgatgaggatgaaatgaaaaccttcgtaccaattgcatgggcagcagcttatggtaataattctgatggaattgaaaaccggaatggcactgcaagtgccctcttgcacatagatgagtctgctggccttggcagactggctaaacagaaaccaaagaaaaagagaagacctgattccaggcagtaccaaacagcaataattattggccctgatggtcatcctttgactgtctatccttgcatgatttgtgggaagaagtttaagtcgaggggttttttgaaaagacacatgaaaaaccatcctgaacaccttgccaagaagaagtaccactgtactgactgtgattacactaccaataagaagataagtttacataaccacctggagagccacaagctgaccagcaaggcagagaaggccattgaatgtgatgagtgtgggaagcatttttctcatgcaggggctttgtttactcacaaaatggtgcataaggaaaaaggggccaacaaaatgcacaagtgtaaattctgtgaatatgagacagctgaacaggggttattgaatcgccacctcttggcagtccacagcaagaactttcctcatatttgtgtggagtgtggtaaaggtttccgacacccgtcggaactgagaaagcacatgcgaatccataccggcgagaagccataccaatgccagtactgtgaatataggtctgcagactcttctaacttgaaaacacatataaaaacaaagcatagtaaagagatgccattcaagtgtgacatttgtcttctgactttctcagataccaaagaagtgcagcaacatactcttgtccaccaagaaagcaaaacacatcagtgtttgcattgcgaccacaagagttcaaactcaagtgatttgaaacgacatgtaatttcagttcatacgaaagactatcctcataagtgtgagatgtgcgagaaaggctttcacaggccttcagaacttaagaaacatgtggctgtccacaaaggtaaaaaaatgcaccaatgtagacattgtgactttaagattgcagacccatttgttctaagtcgccatattctctcagttcacacaaaggatcttccatttaggtgtaagagatgtagaaagggatttaggcaacaaaatgagcttaaaaagcatatgaagacacacagtggcaggaaagtatatcagtgtgagtactgtgagtatagcactacagatgcctcaggctttaaacggcacgttatttccattcatacaaaagactatcctcatcggtgtgagtactgcaagaaaggcttccgaagaccttcagaaaagaaccagcacataatgagacaccataaagaagttggtctgccctaacagtgtgtctacaagcttgtaaagatgttggccttgaagcagaaaattcattttttaaagccagtcttgttcacatccattactatacattgaattatgctgtgtaaaaatagaattattgcttctagtccacttttctttacattttattcaatacgctgtcctgaatcctattcagtttctttaatagatgaggaaaaatagcaacaagcaagttgcttataataaaataatttgtgattctatactgaattttcagtcataaaagctttactatttatttacatatttattcatgttcatggtactcttctaagacaaaatcagattgataactatgaaagtaacatttttgacccatttcctcctacacaagtgtttcacattggagacatctgctaatataaatgggaggttttactgtcaagtccaattagcaaaacgtggtaataatttttttgtcagtattttcagattacatgataaaattttacatttgagcttctagcattgattaatataggatattgaccacgtttatgtttaaatttcattttgttcagcagacaaaatgtacttcccttaactttcattaatagtgtttacatcttttgtcagcacagcaaacttttagaaagtaatagttttacttatttttatcttctgttttctctttgtactgctttgtcttgcattgtgttccaacacatgagacttactgctcactgaattttggagtcttttagaggtaaattgtggactcaggattttttgaaacttggtgtgtaactctaaatcttgtatatgcatctttgttgcttattacatatttacacacacaaccacaaattttaaacttatgatgaaaatttacaataacctgaaagatccagagatgtatgagagcattttgtaacttgttattcagttactaaatttgaggtgaataattaaaaagaaaaggacattaggagagtgaaaatcttctcttcaaataatctttgatagataaaaatggaaggtaagatgtttctagatagaatgttttcatacaatttcagcttcatatcataaatttttctggaaagctatttcagacatagatttcatagtatttttctgagaatcctgtgaaggaacgctgtctctttgcaaagtaaggaggactaagggaaaatgatggtaccatgtaacagaatgagagctaattccaaattagcaacttcatcctgctttctattttacattgagtaaagttttaaaaagacaacagtcaagttgattttgattagaagataaaagtacataatgaaaatccatggccttatttggaatatatatcactttccaaattttattatttatttgagagttaataagttaatgttattaagcagttaataatttatatgtatggatataatataaaatgaattcatataattaaaaagaatttggttaataagaatttggagaatggaaaatacatttttaggttccttaatttggctgttggtacctgtgtatttggaatattttaggggattcgaattttttttaacccacattacagctaccttctagctttagtatggtagtgcttcattcaacttttgctgtcaggtttttattttcacctttttctgtgccaccaattcaaaagttataggattaggaaatataaatttatatttggtgattggcagcctctgaaatgttagattaatttgatctagttctaaagtgctttagtcatatatgaatttaaacctagtaccatccaaaaccatgtaatggattttaagaatctgttaggccttcttagcctttatacatgtccctacctgatttttactgtccttcatgatcctgttcttgaaaacttcagtttgtatttgagaatcctttaaatctccttccaatttgttttctccctgaagtaatataaaaggaagtatttaagtgaaagtttaagagttttaaaacattctttaaaattaatacagatagttagctatttatcttttaaaaataaactaaggtaaaaaacgtgacactttacatatttcatatttttcatatagtctggaggtatacacagttgttttgtttttaaccacggtattgaaacctttaaaaggtaattaagcatttggtcaagtaaatatagaacatttgtataaagaaagaaatgaaattgtgcttaatgttatatactgttattatttgcaggctggttttaattcttaatttgattagcaaagctaaaaaagtggatgttgaagttgaaagttttaaagaggtacaaaatcttacaaggacataaattattatttggttgaaaaatagcctattagatattgtatgtcccttcctctgtacaaattgtaaaatacttaaaataactatgaagaattcatataggaagtgtgatactattgtaaatgtgtatttgagaatatgcaaaaataaaaataatattttactgttaataaatgtttacttgtatatga

SEQ ID NO: 204118 - DNA, 567 bp, Homo sapiens
  Payload ID: 20259
  Gene Name: zinc finger protein, Y-linked
  ENST ID: ENST00000443793
  CDS Start-End: 294-567
tggcctggtcggcgtcccgtagggcgccctcccgcgctaggccggccggcgtggcgctcggcgccgaacaggccccgaggaggccgcagttaggcctagtgattatccagttgccctgagcggctgcggaggtgcgctccataagcgggcagggtgggaaaagttcgcccgtttgtccggaaggcagttgatggacctggggtcgacaccactgcggacgcagggcacggcacgggggcgagaaggcgaaggctgcaggcgtgaggagctgtgactaatgagaattaaaggccatggatgaagatgaatttgaattgcagccacaagagccaaactcattttttgatggaataggagctgatgctacacacatggatggtgatcagattgttgtggaaatacaagaagcagtttttgtttctaatattgtggattctgacataactgtgcataactttgttcctgatgacccagactcagttgtaatccaagatgttgttgaagatgttgtcatagaggaggatgttcagtgctcagatatcttagaagaggcagatgtatctgaaa

SEQ ID NO: 204119 - DNA, 3464 bp, Homo sapiens
  Payload ID: 20259
  Gene Name: zinc finger protein, Y-linked
  Uniprot ID: P08048
  ENST ID: ENST00000449237
  CDS Start-End: 137-2311
gggcagggtgggaaaagttcgcccgtttgtccggaaggcagttgatggacctggggtcgacaccactgcggacgcagggcacggcacgggggcgagaaggcgaaggctgcaggcgtgaggagctgatgctacacacatggatggtgatcagattgttgtggaaatacaagaagcagtttttgtttctaatattgtggattctgacataactgtgcataactttgttcctgatgacccagactcagttgtaatccaagatgttgttgaagatgttgtcatagaggaggatgttcagtgctcagatatcttagaagaggcagatgtatctgaaaatgtcatcattcctgagcaagtgctggactcagatgtaactgaagaagtttctttaccacactgcacagtcccagatgatgttttagcttctgacattacttcaacctcaatgtctatgccagaacatgttttaacgagtgaatccatgcatgtgtgtgacattggacatgttgaacatatggtgcatgatagtgtagtggaagcagaaatcattactgatcctctgacgagtgacatagtttcagaagaagtattggtagcagactgtgcccctgaagcagtcatagatgccagcgggatctcagtggaccagcaagataatgacaaagccagctgtgaggactacctaatgatttcgttggatgatgctggcaaaatagaacatgatggttccactggagtgaccatcgatgcagaatcagaaatggatccttgtaaagtggatagcacttgtcctgaagtcatcaaggtgtacatttttaaagctgaccctggagaagatgacttaggtggaactgtagacattgtggagagtgaacctgaaaatgatcatggagttgaactacttgatcagaacagcagtattcgtgttcccagggaaaagatggtttatatgactgtcaatgactctcaacaagaagatgaagatttaagtaataattctgatggaattgaaaaccggaatggcactgcaagtgccctcttgcacatagatgagtctgctggccttggcagactggctaaacagaaaccaaagaaaaagagaagacctgattccaggcagtaccaaacagcaataattattggccctgatggtcatcctttgactgtctatccttgcatgatttgtgggaagaagtttaagtcgaggggttttttgaaaagacacatgaaaaaccatcctgaacaccttgccaagaagaagtaccactgtactgactgtgattacactaccaataagaagataagtttacataaccacctggagagccacaagctgaccagcaaggcagagaaggccattgaatgtgatgagtgtgggaagcatttttctcatgcaggggctttgtttactcacaaaatggtgcataaggaaaaaggggccaacaaaatgcacaagtgtaaattctgtgaatatgagacagctgaacaggggttattgaatcgccacctcttggcagtccacagcaagaactttcctcatatttgtgtggagtgtggtaaaggtttccgacacccgtcggaactgagaaagcacatgcgaatccataccggcgagaagccataccaatgccagtactgtgaatataggtctgcagactcttctaacttgaaaacacatataaaaacaaagcatagtaaagagatgccattcaagtgtgacatttgtcttctgactttctcagataccaaagaagtgcagcaacatactcttgtccaccaagaaagcaaaacacatcagtgtttgcattgcgaccacaagagttcaaactcaagtgatttgaaacgacatgtaatttcagttcatacgaaagactatcctcataagtgtgagatgtgcgagaaaggctttcacaggccttcagaacttaagaaacatgtggctgtccacaaaggtaaaaaaatgcaccaatgtagacattgtgactttaagattgcagacccatttgttctaagtcgccatattctctcagttcacacaaaggatcttccatttaggtgtaagagatgtagaaagggatttaggcaacaaaatgagcttaaaaagcatatgaagacacacagtggcaggaaagtatatcagtgtgagtactgtgagtatagcactacagatgcctcaggctttaaacggcacgttatttccattcatacaaaagactatcctcatcggtgtgagtactgcaagaaaggcttccgaagaccttcagaaaagaaccagcacataatgagacaccataaagaagttggtctgccctaacagtgtgtctacaagcttgtaaagatgttggccttgaagcagaaaattcattttttaaagccagtcttgttcacatccattactatacattgaattatgctgtgtaaaaatagaattattgcttctagtccacttttctttacattttattcaatacgctgtcctgaatcctattcagtttctttaatagatgaggaaaaatagcaacaagcaagttgcttataataaaataatttgtgattctatactgaattttcagtcataaaagctttactatttatttacatatttattcatgttcatggtactcttctaagacaaaatcagattgataactatgaaagtaacatttttgacccatttcctcctacacaagtgtttcacattggagacatctgctaatataaatgggaggttttactgtcaagtccaattagcaaaacgtggtaataatttttttgtcagtattttcagattacatgataaaattttacatttgagcttctagcattgattaatataggatattgaccacgtttatgtttaaatttcattttgttcagcagacaaaatgtacttcccttaactttcattaatagtgtttacatcttttgtcagcacagcaaacttttagaaagtaatagttttacttatttttatcttctgttttctctttgtactgctttgtcttgcattgtgttccaacacatgagacttactgctcactgaattttggagtcttttagaggtaaattgtggactcaggattttttgaaacttggtgtgtaactctaaatcttgtatatgcatctttgttgcttattacatatttacacacacaaccacaaattttaaacttatgatgaaaatttacaataacctgaaagatccagagatgtatgagagcattttgtaacttgttattcagttactaaatttgaggtgaataattaaaaagaaaaggacattaggagagtgaaaatcttctcttcaaataatctttgatagataaaaatggaaggtaagatgtttctagatagaatgttttcatacaatttcagcttcatatcataaatttttctggaaagctatttcagacatagatttcatagtatttttctgagaatcctgtgaaggaacgctgtctctttgc

SEQ ID NO: 204120 - DNA, 2273 bp, Homo sapiens
  Payload ID: 20259
  Gene Name: zinc finger protein, Y-linked
  Uniprot ID: P08048
  ENST ID: ENST00000625061
  CDS Start-End: 87-1919
agagaaaggccgtcctgcagcacccgccgctgtcgccgaccgcccgcacatccgtcgggagctgtgactaatgagaattaaaggccatggatgaagatgaatttgaattgcagccacaagagccaaactcattttttgatggaatagtggatgatgctggcaaaatagaacatgatggttccactggagtgaccatcgatgcagaatcagaaatggatccttgtaaagtggatagcacttgtcctgaagtcatcaaggtgtacatttttaaagctgaccctggagaagatgacttaggtggaactgtagacattgtggagagtgaacctgaaaatgatcatggagttgaactacttgatcagaacagcagtattcgtgttcccagggaaaagatggtttatatgactgtcaatgactctcaacaagaagatgaagatttaaatgttgctgaaattgctgatgaagtttatatggaagtgatcgtaggagaggaggatgctgctgttgcagcagcagcagctgctgtgcatgagcagcaaattgatgaggatgaaatgaaaaccttcgtaccaattgcatgggcagcagcttatggtaataattctgatggaattgaaaaccggaatggcactgcaagtgccctcttgcacatagatgagtctgctggccttggcagactggctaaacagaaaccaaagaaaaagagaagacctgattccaggcagtaccaaacagcaataattattggccctgatggtcatcctttgactgtctatccttgcatgatttgtgggaagaagtttaagtcgaggggttttttgaaaagacacatgaaaaaccatcctgaacaccttgccaagaagaagtaccactgtactgactgtgattacactaccaataagaagataagtttacataaccacctggagagccacaagctgaccagcaaggcagagaaggccattgaatgtgatgagtgtgggaagcatttttctcatgcaggggctttgtttactcacaaaatggtgcataaggaaaaaggggccaacaaaatgcacaagtgtaaattctgtgaatatgagacagctgaacaggggttattgaatcgccacctcttggcagtccacagcaagaactttcctcatatttgtgtggagtgtggtaaaggtttccgacacccgtcggaactgagaaagcacatgcgaatccataccggcgagaagccataccaatgccagtactgtgaatataggtctgcagactcttctaacttgaaaacacatataaaaacaaagcatagtaaagagatgccattcaagtgtgacatttgtcttctgactttctcagataccaaagaagtgcagcaacatactcttgtccaccaagaaagcaaaacacatcagtgtttgcattgcgaccacaagagttcaaactcaagtgatttgaaacgacatgtaatttcagttcatacgaaagactatcctcataagtgtgagatgtgcgagaaaggctttcacaggccttcagaacttaagaaacatgtggctgtccacaaaggtaaaaaaatgcaccaatgtagacattgtgactttaagattgcagacccatttgttctaagtcgccatattctctcagttcacacaaaggatcttccatttaggtgtaagagatgtagaaagggatttaggcaacaaaatgagcttaaaaagcatatgaagacacacagtggcaggaaagtatatcagtgtgagtactgtgagtatagcactacagatgcctcaggctttaaacggcacgttatttccattcatacaaaagactatcctcatcggtgtgagtactgcaagaaaggcttccgaagaccttcagaaaagaaccagcacataatgagacaccataaagaagttggtctgccctaacagtgtgtctacaagcttgtaaagatgttggccttgaagcagaaaattcattttttaaagccagtcttgttcacatccattactatacattgaattatgctgtgtaaaaatagaattattgcttctagtccacttttctttacattttattcaatacgctgtcctgaatcctattcagtttctttaatagatgaggaaaaatagcaacaagcaagttgcttataataaaataatttgtgattctatactgaattttcagtcataaaagctttactatttatttacatatttattcatgttcatggtactcttctaagacaaaatcagattgataactatgaaagtaacattttt

SEQ ID NO: 204121 - DNA, 1371 bp, Homo sapiens
  Payload ID: 20260
  Gene Name: zinc finger protein-like 1
  Uniprot ID: O95159
  ENST ID: ENST00000294258
  CDS Start-End: 153-1085
cggagggataatcggggcggccggggctgaagggagaggcgcaggagccctggggagagtggtccctgcccttccgcgcctcgagccatcgctaccgcccttcggaaccagtgcagcggccgatcagtaaacacagagactggggatcgatcatggggctttgtaagtgccccaagagaaaggtgaccaacctgttctgcttcgaacatcgggtcaacgtctgcgagcactgcctggtagccaatcacgccaagtgcatcgtccagtcctacctgcaatggctccaagatagcgactacaaccccaattgccgcctgtgcaacatacccctggccagccgagagacgacccgccttgtctgctatgatctctttcactgggcctgcctcaatgaacgtgctgcccagctaccccgaaacacggcacctgccggctatcagtgccccagctgcaatggccccatcttccccccaaccaacctggctggccccgtggcctccgcactgagagagaagctggccacagtcaactgggcccgggcaggactgggcctccctctgatcgatgaggtggtgagcccagagcccgagcccctcaacacgtctgacttctctgactggtctagttttaatgccagcagtacccctggaccagaggaggtagacagcgcctctgctgccccagccttctacagccaggccccccggcccccagcttccccaggccggcccgagcagcacacagtgatccacatgggcaatcctgagcccttgactcacgcccctaggaaggtgtatgatacgcgggatgatgaccggacaccaggcctccatggagactgtgacgatgacaagtaccgacgtcggccggccttgggttggctggcccggctgctaaggagccgggctgggtctcggaagcggccgctgaccctgctccagcgggcggggctgctgctactcttgggactgctgggcttcctggccctccttgccctcatgtctcgcctaggccgggccgcagctgacagcgatcccaacctggacccactcatgaaccctcacatccgcgtgggcccctcctgagcccccttgcttgtggctaggccagcctaggatgtgggttctgtggaggagaggcggggtaatggggaggctgagggcacctcttcactgcccctctccctcaagcctaagacactaagaccccagacccaaagccaagtccaccagagtggctgcaggccaggcctggagtccccgtgggtcaagcatttgtcttgacttgctttcctcccgggtctccagcctccgacccctcgccccatgaaggagctggcaggtggaaataaacaacaactttattaaaaca

SEQ ID NO: 204122 - DNA, 718 bp, Homo sapiens
  Payload ID: 20260
  Gene Name: zinc finger protein-like 1
  ENST ID: ENST00000453524
  CDS Start-End: 153-482
cggagggataatcggggcggccggggctgaagggagaggcgcaggagccctggggagagtggtccctgcccttccgcgcctcgagccatcgctaccgcccttcggaaccagtgcagcggccgatcagtaaacacagagactggggatcgatcatggggctttgtaagtgccccaagagaaaggtgaccaacctgttctgcttcgaacatcgggtcaacgtctgcgagcactgcctggtagccaatcacgccaagtgcatcgtccagtcctacctgcaatggctccaagatagcgactacaaccccaattgccgcctgtgcaacatacccctggccagccgagagacgacccgccttgtctgctatggtgaggccttggcacctcggggggatcaggccagcctcaggggccagcttggtgactggtttccaggccctcctcaagcagcaggacaatctctttcactgggcctgcctcaatgaacgtgctgcccagctaccccgaaacacggcacctgccggctatcagtgccccagctgcaatggccccatcttccccccaaccaacctggctggccccgtggcctccgcactgagagagaagctggccacagtcaactgggcccgggcaggactgggcctccctctgatcgatgaggtggtgagcccagagcccgagcccctcaacacgtctgacttctctgactggtctagtttta

SEQ ID NO: 204123 - DNA, 158 bp, Homo sapiens
  Payload ID: 20260
  Gene Name: zinc finger protein-like 1
  ENST ID: ENST00000530488
  CDS Start-End: 1-158
cgactacaaccccaattgccgcctgtgcaacatacccctggccagccgagagacgacccgccttgtctgctatgattccttcctccagatcgatgaggtggtgagcccagagcccgagcccctcaacacgtctgacttctctgactggtctagtttta

SEQ ID NO: 204124 - DNA, 576 bp, Homo sapiens
  Payload ID: 20260
  Gene Name: zinc finger protein-like 1
  ENST ID: ENST00000526945
  CDS Start-End: 59-576
ccgcccttcggaaccagtgcagcggccgatcagtaaacacagagactggggatcgatcatggggctttgtaagtgccccaagagaaaggtgaccaacctgttctgcttcgaacatcgggtcaacgtctgcgagcactgcctgtgcatcgtccagtcctacctgcaatggctccaagatagcgactacaaccccaattgccgcctgtgcaacatacccctggccagccgagagacgacccgccttgtctgctatgatctctttcactgggcctgcctcaatgaacgtgctgcccagctaccccgaaacacggcacctgccggctatcagtgccccagctgcaatggccccatcttccccccaaccaacctggctggccccgtggcctccgcactgagagagaagctggccacagtcaactgggcccgggcaggactgggcctccctctgatcgatgaggtggtgagcccagagcccgagcccctcaacacgtctgacttctctgactggtctagttttaatgccagcagtacccctggaccagaggaggtagacagcgcctctgctgccccagcctt

SEQ ID NO: 204125 - DNA, 384 bp, Homo sapiens
  Payload ID: 20260
  Gene Name: zinc finger protein-like 1
  ENST ID: ENST00000526791
  CDS Start-End: 80-277
agagtggtccctgcccttccgcgcctcgagccatcgctaccgcccttcggaaccagtgcagcggccgatcagatcgatcatggggctttgtaagtgccccaagagaaaggtgaccaacctgttctgcttcgaacatcgggtcaacgtctgcgagcactgcctggtagccaatcacgccaaggtggggccttcaggggagcgactgagcagggcactgggtgggcaaggcggtattggcttcctccaaatccatgaggggccccgcgctagaatgtaagccccacaagggcaaggacttgatttattttgttcactgatatatcccccgttcccaagagagagtctggtgcacagtatgtgctcaataaatatttattgattaaa

SEQ ID NO: 204126 - DNA, 478 bp, Homo sapiens
  Payload ID: 20260
  Gene Name: zinc finger protein-like 1
  ENST ID: ENST00000525509
  CDS Start-End: 165-362
gagacgtggcagcggagggataatcggggcggccggggctgaagggagaggcgcaggagccctggggagagtggtccctgcccttccgcgcctcgagccatcgctaccgcccttcggaaccagtgcagcggccgatcagtaaacacagagactggggatcgatcatggggctttgtaagtgccccaagagaaaggtgaccaacctgttctgcttcgaacatcgggtcaacgtctgcgagcactgcctggtagccaatcacgccaaggtggggccttcaggggagcgactgagcagggcactgggtgggcaaggcggtattggcttcctccaaatccatgaggggccccgcgctagaatgtaagccccacaagggcaaggacttgatttattttgttcactgatatatcccccgttcccaagagagagtctggtgcacagtatgtgctcaataaatatttattgattaaacaaacgaaa

SEQ ID NO: 204127 - DNA, 692 bp, Homo sapiens
  Payload ID: 20260
  Gene Name: zinc finger protein-like 1
  ENST ID: ENST00000526334
  CDS Start-End: 128-692
ataatcggggcggccggggctgaagggagaggcgcaggagccctggggagagtggtccctgcccttccgcgcctcgagccatcgctaccgcccttcggaaccagtgcagcggccgatcagatcgatcatggggctttgtaagtgccccaagagaaaggtgaccaacctgttctgcttcgaacatcgggtcaacgtctgcgagcactgcctggtagccaatcacgccaagtgcatcgtccagtcctacctgcaatggctccaagatagcgactacaaccccaattgccgcctgtgcaacatacccctggccagccgagagacgacccgccttgtctgctatgatctctttcactgggcctgcctcaatgaacgtgctgcccagctaccccgaaacacggcacctgccggctatcagtgccccagctgcaatggccccatcttccccccaaccaacctggctggccccgtggcctccgcactgagagagaagctggccacagtcaactgggcccgggcaggactgggcctccctctgatcgatgaggtggtgagcccagagcccgagcccctcaacacgtctgacttctctgactggtctagttttaatgccagcagtacccctggaccagaggaggtagacagcgcctctgctgccccagccttctacagccaggccccccggcccccagctt

SEQ ID NO: 204128 - DNA, 413 bp, Homo sapiens
  Payload ID: 20260
  Gene Name: zinc finger protein-like 1
  ENST ID: ENST00000530744
  CDS Start-End: 1-32
ttccaggccctcctcaagcagcaggacagtgagtcccccgagtctcagagcccagattctagtcctgttaaagttccttacctgctgtgtaagttcagatcgatgaggtggtgagcccagagcccgagcccctcaacacgtctgacttctctgactggtctagttttaatgccagcagtacccctggaccagaggaggtagacagcgcctctgctgccccagccttctacagccaggccccccggcccccagcttccccaggccggcccgagcagcacacagtgatccacatgggcaatcctgagcccttgactcacgcccctaggaaggtgtatgatacgcgggatgatgaccggacaccaggcctccatggagactgtgacgatgacaagtaccgacgtcggccggccttg

SEQ ID NO: 204129 - DNA, 518 bp, Homo sapiens
  Payload ID: 20260
  Gene Name: zinc finger protein-like 1
  ENST ID: ENST00000531761
  CDS Start-End: 158-400
ggcagcggagggataatcggggcggccggggctgaagggagaggcgcaggagccctggggagagtggtccctgcccttccgcgcctcgagccatcgctaccgcccttcggaaccagtgcagcggccgatcagtaaacacagagactggggatcgatcatggggctttgtaagtgccccaagagaaaggtgaccaacctgttctgcttcgaacatcgggtcaacgtctgcgagcactgcctggtagccaatcacgccaagatctctttcactgggcctgcctcaatgaacgtgctgcccagctaccccgaaacacggcacctgccggctatcagtgccccagctgcaatggccccatcttccccccaaccaacctggctggccccgtggcctccgcactgagagagaagctggccacagtcaactgggcccgggcaggactgggcctccctctgatcgatgaggtggtgagcccagagcccgagcccctcaacacgtctgacttctctgactggtctag

SEQ ID NO: 204130 - DNA, 802 bp, Homo sapiens
  Payload ID: 20260
  Gene Name: zinc finger protein-like 1
  ENST ID: ENST00000532200
  CDS Start-End: 181-802
gggatttatgcagggggtgtttctccgcataaggagggacagtgggcaggaatctgagatcggggcgaatatgagaggtgtctgggggagttaagagtggaaactgggctggtgagagcgtagtggtggccaccagaacctgacttcctaccaactcatgcccctttcccaggatcgatcatggggctttgtaagtgccccaagagaaaggtgaccaacctgttctgcttcgaacatcgggtcaacgtctgcgagcactgcctggtagccaatcacgccaagtgcatcgtccagtcctacctgcaatggctccaagatagcgactacaaccccaattgccgcctgtgcaacatacccctggccagccgagagacgacccgccttgtctgctatgatctctttcactgggcctgcctcaatgaacgtgctgcccagctaccccgaaacacggcacctgccggctatcagtgccccagctgcaatggccccatcttccccccaaccaacctggctggccccgtggcctccgcactgagagagaagctggccacagtcaactgggcccgggcaggactgggcctccctctgatcgatgaggtggtgagcccagagcccgagcccctcaacacgtctgacttctctgactggtctagttttaatgccagcagtacccctggaccagaggaggtagacagcgcctctgctgccccagccttctacagccaggccccccggcccccagcttccccaggccggcccgagcagcacacagtgatccacatgggcaatcctgagcccttga

SEQ ID NO: 204131 - DNA, 4738 bp, Homo sapiens
  Payload ID: 20261
  Gene Name: zinc finger RNA binding protein
  Uniprot ID: Q96KR1
  ENST ID: ENST00000265069
  CDS Start-End: 104-3328
agtgcggtcggaggcggcggtctgttctccgctgaggaggagcggggcagaggagggaggcagcgggtgagagttcagagttcagcagcagcagcccgagcccatgattcccatatgccctgtagtttctttcacctatgtgcccagccggctgggggaagatgccaaaatggcgaccggcaactactttggattcacccacagcggggcggcggcggcggcggctgcggcccaatatagccagcagccagcttcgggtgtagcctattctcatccaactacagttgctagctacactgtccatcaggctccagtagctgctcacacagttactgctgcctatgcaccagcagccgccacagttgcagttgccaggcctgctccagtagctgttgcagctgctgcaacagctgctgcttatggaggctaccccactgcacacacagcaactgactatggttatactcagaggcaacaagaagcaccaccaccaccacccccagctactacacaaaactaccaggattcatactcatatgtaaggtccacagctcctgctgtagcttatgatagtaagcaatactaccaacaaccaacagcaactgctgctgctgtagctgccgctgcccaacctcagccttctgttgctgaaacttactatcagacagcccccaaagcaggttacagccaaggtgcaactcagtatactcaagcccagcaaactcgacaagtgacagccataaaaccagccacaccaagtccagctaccactactttctccatctatcctgtatcctccaccgtacagccagtagcagctgcggctactgtggtgccatcctatactcagagtgctacttacagtaccacagcagttacatattctggtacgtcttattcaggttatgaagcagcagtgtattcagctgcatcttcctactatcaacagcagcagcagcaacagaagcaggcagcagcagcagctgctgctgctgctgcaacagctgcctggacagggaccacctttactaaaaaagcaccattccaaaataaacaactgaaaccaaaacagcctcccaaaccaccacagattcactattgtgatgtttgtaagatcagctgtgctggaccacagacttataaagaacatttagaaggacagaaacataaaaaaaaagaagctgcattgaaagcctcacaaaataccagcagcagcaacagttctactcgtgggactcaaaatcagctacgttgtgagctctgcgatgtgtcttgtacaggagcagatgcgtatgctgcccacattcgtggtgctaagcatcagaaagtggttaagttacacacaaaacttggtaaacccattccatcaacagaaccaaatgttgttagccaagctacttcttcaacagctgtatctgcttcaaagccgactgcctctccttcaagcattgcagcaaacaattgtactgtgaatacgtcatcagttgcaacgtcttcaatgaagggtcttacgactacaggaaactcgtctcttaatagcacatctaacactaaagtatcagcagtgcctacaaatatggctgccaagaaaacatctacccccaaaataaattttgttggtggtaataagctgcagtcaacaggaaataaagcagaagacataaaaggaaccgaatgtgttaaaagtactcctgtcacttctgctgtgcagattcctgaagtaaagcaagacacagtgtcagaaccagtcacacctgcatctcttgctgctttacagagtgatgtgcagccagtgggccatgattatgtggaagaggtacgaaatgatgaaggaaaagtaattcggttccattgtaaattatgcgagtgcagctttaatgatcccaatgctaaggagatgcacttaaaagggcgaagacacagacttcaatataaaaaaaaagtaaatccagatttgcaagtagaagtaaagcctagtattcgagcaagaaagattcaagaagagaaaatgaggaagcaaatgcagaaggaggagtactggcgaagacgagaagaagaggagcgttggagaatggaaatgagacgttatgaagaggacatgtactggaggagaatggaggaagaacaacatcattgggatgatcgccgccgaatgccagatggaggttatcctcatggtcctccaggcccattaggccttctgggagtccgaccaggcatgcctcctcagcctcaggggcctgcacccttacgtcgtcctgactcatctgatgaccgttatgtaatgacaaaacatgccaccatttatccaactgaagaggagttacaggcagttcagaaaattgtttctattactgaacgtgctttaaaactcgtttcagacagtttgtctgaacatgagaagaacaagaacaaagagggagatgataagaaagagggaggtaaagacagagctttgaaaggagttttgcgagtgggagtattggcaaaaggattacttctccgaggagatagaaatgtcaaccttgttttgctgtgctcagagaaaccttcaaagacattattaagccgtattgcagaaaacctacccaaacagcttgctgttataagccctgagaagtatgacataaaatgtgctgtatctgaagcggcaataattttgaattcatgtgtggaacccaaaatgcaagtcactatcacactgacatctccaattattcgagaagagaacatgagggaaggagatgtaacctcgggtatggtgaaagacccaccggacgtcttggacaggcaaaaatgccttgacgctctggctgctctacgccacgctaagtggttccaggctagagctaatggtctgcagtcctgtgtgattatcatacgcattcttcgagacctctgtcagcgagttccaacttggtctgattttccaagctgggctatggagttactagtagagaaagcaatcagcagtgcttctagccctcagagccctggggatgcactgagaagagtttttgaatgcatttcttcagggattattcttaaaggtagtcctggacttctggatccttgtgaaaaggatccctttgataccttggcaacaatgactgaccagcagcgtgaagacatcacatccagtgcacagtttgcattgagactccttgcattccgccagatacacaaagttctaggcatggatccattaccgcaaatgagccaacgttttaacatccacaacaacaggaaacgaagaagagatagtgatggagttgatggatttgaagctgaggggaaaaaagacaaaaaagattatgataacttttaaaaagtgtctgtaaatcttcagtgttaaaaaaacagatgcccatttgttggctgtttttcattcataataatgtctacattgaaaaatttatcaagaatttaaaggatttcatggaagaaccaagtttttctatgatattaaaaaatgtacagtgttaggtattatttgaatggaaagacacccaaaaaaaaaaatgtgctccgactagggggaaaacagtagttccgattttttcccattatttttattttattttctggttgccctagcttccccccctatttttgtgtcttttattaactagtgcattgtcttattaaatcttcactgtatttaatgcaggatgtgtgcttcagttgctctgtgtattttgatattttaatttagaggttttgtttgctttttgacactagttgtaagttactttgttatagatggtatcctttaccccttcttaatattttacagcagtacgtttttttgtaacgtgagactgcagagtttgtttttctatatgtgaaggattacaacacaaaaagttatcctgccattcgagtgctcagaactgaatgtttctgcagatcttgtggcatttgtctctagtgtgatatataaaggtgtaattaagacagagttctgttaatctaatcaagtttgctgttagttgtgcattagcagtataaaagctaatatatactatatggtcttgcaacagttttaaagcctctgcataattgataataaaaatgcatgacattcttgtttttaatagacttttaaaatcataattttaggtttaacacgtagatctttgtacagttgactttttgacatagcaaggccaaaaataactttctgaatatttttttcttgtgtataagtggaaagggcatttttcacatataagtgggctaaccaatattttcaaaagaacttcatcattgtacaactaacaacagtaactagcccttaattatggtgacagttccttattggtgtgtgtgagattactctagcaactattacagtataacacagatgatcttctccacacaccccatcacccagataatttacagttctgttaacagtgaggttgataaagtattactgataaaaaattatctaaggaaaaaaacagaaaattatttggtgtggccatcttacctgcttatgtctcctacacaaagctaaatattctagcagtgatgtaatgaaaaattacatcttactgttgatatatgtatgctctggtacacagatgtcattttgttgtcacagcactacagtgaaatacacaaaaaatgaaattcatataatgacttaaatgtattatatgttagaattgacaacataaactacttttgctttgaaatgatgtatgcttcagtaaaatcatattcaaattta

SEQ ID NO: 204132 - DNA, 1140 bp, Homo sapiens
  Payload ID: 20261
  Gene Name: zinc finger RNA binding protein
  ENST ID: ENST00000507465
  CDS Start-End: 1-547
gggagtccgaccaggcatgcctcctcagcctcaggggcctgcacccttacgtcgtcctgactcatctgatgaccgttatgtaatgacaaaacatgccaccatttatccaactgaagaggagttacaggcagttcagaaaattgtttctattactgaacgtgctttaaaactcgtttcagacagtttgtctgaacatgagaagaacaagaacaaagagggagatgataagaaagagggaggtaaagacagagctttgaaaggagttttgcgagtgggagtattggcaaaaggattacttctccgaggagatagaaatgtcaaccttgttttgctgtgctcagagaaaccttcaaagacattattaagccgtattgcagaaaacctacccaaacagcttgctgttataagccctgagaagtatgacataaaatgtgctgtatctgaagcggcaataattttgaattcatgtgtggaacccaaaatgcaagtcactatcacactgacatctccaattattcgagaagagaacatgagggaaggaggctagagctaatggtctgcagtcctgtgtgattatcatacgcattcttcgagacctctgtcagcgagttccaacttggtctgattttccaagctgggctatggagttactagtagagaaagcaatcagcagtgcttctagccctcagagccctggggatgcactgagaagagtttttgaatgcatttcttcagggattattcttaaaggtagtcctggacttctggatccttgtgaaaaggatccctttgataccttggcaacaatgactgaccagcagcgtgaagacatcacatccagtgcacagtttgcattgagactccttgcattccgccagatacacaaagttctaggcatggatccattaccgcaaatgagccaacgttttaacatccacaacaacaggaaacgaagaagagatagtgatggagttgatggatttgaagctgaggggaaaaaagacaaaaaagattatgataacttttaaaaagtgtctgtaaatcttcagtgttaaaaaaacagatgcccatttgttggctgtttttcattcataataatgtctacattgaaaaatttatcaagaatttaaaggatttcat

SEQ ID NO: 204133 - DNA, 4756 bp, Homo sapiens
  Payload ID: 20262
  Gene Name: zinc finger RNA binding protein 2
  Uniprot ID: Q9UPR6
  ENST ID: ENST00000262961
  CDS Start-End: 12-2831
aagacgccaagatggcgacgagtcagtatttcgacttcgcgcagggcggcggcccgcagtacagcgcccagcctccgacccttcccctgcccactgtgggggccagctatactgcacaacccactcctgggatggaccctgccgtgaacccggcctttcccccagctgccccggcagggtacggtggataccagccccactccggccaggacttcgcctacggcagccgaccccaggagcccgtccccacggccaccaccatggctacctaccaggacagttacagctacggacagtcagcagctgccaggagctatgaggacaggccgtacttccagtctgctgccctccagtctgggcgcatgacagccgcagactccggccagccagggacccaagaagcctgcgggcagcccagcccccatggcagtcacagccacgctcagcccccacagcaggcgcccatagtggagtccggacagccagcgagcaccttgtcctcgggatacacctaccccacggcgacaggcgtccagcccgagtcgtcagcttccatcgtgacctcctaccccccgccctcctacaaccccacctgcaccgcctacacggcaccaagctacccgaactatgacgcgtcggtgtactccgctgccagccctttctatcctccagcgcagcccccgcctcccccgggacccccgcagcagctgcccccgccgcccgcgcctgcaggctcaggaagcagccccagggccgactcgaagccaccgcttcccagcaagctgccgagacccaaggcggggcccaggcagctccagcttcactactgcgacatctgcaagatcagctgcgctggcccccagacctaccgggaacatctgggagggcagaagcacagaaagaaggaggcggcccagaagacaggcgtgcagcccaacgggagcccgcgcggggtgcaggcgcagctgcattgcgacctgtgcgccgtgtcctgcaccggggcggacgcctacgcggcccacatccggggatccaagcaccagaaggtcttcaagctgcacgccaaactggggaagcccattcccaccctcgagcctgcactggccacagagagcccccccggggcagaggccaagcccacgtcccccactggccccagcgtgtgtgcctcgagcaggccagcgctggccaagagacccgtggcctcgaaggccttatgcgaggggcctcctgagccacaggcagcaggctgcagaccccagtgggggaaaccagcccaacctaaattagagggtcccggagcacctacccaaggaggctcaaaggaagctcccgcgggctgctctgatgcgcagccggtgggcccggaatatgtggaggaggtgttcagcgacgaagggcgagtgcttcgcttccactgcaagctgtgcgagtgcagtttcaacgaccttaacgcgaaggacctgcacgtgagggggcggcggcaccggctgcagtaccggaagaaagtgaacccggaccttcccattgccacggagcccagcagccgggctcggaaggtcctggaggagcgcatgaggaagcagcggcacctggcggaggagcggctggagcagctgcggcgctggcacgcggagaggaggcggctggaggaggagccaccccaggacgtgccgccccacgcgccgcccgactgggcccagcctctgctcatgggcaggccggagtcacccgccagcgccccactccagcccgggcggcggccggcgtccagcgacgaccggcacgtcatgtgcaagcacgccaccatctaccccacggagcaggagctcctggccgtgcagagggccgtgtcccacgcagagcgggccctcaagctggtgtccgacacactggccgaggaggaccggggccgccgagaggaagagggtgacaagcgcagcagcgttgccccccagactcgggtcctgaaaggcgtcatgcgagtaggcatcctggcgaaaggcctcctcctgcgtggggacaggaacgtgcgcctcgctctgctctgctccgagaagcccacgcacagcctgctgcggaggatcgcccagcagctgccccggcagctccagatggtgaccgaggatgagtatgaggtctcctccgaccctgaagccaacattgtcatctcctcctgtgaggagcccaggatgcaggtcaccatatctgtcacctcacctctgatgcgggaggacccctccacagacccaggtgtggaggagcctcaggctgatgcaggtgatgtcctgagccccaagaagtgcctcgagtccctggccgccctccgtcatgccaggtggtttcaggctcgagccagcggcctgcagccatgcgtgatcgtcatcagggtcctgagggacctctgccggcgtgtgcccacctggggggccctgccagcctgggccatggagctgctggtggagaaggctgtgagcagtgcggctgggcccctgggccccggggatgcagtcaggcgagtcctggagtgcgtggccacagggacgctcctgacagacgggcccgggctccaggatccctgcgagagagaccagacagatgccctcgagcccatgaccctccaagagcgggaagacgtgaccgccagcgcccagcacgccctgcgaatgctggccttccggcagacccacaaggtcctgggcatggatctcctgccgcccagacaccggctgggggcccgcttccggaagaggcaacggggacctggcgagggagaggagggcgcaggggagaagaagcggggccggcggggcggagaggggctcgtgtgagccgcctacctcccccacctgcgggcctttgcatccctgcactcctggacgtgtgcgcgccgaccaatggctgcttcatccccgacgttggacaatggtcatttccttttgagtaacgctctgtaggtttcctttaaaacacctgtgcttcagaccgggcactgtggctcatgcctttaatcccagcactttgggaggctgagttgcttgagcctgagagttcaaggccagcccagacaacagagtgagacccccatctctccaaaatatttttaaaaatcagcttggcatggttggtggccaggcgcggtgattcacgcctgtaatcccagcactttgagaggccgaggtgggcagatcgcctgaggtcaggagttcgagaccggcctggtcaacatggtgaaaccctgtctctagtaaaaaacacaacaattagcctggcgtggtggtgtgcacctgtagtcccagctacttgggaggctgagtccggagccttgaggccaggagggcagtgagctgtgattgcaccgtgacactccagcctgggcaacagaagaagactttgtcacttaaaagaaatgttttttaacatttgtgcttaaattgttacagaaatgacaccatccagccctgggagtggcaccccttcctcgagggccccatcccccacagccaggggggccagcagtacagcaagcagattctaaactcgggggcatcttgctggctctaaactcacctcgtggtacaggaaggggttttaaaatacttcctctgggctgcgcatggtggctcacacctataatcccagcactttgggaggccaagcttggtggatcgcttgagcccagcggtttaagatcagtctgggcaatatggtgacaccccatctctacaaaaaattagccagttgtggtggcccaagcctgtagtcccagctactcgggaggctgaggccgtaggatcccttgagcccaggagttcgaggctgcagcgagccgagattgcgctactgaactccagcctgggttacagagcgagaccctgtctcaaagaaacaaacaaacaaacaaacaaacaaacaaaactttctttggatgcggctgcggcatggatttgaaatcacgtgggcaggccctgttctggggccccaccacatgtgcaggacaagcccaggggagctcccagccggcatccccacgcccccagcccagcctgctccaaacagaccccccacccacctccacagccaggatgtcagcagggcctgagccaggctcgtcccctgtggggagagccacagggccaggtggacacgccgacgggcgatgaggatcctggctgggcctcccccgggaacagctgtgctggacagtcagacccggagcccagaggcacccccacccaccccccgccccgagccctgtaccactgagtgcctttcacagagaaaacccactctgccatgtgtcactgaggcctggatttgagcttccgtccttccttcctccctctctccctgatgtaggccttggctggccctgaggcagggggtccccaatccccccttgtggtagcagggcccgggacccgtgcctgggggacccggggaggggccgccgtcttgtggatgctggccatggtgggcaggcgcctcctggcactgatggatgtgggggcacccccttctgagtccccaccccaacctgttcaaaccttccgcttggtcagtttttttttctttggccagctgcccagtggcattgaatgagaaaagtccacctttgggcagatgtgatctccagccagtggctcagttttgtttctctgtgtttgaaggacagcctgcatgtggctctgtctgaatgtctttgtagagctacctggaaattgggaggcagggggaataaaggaaatcatttgtc

SEQ ID NO: 204134 - DNA, 870 bp, Homo sapiens
  Payload ID: 20262
  Gene Name: zinc finger RNA binding protein 2
  Uniprot ID: Q9UPR6
  ENST ID: ENST00000439086
  CDS Start-End: 16-228
ggggaagacgccaagatggcgacgagtcagtatttcgacttcgcgcagggcggcggcccgcagtacagtccagaagtggagaccactcccccggcccttgcatctgggcttccttgtgccctgccttggacagttggctgcagtggaagtgacgctgtgactgccctgtgcccaagcttaagaggccttgcctgcatctgctccatcttatgggaccctgcctggtgaaggacccaaggctggcctgctggaggaggagatataaggagaagagtcacagtgccccatccaacaggtagctgccctccaggggcagagaagcccagccatggtcaggagagccacccagctgaggcccacctccaccaggattgccacccagctgaaccccacctcagccaggagagccacccagctgagccccatctggccaggagagccatccagctgagccccacctctgccaggattgccacccagctgagccccgccttggccaggagagccacccagctgagccccgcctgggccagaagagccacccagctgagccccgccttggccagaagagccacccagctgagcaccgccttggccagaagaggcacccagctgagccccgcctggccaggagagctgcccagctgatccccgcctgcagaatcacaagtgaaataaatgattgttgctttgagtcagaggtcagcggaccttttctgtaaaaagccacatagtaaatatctttggctttgtgagccacaccatgtctgtcacattagtgaaccctgctattgtattgcaagatgagccgtggacaatgtgtcatccagtgggcttggctgtgtgccaataaaactttatttttttgga

SEQ ID NO: 204135 - DNA, 1377 bp, Homo sapiens
  Payload ID: 20262
  Gene Name: zinc finger RNA binding protein 2
  Uniprot ID: Q9UPR6
  ENST ID: ENST00000438164
  CDS Start-End: 12-1112
aagacgccaagatggcgacgagtcagtatttcgacttcgcgcagggcggcggcccgcagtacagcgcccagcctccgacccttcccctgcccactgtgggggccagctatactgcacaacccactcctgggatggaccctgccgtgaacccggcctttcccccagctgccccggcagggtacggtggataccagccccactccggccaggacttcgcctacggcagccgaccccaggagcccgtccccacggccaccaccatggctacctaccaggacagttacagctacggacagtcagcagctgccaggagctatgaggacaggccgtacttccagtctgctgccctccagtctgggcgcatgacagccgcagactccggccagccagggacccaagaagcctgcgggcagcccagcccccatggcagtcacagccacgctcagcccccacagcaggcgcccatagtggagtccggacagccagcgagcaccttgtcctcgggatacacctaccccacggcgacaggcgtccagcccgagtcgtcagcttccatcgtgacctcctaccccccgccctcctacaaccccacctgcaccgcctacacggcaccaagctacccgaactatgacgcgtcggtgtactccgctgccagccctttctatcctccagcgcagcccccgcctcccccgggacccccgcagcagctgcccccgccgcccgcgcctgcaggctcaggaagcagccccagggccgactcgaagccaccgcttcccagcaagctgccgagacccaaggcggggcccaggcagctccagcttcactactgcgacatctgcaagatcagctgcgctggcccccagacctaccgggaacatctgggagggcagaagcacagaaagaaggaggcggcccagaagacaggcgtgcagcccaacgggagcccgcgcggggtgcaggcgcagctgcattgcgacctgtgcgccgtgtcctgcaccggggcggacgcctacgcggcccacatccggggatccaagcaccagaagggcctcctgagccacaggcagcaggctgcagaccccagtgggggaaaccagcccaacctaaattagagggtcccggagcacctacccaaggaggctcaaaggaagctcccgcgggctgctctgatgcgcagccggtgggcccggaatatgtggaggaggtgttcagcgacgaagggcgagtgcttcgcttccactgcaagctgtgcgagtgcagtttcaacgaccttaacgcgaaggacctgcacgtgagggggcggcggcaccggctgcagtaccggaagaaagtgaacccggaccttcccattgccacggagcccagcagccgggctcg

SEQ ID NO: 204136 - DNA, 1019 bp, Homo sapiens
  Payload ID: 20262
  Gene Name: zinc finger RNA binding protein 2
  ENST ID: ENST00000586578
  CDS Start-End: 1-133
ggcgacgagtcagtatttcgacttcgcgcagggcggcggcccgcagtacagcaccctcctggaggacgggactttggtctggttattccccgctgctgtgacagcgcccatgacagcagctggtccccactagcacccaggaagtatttatccaatgactcaatgaatctgccgccggatcgcccgggactgctttcactttctgtcagtccagaagtggagaccactcccccggcccttgcatctgggcttccttgtgccctgccttggacagttggctgcagtggaagtgacgctgtgactgccctgtgcccaagcttaagaggccttgcctgcatctgctccatcttatgggaccctgcctggtgaaggacccaaggctggcctgctggaggaggagatataaggagaagagtcacagtgccccatccaacaggtagctgccctccaggggcagagaagcccagccatggtcaggagagccacccagctgaggcccacctccaccaggattgccacccagctgaaccccacctcagccaggagagccacccagctgagccccatctggccaggagagccatccagctgagccccacctctgccaggattgccacccagctgagccccgccttggccaggagagccacccagctgagccccgcctgggccagaagagccacccagctgagccccgccttggccagaagagccacccagctgagcaccgccttggccagaagaggcacccagctgagccccgcctggccaggagagctgcccagctgatccccgcctgcagaatcacaagtgaaataaatgattgttgctttgagtcagaggtcagcggaccttttctgtaaaaagccacatagtaaatatctttggctttgtgagccacaccatgtctgtcacattagtgaaccctgctattgtattgcaagatgagccgtggacaatgtgtcatccagtgggcttggctgtgtgccaataaaactttatttttttggacactgaaa

SEQ ID NO: 204137 - DNA, 493 bp, Homo sapiens
  Payload ID: 20262
  Gene Name: zinc finger RNA binding protein 2
  ENST ID: ENST00000587212
  CDS Start-End: 13-147
gaagacgccaagatggcgacgagtcagtatttcgacttcgcgcagggcggcggcccgcagtacagcaccctcctggaggacgggactttggtctggttattccccgctgctgtgacagcgcccatgacagcagctggtccccactagcacccaggaagtatttatccaatgactcaatgaatctgccgccggatcgcccgggactgctttcactttctgtcagcgcccagcctccgacccttcccctgcccactgtgggggccagctatactgcacaacccactcctgggatggaccctgccgtgaacccggcctttcccccagctgccccggcagggtacggtggataccagccccactccggccaggacttcgcctacggcagccgaccccaggagcccgtccccacggccaccaccatggctacctaccaggacagttacagctacggacagtcagcagctgccaggagctatgaggacaggccgtactt

SEQ ID NO: 204138 - DNA, 364 bp, Homo sapiens
  Payload ID: 20262
  Gene Name: zinc finger RNA binding protein 2
  ENST ID: ENST00000591712
  CDS Start-End: 143-349
tgaccccgtgtctccctggactatcgcgcagcaccctcctggaggacgggactttggtctggttattccccgctgctgtgacagcgcccatgacagcagctggtccccactagcacccaggaagtatttatccaatgactcaatgaatctgccgccggatcgcccgggactgctttcactttctgtcagtccagaagtggagaccactcccccggcccttgcatctgggcttccttgtgccctgccttggacagttggctgcagtggaagtgacgctgtgactgccctgtgcccaagcttaagaggccttgcctgcatctgctccatcttatgggaccctgcctggtgaaggacccaaggctgg

SEQ ID NO: 204139 - DNA, 532 bp, Homo sapiens
  Payload ID: 20262
  Gene Name: zinc finger RNA binding protein 2
  ENST ID: ENST00000592398
  CDS Start-End: 233-439
gccaagatggcgacgagtcagtatttcgacttcgcgcagggcggcggcccgcagtacaggtgcagtgactcctgcctgtaatccagcactttggaaggccgaggtggacggatcacttgagcaccctcctggaggacgggactttggtctggttattccccgctgctgtgacagcgcccatgacagcagctggtccccactagcacccaggaagtatttatccaatgactcaatgaatctgccgccggatcgcccgggactgctttcactttctgtcagtccagaagtggagaccactcccccggcccttgcatctgggcttccttgtgccctgccttggacagttggctgcagtggaagtgacgctgtgactgccctgtgcccaagcttaagaggccttgcctgcatctgctccatcttatgggaccctgcctggtgaaggacccaaggctggcctgctggaggaggagatataaggagaagagtcacagtgccccatccaacaggtagctgccctccaggggcagagaag

SEQ ID NO: 204140 - DNA, 9418 bp, Homo sapiens
  Payload ID: 20263
  Gene Name: zinc finger with KRAB and SCAN domains 1
  Uniprot ID: P17029
  ENST ID: ENST00000324306
  CDS Start-End: 235-1926
acgcttccggcctttgtgactcattgtgtctgtgtcgaggcgtcgggagggcctaagtccgtgtgcggtgcccttcggccggcctgagccccagagtcagctcccctttctcgcccagcgcccccaggccgctcccggggctcacggaatagtaaagaaacacatcataaaacctcccaggacataaaggtgagcacagaccctgtttggatcaagtcagttcctggagcctgaatgatgactgctgaatcacgggaagccacgggtctgtccccacaggctgcacaggagaaggatggtatcgtaatagtgaaggtggaagaggaagatgaggaagaccacatgtgggggcaggattccaccctacaggacacgcctcctccagacccagagatattccgccaacgcttcaggcgcttctgttaccagaacacttttgggccccgagaggctctcagtcggctgaaggaactttgtcatcagtggctgcggccagaaataaacaccaaggaacagatcctggagcttctggtgctagagcagtttctttccatcctgcccaaggagctccaggtctggctgcaggaataccgccccgatagtggagaggaggccgtgacccttctagaagacttggagcttgatttatcaggacaacaggtcccaggtcaagttcatggacctgagatgctcgcaagggggatggtgcctctggatccagttcaggagtcctcgagctttgaccttcatcacgaggccacccagtcccacttcaaacattcgtctcggaaaccccgcctcttacagtcacgagctcttcctgctgcccacattcctgcaccccctcatgagggtagtcccagagaccaggcgatggcatctgcactattcacagcggattcccaggcaatggtgaagatcgaggacatggctgtgtccctcattctggaggaatggggatgtcagaatctggctcggaggaatctcagtagggacaacaggcaggagaattatgggagcgcatttccccagggtggtgaaaacaggaatgagaacgaggagtcaacctcaaaggctgaaacctcggaagattcagcatcacgcggggagacaacaggaagatcccagaaagagtttggagagaaacgtgaccaggagggcaaaacaggagaaagacagcagaaaaaccctgaggagaaaaccaggaaagagaaaagagattcagggccagctataggaaaggacaaaaaaaccatcacaggagagagaggtccaagggagaaggggaaaggattgggaagaagcttcagtctgagctccaacttcaccacccctgaagaagttcccacgggaacaaagtctcacagatgtgatgaatgtggtaaatgcttcacgagaagttcaagccttatccgccataaaataatccacactggagaaaagccctatgaatgtagtgagtgtgggaaagccttcagtcttaactccaaccttgtcctgcatcagaggatccacacaggagagaaacctcatgaatgtaacgagtgtggcaaggccttcagccacagttccaatctcatcctccatcagcgcatccactctggagagaaaccttatgaatgtaatgagtgcgggaaggccttcagccagagctcggacctcaccaagcatcagagaattcacacgggggagaaaccctatgaatgtagtgaatgtggaaaagctttcaaccgaaactcatacctgattttgcatcggagaattcacactcgagaaaagccctacaagtgcactaagtgtggcaaggccttcacccgcagctccaccctcactctgcatcacagaatccatgccagagagagagcctctgagtacagcccagcctcccttgatgcatttggcgcgttcctgaaaagttgtgtgtaaaggaagaatttgccatcaagccatttcccccttttgtttctaaaattatttcagagatgtgtgctcctggagggaaaaagaaatacagcctcaacagattaaaaaacaaaagtcacacttaaggatccttctagtcacatcagcagtgttctgcctttatgtagtagttgggcatataatccttccacacagcccctgcagggaaaggctaatcttacggataatccacgtgagatttccacacaagagaaaagcacacgcatagtgaaatgtcagtcttttcagtaatgaggatacctttaaggcactcttggactctcggcaaccacaacataatagttgaaagatcaagattggctccacgaaagtgatacggaggttaggatgctacttgctgcaaacaagccctactttggccaacatcctgcttatttctcaaaaaagagggacagtgaaaacaaaaacgacattgggacatgctgctcaaggtagttatatatacgataagttgtatatatgatcactggtagcctaccaaagctgtagaaatctaggactgtgctaatcagtatcaaaccaaagatttctatctcttcccgaaagagagggtatgtgcaccagtctacagttccaaaggactgcaacaaatgtagatggttctgtcctcatccctgagatcagttctactgaaatggcaacaacaactccaaatacatctctcccttcttgaaatccctaaagcactatcgcactcctaaatgcatttctccacaagttagcacttgattgtatactgtcttttaatccttcattgtttcatgtatgaagtttttaatcaccccctaacccccaaaaaagattcggttgtcaagggatatatttctatccctgccagcacagtgctggacatagtgagtactgaacacctaagaggcactcattcagactgacttctacaggacttctacgtgtgtgataaaagcctgtgaatcgtgagtccctgaaatatggtagcctggcccagcttctaaagaggaccttcgtagccacaaggcatgctaaacctctagggtctgatgctgtttttgttccaaatataaacgaaaggcactagtcagccgcctgcatagactttctaaacagtgagtaaataccatggaatgtcagaaatgactttatcatcgtcatcttgaagaaaaatatgaacactgatgaaggtcattttttttttttgacatctttctgtggcaaagctcttagaattctttgcagttagctgctgaacagtatgatgatttggggattttctgaatcatttgtacttagatactggagttcagaagatgtgatttttgttgcttttcagaaaaaggaacgtggtagggagtgttttttcccacgcttttccagtaactttgcaaaagcattaattgttcactggcaattactaaatgtattttgttgctctgagaaactcagcagtgtactgagatgtggctggctgtgccatcgtcatagtgcacagtgacttttctgtttcttatcactaaagactgaggtgaggttatgaaactttcattggtcccatcgttgtgcgcagggtgcaactggctacctagaagctgatggcaggagactgtttcacacacaggagattgtgagctgtgtaagtagtcatcgccactcaagtaggacaagggtcctacccaaggctaggaccgccctgcggaaacagaaacatagactgagaacaaacctcaagactatcagtgtgacctccccataacaagagaaccccatatatagtttgagactttcccttgagaaacttatactaaaactattactcatcagtcattcactgatcagcagctaaagtccatgagaccaaatggttttatatggaaccaacgaagtgggagctaaaactgcacagtggtcattctttggcctctccttggctttatgacttaaaccaactacaacttccctatagcttctaagcagtttcatcagcattacttgggaaaacgtgttgcaagtcaaccagtcactaggatatttctacccatgcaacggaagaaaaacccattactccagaagagtatatctaagtaactaaaatggaggcagaaaatgttttaaggattttcttcaaagaataagccacagcaatggttttgtagaaaactcctgtgcttttgagcaaggacttttgccctctagaaagcaactgaggccaggtgcggtggctcacgcctgtaatcccagcactttgggaggccgaggtgagcggatcacctgaggtcaggagttttgagaccagcctggccaacatggtaaaatcccgtctctactaaaattataaaaattagccgggcatgatggtgggcacctgtaatcccagctacttgggaggctgaggcaggagaatcacttgaacccaggaggcagaggttgcagtgagccaagattgcacactgcactccagcctgggtgactagcaaaactccatctcaaaaaaaaaaaaaagaaagaaagaaactgaaaagtgaggtgtggaactccaggcaacgacccaagcacttattttttaagagggaaaggactttggtcatgtttacattggcctttggtttttttttttctttcagccacaactatatgctgatataactcagccatcacttttgagttttgtttttaaatgaaggttaaatgtgacctgtgccctcacatttaattccgtttcatggagacatcttcctgactttgttggatagctgccactagggttgcttcgatcttcagccacatgctgtccttgaagcagctatttgaagatgtgttttctgaggaaaacaggctacaactgtttattaaaaccacttgcagtgcattcgtttatcagatgctcagtgcaaagtgtaattgggtcatggtcaaaaacgcttgcaacatctaattggcgttcaagatagtcattcaaaagttcttggcccgctgaagtctgttaacagttgaaacattctacagttaaccattagcatgctagttgtcctaatggaaatttttgaagagtttttcaatatataccctacccttgccaggaagagaagtaaaatcctcaggttgtggggtatttgtttctactccagcctggcaggcaaggctaaaacctgagattatcgatctatgagacatcttgatatgtaaagcacttaatattaaaggcataaaagtgaaactgctaaatatgtatagagaggttgacgtgtgatacgtgggacagttcacatagacatcagagaatttattccagaaaggagcctcctgaatgtgatgaatacggcaaagcctttaatcacatctcagcccttagcatcggaaagcttatactgtaaataaacttgatgaatattatatgtgaggaaaactttcatgtatagcactcattgcttcagacagaaaatgaattccgtcggtatgttccaatcgtgatgaatttgagaaacattgcaagagggagctcaatcttggccgggcgccgtggctcacgcctgtaatcgcagcactttgggaggccgaggcaggcggatcacgaggtcagtagttcgagaccagcctggccaacatggtgaaaccttgtctctactaaaaatacaaaaaaaaattagctgggcacagtggcgcacgcctgtagtcccagctactcgggaggctgaggcaggagaatggcttgaacctgcgaggcggaggttgcagtgagctaagatcatgccactggcactccagccttgagtgacagagcgaggctctgtatcaaaaaaaaaagttgcgggggggtgctcaatcttaactgcagaggatctacagatgaaaaaaaatgtggggaaatgctttaaaaaaatagcaaaatgtgcaacttcttacaaaaattgttaacgttaggtacttctatatattttatatgaccataatgtccgtgtgtgttttgtaccttcagtcccttgttattgttccgtatattacctgtaagcagatactgtattttattttagcctatttgacagaacacatcactcagaaaaagtgaagtttcagagcaaacagtgaagaaatcagtgtgattgtagacaaaaagtcggttcacagaacggagcagcggggagaggaagggaaaagcttcatagtttggtgcttatcacatcaagagattggtaaatttctgaggaaagacaggctaatggggcactgaaatggaacaactcctttaaacgtgcagccttttgaatttttcctcaaaaccaagaagttgacctctgagctgtcaggtgaccactgtgtgcaaaggggatggattctcttgtcagtagacggtcttctccatgaagcgagagtaggaagtgtactggaatggccaagtgggactgcttcagctgaccaggttcttttaaaccgtagtcatgctttcccactaactcttaaatccttatgcttagaaaattgaggataaggctgggcacagtggctcaggcctgtaatcccagcactttgggagaccaaggcgggtggatcacaaggtcaggagatcgagaccatcctggctaacatggcgaaaccccgtctctactaaaaatacaaaaaaatagctgggcgtggtggcgggcgcctgtagtcccagctactcaggaggctgaggcaggaggatcacttgaacatgggaggcggaggttgcagtgagccaagatggcgccactgcactccagcctgggtgatggcgtgagactccatgtcaaaaaaaaaaaaaaggttggggggaggataggactggccaggcacggtggctcactcctgtaatctcagcactttgggaggcagaggtgggcggatcacttgaggtcaggagtttgagaccagcctggccaacgtggtgaaagcctgtctctactaaaaatacaaaaattagccgggcgtggtggtgggcgcctgtagtcccagctactcaggaggctgaggcaggagaatcacctaaatctgggaggcagaggttgcagtgagccgagattgcaccactgcactccagcctgggtaacagagactctgtctcaaaaaaagaaaaaaaaaaaagaaagaaagaaagaaaattggggataggagaacagcaaggtgggcatttcccggaattgtgtgcagatgcatccagtcgtggcattgcaagaagtctgtctgatgaagctcgggaagcattttgcaatattccctttggctgtgttcctgtgttccctgctcccacttttcttcccctggtttgtgattattaggagagaggttttgcaaagactcgttgctgtgaaagaatctttttttaatttttatcctagagtcagtcacttttattccaggtagtcatgctgatctgcttatccaaagccagctaaccaggttcatcctaccatcctcatggaagactgtgtgtatgaattggagtaacagaactgaaatacacttaaacagtgacagcagtacttcccagggtgggggccatatttctctgtgtcctactctgagcaacttctcagagatacgagggggctagggttttcccatctgggaaatggggtgaaagtctgcagattgttaaatgaaatatagaatcagagaaaaagaaaagtcagtgatataaatagatcatttcatagaaattagggtagatttttatttcaactactactggagaatttaataaaaggcattatttgaaaagtttttctaacatagatttagggtttttttttttagagtggacacactacatttaaaagcaattattttgctattcagattttttattatctgaaaatgaaattatctgttttacttttcaaagctttgtgaaacaaacttgaagttatagggaggtaagccatctccaactctgcaggtcaaacgaaagtttgggaaatacttttgacatcccacaatacagaatgtcttaacatgagaattgaatttcatgatgtgtggttccatttaatagcggacaccaccccaatctcatgttttcctgttaccctaaaacagtggaaggaaactgggtgtttggtagacttctaaatcatggtctctgacaatttgaatctgagattctcacctccatttactaaagaatcgtgacttaattcaaattgcacagtaatcagtaaagtgaatacgtttttaaaatggaattttctcccttcagcaagcactcattaaggagtgaggctgagtattttaagatagagtgagatctgtgagtgattgaaaggtgatatttaaaaacttggatttcattccagtgtcaggtttgggttttaagttcctttggtccagggaagggtccaagcagccacagttgccctaaatctccatcattaagtcttccagcaaggttaagtgcagtatggaaggagaagggggaagaggacggtaacggccccacactccaggctgagaaagagtaattaggaggcctgaggaggggccgaggaaaggctgttggggtgtgctggggttggtacccgagcgccttcccctcacctcaaccagagaagagcatccggttgctttttaaagcttttagcctgccctagcaaggacaaagcatgttagattagagatgcttctgctgatcgcaggggttcttatttgaaaacatctatgatgggggtggggtgggaggagacaggttgtggttatgcaggaaaatcttgtcctaaaaatatatgagtttgggggtaaggggtgggatagccaagcaaaatcagtaattattttaaaatgaacatatgtatttttattaacttttagttaaatacagattttacaacgaggtcagcataagcctaaatctatatagagggctaactcaggcattgtcttgtttatttgtagactggattaaaaacaacctgtcctgttttgtcagttcccagcttcttcgtttagaataaattagaccaaaagaagaaacgtgcttgtctctgtatacccgcagaatgaagttactgttgttaaaactggattttttcattttactaggttccgaagagtccagatgcttggtagatgttcaatacgtgattttttttttaattgaatgtgttcatttaaaatcctccttaacatttctagaaagacttctttcaataaataatggaatcttagaggaaaagtggttttttaaaagctagggaactcctccactaaaagtaaccattggaaacctcgaatgagggctaaagttttaatcataagagaaaaggcagcataatgaaatgtgtacacatacatagtcagtggtccattttaggaagccagtggcgtctgataaagaaatgttaagagtagtgaggttgaggaaggaaattgtggggatttgaaatattctctttatgttgtttctcttctgagtcatggtaaaacaataaattatcatctctaggtggca

SEQ ID NO: 204141 - DNA, 573 bp, Homo sapiens
  Payload ID: 20263
  Gene Name: zinc finger with KRAB and SCAN domains 1
  ENST ID: ENST00000432317
  CDS Start-End: 198-573
attgtaaccacatcagcaaagcactgttagtatatatgctgaacaaatgtggagaaatcgctgttttacataggaaaccatggtgatttgccccagaatgtgtatccaggaatagtaaagaaacacatcataaaacctcccaggacataaaggtgagcacagaccctgtttggatcaagtcagttcctggagcctgaatgatgactgctgaatcacgggaagccacgggtctgtccccacaggctgcacaggagaaggatggtatcgtaatagtgaaggtggaagaggaagatgaggaagaccacatgtgggggcaggattccaccctacaggacacgcctcctccagacccagagatattccgccaacgcttcaggcgcttctgttaccagaacacttttgggccccgagaggctctcagtcggctgaaggaactttgtcatcagtggctgcggccagaaataaacaccaaggaacagatcctggagcttctggtgctagagcagtttctttccatcctgcccaaggagctccaggtctggctgcaggaataccgccccgatagtggagagg

SEQ ID NO: 204142 - DNA, 2011 bp, Homo sapiens
  Payload ID: 20263
  Gene Name: zinc finger with KRAB and SCAN domains 1
  ENST ID: ENST00000426572
  CDS Start-End: 354-1937
actcattgtgtctgtgtcgaggcgtcgggagggcctaagtccgtgtgcggtgcccttcggccggcctgagccccagagtcagctcccctttctcgcccagcgcccccaggccgctcccggggctcacggagtctctctctgtcacccaggctggagtgcagtggcgcgttctcagctcactgcaccctccacctcccaggttcaagtgattctcctgcctcagcctcccgagtagctgagattacaggaatagtaaagaaacacatcataaaacctcccaggacataaaggctgcacaggagaaggatggtatcgtaatagtgaaggtggaagaggaagatgaggaagaccacatgtgggggcaggattccaccctacaggacacgcctcctccagacccagagatattccgccaacgcttcaggcgcttctgttaccagaacacttttgggccccgagaggctctcagtcggctgaaggaactttgtcatcagtggctgcggccagaaataaacaccaaggaacagatcctggagcttctggtgctagagcagtttctttccatcctgcccaaggagctccaggtctggctgcaggaataccgccccgatagtggagaggaggccgtgacccttctagaagacttggagcttgatttatcaggacaacaggtcccaggtcaagttcatggacctgagatgctcgcaagggggatggtgcctctggatccagttcaggagtcctcgagctttgaccttcatcacgaggccacccagtcccacttcaaacattcgtctcggaaaccccgcctcttacagtcacgagctcttcctgctgcccacattcctgcaccccctcatgagggtagtcccagagaccaggcgatggcatctgcactattcacagcggattcccaggcaatggtgaagatcgaggacatggctgtgtccctcattctggaggaatggggatgtcagaatctggctcggaggaatctcagtagggacaacaggcaggagaattatgggagcgcatttccccagggtggtgaaaacaggaatgagaacgaggagtcaacctcaaaggctgaaacctcggaagattcagcatcacgcggggagacaacaggaagatcccagaaagagtttggagagaaacgtgaccaggagggcaaaacaggagaaagacagcagaaaaaccctgaggagaaaaccaggaaagagaaaagagattcagggccagctataggaaaggacaaaaaaaccatcacaggagagagaggtccaagggagaaggggaaaggattgggaagaagcttcagtctgagctccaacttcaccacccctgaagaagttcccacgggaacaaagtctcacagatgtgatgaatgtggtaaatgcttcacgagaagttcaagccttatccgccataaaataatccacactggagaaaagccctatgaatgtagtgagtgtgggaaagccttcagtcttaactccaaccttgtcctgcatcagaggatccacacaggagagaaacctcatgaatgtaacgagtgtggcaaggccttcagccacagttccaatctcatcctccatcagcgcatccactctggagagaaaccttatgaatgtaatgagtgcgggaaggccttcagccagagctcggacctcaccaagcatcagagaattcacacgggggagaaaccctatgaatgtagtgaatgtggaaaagctttcaaccgaaactcatacctgattttgcatcggagaattcacactcgagaaaagccctacaagtgcactaagtgtggcaaggccttcacccgcagctccaccctcactctgcatcacagaatccatgccagagagagagcctctgagtacagcccagcctcccttgatgcatttggcgcgttcctgaaaagttgtgtgtaaaggaagaatttgccatcaagccatttcccccttttgtttctaaaattatttcagagatgtgtgctcctggaggg

SEQ ID NO: 204143 - DNA, 8758 bp, Homo sapiens
  Payload ID: 20263
  Gene Name: zinc finger with KRAB and SCAN domains 1
  ENST ID: ENST00000535170
  CDS Start-End: 215-1267
ggtggtgacacgcttccggcctttgtgactcattgtgtctgtgtcgaggcgtcgggagggcctaagtccgtgtgcggtgcccttcggccggcctgagccccagagtcagctcccctttctcgcccagcgcccccaggccgctcccggggctcacgctcttcctgctgcccacattcctgcaccccctcatgagggtagtcccagagaccaggcgatggcatctgcactattcacagcggattcccaggcaatggtgaagatcgaggacatggctgtgtccctcattctggaggaatggggatgtcagaatctggctcggaggaatctcagtagggacaacaggcaggagaattatgggagcgcatttccccagggtggtgaaaacaggaatgagaacgaggagtcaacctcaaaggctgaaacctcggaagattcagcatcacgcggggagacaacaggaagatcccagaaagagtttggagagaaacgtgaccaggagggcaaaacaggagaaagacagcagaaaaaccctgaggagaaaaccaggaaagagaaaagagattcagggccagctataggaaaggacaaaaaaaccatcacaggagagagaggtccaagggagaaggggaaaggattgggaagaagcttcagtctgagctccaacttcaccacccctgaagaagttcccacgggaacaaagtctcacagatgtgatgaatgtggtaaatgcttcacgagaagttcaagccttatccgccataaaataatccacactggagaaaagccctatgaatgtagtgagtgtgggaaagccttcagtcttaactccaaccttgtcctgcatcagaggatccacacaggagagaaacctcatgaatgtaacgagtgtggcaaggccttcagccacagttccaatctcatcctccatcagcgcatccactctggagagaaaccttatgaatgtaatgagtgcgggaaggccttcagccagagctcggacctcaccaagcatcagagaattcacacgggggagaaaccctatgaatgtagtgaatgtggaaaagctttcaaccgaaactcatacctgattttgcatcggagaattcacactcgagaaaagccctacaagtgcactaagtgtggcaaggccttcacccgcagctccaccctcactctgcatcacagaatccatgccagagagagagcctctgagtacagcccagcctcccttgatgcatttggcgcgttcctgaaaagttgtgtgtaaaggaagaatttgccatcaagccatttcccccttttgtttctaaaattatttcagagatgtgtgctcctggagggaaaaagaaatacagcctcaacagattaaaaaacaaaagtcacacttaaggatccttctagtcacatcagcagtgttctgcctttatgtagtagttgggcatataatccttccacacagcccctgcagggaaaggctaatcttacggataatccacgtgagatttccacacaagagaaaagcacacgcatagtgaaatgtcagtcttttcagtaatgaggatacctttaaggcactcttggactctcggcaaccacaacataatagttgaaagatcaagattggctccacgaaagtgatacggaggttaggatgctacttgctgcaaacaagccctactttggccaacatcctgcttatttctcaaaaaagagggacagtgaaaacaaaaacgacattgggacatgctgctcaaggtagttatatatacgataagttgtatatatgatcactggtagcctaccaaagctgtagaaatctaggactgtgctaatcagtatcaaaccaaagatttctatctcttcccgaaagagagggtatgtgcaccagtctacagttccaaaggactgcaacaaatgtagatggttctgtcctcatccctgagatcagttctactgaaatggcaacaacaactccaaatacatctctcccttcttgaaatccctaaagcactatcgcactcctaaatgcatttctccacaagttagcacttgattgtatactgtcttttaatccttcattgtttcatgtatgaagtttttaatcaccccctaacccccaaaaaagattcggttgtcaagggatatatttctatccctgccagcacagtgctggacatagtgagtactgaacacctaagaggcactcattcagactgacttctacaggacttctacgtgtgtgataaaagcctgtgaatcgtgagtccctgaaatatggtagcctggcccagcttctaaagaggaccttcgtagccacaaggcatgctaaacctctagggtctgatgctgtttttgttccaaatataaacgaaaggcactagtcagccgcctgcatagactttctaaacagtgagtaaataccatggaatgtcagaaatgactttatcatcgtcatcttgaagaaaaatatgaacactgatgaaggtcattttttttttttgacatctttctgtggcaaagctcttagaattctttgcagttagctgctgaacagtatgatgatttggggattttctgaatcatttgtacttagatactggagttcagaagatgtgatttttgttgcttttcagaaaaaggaacgtggtagggagtgttttttcccacgcttttccagtaactttgcaaaagcattaattgttcactggcaattactaaatgtattttgttgctctgagaaactcagcagtgtactgagatgtggctggctgtgccatcgtcatagtgcacagtgacttttctgtttcttatcactaaagactgaggtgaggttatgaaactttcattggtcccatcgttgtgcgcagggtgcaactggctacctagaagctgatggcaggagactgtttcacacacaggagattgtgagctgtgtaagtagtcatcgccactcaagtaggacaagggtcctacccaaggctaggaccgccctgcggaaacagaaacatagactgagaacaaacctcaagactatcagtgtgacctccccataacaagagaaccccatatatagtttgagactttcccttgagaaacttatactaaaactattactcatcagtcattcactgatcagcagctaaagtccatgagaccaaatggttttatatggaaccaacgaagtgggagctaaaactgcacagtggtcattctttggcctctccttggctttatgacttaaaccaactacaacttccctatagcttctaagcagtttcatcagcattacttgggaaaacgtgttgcaagtcaaccagtcactaggatatttctacccatgcaacggaagaaaaacccattactccagaagagtatatctaagtaactaaaatggaggcagaaaatgttttaaggattttcttcaaagaataagccacagcaatggttttgtagaaaactcctgtgcttttgagcaaggacttttgccctctagaaagcaactgaggccaggtgcggtggctcacgcctgtaatcccagcactttgggaggccgaggtgagcggatcacctgaggtcaggagttttgagaccagcctggccaacatggtaaaatcccgtctctactaaaattataaaaattagccgggcatgatggtgggcacctgtaatcccagctacttgggaggctgaggcaggagaatcacttgaacccaggaggcagaggttgcagtgagccaagattgcacactgcactccagcctgggtgactagcaaaactccatctcaaaaaaaaaaaaaagaaagaaagaaactgaaaagtgaggtgtggaactccaggcaacgacccaagcacttattttttaagagggaaaggactttggtcatgtttacattggcctttggtttttttttttctttcagccacaactatatgctgatataactcagccatcacttttgagttttgtttttaaatgaaggttaaatgtgacctgtgccctcacatttaattccgtttcatggagacatcttcctgactttgttggatagctgccactagggttgcttcgatcttcagccacatgctgtccttgaagcagctatttgaagatgtgttttctgaggaaaacaggctacaactgtttattaaaaccacttgcagtgcattcgtttatcagatgctcagtgcaaagtgtaattgggtcatggtcaaaaacgcttgcaacatctaattggcgttcaagatagtcattcaaaagttcttggcccgctgaagtctgttaacagttgaaacattctacagttaaccattagcatgctagttgtcctaatggaaatttttgaagagtttttcaatatataccctacccttgccaggaagagaagtaaaatcctcaggttgtggggtatttgtttctactccagcctggcaggcaaggctaaaacctgagattatcgatctatgagacatcttgatatgtaaagcacttaatattaaaggcataaaagtgaaactgctaaatatgtatagagaggttgacgtgtgatacgtgggacagttcacatagacatcagagaatttattccagaaaggagcctcctgaatgtgatgaatacggcaaagcctttaatcacatctcagcccttagcatcggaaagcttatactgtaaataaacttgatgaatattatatgtgaggaaaactttcatgtatagcactcattgcttcagacagaaaatgaattccgtcggtatgttccaatcgtgatgaatttgagaaacattgcaagagggagctcaatcttggccgggcgccgtggctcacgcctgtaatcgcagcactttgggaggccgaggcaggcggatcacgaggtcagtagttcgagaccagcctggccaacatggtgaaaccttgtctctactaaaaatacaaaaaaaaattagctgggcacagtggcgcacgcctgtagtcccagctactcgggaggctgaggcaggagaatggcttgaacctgcgaggcggaggttgcagtgagctaagatcatgccactggcactccagccttgagtgacagagcgaggctctgtatcaaaaaaaaaagttgcgggggggtgctcaatcttaactgcagaggatctacagatgaaaaaaaatgtggggaaatgctttaaaaaaatagcaaaatgtgcaacttcttacaaaaattgttaacgttaggtacttctatatattttatatgaccataatgtccgtgtgtgttttgtaccttcagtcccttgttattgttccgtatattacctgtaagcagatactgtattttattttagcctatttgacagaacacatcactcagaaaaagtgaagtttcagagcaaacagtgaagaaatcagtgtgattgtagacaaaaagtcggttcacagaacggagcagcggggagaggaagggaaaagcttcatagtttggtgcttatcacatcaagagattggtaaatttctgaggaaagacaggctaatggggcactgaaatggaacaactcctttaaacgtgcagccttttgaatttttcctcaaaaccaagaagttgacctctgagctgtcaggtgaccactgtgtgcaaaggggatggattctcttgtcagtagacggtcttctccatgaagcgagagtaggaagtgtactggaatggccaagtgggactgcttcagctgaccaggttcttttaaaccgtagtcatgctttcccactaactcttaaatccttatgcttagaaaattgaggataaggctgggcacagtggctcaggcctgtaatcccagcactttgggagaccaaggcgggtggatcacaaggtcaggagatcgagaccatcctggctaacatggcgaaaccccgtctctactaaaaatacaaaaaaatagctgggcgtggtggcgggcgcctgtagtcccagctactcaggaggctgaggcaggaggatcacttgaacatgggaggcggaggttgcagtgagccaagatggcgccactgcactccagcctgggtgatggcgtgagactccatgtcaaaaaaaaaaaaaaggttggggggaggataggactggccaggcacggtggctcactcctgtaatctcagcactttgggaggcagaggtgggcggatcacttgaggtcaggagtttgagaccagcctggccaacgtggtgaaagcctgtctctactaaaaatacaaaaattagccgggcgtggtggtgggcgcctgtagtcccagctactcaggaggctgaggcaggagaatcacctaaatctgggaggcagaggttgcagtgagccgagattgcaccactgcactccagcctgggtaacagagactctgtctcaaaaaaagaaaaaaaaaaaagaaagaaagaaagaaaattggggataggagaacagcaaggtgggcatttcccggaattgtgtgcagatgcatccagtcgtggcattgcaagaagtctgtctgatgaagctcgggaagcattttgcaatattccctttggctgtgttcctgtgttccctgctcccacttttcttcccctggtttgtgattattaggagagaggttttgcaaagactcgttgctgtgaaagaatctttttttaatttttatcctagagtcagtcacttttattccaggtagtcatgctgatctgcttatccaaagccagctaaccaggttcatcctaccatcctcatggaagactgtgtgtatgaattggagtaacagaactgaaatacacttaaacagtgacagcagtacttcccagggtgggggccatatttctctgtgtcctactctgagcaacttctcagagatacgagggggctagggttttcccatctgggaaatggggtgaaagtctgcagattgttaaatgaaatatagaatcagagaaaaagaaaagtcagtgatataaatagatcatttcatagaaattagggtagatttttatttcaactactactggagaatttaataaaaggcattatttgaaaagtttttctaacatagatttagggtttttttttttagagtggacacactacatttaaaagcaattattttgctattcagattttttattatctgaaaatgaaattatctgttttacttttcaaagctttgtgaaacaaacttgaagttatagggaggtaagccatctccaactctgcaggtcaaacgaaagtttgggaaatacttttgacatcccacaatacagaatgtcttaacatgagaattgaatttcatgatgtgtggttccatttaatagcggacaccaccccaatctcatgttttcctgttaccctaaaacagtggaaggaaactgggtgtttggtagacttctaaatcatggtctctgacaatttgaatctgagattctcacctccatttactaaagaatcgtgacttaattcaaattgcacagtaatcagtaaagtgaatacgtttttaaaatggaattttctcccttcagcaagcactcattaaggagtgaggctgagtattttaagatagagtgagatctgtgagtgattgaaaggtgatatttaaaaacttggatttcattccagtgtcaggtttgggttttaagttcctttggtccagggaagggtccaagcagccacagttgccctaaatctccatcattaagtcttccagcaaggttaagtgcagtatggaaggagaagggggaagaggacggtaacggccccacactccaggctgagaaagagtaattaggaggcctgaggaggggccgaggaaaggctgttggggtgtgctggggttggtacccgagcgccttcccctcacctcaaccagagaagagcatccggttgctttttaaagcttttagcctgccctagcaaggacaaagcatgttagattagagatgcttctgctgatcgcaggggttcttatttgaaaacatctatgatgggggtggggtgggaggagacaggttgtggttatgcaggaaaatcttgtcctaaaaatatatgagtttgggggtaaggggtgggatagccaagcaaaatcagtaattattttaaaatgaacatatgtatttttattaacttttagttaaatacagattttacaacgaggtcagcataagcctaaatctatatagagggctaactcaggcattgtcttgtttatttgtagactggattaaaaacaacctgtcctgttttgtcagttcccagcttcttcgtttagaataaattagaccaaaagaagaaacgtgcttgtctctgtatacccgcagaatgaagttactgttgttaaaactggattttttcattttactaggttccgaagagtccagatgcttggtagatgttcaatacgtgattttttttttaattgaatgtgttcatttaaaatcctccttaacatttctagaaagacttctttcaataaataatggaatcttagaggaaaagtggttttttaaaagctagggaactcctccactaaaagtaaccattggaaacctcgaatgagggctaaagttttaatcataagagaaaaggcagcataatgaaatgtgtacacatacatagtcagtggtccattttaggaagccagtggcgtctgataaagaaatgttaagagtagtgaggttgaggaaggaaattgtggggatttgaaatattctctttatgttgtttctcttctgagtcatggtaaaacaataaattatcatctctaggtggc

SEQ ID NO: 204144 - DNA, 9192 bp, Homo sapiens
  Payload ID: 20263
  Gene Name: zinc finger with KRAB and SCAN domains 1
  ENST ID: ENST00000620510
  CDS Start-End: 118-1701
ttatacttcaggaatagtaaagaaacacatcataaaacctcccaggacataaaggctgcacaggagaaggatggtatcgtaatagtgaaggtggaagaggaagatgaggaagaccacatgtgggggcaggattccaccctacaggacacgcctcctccagacccagagatattccgccaacgcttcaggcgcttctgttaccagaacacttttgggccccgagaggctctcagtcggctgaaggaactttgtcatcagtggctgcggccagaaataaacaccaaggaacagatcctggagcttctggtgctagagcagtttctttccatcctgcccaaggagctccaggtctggctgcaggaataccgccccgatagtggagaggaggccgtgacccttctagaagacttggagcttgatttatcaggacaacaggtcccaggtcaagttcatggacctgagatgctcgcaagggggatggtgcctctggatccagttcaggagtcctcgagctttgaccttcatcacgaggccacccagtcccacttcaaacattcgtctcggaaaccccgcctcttacagtcacgagctcttcctgctgcccacattcctgcaccccctcatgagggtagtcccagagaccaggcgatggcatctgcactattcacagcggattcccaggcaatggtgaagatcgaggacatggctgtgtccctcattctggaggaatggggatgtcagaatctggctcggaggaatctcagtagggacaacaggcaggagaattatgggagcgcatttccccagggtggtgaaaacaggaatgagaacgaggagtcaacctcaaaggctgaaacctcggaagattcagcatcacgcggggagacaacaggaagatcccagaaagagtttggagagaaacgtgaccaggagggcaaaacaggagaaagacagcagaaaaaccctgaggagaaaaccaggaaagagaaaagagattcagggccagctataggaaaggacaaaaaaaccatcacaggagagagaggtccaagggagaaggggaaaggattgggaagaagcttcagtctgagctccaacttcaccacccctgaagaagttcccacgggaacaaagtctcacagatgtgatgaatgtggtaaatgcttcacgagaagttcaagccttatccgccataaaataatccacactggagaaaagccctatgaatgtagtgagtgtgggaaagccttcagtcttaactccaaccttgtcctgcatcagaggatccacacaggagagaaacctcatgaatgtaacgagtgtggcaaggccttcagccacagttccaatctcatcctccatcagcgcatccactctggagagaaaccttatgaatgtaatgagtgcgggaaggccttcagccagagctcggacctcaccaagcatcagagaattcacacgggggagaaaccctatgaatgtagtgaatgtggaaaagctttcaaccgaaactcatacctgattttgcatcggagaattcacactcgagaaaagccctacaagtgcactaagtgtggcaaggccttcacccgcagctccaccctcactctgcatcacagaatccatgccagagagagagcctctgagtacagcccagcctcccttgatgcatttggcgcgttcctgaaaagttgtgtgtaaaggaagaatttgccatcaagccatttcccccttttgtttctaaaattatttcagagatgtgtgctcctggagggaaaaagaaatacagcctcaacagattaaaaaacaaaagtcacacttaaggatccttctagtcacatcagcagtgttctgcctttatgtagtagttgggcatataatccttccacacagcccctgcagggaaaggctaatcttacggataatccacgtgagatttccacacaagagaaaagcacacgcatagtgaaatgtcagtcttttcagtaatgaggatacctttaaggcactcttggactctcggcaaccacaacataatagttgaaagatcaagattggctccacgaaagtgatacggaggttaggatgctacttgctgcaaacaagccctactttggccaacatcctgcttatttctcaaaaaagagggacagtgaaaacaaaaacgacattgggacatgctgctcaaggtagttatatatacgataagttgtatatatgatcactggtagcctaccaaagctgtagaaatctaggactgtgctaatcagtatcaaaccaaagatttctatctcttcccgaaagagagggtatgtgcaccagtctacagttccaaaggactgcaacaaatgtagatggttctgtcctcatccctgagatcagttctactgaaatggcaacaacaactccaaatacatctctcccttcttgaaatccctaaagcactatcgcactcctaaatgcatttctccacaagttagcacttgattgtatactgtcttttaatccttcattgtttcatgtatgaagtttttaatcaccccctaacccccaaaaaagattcggttgtcaagggatatatttctatccctgccagcacagtgctggacatagtgagtactgaacacctaagaggcactcattcagactgacttctacaggacttctacgtgtgtgataaaagcctgtgaatcgtgagtccctgaaatatggtagcctggcccagcttctaaagaggaccttcgtagccacaaggcatgctaaacctctagggtctgatgctgtttttgttccaaatataaacgaaaggcactagtcagccgcctgcatagactttctaaacagtgagtaaataccatggaatgtcagaaatgactttatcatcgtcatcttgaagaaaaatatgaacactgatgaaggtcattttttttttttgacatctttctgtggcaaagctcttagaattctttgcagttagctgctgaacagtatgatgatttggggattttctgaatcatttgtacttagatactggagttcagaagatgtgatttttgttgcttttcagaaaaaggaacgtggtagggagtgttttttcccacgcttttccagtaactttgcaaaagcattaattgttcactggcaattactaaatgtattttgttgctctgagaaactcagcagtgtactgagatgtggctggctgtgccatcgtcatagtgcacagtgacttttctgtttcttatcactaaagactgaggtgaggttatgaaactttcattggtcccatcgttgtgcgcagggtgcaactggctacctagaagctgatggcaggagactgtttcacacacaggagattgtgagctgtgtaagtagtcatcgccactcaagtaggacaagggtcctacccaaggctaggaccgccctgcggaaacagaaacatagactgagaacaaacctcaagactatcagtgtgacctccccataacaagagaaccccatatatagtttgagactttcccttgagaaacttatactaaaactattactcatcagtcattcactgatcagcagctaaagtccatgagaccaaatggttttatatggaaccaacgaagtgggagctaaaactgcacagtggtcattctttggcctctccttggctttatgacttaaaccaactacaacttccctatagcttctaagcagtttcatcagcattacttgggaaaacgtgttgcaagtcaaccagtcactaggatatttctacccatgcaacggaagaaaaacccattactccagaagagtatatctaagtaactaaaatggaggcagaaaatgttttaaggattttcttcaaagaataagccacagcaatggttttgtagaaaactcctgtgcttttgagcaaggacttttgccctctagaaagcaactgaggccaggtgcggtggctcacgcctgtaatcccagcactttgggaggccgaggtgagcggatcacctgaggtcaggagttttgagaccagcctggccaacatggtaaaatcccgtctctactaaaattataaaaattagccgggcatgatggtgggcacctgtaatcccagctacttgggaggctgaggcaggagaatcacttgaacccaggaggcagaggttgcagtgagccaagattgcacactgcactccagcctgggtgactagcaaaactccatctcaaaaaaaaaaaaaagaaagaaagaaactgaaaagtgaggtgtggaactccaggcaacgacccaagcacttattttttaagagggaaaggactttggtcatgtttacattggcctttggtttttttttttctttcagccacaactatatgctgatataactcagccatcacttttgagttttgtttttaaatgaaggttaaatgtgacctgtgccctcacatttaattccgtttcatggagacatcttcctgactttgttggatagctgccactagggttgcttcgatcttcagccacatgctgtccttgaagcagctatttgaagatgtgttttctgaggaaaacaggctacaactgtttattaaaaccacttgcagtgcattcgtttatcagatgctcagtgcaaagtgtaattgggtcatggtcaaaaacgcttgcaacatctaattggcgttcaagatagtcattcaaaagttcttggcccgctgaagtctgttaacagttgaaacattctacagttaaccattagcatgctagttgtcctaatggaaatttttgaagagtttttcaatatataccctacccttgccaggaagagaagtaaaatcctcaggttgtggggtatttgtttctactccagcctggcaggcaaggctaaaacctgagattatcgatctatgagacatcttgatatgtaaagcacttaatattaaaggcataaaagtgaaactgctaaatatgtatagagaggttgacgtgtgatacgtgggacagttcacatagacatcagagaatttattccagaaaggagcctcctgaatgtgatgaatacggcaaagcctttaatcacatctcagcccttagcatcggaaagcttatactgtaaataaacttgatgaatattatatgtgaggaaaactttcatgtatagcactcattgcttcagacagaaaatgaattccgtcggtatgttccaatcgtgatgaatttgagaaacattgcaagagggagctcaatcttggccgggcgccgtggctcacgcctgtaatcgcagcactttgggaggccgaggcaggcggatcacgaggtcagtagttcgagaccagcctggccaacatggtgaaaccttgtctctactaaaaatacaaaaaaaaattagctgggcacagtggcgcacgcctgtagtcccagctactcgggaggctgaggcaggagaatggcttgaacctgcgaggcggaggttgcagtgagctaagatcatgccactggcactccagccttgagtgacagagcgaggctctgtatcaaaaaaaaaagttgcgggggggtgctcaatcttaactgcagaggatctacagatgaaaaaaaatgtggggaaatgctttaaaaaaatagcaaaatgtgcaacttcttacaaaaattgttaacgttaggtacttctatatattttatatgaccataatgtccgtgtgtgttttgtaccttcagtcccttgttattgttccgtatattacctgtaagcagatactgtattttattttagcctatttgacagaacacatcactcagaaaaagtgaagtttcagagcaaacagtgaagaaatcagtgtgattgtagacaaaaagtcggttcacagaacggagcagcggggagaggaagggaaaagcttcatagtttggtgcttatcacatcaagagattggtaaatttctgaggaaagacaggctaatggggcactgaaatggaacaactcctttaaacgtgcagccttttgaatttttcctcaaaaccaagaagttgacctctgagctgtcaggtgaccactgtgtgcaaaggggatggattctcttgtcagtagacggtcttctccatgaagcgagagtaggaagtgtactggaatggccaagtgggactgcttcagctgaccaggttcttttaaaccgtagtcatgctttcccactaactcttaaatccttatgcttagaaaattgaggataaggctgggcacagtggctcaggcctgtaatcccagcactttgggagaccaaggcgggtggatcacaaggtcaggagatcgagaccatcctggctaacatggcgaaaccccgtctctactaaaaatacaaaaaaatagctgggcgtggtggcgggcgcctgtagtcccagctactcaggaggctgaggcaggaggatcacttgaacatgggaggcggaggttgcagtgagccaagatggcgccactgcactccagcctgggtgatggcgtgagactccatgtcaaaaaaaaaaaaaaggttggggggaggataggactggccaggcacggtggctcactcctgtaatctcagcactttgggaggcagaggtgggcggatcacttgaggtcaggagtttgagaccagcctggccaacgtggtgaaagcctgtctctactaaaaatacaaaaattagccgggcgtggtggtgggcgcctgtagtcccagctactcaggaggctgaggcaggagaatcacctaaatctgggaggcagaggttgcagtgagccgagattgcaccactgcactccagcctgggtaacagagactctgtctcaaaaaaagaaaaaaaaaaaagaaagaaagaaagaaaattggggataggagaacagcaaggtgggcatttcccggaattgtgtgcagatgcatccagtcgtggcattgcaagaagtctgtctgatgaagctcgggaagcattttgcaatattccctttggctgtgttcctgtgttccctgctcccacttttcttcccctggtttgtgattattaggagagaggttttgcaaagactcgttgctgtgaaagaatctttttttaatttttatcctagagtcagtcacttttattccaggtagtcatgctgatctgcttatccaaagccagctaaccaggttcatcctaccatcctcatggaagactgtgtgtatgaattggagtaacagaactgaaatacacttaaacagtgacagcagtacttcccagggtgggggccatatttctctgtgtcctactctgagcaacttctcagagatacgagggggctagggttttcccatctgggaaatggggtgaaagtctgcagattgttaaatgaaatatagaatcagagaaaaagaaaagtcagtgatataaatagatcatttcatagaaattagggtagatttttatttcaactactactggagaatttaataaaaggcattatttgaaaagtttttctaacatagatttagggtttttttttttagagtggacacactacatttaaaagcaattattttgctattcagattttttattatctgaaaatgaaattatctgttttacttttcaaagctttgtgaaacaaacttgaagttatagggaggtaagccatctccaactctgcaggtcaaacgaaagtttgggaaatacttttgacatcccacaatacagaatgtcttaacatgagaattgaatttcatgatgtgtggttccatttaatagcggacaccaccccaatctcatgttttcctgttaccctaaaacagtggaaggaaactgggtgtttggtagacttctaaatcatggtctctgacaatttgaatctgagattctcacctccatttactaaagaatcgtgacttaattcaaattgcacagtaatcagtaaagtgaatacgtttttaaaatggaattttctcccttcagcaagcactcattaaggagtgaggctgagtattttaagatagagtgagatctgtgagtgattgaaaggtgatatttaaaaacttggatttcattccagtgtcaggtttgggttttaagttcctttggtccagggaagggtccaagcagccacagttgccctaaatctccatcattaagtcttccagcaaggttaagtgcagtatggaaggagaagggggaagaggacggtaacggccccacactccaggctgagaaagagtaattaggaggcctgaggaggggccgaggaaaggctgttggggtgtgctggggttggtacccgagcgccttcccctcacctcaaccagagaagagcatccggttgctttttaaagcttttagcctgccctagcaaggacaaagcatgttagattagagatgcttctgctgatcgcaggggttcttatttgaaaacatctatgatgggggtggggtgggaggagacaggttgtggttatgcaggaaaatcttgtcctaaaaatatatgagtttgggggtaaggggtgggatagccaagcaaaatcagtaattattttaaaatgaacatatgtatttttattaacttttagttaaatacagattttacaacgaggtcagcataagcctaaatctatatagagggctaactcaggcattgtcttgtttatttgtagactggattaaaaacaacctgtcctgttttgtcagttcccagcttcttcgtttagaataaattagaccaaaagaagaaacgtgcttgtctctgtatacccgcagaatgaagttactgttgttaaaactggattttttcattttactaggttccgaagagtccagatgcttggtagatgttcaatacgtgattttttttttaattgaatgtgttcatttaaaatcctccttaacatttctagaaagacttctttcaataaataatggaatcttagaggaaaagtggttttttaaaagctagggaactcctccactaaaagtaaccattggaaacctcgaatgagggctaaagttttaatcataagagaaaaggcagcataatgaaatgtgtacacatacatagtcagtggtccattttaggaagccagtggcgtctgataaagaaatgttaagagtagtgaggttgaggaaggaaattgtggggatttgaaatattctctttatgttgtttctcttctgagtcatggtaaaacaataaattatcatctctaggtggc

SEQ ID NO: 204145 - DNA, 7523 bp, Homo sapiens
  Payload ID: 20264
  Gene Name: zinc finger with KRAB and SCAN domains 2
  Uniprot ID: Q63HK3
  ENST ID: ENST00000328086
  CDS Start-End: 805-3708
ctcccccagcccctcgcccgccaggacgcctcgcgcgggccccgcggcgctcggtggcaggcggcgcatgcgtgactgcggttcccagcgccccccgcgctctccgcgggccgagtggacgaggccgaacgcgagcagcctgccgctgccccctgcgagccctggcttcgccccgcagctcttctcccttccgggcggaacagtttttgcggcctttcctcggcggcagcggtttcctcaggacggtcggggccgtcgtgggcccgaaagagcccggcgccgctctcggaatccggcggccccagcggcacccgcggcggcctggacgtgctgcggtgacccgagcccggaacctggcgccgggcggggcctgcacatccggccccacccactcggggactcgcctctccgcgcccgacccgggagtagcggacacaccccctcccggcccggctgtccgcctccgcccagcctttcctcagcctgcttcatttttctcccagtcgtccagcctcccggtttccgactttgcactaagagggatgcactctggaaaaccacattgcgcggtcacatcttgtttggagaagaggccaggcttttgcatcttagagtatacgttcaccttttcaagggcctggcatagatttgattaatcagcctggaataccctgttcctgccgacctggccgtttttacctccgtaccttatcacactcccaggaacattaagcagggagcgcttggagtcttctttgggtccccaccttgagctagacgtgaagttgacccctgggctgcagcatggctgtcgccctcgactctcagatcgacgcgcccctggaggttgagggatgcctaataatgaaggtggaaaaggaccctgagtgggcatcagagcccattctggaaggatcggatagctctgagaccttccgcaaatgcttcaggcaattctgttatgaggatgtgactggaccccatgaagctttcagtaaactctgggaactttgctgccggtggctgaagccagaaatgcgttccaaggagcaaatacttgagctgctggtgattgagcagtttctcaccattttacccgagaagattcaggcttgggcacagaagcagtgtccgcaaagtggagaggaagcggtggccctggtagtgcatttggagaaagagactggaagactaagacagcaggtcagcagtcccgtgcaccgggagaagcactccccacttggagcagcgtgggaggtggcagacttccagccagagcaggtggagacccaacccagggcggtgtctcgggaggaacctggaagcctccactcaggacaccaggaacagctgaaccgaaagcgagaacgtcggcccttacccaagaatgctcggccttctccctgggttcctgcccttgctgatgaatggaataccctagatcaggaagtgacaaccacacggcttcctgctgggtcccaggaaccagtgaaagatgtccacgtggccagaggcttttcctacagaaagagtgtgcatcagattcctgcccaaagggacctctaccgggatttcaggaaggagaatgttgggaacgtggtctccctgggaagtgcagtgtctacatctaacaagataacccggttggaacagagaaaggagccatggactctaggtctgcattcctctaacaagagaagtatcctacgaagcaactacgtcaaggaaaagtcagttcatgctattcaggtccctgcaaggagtgcaggaaaaacatggagagagcagcagcagtggggtttagaagatgaaaagatagcaggtgtgcattggagctatgaggaaacaaagactttcctggcaattctcaaagagtctcgcttttatgaaacacttcaggcctgtccccgaaatagccaagtgtatggtgctgtggctgaatggttgcgagaatgtggcttccttagaaccccagaacagtgtcgaaccaagttcaaaagtctccagaaaagctatcgaaaggtgagaaatggccacatgctagaaccctgcgccttctttgaggacatggatgctttgttgaaccctgcagcccgtgctccgtccactgataaaccaaaggagatgatacctgtccccagactgaagagaattgccatcagtgctaaggaacacatcagcttggtggaggaggaggaagctgcagaagattctgatgatgatgaaataggcatcgaatttatccgcaagtctgaaatccatggtgcccctgtcttgtttcagaatctcagtggcgtgcactggggctatgaagaaaccaagacttttcttgatatcctccgtgagactcggttttatgaagcgcttcaagcctgtcatcggaagagcaaattgtatggggctgtagctgaacagcttcgagagtgcggcttcctccggacaccagaacagtgccgaaccaagttcaaaagccttcagaagagttaccgcaaggtgaaaaatggccacgtgctagagtcctgcgcgttctacaaggagatggatgccctgattaactctcgggcatctgctccttcccccagcaccccagaggaagtcccatcaccttcaaggcaagaaagagggggtattgaggttgaaccccaggaacctacaggctgggaacctgaagagacctcacaggaggcagtaatagaagactcttgcagtgagagaatgagcgaggaggaaattgtgcaagagccagagttccagggacctccaggtctactgcagagcccaaatgattttgaaatcggaagtagcatcaaggaggatccaacacagatagtatataaggacatggaacagcatagggcattaatagaaaagtctaaaagagttgtttcccagagtaccgaccccagcaaatatcgcaaaagggaatgcatctcaggaagacaatgggaaaatcttcaaggaattagacagggaaagccgatgtctcagcctagagatttagggaaagccgttgtgcatcagaggccttttgtggggaagagaccctacagacttctcaaatatggagaaagctttggaaggagcactcgtctgatgtgccggatgacccaccacaaggagaatccttacaagtgtggtgtctgtgggaagtgctttggtagaagcaggagcctgatcagacaccaaagaatccacacaggcgaaaaaccttttaaatgtcttgactgtggaaaaagctttaatgactcctcaaattttggtgcccaccagagaatccacacaggagagaaaccctacagatgcggagagtgtggaaaatgctttagtcagagctctagtcttattatacatcagagaacgcacaccggtgagaagccctatcagtgtggagagtgtgggaaaagtttcaccaacagttctcatttcagcgcccaccggagagttcacactggggagaatccctacaaatgtgtggactgtgaaaaaagtttcaataactgtacgagatttcgagaacatcggagaatacacactggagagaagccctatggatgtgcccagtgtggcaaacgtttcagtaagagttctgttcttaccaaacatcgggaagttcatgtgagagaaaagcctctgccacaccctccatctctgtattgccctgagaacccacataagggaaagactgatgaatttaggaaaactttttgatgatgatcttctcttcctaaatgcccccttagccattttaccctaatctcattcttggaagcaatcttttcttagctatgaagtgtaatttccaagataaacttgagaatataaataaactaaacactttcatcctgttctcacctctgcctctaacttcatcagtctgttcctcctcttctgtgtgtctcagcttctcctttaagaatgtggcgaagatacattgtccgagttcagaatgaaatacccttcagtacattgaggccactgcaactggattgctaagttcggcaacattcaagatcttccatatgggtgagagttgtcttcaaggatataaaaaatgccaaaagtttttttgttgttattacctactccgtgagatcctggatgaaacttgataacagattttcacatttagatagaactttgaggagtctgatcggaactacatcaaatccatcttggttttgaagagatccacaaaagaagagtgaagattttatagctttcctcagaagtctgttacagtgtacctttttttttttttttgtcaagaagttgatccaaatagctagggcagaatccctgtattgtcactgaaatcctgttactaatgccttgccctccatggaggtgagaagcaattgatcacccctcatccttttctgtacccgaagacttaaatcccctggctgctgcttctccagcctataagtaatcccaggtcctcctactgtttctcatagccctgcacttgcctctcagttgctctgggtgctcctgccggcctcttccgaactaccatgccctcctcagatagaataggaggcctgctcgtggtgtgtctcactaaagcaaagtaggatttcagatgcgttctagttctatcctctaacttctctggctcttatctagaacatgactggcatgttggcatatttcgtacctcccacccctgcactgcagtataatattataatagtgtttctaaaactttaaggggatagggaagaggtaatagacacctgaagcatttctaagaccagttggactcctttggcctgctgtcgatcagatagccacctcagcttagaccagcgctctcaggtctggctgttaaatctcccagtctcttttcctgaggcttctagtccctgttcaccgcatcagaaacctaactgtagtgtgccaagtaacttaacacaactctagagctcactgggtgaaaagtgggaacatttataaaaacttcaatccagaaatccagaacaccgtttttgttttcctcatttacttgttttgtctgaaaaatctctttgagaacccccggcagtaacccagtaaacactgaaggaaaagttctgatgggggatggttaattgacttttgaagttacagatgaaacccagagatttgattttccatggccagttgcttcaggatggagtcagtggcgtttattcccttagtatgtaggtgacccagggtggctttgctttggcaagggagaagtcacaagtttaatgggaagggaaccggagttagggctgtttgtgggtgattattttgctcttctctctccctttctttgtcaaatgctcttatttgaagccatctggaaatgatatttttccttttggtatgtttcaatcttttgaaacttgttcagcaaagtacctaggagggtaggcactgtagaaagaaatctaatttatggtgccagaatagggtgtggcctgttggaaggcaggtgactcaggtagacattgataaatgtttctgatttacatttgttggaaatattatgactgttcacatctcaataggttgatttttctgtgttgtccaagttatagatttctaatgctaagtacagttccatgttggtagtgtgcgtagcacagtaagatgtttgtggtgccagtgggcttgtgtttatattgtgtagatgttctggaattccagctctagagaagatgtaaattaatagaaatcaccacttaataatatgtacacaggattgatattatgtggaagcatgattcaggaaagtagatgacttattcataaatatgaagcactgttacatgtaaggccatgttctagccacagtgaatgatagaaaaaggaaggaaggggcatggtgcctgggctcaaggaactcacagtttgatagaggaagcatcacagcaaaagttggggccacttacaccatggcagttacagaaggccaggagctcagtcatgagaacatcaccttcccctgcagaagagttgcgctaagttgcccagaatcatattctgtaccttcatctctcaaccttccccagtggcaggaaagggtcaagcaagacccattccctctctagtgggacaaactgattctgtttaactctcatatgcctgggagcaagctgaggtggaatttgggttcccctatctctactcctaattgtaaatgggctgtctagacatgtgttacattaatttgatgaactttgttctgaagaaatggaaggtctcccccccattttagaccaacactacctgtctccctgcattttatttgttttcacctggtacatgtaagtcaaaatgaataatcatgttctgaccaatgtgtcttttagatcacataacattgcctttatgaagattcatagaaaaaggtttttttatctagatctcagtgccaaggaaagctctgatcctaagcgcagtatgtgtacacacacacgtctacatgtgtgtgtagatctgtatgtatgtattacaaacactgtgatttttgtaacttaagctgctttttctctctttgttctggctgctggaaagttcaacaaaacttacagcccacctcaaccaactaccccaacctatatttatttaatttcatcttatttccttgtaaattgtgtcaaatcctgtttttgaaaagcagcatagactgacaacttttcactatcatcttatcgaaggcattttggaaactggggtcgtatgtcccacctaggcttgctttgttactgccacaaatacctccagttcttaccagtgatgttattatgcattcaacctaattcattcatctggaaagaaacagttttttaaaaagggaaacctcacacgtaaatggctcagggcagcctggccttggtggaatgagcatgagactggaagctgaaagaagcaagttttaatcttgtcactaaatgagtgttgtttgacacatcatagcctctctgggcctcggctcctcatctgaagagaagttgaacttaactgctaagttgctctggctctaatgtttcatgaggctgtggagcgtgatatagatgcggaagaggttagaagaccaggctgccggcccagctgtcctgtgcctgccacatctggccataccaaatccatcgcatgcttcaggaaagggaggggatgctgtgacagcaaactcagcccaggagcttgttggggaaggagaaagggcaagtccctcgtggtccacagcaggcaccccccaagcacctcgataaccagtggcaggtaggctgaagtgaaggaagcctctgtcaggaggtctggcgcccagtgacagacaagacagctgtgagggagctggggcagccctggctaaaggaatgtctgagtaacttgtgaaactggaagcctctgcctctgaatgcattccaagacctggtgcaaatggatgtccattcattgttttgtatcagtgttcacttagatgtcttcttgaaaacttgtttgtggaataaatgtctaaaataaatggctcccactggtttctgccataa

SEQ ID NO: 204146 - DNA, 3667 bp, Homo sapiens
  Payload ID: 20264
  Gene Name: zinc finger with KRAB and SCAN domains 2
  ENST ID: ENST00000569150
  CDS Start-End: 431-1129
acatccggccccacccactcggggactcgcctctccgcgcccgacccgggagtagcggacacaccccctcccggcccggctgtccgcctccgcccagcctttcctcagcctgcttcatttttctcccagtcgtccagcctcccggtttccgactttgcactaagagggatgcactctggaaaaccacattgcgcggtcacatcttgtttggagaagaggccaggcttttgcatcttagagtatacgttcaccttttcaagggcctggcatagatttgattaatcagcctggaataccctgttcctgccgacctggccgtttttacctccgtaccttatcacactcccaggaacattaagcagggagcgcttggagtcttctttgggtccccaccttgagctagacgtgaagttgacccctgggctgcagcatggctgtcgccctcgactctcagatcgacgcgcccctggaggttgagggatgcctaataatgaaggtggaaaaggaccctgagtgggcatcagagcccattctggaaggatcggatagctctgagaccttccgcaaatgcttcaggcaattctgttatgaggatgtgactggaccccatgaagctttcagtaaactctgggaactttgctgccggtggctgaagccagaaatgcgttccaaggagcaaatacttgagctgctggtgattgagcagtttctcaccattttacccgagaagattcaggcttgggcacagaagcagtgtccgcaaagtggagaggaagcggtggccctggtagtgcatttggagaaagagactggaagactaagacagcaggtcagcagtcccgtgcaccgggagaagcactccccacttggagcagcgtgggaggtggcagacttccagccagagcaggtggagacccaacccagggcggtgtctcgggaggaacctggaagcctccactcaggacaccaggaacagctgaaccgaaagcgagaacgtcggcccttacccaagaatgctcggccttctccctgggttcctgcccttgctgatgaatggaataccctagatcaggaagtgacaaccacacggcttcctgctgggtcccagtgtcattacaggaaccagtgaaagatgtccacgtggccagaggcttttcctacagaaagagtgtgcatcagattcctgcccaaagggacctctaccgggatttcaggaaggagaatgttgggaacgtggtctccctgggaagtgcagtgtctacatctaacaagataacccggttggaacagagaaaggagccatggactctaggtctgcattcctctaacaagagaagtatcctacgaagcaactacgtcaaggaaaagtcagttcatgctattcaggtccctgcaaggagtgcaggaaaaacatggagagagcagcagcagtggggtttagaagatgaaaagatagcaggtgtgcattggagctatgaggaaacaaagactttcctggcaattctcaaagagtctcgcttttatgaaacacttcaggcctgtccccgaaatagccaagtgtatggtgctgtggctgaatggttgcgagaatgtggcttccttagaaccccagaacagtgtcgaaccaagttcaaaagtctccagaaaagctatcgaaaggtgagaaatggccacatgctagaaccctgcgccttctttgaggacatggatgctttgttgaaccctgcagcccgtgctccgtccactgataaaccaaaggagatgatacctgtccccagactgaagagaattgccatcagtgctaaggaacacatcagcttggtggaggaggaggaagctgcagaagattctgatgatgatgaaataggcatcgaatttatccgcaagtctgaaatccatggtgcccctgtcttgtttcagaatctcagtggcgtgcactggggctatgaagaaaccaagacttttcttgatatcctccgtgagactcggttttatgaagcgcttcaagcctgtcatcggaagagcaaattgtatggggctgtagctgaacagcttcgagagtgcggcttcctccggacaccagaacagtgccgaaccaagttcaaaagccttcagaagagttaccgcaaggtgaaaaatggccacgtgctagagtcctgcgcgttctacaaggagatggatgccctgattaactctcgggcatctgctccttcccccagcaccccagaggaagtcccatcaccttcaaggcaagaaagagggggtattgaggttgaaccccaggaacctacaggctgggaacctgaagagacctcacaggaggcagtaatagaagactcttgcagtgagagaatgagcgaggaggaaattgtgcaagagccagagttccagggacctccaggtctactgcagagcccaaatgattttgaaatcggaagtagcatcaaggaggatccaacacagatagtatataaggacatggaacagcatagggcattaatagaaaagtctaaaagagttgtttcccagagtaccgaccccagcaaatatcgcaaaagggaatgcatctcaggaagacaatgggaaaatcttcaaggaattagacagggaaagccgatgtctcagcctagagatttagggaaagccgttgtgcatcagaggccttttgtggggaagagaccctacagacttctcaaatatggagaaagctttggaaggagcactcgtctgatgtgccggatgacccaccacaaggagaatccttacaagtgtggtgtctgtgggaagtgctttggtagaagcaggagcctgatcagacaccaaagaatccacacaggcgaaaaaccttttaaatgtcttgactgtggaaaaagctttaatgactcctcaaattttggtgcccaccagagaatccacacaggagagaaaccctacagatgcggagagtgtggaaaatgctttagtcagagctctagtcttattatacatcagagaacgcacaccggtgagaagccctatcagtgtggagagtgtgggaaaagtttcaccaacagttctcatttcagcgcccaccggagagttcacactggggagaatccctacaaatgtgtggactgtgaaaaaagtttcaataactgtacgagatttcgagaacatcggagaatacacactggagagaagccctatggatgtgcccagtgtggcaaacgtttcagtaagagttctgttcttaccaaacatcgggaagttcatgtgagagaaaagcctctgccacaccctccatctctgtattgccctgagaacccacataagggaaagactgatgaatttaggaaaactttttgatgatgatcttctcttcctaaatgcccccttagccattttaccctaatctcattcttggaagcaatcttttcttagctatgaagtgtaatttccaagataaacttgagaatataaataaactaaacactttcatcctgttctcacctctgcctctaacttcatcagtctgttcctcctcttctgtgtgtctcagcttctcctttaagaatgtggcgaagatacattgtccgagttcagaatgaaatacccttcagtacattgaggccactgcaactggattgctaagttcggcaacattcaagatcttccatatgggtgagag

SEQ ID NO: 204147 - DNA, 4725 bp, Homo sapiens
  Payload ID: 20265
  Gene Name: zinc finger with KRAB and SCAN domains 3
  Uniprot ID: Q9BRR0
  ENST ID: ENST00000252211
  CDS Start-End: 217-1833
agtggcttctgtgccccgccctgcgggtggtttgctagtttcaagcactttgtgagtatggggtgaatcggcgtcggccttccactgtggggttaaatctcatcccgcggctctcctcctgtcggtcctgcagttcttttgtccccgggtagagggatcttctgcagaaatagcgctggaagctagagtgaggcctgagtactgccttggcctaggatggctagagaattaagtgaaagcacagccctggatgcccagtctacagaagaccagatggagcttctggtcataaaggtggaggaagaagaagccggttttcccagtagcccagatctgggttctgagggctcccgcgagcgcttccgaggcttccgctacccggaggctgcaggcccccgcgaggcgctgagtcggctccgagagctctgccgacagtggctgcagcctgagatgcacagcaaggagcagatcctggagctgctggtgctggagcagttcctgaccatcctgccggggaatctgcagagctgggtgcgggagcagcatccagagagcggggaggaggtggtggtgctattggagtatttggagaggcagctggatgagccggcgccgcaggtttcaggtgttgaccaggggcaagaactgctctgttgcaagatggcactattgacaccagccccagggtcacaaagtagccaatttcagctaatgaaggctctgctcaagcatgaatctgtgggatcccagcctttacaagatagagttctccaggtccccgtgcttgcccatggaggatgctgcagagaagataaagtggtagcttctaggcttactccagagtcccaggggttgttgaaagtggaagatgtggccctgaccctcacccctgaatggacacagcaggattcatctcaggggaatctctgtagagatgaaaagcaggagaaccatggcagcctggtctccctgggtgatgaaaaacagactaagagcagggacttgcctccagctgaggagcttccagaaaaggagcatgggaagatatcgtgccacctgagagaagacattgcccagattcctacatgtgcagaagctggtgaacaggagggcaggctacaaagaaagcagaaaaatgccacaggagggaggcggcacatctgccatgaatgtggaaagagttttgctcaaagctcaggcctgagtaaacacaggagaatccacactggtgagaaaccctacgaatgtgaagagtgtggcaaagccttcattgggagctctgcccttgtcattcatcagagagtccacactggtgagaagccatatgagtgtgaagaatgtggtaaggccttcagtcatagctcagaccttatcaagcatcagagaacccacactggggagaagccctatgagtgtgatgactgtgggaagaccttcagccagagctgcagcctccttgaacatcacagaatccacactggggagaagccgtatcagtgcagtatgtgtggcaaagcctttaggcgaagttcacatctcctgagacatcagaggatccatactggggataaaaatgttcaggaacctgagcagggagaggcctggaaaagtaggatggaaagccagttggaaaatgttgaaactcccatgtcttataaatgtaatgagtgtgaaagaagtttcactcagaatacaggcctcattgaacatcaaaaaatccacactggtgagaaaccctatcagtgtaatgcgtgtggaaaaggcttcacccgaatttcataccttgttcaacatcagagaagccatgtagggaaaaacatcctatcacagtgacccatgccatacatgccagagttggtgctcatttgtcactgatctgaagccactccccctggagtctcaactatagaaattgtgggctgggctttatttaccactacacattatcaggtgttagaaaatgtagactgggttagacaaattatcttctaagttctagaaggggtttgtaatcaaaacatatttgataggaggctacgggagagttgtctagaagaggtaagacctgaaactgtttgttctctcccactagaattaaatggatgtttagactggctacttgccctaaaccagcacttggtgatgtctactgggtggatggttgtgatttgggggctgcttctctgaccattctttttgactgtaatgaatcctccacagttggtcagattcataaagtcttatatccccctctgtgccttttctgcaggtgctaataaatgtttattgaatgtaccagtgagattaccttcatagatctgaaaatctgatgttatccaggtttctgaagaacttctcgccaaggccatttgtgcttgtgtccaattctctgacctagattgtgactcaatctagtgtgtttcttaccaagtacataggcagagcagggttactgtgattgaaagaatccattttttttttggagacgtagtcttgctctgtcgcccaggctggagtgcagtggcacaatcttggctcactgcaacctccacctcctgggttcaagcgattctcctgcctcagcctcctgagtagctgggattacaggtgtgtgccaccatgcccggctaattttttatgtttttagtagagacgggattttaccgtgttagccaggatggtctcgatctcctaacctcatgatcctcctgcctcagcctaccaaagtgctgggattacaggcatgagccaccatgcccggccaagaatccatatttctttaccagactaggaattctattctagtgcaaatgccttaaaaagcttatcactaaatcattacgaatgtgtgccatccgtggaattgcttttttttttttttttttgtaaatatgaggtctcactatgttgcccaggctggtctcgaaatcctgggcaatcctcctgcctcaccctctcaagtactggaattacaggcgtgagccaccatacccagcccaaatttcactctttaatgttttcctgttgctattctttaaggaaaaaactttcctattcagacagtgtgaaaatcagtcatcaagtcagaataaaatgatgaatattctaatgctcagtatcttagttctctcgggcctaaccaatgcctcctaaaacaatagatactatcctgccccaccctaccacccaacacacactgtatagtaaactgcatcaaaacttattcctgctaagttcatactttctccagctcaatggattcacaccaaatttttttttttttttttagacggagtcttctctgtcacccaggctggagtgcagtggcgcgatctcggctcactgcaagctccgcctcccaggttcctgccattctcctgcctcagcctcccgagtagctgggactataggcgtccgcctccacgccgggctattttttttttttattttatactttaagttctagggtacatgtgcacaacgtgcaggtttgttacatatgtatacatgtgccatgttggtgtgctgcacccattaactcgtcatttacattgggtgtatctcctaatgctttccctccccccaccccacaacaggccccagtgtgtgatgttccccttcctgtgtccaagtgttctccttattcaattcccacctatgagtgagaatatgccgtgtttgattttttgttcttggcgatagtttgctgagaatgatgagacgaggtttcactgtgttagccaggatgctctcgatctcctgacctcgtgatccacctgtctcggcctcccaaaatgctgggattacaggcgtgagccaccgcgcccggcccaagtatcacttatggtttcagaacgccattattagtgtctgactgtcttggtcttcttatacattgattcccaaatcacgtgtggtaacagcatctcaatttttcatgatgacggtttgaaccattaatttaattcctcaggctatctacttttttgttaaacatactgtgtagaccatcttttttttttcccatcatgatagtcaaaattttagtctgtgtattcaagtgagaaaatttttagtcagcattatacaagtagtatttattatgtatacattcagtggagttgtttctacaaaagtatttcggaatgactattctgctgcaaacttttgtgtaagcgcttcaccttattcctacaataaggagaagtgcactaacaaaatgaacaatgcagcaagggcttcagtcgcagctcaggtcttatcaaacaccagagaaccctcaatgggagaagccttatgagtgtgacaactgtggaaagacagttccttttttgttagtatcacttctacttattgtagaaatatgctttcattattgcatctactcacatttctcactcggtttctggcaccagcaatctcttccatatttataatatcagtcaaaaactctggaattcaaatataacaagacttttctggtcacctttgatagttaatgacttgggcattgtgatatattatctcctgctgtatgtattttgtttagtagaaattgaatcattatccacaatcctttatagaactatccaagtccctgtttttatgctagtttccaaggcttggtccttcaaggttttcagggatctaggggacacaaatctaacaaatcctaatgtatattatttgtattatagtaataaaccatatggttactttgtttga

SEQ ID NO: 204148 - DNA, 1794 bp, Homo sapiens
  Payload ID: 20265
  Gene Name: zinc finger with KRAB and SCAN domains 3
  Uniprot ID: Q9BRR0
  ENST ID: ENST00000341464
  CDS Start-End: 161-1333
agtttcaagcactttgtgagtatggggtgaatcggcgtcggccttccactgtggggttaaatctcatcccgcggctctcctcctgtcggtcctgcagttcttttgtccccgggtagaggtttcaggtgttgaccaggggcaagaactgctctgttgcaagatggcactattgacaccagccccagggtcacaaagtagccaatttcagctaatgaaggctctgctcaagcatgaatctgtgggatcccagcctttacaagatagagttctccaggtccccgtgcttgcccatggaggatgctgcagagaagataaagtggtagcttctaggcttactccagagtcccaggggttgttgaaagtggaagatgtggccctgaccctcacccctgaatggacacagcaggattcatctcaggggaatctctgtagagatgaaaagcaggagaaccatggcagcctggtctccctgggtgatgaaaaacagactaagagcagggacttgcctccagctgaggagcttccagaaaaggagcatgggaagatatcgtgccacctgagagaagacattgcccagattcctacatgtgcagaagctggtgaacaggagggcaggctacaaagaaagcagaaaaatgccacaggagggaggcggcacatctgccatgaatgtggaaagagttttgctcaaagctcaggcctgagtaaacacaggagaatccacactggtgagaaaccctacgaatgtgaagagtgtggcaaagccttcattgggagctctgcccttgtcattcatcagagagtccacactggtgagaagccatatgagtgtgaagaatgtggtaaggccttcagtcatagctcagaccttatcaagcatcagagaacccacactggggagaagccctatgagtgtgatgactgtgggaagaccttcagccagagctgcagcctccttgaacatcacagaatccacactggggagaagccgtatcagtgcagtatgtgtggcaaagcctttaggcgaagttcacatctcctgagacatcagaggatccatactggggataaaaatgttcaggaacctgagcagggagaggcctggaaaagtaggatggaaagccagttggaaaatgttgaaactcccatgtcttataaatgtaatgagtgtgaaagaagtttcactcagaatacaggcctcattgaacatcaaaaaatccacactggtgagaaaccctatcagtgtaatgcgtgtggaaaaggcttcacccgaatttcataccttgttcaacatcagagaagccatgtagggaaaaacatcctatcacagtgacccatgccatacatgccagagttggtgctcatttgtcactgatctgaagccactccccctggagtctcaactatagaaattgtgggctgggctttatttaccactacacattatcaggtgttagaaaatgtagactgggttagacaaattatcttctaagttctagaaggggtttgtaatcaaaacatatttgataggaggctacgggagagttgtctagaagaggtaagacctgaaactgtttgttctctcccactagaattaaatggatgtttagactggctacttgccctaaaccagcacttggtgatgtctactgggtggatggttgtgatttgggggctgcttctctgaccattctttttgactgtaatgaatcctccacagttggtcagattcataaagtcttatatccccctctgtgccttttctgcaggtgctaataaatgtttattgaatgt

SEQ ID NO: 204149 - DNA, 4799 bp, Homo sapiens
  Payload ID: 20265
  Gene Name: zinc finger with KRAB and SCAN domains 3
  Uniprot ID: Q9BRR0
  ENST ID: ENST00000377255
  CDS Start-End: 298-1914
agtttcaagcactttgtgagtatggggtgaatcggcgtcggccttccactgtggggttaaatctcatcccgcggctctcctcctgtcggtcctgcagttcttttgtccccgggtagagggccgttaccgagtgtccgggtcggttcttgagggtatttggagacgggatgcatgggtcacatagacaagcctcgagaatgggagccgttacatttttgcactgcctggtaacaagggatcttctgcagaaatagcgctggaagctagagtgaggcctgagtactgccttggcctaggatggctagagaattaagtgaaagcacagccctggatgcccagtctacagaagaccagatggagcttctggtcataaaggtggaggaagaagaagccggttttcccagtagcccagatctgggttctgagggctcccgcgagcgcttccgaggcttccgctacccggaggctgcaggcccccgcgaggcgctgagtcggctccgagagctctgccgacagtggctgcagcctgagatgcacagcaaggagcagatcctggagctgctggtgctggagcagttcctgaccatcctgccggggaatctgcagagctgggtgcgggagcagcatccagagagcggggaggaggtggtggtgctattggagtatttggagaggcagctggatgagccggcgccgcaggtttcaggtgttgaccaggggcaagaactgctctgttgcaagatggcactattgacaccagccccagggtcacaaagtagccaatttcagctaatgaaggctctgctcaagcatgaatctgtgggatcccagcctttacaagatagagttctccaggtccccgtgcttgcccatggaggatgctgcagagaagataaagtggtagcttctaggcttactccagagtcccaggggttgttgaaagtggaagatgtggccctgaccctcacccctgaatggacacagcaggattcatctcaggggaatctctgtagagatgaaaagcaggagaaccatggcagcctggtctccctgggtgatgaaaaacagactaagagcagggacttgcctccagctgaggagcttccagaaaaggagcatgggaagatatcgtgccacctgagagaagacattgcccagattcctacatgtgcagaagctggtgaacaggagggcaggctacaaagaaagcagaaaaatgccacaggagggaggcggcacatctgccatgaatgtggaaagagttttgctcaaagctcaggcctgagtaaacacaggagaatccacactggtgagaaaccctacgaatgtgaagagtgtggcaaagccttcattgggagctctgcccttgtcattcatcagagagtccacactggtgagaagccatatgagtgtgaagaatgtggtaaggccttcagtcatagctcagaccttatcaagcatcagagaacccacactggggagaagccctatgagtgtgatgactgtgggaagaccttcagccagagctgcagcctccttgaacatcacagaatccacactggggagaagccgtatcagtgcagtatgtgtggcaaagcctttaggcgaagttcacatctcctgagacatcagaggatccatactggggataaaaatgttcaggaacctgagcagggagaggcctggaaaagtaggatggaaagccagttggaaaatgttgaaactcccatgtcttataaatgtaatgagtgtgaaagaagtttcactcagaatacaggcctcattgaacatcaaaaaatccacactggtgagaaaccctatcagtgtaatgcgtgtggaaaaggcttcacccgaatttcataccttgttcaacatcagagaagccatgtagggaaaaacatcctatcacagtgacccatgccatacatgccagagttggtgctcatttgtcactgatctgaagccactccccctggagtctcaactatagaaattgtgggctgggctttatttaccactacacattatcaggtgttagaaaatgtagactgggttagacaaattatcttctaagttctagaaggggtttgtaatcaaaacatatttgataggaggctacgggagagttgtctagaagaggtaagacctgaaactgtttgttctctcccactagaattaaatggatgtttagactggctacttgccctaaaccagcacttggtgatgtctactgggtggatggttgtgatttgggggctgcttctctgaccattctttttgactgtaatgaatcctccacagttggtcagattcataaagtcttatatccccctctgtgccttttctgcaggtgctaataaatgtttattgaatgtaccagtgagattaccttcatagatctgaaaatctgatgttatccaggtttctgaagaacttctcgccaaggccatttgtgcttgtgtccaattctctgacctagattgtgactcaatctagtgtgtttcttaccaagtacataggcagagcagggttactgtgattgaaagaatccattttttttttggagacgtagtcttgctctgtcgcccaggctggagtgcagtggcacaatcttggctcactgcaacctccacctcctgggttcaagcgattctcctgcctcagcctcctgagtagctgggattacaggtgtgtgccaccatgcccggctaattttttatgtttttagtagagacgggattttaccgtgttagccaggatggtctcgatctcctaacctcatgatcctcctgcctcagcctaccaaagtgctgggattacaggcatgagccaccatgcccggccaagaatccatatttctttaccagactaggaattctattctagtgcaaatgccttaaaaagcttatcactaaatcattacgaatgtgtgccatccgtggaattgcttttttttttttttttttgtaaatatgaggtctcactatgttgcccaggctggtctcgaaatcctgggcaatcctcctgcctcaccctctcaagtactggaattacaggcgtgagccaccatacccagcccaaatttcactctttaatgttttcctgttgctattctttaaggaaaaaactttcctattcagacagtgtgaaaatcagtcatcaagtcagaataaaatgatgaatattctaatgctcagtatcttagttctctcgggcctaaccaatgcctcctaaaacaatagatactatcctgccccaccctaccacccaacacacactgtatagtaaactgcatcaaaacttattcctgctaagttcatactttctccagctcaatggattcacaccaaatttttttttttttttttagacggagtcttctctgtcacccaggctggagtgcagtggcgcgatctcggctcactgcaagctccgcctcccaggttcctgccattctcctgcctcagcctcccgagtagctgggactataggcgtccgcctccacgccgggctattttttttttttattttatactttaagttctagggtacatgtgcacaacgtgcaggtttgttacatatgtatacatgtgccatgttggtgtgctgcacccattaactcgtcatttacattgggtgtatctcctaatgctttccctccccccaccccacaacaggccccagtgtgtgatgttccccttcctgtgtccaagtgttctccttattcaattcccacctatgagtgagaatatgccgtgtttgattttttgttcttggcgatagtttgctgagaatgatgagacgaggtttcactgtgttagccaggatgctctcgatctcctgacctcgtgatccacctgtctcggcctcccaaaatgctgggattacaggcgtgagccaccgcgcccggcccaagtatcacttatggtttcagaacgccattattagtgtctgactgtcttggtcttcttatacattgattcccaaatcacgtgtggtaacagcatctcaatttttcatgatgacggtttgaaccattaatttaattcctcaggctatctacttttttgttaaacatactgtgtagaccatcttttttttttcccatcatgatagtcaaaattttagtctgtgtattcaagtgagaaaatttttagtcagcattatacaagtagtatttattatgtatacattcagtggagttgtttctacaaaagtatttcggaatgactattctgctgcaaacttttgtgtaagcgcttcaccttattcctacaataaggagaagtgcactaacaaaatgaacaatgcagcaagggcttcagtcgcagctcaggtcttatcaaacaccagagaaccctcaatgggagaagccttatgagtgtgacaactgtggaaagacagttccttttttgttagtatcacttctacttattgtagaaatatgctttcattattgcatctactcacatttctcactcggtttctggcaccagcaatctcttccatatttataatatcagtcaaaaactctggaattcaaatataacaagacttttctggtcacctttgatagttaatgacttgggcattgtgatatattatctcctgctgtatgtattttgtttagtagaaattgaatcattatccacaatcctttatagaactatccaagtccctgtttttatgctagtttccaaggcttggtccttcaaggttttcagggatctaggggacacaaatctaacaaatcctaatgtatattatttgtattatagtaataaaccatatggttactt

SEQ ID NO: 204150 - DNA, 2375 bp, Homo sapiens
  Payload ID: 20266
  Gene Name: zinc finger with KRAB and SCAN domains 4
  Uniprot ID: Q969J2
  ENST ID: ENST00000377294
  CDS Start-End: 245-1882
ccaaagacatcctttggtgatacttactgtgggattcagagtggggtgcagaggacgaccctgcaaaggcacggactataagagagatctgtgcagctgcgcctcagggggtgtcctgggcccctgggcatgacaggagggggaccacttgcagttctactggaaaatttaccacccttccagaatcctctgaagatatacaggtcgcaactagagtgagacccgagtactgccttgggtcagaatggctagagaaccgagaaaaaacgcagccctggacgcccagtctgcagaagaccagacggggctcctgaccgtgaaggtggagaaggaggaagcctccgccttgacggcggaggtgagagcaccctgcagccctgctcggggccccgaacgctcccgccagcgcttccgaggcttccgctacccggaggctgcgggcccccgcgaggcgttgagccggctccgagaactctgcggacaatggctgcagcctgagatgcacagcaaggagcagatcctggagctgctggtgctggagcagttcctgaccatcctgccggggaatctgcagagctgggtgcgggagcagcatccagagagcggggaggaggtggtggtgctattggagtatttggagaggcagctggatgagccggcgccgcaggttcccgttggtgaccaggggcaagaactgctctgttgcaagatggcactattgacacaaactcaagggtctcaaagtagccagtgccagccaatgaaggctctgttcaagcatgaatctctgggatcccagcccttacacgatagagttctccaggttcctgggcttgcccagggagggtgctgcagagaagatgcaatggtagcttccaggctcactccagggtcccagggtttgctgaaaatggaagatgtggccctgaccctcactcctgggtggacacagctggattcatctcaggtgaacctctacagagatgaaaagcaggagaaccatagcagcctggtctcccttggtggtgaaatacagactaagagcagggacttgcctccagtcaagaagcttccagaaaaggagcatgggaagatatgccacctgagggaagacattgcccagattcctacacatgcagaagctggtgaacaggagggcaggttacaaagaaagcagaaaaatgccatagggagtaggcgacattattgccatgaatgtggaaagagttttgctcaaagttcaggcctgactaaacacaggagaatccacactggtgagaaaccctatgaatgtgaagactgtggaaagaccttcattgggagctctgcccttgtcattcatcagagagtccacactggtgagaagccatatgagtgtgaagaatgtggtaaggtcttcagtcacagctcaaaccttatcaaacaccagagaacccacactggggagaagccctatgagtgtgatgactgtgggaagaccttcagccagagctgcagcctccttgaacatcacaaaattcatactggggagaagccataccagtgcaatatgtgtggcaaagcctttaggcggaattcacatctcctgagacatcagaggattcatggtgataaaaatgttcagaatcctgagcacggggagtcctgggaaagtcagggtaggacggaaagccagtgggaaaatactgaggctcccgtgtcttataaatgtaatgagtgtgagagaagtttcacacggaatagaagtcttattgaacatcagaaaatccacactggtgagaaaccctatcagtgtgacacatgtggaaaaggtttcactcgaacttcataccttgttcaacatcagagaagccatgtagggaaaaaaactctttcacagtgacccatggtattcatgccaacattggtgctcatttgtcactgaactgaagccaccctggagcccttaatggttacagaaattgtggaccagggctttatttaccactatacatcatcgggtattagaaaatgtagtctggctgagacgatgagttatcttctacattctagaaagtgattggaagaagtcatttgataagaggccatgggagagtggtctggaagttgtaggacctaaaatagtttgttctcacccagtgtatttaaatggccttctggacttgttaattgccctcagccagcactttaggacatctggttggatggctctgatgtggggggctgctgctctgaccattcattttgcctctaatgaatctttcacaaattggtcagatccatgaggtcttttactcttctttgtgccttgtatgataggtgctaataaacatttattaaatgtaccagtaaaatggcctttgtaccaaaaattt

SEQ ID NO: 204151 - DNA, 4178 bp, Homo sapiens
  Payload ID: 20267
  Gene Name: zinc finger with KRAB and SCAN domains 5
  Uniprot ID: Q9Y2L8
  ENST ID: ENST00000326775
  CDS Start-End: 124-2643
gttccgggaacagctggcccctgcgactcgcgggtgtgacgttgaagatgtcggccttctgagccgactgcggtggtcaagagtgtaacacagccagcctcgaagacttccctctgagttggaatgataatgaccgaatcccgagaagttatagacttagaccccccagctgagacttcccaggagcaggaagaccttttcatagtgaaggtggaagaagaagactgcacctggatgcaggagtacaacccgccaacgtttgagactttttaccagcgcttcaggcacttccagtaccatgaggcttcaggaccccgggaggctctcagccaactccgggtgctctgctgtgagtggctgaggcccgagctgcacacgaaggagcagatcctggagctgctggtgctggagcagttcctgaccatcctgcctgaagagttccagccctgggtgagggaacatcaccctgaaagtggagaagaggcggtggccgtgatagaaaatatacagcgagaacttgaggaacgcagacagcagattgttgcctgccctgatgtgcttcctcggaagatggcaacacctggagcagtgcaggagtcctgcagcccccatcccctgaccgtggacacccagcctgagcaagcgccacagaagcctcgtctcctggaggaaaatgcccttcctgttctccaagttccttcccttcccctgaaggacagccaggagctgacagcttcacttctctcaactgggtcccagaagttggtgaaaattgaagaggtggctgatgtggctgtatccttcatcctggaggaatgggggcatttggaccagtcccagaagtccctttatagggatgacaggaaggagaactatgggagtattacttccatgggttatgagtccagggacaatatggagctcatagtgaagcagatttctgatgactctgaatcacactgggtggcgccagaacacaccgaaaggagcgttcctcaggatccagactttgcagaagtcagtgaccttaaaggcatggtacaaaggtggcaggtcaaccccactgtggggaaatcaaggcagaatccttcccagaaaagggatctggatgcaatcacagacatcagccctaagcaaagcacacatggcgagagagggcacagatgcagcgattgtggcaaattcttcctccaagcctcaaactttattcagcatcggcgcatccacactggagaaaaaccgtttaagtgcggagaatgtgggaagagctacaatcagcgggtgcacctcacccagcaccagcgcgtccacacaggggagaaaccctacaaatgtcaggtgtgcggaaaggctttccgggtgagttcccacctggttcagcaccacagtgtccacagcggagagaggccctatggctgcaatgagtgtgggaagaacttcggtcgccattcgcatctgatcgaacacctaaaacgccacttcagggagaaatcccagagatgcagtgacaaaagaagtaagaacacaaaattaagtgttaagaagaaaatttcagaatattcagaagcagacatggaactatctggaaaaacccaaagaaatgtttctcaagttcaagattttggagaaggctgtgagtttcaaggcaagctggatagaaagcagggaattcccatgaaagagatactaggacaaccatcttcaaagaggatgaactacagtgaagtcccatatgtccacaaaaaatcctccactggagagagaccacataaatgtaacgagtgtgggaaaagcttcattcagagtgcacatcttattcaacatcaaagaatacacactggggagaaaccattcaggtgtgaggaatgtgggaaaagctacaaccaacgcgtgcacctaactcagcatcagcgcgtccacacaggtgagaagccctacacctgtcccttatgtgggaaagccttcagagtgaggtcccaccttgttcagcatcagagcgtgcacagtggggagagacccttcaagtgtaacgaatgtgggaaaggctttgggaggcgttcccacctggctggacatcttcgactccactcccgagagaaatcccatcagtgtcgtgaatgtggggaaatcttttttcagtacgttagcctaattgaacatcaggtgctccacatgggtcagaaaaatgaaaaaaatggcatctgtgaggaagcatatagttggaacttgacagtgattgaagacaagaagattgagttacaagagcagccttatcagtgtgatatctgtggaaaagcctttggttatagctcagacctcattcagcattacagaactcatacagcagagaagccctatcaatgtgatatatgtagagaaaatgttggccagtgttcccacaccaaacaacatcaaaaaatctactccagcacaaaatcccatcaatgtcatgaatgtggcagaggcttcactctgaagtcacatcttaatcaacatcagagaatccatactggtgagaaaccttttcaatgtaaagaatgtggaatgaatttcagctggagttgtagcctctttaaacacctgagaagccatgagaggacagatcccataaataccttaagtgtagaggggtctctgttgtagaatagctcttaattttagagaaaccttcctggagggaaaccatactcctataatgagcaaagtaacaacttcaagcatttttccagcgttaccatcaaactcacaaataggttgaaatcctttagttataactcagcctttaggaacaccggagaacccacaataatagaaatcttttcgtgttccccattgagaaatgctttagttagcatcttcatgcttggaaatctagacaagaagagaatccatggatggacatggtcgaggaattcggaaagcctgcagttgacattcagtcttcacttgaaactcaaaactgacactaggaacagcttcatgagttcagtagaagtaagctttatttgtagcttctgccttgtttgacggcgtatctattcagggaagcgcacagtaaaagaattccttagcatgatgtctgttttggtacctcagcaatgaaccttttctagaaattattattccaaccactagaataccctagtcactattcccactttgagcattaacccctttgaaaagaaatggacttaaagtatctctgttttggcaaaattcaggttcaggggctggatggtatgtgtttctgctgccttattcaatccaccacttctctgtgaaacactctaccttgtttttggtttgattctactgatgtcagggtttagccggtagaaggagtagttcagtttgtcaattcaggagaaactgtactggtcagtcacatcttacggcgaagggagagggaccttaggggagcagagaagacaggcaaagttgtggactgtttgatcttgtattacccacaggaatgagggcagctaaacccatagaaggagttggaccaaggcgaattacgagtcctggtcccagcagtatgtgtgctgacttctgggtgccccagaaatagacctctcctgtagagtggtgatatacagaatgagtttcagtttgcattgcagctgggattgaaagtaatcagtcgtgagcaggcaggcaggaggtcctgttagccctgccttccaggaaggttggggtgggagttttgagtgggaaagaggatgacatgtgtgagagagttctgagcctgtttgctagggagagtgagtgagtgctcttgggcactgctcaggccgtttctgctgacttgcctggcttacaataaatgcccaataaatatttgttgaccatatgtgttgtacactgtggtgccctgtccagtcccctctaccaagctgagacccccatccccagctgctctgagtttgggctgcaagtgctcacagctcttgttctccagaaactggagaattgccctcaggagatgagagccatctcacctcacccaggagtcacttcctctctacaccccaacacctggttcatttgattaaagcggagaaaactccagggtgctatgactgctctggcacccttggatcaggccaagctagactttttctgagccttcatccgtgctaagctctctcccttctctatcctgtttcattccctcc

SEQ ID NO: 204152 - DNA, 4344 bp, Homo sapiens
  Payload ID: 20267
  Gene Name: zinc finger with KRAB and SCAN domains 5
  Uniprot ID: Q9Y2L8
  ENST ID: ENST00000394170
  CDS Start-End: 252-2771
cttccccgccccacggaaaggggaggagcttgggctgtttgaatggctttgggatggagcaggggagagagtggctccgtttgcctccccgctttggtgatgctgtgcgagcggcttcgggggccctggagacgtccgagtcactgagggtgggctgggactcggggcccgcgtcccatctccccgccgattggtccgccccccgtgcgagtgtaacacagccagcctcgaagacttccctctgagttggaatgataatgaccgaatcccgagaagttatagacttagaccccccagctgagacttcccaggagcaggaagaccttttcatagtgaaggtggaagaagaagactgcacctggatgcaggagtacaacccgccaacgtttgagactttttaccagcgcttcaggcacttccagtaccatgaggcttcaggaccccgggaggctctcagccaactccgggtgctctgctgtgagtggctgaggcccgagctgcacacgaaggagcagatcctggagctgctggtgctggagcagttcctgaccatcctgcctgaagagttccagccctgggtgagggaacatcaccctgaaagtggagaagaggcggtggccgtgatagaaaatatacagcgagaacttgaggaacgcagacagcagattgttgcctgccctgatgtgcttcctcggaagatggcaacacctggagcagtgcaggagtcctgcagcccccatcccctgaccgtggacacccagcctgagcaagcgccacagaagcctcgtctcctggaggaaaatgcccttcctgttctccaagttccttcccttcccctgaaggacagccaggagctgacagcttcacttctctcaactgggtcccagaagttggtgaaaattgaagaggtggctgatgtggctgtatccttcatcctggaggaatgggggcatttggaccagtcccagaagtccctttatagggatgacaggaaggagaactatgggagtattacttccatgggttatgagtccagggacaatatggagctcatagtgaagcagatttctgatgactctgaatcacactgggtggcgccagaacacaccgaaaggagcgttcctcaggatccagactttgcagaagtcagtgaccttaaaggcatggtacaaaggtggcaggtcaaccccactgtggggaaatcaaggcagaatccttcccagaaaagggatctggatgcaatcacagacatcagccctaagcaaagcacacatggcgagagagggcacagatgcagcgattgtggcaaattcttcctccaagcctcaaactttattcagcatcggcgcatccacactggagaaaaaccgtttaagtgcggagaatgtgggaagagctacaatcagcgggtgcacctcacccagcaccagcgcgtccacacaggggagaaaccctacaaatgtcaggtgtgcggaaaggctttccgggtgagttcccacctggttcagcaccacagtgtccacagcggagagaggccctatggctgcaatgagtgtgggaagaacttcggtcgccattcgcatctgatcgaacacctaaaacgccacttcagggagaaatcccagagatgcagtgacaaaagaagtaagaacacaaaattaagtgttaagaagaaaatttcagaatattcagaagcagacatggaactatctggaaaaacccaaagaaatgtttctcaagttcaagattttggagaaggctgtgagtttcaaggcaagctggatagaaagcagggaattcccatgaaagagatactaggacaaccatcttcaaagaggatgaactacagtgaagtcccatatgtccacaaaaaatcctccactggagagagaccacataaatgtaacgagtgtgggaaaagcttcattcagagtgcacatcttattcaacatcaaagaatacacactggggagaaaccattcaggtgtgaggaatgtgggaaaagctacaaccaacgcgtgcacctaactcagcatcagcgcgtccacacaggtgagaagccctacacctgtcccttatgtgggaaagccttcagagtgaggtcccaccttgttcagcatcagagcgtgcacagtggggagagacccttcaagtgtaacgaatgtgggaaaggctttgggaggcgttcccacctggctggacatcttcgactccactcccgagagaaatcccatcagtgtcgtgaatgtggggaaatcttttttcagtacgttagcctaattgaacatcaggtgctccacatgggtcagaaaaatgaaaaaaatggcatctgtgaggaagcatatagttggaacttgacagtgattgaagacaagaagattgagttacaagagcagccttatcagtgtgatatctgtggaaaagcctttggttatagctcagacctcattcagcattacagaactcatacagcagagaagccctatcaatgtgatatatgtagagaaaatgttggccagtgttcccacaccaaacaacatcaaaaaatctactccagcacaaaatcccatcaatgtcatgaatgtggcagaggcttcactctgaagtcacatcttaatcaacatcagagaatccatactggtgagaaaccttttcaatgtaaagaatgtggaatgaatttcagctggagttgtagcctctttaaacacctgagaagccatgagaggacagatcccataaataccttaagtgtagaggggtctctgttgtagaatagctcttaattttagagaaaccttcctggagggaaaccatactcctataatgagcaaagtaacaacttcaagcatttttccagcgttaccatcaaactcacaaataggttgaaatcctttagttataactcagcctttaggaacaccggagaacccacaataatagaaatcttttcgtgttccccattgagaaatgctttagttagcatcttcatgcttggaaatctagacaagaagagaatccatggatggacatggtcgaggaattcggaaagcctgcagttgacattcagtcttcacttgaaactcaaaactgacactaggaacagcttcatgagttcagtagaagtaagctttatttgtagcttctgccttgtttgacggcgtatctattcagggaagcgcacagtaaaagaattccttagcatgatgtctgttttggtacctcagcaatgaaccttttctagaaattattattccaaccactagaataccctagtcactattcccactttgagcattaacccctttgaaaagaaatggacttaaagtatctctgttttggcaaaattcaggttcaggggctggatggtatgtgtttctgctgccttattcaatccaccacttctctgtgaaacactctaccttgtttttggtttgattctactgatgtcagggtttagccggtagaaggagtagttcagtttgtcaattcaggagaaactgtactggtcagtcacatcttacggcgaagggagagggaccttaggggagcagagaagacaggcaaagttgtggactgtttgatcttgtattacccacaggaatgagggcagctaaacccatagaaggagttggaccaaggcgaattacgagtcctggtcccagcagtatgtgtgctgacttctgggtgccccagaaatagacctctcctgtagagtggtgatatacagaatgagtttcagtttgcattgcagctgggattgaaagtaatcagtcgtgagcaggcaggcaggaggtcctgttagccctgccttccaggaaggttggggtgggagttttgagtgggaaagaggatgacatgtgtgagagagttctgagcctgtttgctagggagagtgagtgagtgctcttgggcactgctcaggccgtttctgctgacttgcctggcttacaataaatgcccaataaatatttgttgaccatatgtgttgtacactgtggtgccctgtccagtcccctctaccaagctgagacccccatccccagctgctctgagtttgggctgcaagtgctcacagctcttgttctccagaaactggagaattgccctcaggagatgagagccatctcacctcacccaggagtcacttcctctctacaccccaacacctggttcatttgattaaagcggagaaaactccagggtgctatgactgctctggcacccttggatcaggccaagctagactttttctgagccttcatccgtgctaagctctctcccttctctatcctgtttcattccctccctcaaaggcgtttcccaaataaatcacactgtcaatca

SEQ ID NO: 204153 - DNA, 3111 bp, Homo sapiens
  Payload ID: 20267
  Gene Name: zinc finger with KRAB and SCAN domains 5
  Uniprot ID: Q9Y2L8
  ENST ID: ENST00000451158
  CDS Start-End: 162-2681
gactcgcgggtgtgacgttgaagatgtcggccttctgagccgactgcggtggtcaagaggttgcatgctactgaaagtgtccttcagaagatattaaagagcagaaaaacaattgtttcagtgtaacacagccagcctcgaagacttccctctgagttggaatgataatgaccgaatcccgagaagttatagacttagaccccccagctgagacttcccaggagcaggaagaccttttcatagtgaaggtggaagaagaagactgcacctggatgcaggagtacaacccgccaacgtttgagactttttaccagcgcttcaggcacttccagtaccatgaggcttcaggaccccgggaggctctcagccaactccgggtgctctgctgtgagtggctgaggcccgagctgcacacgaaggagcagatcctggagctgctggtgctggagcagttcctgaccatcctgcctgaagagttccagccctgggtgagggaacatcaccctgaaagtggagaagaggcggtggccgtgatagaaaatatacagcgagaacttgaggaacgcagacagcagattgttgcctgccctgatgtgcttcctcggaagatggcaacacctggagcagtgcaggagtcctgcagcccccatcccctgaccgtggacacccagcctgagcaagcgccacagaagcctcgtctcctggaggaaaatgcccttcctgttctccaagttccttcccttcccctgaaggacagccaggagctgacagcttcacttctctcaactgggtcccagaagttggtgaaaattgaagaggtggctgatgtggctgtatccttcatcctggaggaatgggggcatttggaccagtcccagaagtccctttatagggatgacaggaaggagaactatgggagtattacttccatgggttatgagtccagggacaatatggagctcatagtgaagcagatttctgatgactctgaatcacactgggtggcgccagaacacaccgaaaggagcgttcctcaggatccagactttgcagaagtcagtgaccttaaaggcatggtacaaaggtggcaggtcaaccccactgtggggaaatcaaggcagaatccttcccagaaaagggatctggatgcaatcacagacatcagccctaagcaaagcacacatggcgagagagggcacagatgcagcgattgtggcaaattcttcctccaagcctcaaactttattcagcatcggcgcatccacactggagaaaaaccgtttaagtgcggagaatgtgggaagagctacaatcagcgggtgcacctcacccagcaccagcgcgtccacacaggggagaaaccctacaaatgtcaggtgtgcggaaaggctttccgggtgagttcccacctggttcagcaccacagtgtccacagcggagagaggccctatggctgcaatgagtgtgggaagaacttcggtcgccattcgcatctgatcgaacacctaaaacgccacttcagggagaaatcccagagatgcagtgacaaaagaagtaagaacacaaaattaagtgttaagaagaaaatttcagaatattcagaagcagacatggaactatctggaaaaacccaaagaaatgtttctcaagttcaagattttggagaaggctgtgagtttcaaggcaagctggatagaaagcagggaattcccatgaaagagatactaggacaaccatcttcaaagaggatgaactacagtgaagtcccatatgtccacaaaaaatcctccactggagagagaccacataaatgtaacgagtgtgggaaaagcttcattcagagtgcacatcttattcaacatcaaagaatacacactggggagaaaccattcaggtgtgaggaatgtgggaaaagctacaaccaacgcgtgcacctaactcagcatcagcgcgtccacacaggtgagaagccctacacctgtcccttatgtgggaaagccttcagagtgaggtcccaccttgttcagcatcagagcgtgcacagtggggagagacccttcaagtgtaacgaatgtgggaaaggctttgggaggcgttcccacctggctggacatcttcgactccactcccgagagaaatcccatcagtgtcgtgaatgtggggaaatcttttttcagtacgttagcctaattgaacatcaggtgctccacatgggtcagaaaaatgaaaaaaatggcatctgtgaggaagcatatagttggaacttgacagtgattgaagacaagaagattgagttacaagagcagccttatcagtgtgatatctgtggaaaagcctttggttatagctcagacctcattcagcattacagaactcatacagcagagaagccctatcaatgtgatatatgtagagaaaatgttggccagtgttcccacaccaaacaacatcaaaaaatctactccagcacaaaatcccatcaatgtcatgaatgtggcagaggcttcactctgaagtcacatcttaatcaacatcagagaatccatactggtgagaaaccttttcaatgtaaagaatgtggaatgaatttcagctggagttgtagcctctttaaacacctgagaagccatgagaggacagatcccataaataccttaagtgtagaggggtctctgttgtagaatagctcttaattttagagaaaccttcctggagggaaaccatactcctataatgagcaaagtaacaacttcaagcatttttccagcgttaccatcaaactcacaaataggttgaaatcctttagttataactcagcctttaggaacaccggagaacccacaataatagaaatcttttcgtgttccccattgagaaatgctttagttagcatcttcatgcttggaaatctagacaagaagagaatccatggatggacatggtcgaggaattcggaaagcctgcagttgacattcagtcttcacttgaaactcaaaactgacactaggaacagcttcatgagttcagtagaagtaagctttatttgtagcttctgccttgtttgacggcgtatctattcagggaagcgcacagtaaaagaattccttagca

SEQ ID NO: 204154 - DNA, 5626 bp, Homo sapiens
  Payload ID: 20267
  Gene Name: zinc finger with KRAB and SCAN domains 5
  ENST ID: ENST00000454175
  CDS Start-End: 792-1460
ggacttggttacttccggcgaggaagtgttggggagtgtcggcttcggtttctctccgtgggaagaaccgcatcttcccagcctcggctgcggggagcttgatgttccaggagagctcccctagagtggggccttgaggggagggggcaggggcttcgtgactggacgggggtcctgtccctaaccttgaccgggccacagtctctgtatctcggggtcaggggccattctgaggaatccaggtccagatctgtaccttataaacgctgcttctctttgggaccgatggagtctccccttggcctgtcaagctcttgtagcttagagaacaggctcagttttgaccattataatgattttcacccttattccgacttaagttcgtcttatggtagagagaaagagcggctgcgtctggactagttagtctcgtcccgttatttatatggaatgtaaagttcttcactctaaaactgtgttttaggttgggcctgatgtcagatttgtatggctctcttttacacttttaaaatgttggggttattccttattatcattttgtgggtgaagtgatggctaccttgtagtacctatttttaagtaaattactttgttgagtggtcgtctttagtatagatgacctctttgccatctgtctttgctaataatgatgcccaatacatcagtaggttgcatgctactgaaagtgtccttcagaagatattaaagagcagaaaaacaattgtttcagtgtaacacagccagcctcgaagacttccctctgagttggaatgataatgaccgaatcccgagaagttatagacttagaccccccagctgagacttcccaggagcaggaagaccttttcatagtgaaggtggaagaagaagactgcacctggatgcaggagtacaacccgccaacgtttgagactttttaccagcgcttcaggcacttccagtaccatgaggcttcaggaccccgggaggctctcagccaactccgggtgctctgctgtgagtggctgaggcccgagctgcacacgaaggagcagatcctggagctgctggtgctggagcagttcctgaccatcctgcctgaagagttccagccctgggtgagggaacatcaccctgaaagtggagaagaggcggtggccgtgatagaaaatatacagcgagaacttgaggaacgcagacagcagattgttgcctgccctgatgtgcttcctcggaagatggcaacacctggagcagtgcaggagtcctgcagcccccatcccctgaccgtggacacccagcctgagcaagcgccacagaagcctcgtctcctggaggaaaatgcccttcctgttctccaagttccttcccttcccctgaaggacagccaggagctgacagcttcacttctctcaactgggtcccaggttatgagtccagggacaatatggagctcatagtgaagcagatttctgatgactctgaatcacactgggtggcgccagaacacaccgaaaggagcgttcctcaggatccagactttgcagaagtcagtgaccttaaaggcatggtacaaaggtggcaggtcaaccccactgtggggaaatcaaggcagaatccttcccagaaaagggatctggatgcaatcacagacatcagccctaagcaaagcacacatggcgagagagggcacagatgcagcgattgtggcaaattcttcctccaagcctcaaactttattcagcatcggcgcatccacactggagaaaaaccgtttaagtgcggagaatgtgggaagagctacaatcagcgggtgcacctcacccagcaccagcgcgtccacacaggggagaaaccctacaaatgtcaggtgtgcggaaaggctttccgggtgagttcccacctggttcagcaccacagtgtccacagcggagagaggccctatggctgcaatgagtgtgggaagaacttcggtcgccattcgcatctgatcgaacacctaaaacgccacttcagggagaaatcccagagatgcagtgacaaaagaagtaagaacacaaaattaagtgttaagaagaaaatttcagaatattcagaagcagacatggaactatctggaaaaacccaaagaaatgtttctcaagttcaagattttggagaaggctgtgagtttcaaggcaagctggatagaaagcagggaattcccatgaaagagatactaggacaaccatcttcaaagaggatgaactacagtgaagtcccatatgtccacaaaaaatcctccactggagagagaccacataaatgtaacgagtgtgggaaaagcttcattcagagtgcacatcttattcaacatcaaagaatacacactggggagaaaccattcaggtgtgaggaatgtgggaaaagctacaaccaacgcgtgcacctaactcagcatcagcgcgtccacacaggtgagaagccctacacctgtcccttatgtgggaaagccttcagagtgaggtcccaccttgttcagcatcagagcgtgcacagtggggagagacccttcaagtgtaacgaatgtgggaaaggctttgggaggcgttcccacctggctggacatcttcgactccactcccgagagaaatcccatcagtgtcgtgaatgtggggaaatcttttttcagtacgttagcctaattgaacatcaggtgctccacatgggtcagaaaaatgaaaaaaatggcatctgtgaggaagcatatagttggaacttgacagtgattgaagacaagaagattgagttacaagagcagccttatcagtgtgatatctgtggaaaagcctttggttatagctcagacctcattcagcattacagaactcatacagcagagaagccctatcaatgtgatatatgtagagaaaatgttggccagtgttcccacaccaaacaacatcaaaaaatctactccagcacaaaatcccatcaatgtcatgaatgtggcagaggcttcactctgaagtcacatcttaatcaacatcagagaatccatactggtgagaaaccttttcaatgtaaagaatgtggaatgaatttcagctggagttgtagcctctttaaacacctgagaagccatgagaggacagatcccataaataccttaagtgtagaggggtctctgttgtagaatagctcttaattttagagaaaccttcctggagggaaaccatactcctataatgagcaaagtaacaacttcaagcatttttccagcgttaccatcaaactcacaaataggttgaaatcctttagttataactcagcctttaggaacaccggagaacccacaataatagaaatcttttcgtgttccccattgagaaatgctttagttagcatcttcatgcttggaaatctagacaagaagagaatccatggatggacatggtcgaggaattcggaaagcctgcagttgacattcagtcttcacttgaaactcaaaactgacactaggaacagcttcatgagttcagtagaagtaagctttatttgtagcttctgccttgtttgacggcgtatctattcagggaagcgcacagtaaaagaattccttagcatgatgtctgttttggtacctcagcaatgaaccttttctagaaattattattccaaccactagaataccctagtcactattcccactttgagcattaacccctttgaaaagaaatggacttaaagtatctctgttttggcaaaattcaggttcaggggctggatggtatgtgtttctgctgccttattcaatccaccacttctctgtgaaacactctaccttgtttttggtttgattctactgatgtcagggtttagccggtagaaggagtagttcagtttgtcaattcaggagaaactgtactggtcagtcacatcttacggcgaagggagagggaccttaggggagcagagaagacaggcaaagttgtggactgtttgatcttgtattacccacaggaatgagggcagctaaacccatagaaggagttggaccaaggcgaattacgagtcctggtcccagcagtatgtgtgctgacttctgggtgccccagaaatagacctctcctgtagagtggtgatatacagaatgagtttcagtttgcattgcagctgggattgaaagtaatcagtcgtgagcaggcaggcaggaggtcctgttagccctgccttccaggaaggttggggtgggagttttgagtgggaaagaggatgacatgtgtgagagagttctgagcctgtttgctagggagagtgagtgagtgctcttgggcactgctcaggccgtttctgctgacttgcctggcttacaataaatgcccaataaatatttgttgaccatatgtgttgtacactgtggtgccctgtccagtcccctctaccaagctgagacccccatccccagctgctctgagtttgggctgcaagtgctcacagctcttgttctccagaaactggagaattgccctcaggagatgagagccatctcacctcacccaggagtcacttcctctctacaccccaacacctggttcatttgattaaagcggagaaaactccagggtgctatgactgctctggcacccttggatcaggccaagctagactttttctgagccttcatccgtgctaagctctctcccttctctatcctgtttcattccctccctcaaaggcgtttcccaaataaatcacactgtcaatcacatggttctgaatccctgtctcaggctctgctttagagaacctgatctaagacatttggtgccacaagtggtcataggaagctgctgtgagagtggattgtggagttggtcactcgccaggagggagtgaagacccgcatcactgttaatagtcctggcatgtggtacctgtccagtcactaagtcattcacttgtggggaactgggatgagatacaggtggaaagcgatctattgacttgtagaggtttgggacaaacaggaaaataaagattatggaattgggtggctcttgctgaaagtcactgaatccttgaagagaagaaaatgacagggcaaataaccaccaatttaatgccaagtgtgtgtcagaggaccttcttggtagctttttaatttttttatagacagggtcttgctctgctgcccaggctagagtgcagtggtgcaatcacagctcactgcagccttgacctcccgggctcaagtggtctagccacctcagcctcctgaatagctgggactacaggcacatgccaccatgagtggctaatttttaaaaaacatactttagctgggcgcggtggctcatgcctataaacccagcactttgggaggctgaggcgggcagatcacgaggtcaagagatcgaaaccatcctggccaaccaacatggtgaaacccggtctctacttaaaatacaaaaattagctgggcatagtggcgcatgcctatagtcccagctactccagaggctgaggcaggagaatcgcttgaacccgggaggcagaggttgcagtgagctgagatcacgccactgcactctagcccagttgacagagcgacagtgtctaaaaaaaaaaaaaaaaaaaaaaaaaa

SEQ ID NO: 204155 - DNA, 3477 bp, Homo sapiens
  Payload ID: 20268
  Gene Name: zinc finger with KRAB and SCAN domains 7
  Uniprot ID: Q9P0L1
  ENST ID: ENST00000273320
  CDS Start-End: 430-2694
attgtttttggtctaacgggcagtagagtgtccggcttcggtgccgagtgccaccgcgagtgggccgagacgcggagggaggcgcggccggagctcgggtcgccgacgctggccaggaccgcgcttcttcccggcggcaggcggcgcggtccccgtgactctcagaagccgcccgatgtagagccgcttctttgtctcatacccctgaccattcgtgcgtggcacggagccgggtatctgcgggtacagcgatgaacagggcagacgtggccaggtgagcggcgctgctgaagcctggtttaacacgaaaggccacactaccatcacccctttctccaaccctgaaaaacagttcctgagacctgaactattgaccatcattttaatcggaccaactgcagctgtaacaagcttctctttggggtcacaatgaccactgcaggcaggggaaatttaggcctcatccccaggagcactgctttccagaagcaagaggggcgcctgactgtgaagcaggagccagcaaaccagacctgggggcagggcagcagtctccagaagaactatcctcctgtctgcgaaatcttccggctacacttcaggcaattgtgttaccacgagatgtctgggccgcaggaagcattgagccggcttcgggagctctgccgctggtggctcatgccagaggtgcacaccaaggagcagatcctggagctgctggtgcttgagcagttcctgagcatcctccctggggagctccggacctgggtgcagctgcatcaccctgagagtggtgaggaggctgtggctgtggtggaggatttccagagacacctcagtggatcagaggaggtttcagccccagcacagaaacaggaaatgcattttgaggagacaacagctctgggtacaacaaaggaatctcctcctacctcacccctcagtgggggctcagcccctggagcccacctggagcctccttatgacccagggacacaccacctccccagtggggacttcgctcaatgtacttctccagttcctacccttcctcaagtggggaactcaggagaccaagcaggggcaactgtacttcggatggtcaggccccaggatactgtggcatatgaggacctatctgtagactacactcagaagaaatggaaaagtctcacactcagtcagagagccctgcagtggaacatgatgccagaaaatcaccatagcatggcctccttggcaggtgagaacatgatgaagggttcagagttgactccaaagcaggaattttttaaaggatcagagtcatctaacaggacatcagggggactctttggggtggttcctggggcagcagagactggagatgtttgtgaagatactttcaaggagttagaaggacaaacctcagatgaagaagggagcagactagaaaatgatttcttggaaataacagatgaagataagaaaaaatccacaaaagacagatatgacaaatataaggaagttggggaacatccacctctgtcttccagtcctgttgaacatgaaggagttttaaagggacagaaatcctatcgatgtgatgaatgtggcaaagctttcaatcggagttctcaccttattggccatcagagaatccacactggagagaaaccctatgagtgtaatgagtgtgggaagaccttcaggcaaacctcccagctcattgttcatctcagaacccacacaggggaaaaaccctatgaatgcagtgagtgtggaaaggcctataggcacagctcccatctcattcaacaccagagactccataatggggagaaaccctataaatgtaatgaatgtgcaaaagcctttactcagagttcccgactcactgaccaccagagaacccatactggggagaaaccttatgaatgcaatgagtgtggagaggcattcattcgaagcaaaagtcttgctcgacatcaggtcctgcacactggtaagaaaccttacaaatgcaatgagtgtgggagagcattctgttccaatagaaatctcattgaccatcagagaatccacactggggagaagccttatgagtgtagtgaatgtggcaaagccttcagtcggagtaaatgtcttattcgacatcagagcctccatactggggaaaagccatacaaatgtagtgaatgtgggaaagccttcaatcagaactctcaactcattgagcatgagcgaattcatactggagaaaaaccttttgaatgtagcgagtgtggtaaggcatttggtctgagtaaatgtcttattcggcaccagagacttcacacgggtgaaaagccctataaatgcaatgagtgtggaaaatccttcaatcaaaactcacaccttattatacaccagagaattcacactggtgagaaaccctatgaatgtaatgagtgtgggaaggtattcagttatagctccagccttatggtacatcagagaacccatactggggaaaaaccctataaatgcaatgattgtgggaaagcttttagtgacagctcacagcttattgtacaccagagagtccacaccggagagaaaccttatgaatgtagtgaatgtgggaaagcctttagtcagcgttccacttttaatcaccaccagcgaactcacactggagagaagtcctcaggtctggcttggtcagtttcttaaggtatggttctctgagacagagagcaacgacctttgagttaagctgtctttataagcaggatgctcatagtggtttcccggagccagtagtcacggtggaccattccctacttgcttttccttggatcactaaggtgggagagtaggagtaacttattccagttcttacccattattaggaaggtaaggactacacatgtcattgaattgtaggtttcctttttttttctttacttttaaattttaacttttaaaatctatttcatttcttagttatgcatctcataatcagactccatgctttttaaagacagagataatatcttctctattctattctacttcctccatttcaccatttatacaaagtcattcaaaaaggctgattcatgccttcctgcctcttggctatggccctccccatctactctttaaactttaatctataacttttcatcagttttgttccctatctagaaaacattttcttctgtttgctaatctttgtccctcacaatttttgaaatccatctcatcactgaaatactttcttcttcaagtacttttttatttttcttcaacttctcttgatttgacctcagtgctttgaattcactggtgctacaatatgtaactgtggttaattgccttgtaaattttgcgtgtctgtatacttttataccaacttattgtaggctctttgaggtcaggtatgtatttctttcccatatagatagtattttgtacataccagttgttaaataaataatttttaaaatctca

SEQ ID NO: 204156 - DNA, 1757 bp, Homo sapiens
  Payload ID: 20268
  Gene Name: zinc finger with KRAB and SCAN domains 7
  Uniprot ID: Q9P0L1
  ENST ID: ENST00000341840
  CDS Start-End: 435-1265
cggccattgtttttggtctaacgggcagtagagtgtccggcttcggtgccgagtgccaccgcgagtgggccgagacgcggagggaggcgcggccggagctcgggtcgccgacgctggccaggaccgcgcttcttcccggcggcaggcggcgcggtccccgtgactctcagaagccgcccgatgtagagccgcttctttgtctcatacccctgaccattcgtgcgtggcacggagccgggtatctgcgggtacagcgatgaacagggcagacgtggccaggtgagcggcgctgctgaagcctggtttaacacgaaaggccacactaccatcacccctttctccaaccctgaaaaacagttcctgagacctgaactattgaccatcattttaatcggaccaactgcagctgtaacaagcttctctttggggtcacaatgaccactgcaggcaggggaaatttaggcctcatccccaggagcactgctttccagaagcaagaggggcgcctgactgtgaagcaggagccagcaaaccagacctgggggcagggcagcagtctccagaagaactatcctcctgtctgcgaaatcttccggctacacttcaggcaattgtgttaccacgagatgtctgggccgcaggaagcattgagccggcttcgggagctctgccgctggtggctcatgccagaggtgcacaccaaggagcagatcctggagctgctggtgcttgagcagttcctgagcatcctccctggggagctccggacctgggtgcagctgcatcaccctgagagtggtgaggaggctgtggctgtggtggaggatttccagagacacctcagtggatcagaggaggtttcagccccagcacagaaacaggaaatgcattttgaggagacaacagctctgggtacaacaaaggaatctcctcctacctcacccctcagtgggggctcagcccctggagcccacctggagcctccttatgacccagggacacaccacctccccagtggggacttcgctcaatgtacttctccagttcctacccttcctcaagtggggaactcaggagaccaagcaggggcaactgtacttcggatggtcaggccccaggatactgtggcatatgaggacctatctgtagactacactcagaagaaatggaaaagtctcacactcagtcagagagccctgcagtggaacatgatgccagaaaatcaccatagcatggcctccttgggctggagtacaatggcgtgatcttggctcacttcaatctccagctcccgagttcaagcgattctcctgcctcagactcctgagtagctgggattacaggcgcctgccaccatgcccagctaatttttgtaatatttagtagagacggggtttcaccatgttggccaggctggtttcgaactcctgacctcaggtgatccacccgcctcagcctcccaaagtggtgggattacaggcgtgagccaccacacccagcctattctttttaagtttcttgatgtagtggcagtagtcttgtgctcttcaggagagtgtcccgagttctacgtcccacatcaactgagggtgtgaacttgtggaggacttttgtctgaatctctttttcaatctctatacaatgtggcggagttgtgccacctacatgagccaatggagaagaaagctcctggtatactttaagtactcaacaatattaaatactgaatatttgtcaattgacgaagtacttcaaaa

SEQ ID NO: 204157 - DNA, 476 bp, Homo sapiens
  Payload ID: 20268
  Gene Name: zinc finger with KRAB and SCAN domains 7
  ENST ID: ENST00000419137
  CDS Start-End: 1-366
cctcctacctcacccctcagtgggggctcagcccctggagcccacctggagcctccttatgacccagggacacaccacctccccagtggggacttcgctcaatgtacttctccagttcctacccttcctcaagtggggaactcaggagaccaagcaggggcaactgtacttcggatggtcaggccccaggatactgtggcatatgaggacctatctgtagactacactcagaagaaatggaaaagtctcacactcagtcagagagccctgcagtggaacatgatgccagaaaatcaccatagcatggcctccttggatggtgaaactgggactgaggaggagttaattccaaagcatcattcctgaaaaatcagaatcatacatactttcaagagaattccacagagacattgcccaggaagtcaaaatttagaaggctcctctgaagggaaagagaagactagagaggacactgg

SEQ ID NO: 204158 - DNA, 2791 bp, Homo sapiens
  Payload ID: 20268
  Gene Name: zinc finger with KRAB and SCAN domains 7
  Uniprot ID: Q9P0L1
  ENST ID: ENST00000426540
  CDS Start-End: 408-2672
gcttccggctcggccattgtttttggtctaacgggcagtagagtgtccggcttcggtgccgagtgccaccgcgagtgggccgagacgcggagggaggcgcggccggagctcgggtcgccgacgctggccaggaccgcgcttcttcccggcggcaggcggcgcggtccccgtgactctcagaagccgcccgatgtagagccgcttctttgtctcatacccctgaccattcgtgcgtggcacggagccgggtatctgcgggtacagcgatgaacagggcagacgtggccaggccacactaccatcacccctttctccaaccctgaaaaacagttcctgagacctgaactattgaccatcattttaatcggaccaactgcagctgtaacaagcttctctttggggtcacaatgaccactgcaggcaggggaaatttaggcctcatccccaggagcactgctttccagaagcaagaggggcgcctgactgtgaagcaggagccagcaaaccagacctgggggcagggcagcagtctccagaagaactatcctcctgtctgcgaaatcttccggctacacttcaggcaattgtgttaccacgagatgtctgggccgcaggaagcattgagccggcttcgggagctctgccgctggtggctcatgccagaggtgcacaccaaggagcagatcctggagctgctggtgcttgagcagttcctgagcatcctccctggggagctccggacctgggtgcagctgcatcaccctgagagtggtgaggaggctgtggctgtggtggaggatttccagagacacctcagtggatcagaggaggtttcagccccagcacagaaacaggaaatgcattttgaggagacaacagctctgggtacaacaaaggaatctcctcctacctcacccctcagtgggggctcagcccctggagcccacctggagcctccttatgacccagggacacaccacctccccagtggggacttcgctcaatgtacttctccagttcctacccttcctcaagtggggaactcaggagaccaagcaggggcaactgtacttcggatggtcaggccccaggatactgtggcatatgaggacctatctgtagactacactcagaagaaatggaaaagtctcacactcagtcagagagccctgcagtggaacatgatgccagaaaatcaccatagcatggcctccttggcaggtgagaacatgatgaagggttcagagttgactccaaagcaggaattttttaaaggatcagagtcatctaacaggacatcagggggactctttggggtggttcctggggcagcagagactggagatgtttgtgaagatactttcaaggagttagaaggacaaacctcagatgaagaagggagcagactagaaaatgatttcttggaaataacagatgaagataagaaaaaatccacaaaagacagatatgacaaatataaggaagttggggaacatccacctctgtcttccagtcctgttgaacatgaaggagttttaaagggacagaaatcctatcgatgtgatgaatgtggcaaagctttcaatcggagttctcaccttattggccatcagagaatccacactggagagaaaccctatgagtgtaatgagtgtgggaagaccttcaggcaaacctcccagctcattgttcatctcagaacccacacaggggaaaaaccctatgaatgcagtgagtgtggaaaggcctataggcacagctcccatctcattcaacaccagagactccataatggggagaaaccctataaatgtaatgaatgtgcaaaagcctttactcagagttcccgactcactgaccaccagagaacccatactggggagaaaccttatgaatgcaatgagtgtggagaggcattcattcgaagcaaaagtcttgctcgacatcaggtcctgcacactggtaagaaaccttacaaatgcaatgagtgtgggagagcattctgttccaatagaaatctcattgaccatcagagaatccacactggggagaagccttatgagtgtagtgaatgtggcaaagccttcagtcggagtaaatgtcttattcgacatcagagcctccatactggggaaaagccatacaaatgtagtgaatgtgggaaagccttcaatcagaactctcaactcattgagcatgagcgaattcatactggagaaaaaccttttgaatgtagcgagtgtggtaaggcatttggtctgagtaaatgtcttattcggcaccagagacttcacacgggtgaaaagccctataaatgcaatgagtgtggaaaatccttcaatcaaaactcacaccttattatacaccagagaattcacactggtgagaaaccctatgaatgtaatgagtgtgggaaggtattcagttatagctccagccttatggtacatcagagaacccatactggggaaaaaccctataaatgcaatgattgtgggaaagcttttagtgacagctcacagcttattgtacaccagagagtccacaccggagagaaaccttatgaatgtagtgaatgtgggaaagcctttagtcagcgttccacttttaatcaccaccagcgaactcacactggagagaagtcctcaggtctggcttggtcagtttcttaaggtatggttctctgagacagagagcaacgacctttgagttaagctgtctttataagcaggatgctcatagtggtttcccggagccagtagtcacggtggaccattccctacttgctttt

SEQ ID NO: 204159 - DNA, 1502 bp, Homo sapiens
  Payload ID: 20268
  Gene Name: zinc finger with KRAB and SCAN domains 7
  ENST ID: ENST00000447279
  CDS Start-End: 66-1187
tctgcgggtacagcgatgaacagggcagacgtggccaggtttcagccccagcacagaaacaggaaatgcattttgaggagacaacagctctgggtacaacaaaggaatctcctcctacctcacccctcagtgggggctcagcccctggagcccacctggagcctccttatgacccagggacacaccacctccccagtggggacttcgctcaatgtacttctccagttcctacccttcctcaagtggggaactcaggagaccaagcaggggcaactgtacttcggatggtcaggccccaggatactgtggcatatgaggacctatctgtagactacactcagaagaaatggaaaagtctcacactcagtcagagagccctgcagtggaacatgatgccagaaaatcaccatagcatggcctccttgggtgagaacatgatgaagggttcagagttgactccaaagcaggaattttttaaaggatcagagtcatctaacaggacatcagggggactctttggggtggttcctggggcagcagagactggagatgtttgtgaagatactttcaaggagttagaaggacaaacctcagatgaagaagggagcagactagaaaatgatttcttggaaataacagatgaagataagaaaaaatccacaaaagacagatatgacaaatataaggaagttggggaacatccacctctgtcttccagtcctgttgaacatgaaggagttttaaagggacagaaatcctatcgatgtgatgaatgtggcaaagctttcaatcggagttctcaccttattggccatcagagaatccacactggagagaaaccctatgagtgtaatgagtgtgggaagaccttcaggcaaacctcccagctcattgttcatctcagaacccacacaggggaaaaaccctatgaatgcagtgagtgtggaaaggcctataggcacagctcccatctcattcaacaccagagactccataatggggagaaaccctataaatgtaatgaatgtgcaaaagcctttactcagagttcccgactcactgaccaccagagaacccatactggggagaaaccttatgaatgcaatgagtgtggagaggcattcattcgaagcaaaagtcttgctcgacatcaggtcctgcacactggctggagtacaatggcgtgatcttggctcacttcaatctccagctcccgagttcaagcgattctcctgcctcagactcctgagtagctgggattacaggcgcctgccaccatgcccagctaatttttgtaatatttagtagagacggggtttcaccatgttggccaggctggtttcgaactcctgacctcaggtgatccacccgcctcagcctcccaaagtggtgggattacaggcgtgagccaccacacccagcctattctttttaagtttcttgatgtagtggcagtagtcttgtgctcttcaggagagtgtcccgagttctacgtcccacat

SEQ ID NO: 204160 - DNA, 1294 bp, Homo sapiens
  Payload ID: 20268
  Gene Name: zinc finger with KRAB and SCAN domains 7
  ENST ID: ENST00000418719
  CDS Start-End: 372-980
agtagagtgtccggcttcggtgccgagtgccaccgcgagtgggccgagacgcggagggaggcgcggccggagctcgggtcgccgacgctggccaggaccgcgcttcttcccggcggcaggcggcgcggtccccgtgactctcagaagccgcccgatgtagagccgcttctttgtctcatacccctgaccattcgtgcgtggcacggagccgggtatctgcgggtacagcgatgaacagggcagacgtggccaggccacactaccatcacccctttctccaaccctgaaaaacagttcctgagacctgaactattgaccatcattttaatcggaccaactgcagctgtaacaagcttctctttggggtcacaatgaccactgcaggcaggggaaatttaggcctcatccccaggagcactgctttccagaagcaagaggggcgcctgactgtgaagcaggagccagcaaaccagacctgggggcagggcagcagtctccagaagaactatcctcctgtctgcgaaatcttccggctacacttcaggcaattgtgttaccacgagatgtctgggccgcaggaagcattgagccggcttcgggagctctgccgctggtggctcatgccagaggtgcacaccaaggagcagatcctggagctgctggtgcttgagcagttcctgagcatcctccctggggagctccggacctgggtgcagctgcatcaccctgagagtggtgaggaggctgtggctgtggtggaggatttccagagacacctcagtggatcagaggaggtttcagccccagcacagaaacaggaaatgcattttgaggagacaacagctctgggtacaacaaaggaatctcctcctacctcacccctcagtgggggctcagcccctggagcccacctggagcctccttatgacccagggacacaccacctccccagtggggacttcggatactgtggcatatgaggacctatctgtagactacactcagaagaaatggaaaagtctcacactcagtcagagagccctgcagtggaacatgatgccagaaaatcaccatagcatggcctccttgggtgagaacatgatgaagggttcagagttgactccaaagcaggaattttttaaaggatcagagtcatctaacaggacatcagggggactctttggggtggttcctggggcagcagagactggagatgtttgtgaagatactttcaaggagttagaaggacaaacctcagatgaagaagggagcagactagaaaatgatttcttgg

SEQ ID NO: 204161 - DNA, 1692 bp, Homo sapiens
  Payload ID: 20268
  Gene Name: zinc finger with KRAB and SCAN domains 7
  Uniprot ID: Q9P0L1
  ENST ID: ENST00000431636
  CDS Start-End: 408-1238
gcttccggctcggccattgtttttggtctaacgggcagtagagtgtccggcttcggtgccgagtgccaccgcgagtgggccgagacgcggagggaggcgcggccggagctcgggtcgccgacgctggccaggaccgcgcttcttcccggcggcaggcggcgcggtccccgtgactctcagaagccgcccgatgtagagccgcttctttgtctcatacccctgaccattcgtgcgtggcacggagccgggtatctgcgggtacagcgatgaacagggcagacgtggccaggccacactaccatcacccctttctccaaccctgaaaaacagttcctgagacctgaactattgaccatcattttaatcggaccaactgcagctgtaacaagcttctctttggggtcacaatgaccactgcaggcaggggaaatttaggcctcatccccaggagcactgctttccagaagcaagaggggcgcctgactgtgaagcaggagccagcaaaccagacctgggggcagggcagcagtctccagaagaactatcctcctgtctgcgaaatcttccggctacacttcaggcaattgtgttaccacgagatgtctgggccgcaggaagcattgagccggcttcgggagctctgccgctggtggctcatgccagaggtgcacaccaaggagcagatcctggagctgctggtgcttgagcagttcctgagcatcctccctggggagctccggacctgggtgcagctgcatcaccctgagagtggtgaggaggctgtggctgtggtggaggatttccagagacacctcagtggatcagaggaggtttcagccccagcacagaaacaggaaatgcattttgaggagacaacagctctgggtacaacaaaggaatctcctcctacctcacccctcagtgggggctcagcccctggagcccacctggagcctccttatgacccagggacacaccacctccccagtggggacttcgctcaatgtacttctccagttcctacccttcctcaagtggggaactcaggagaccaagcaggggcaactgtacttcggatggtcaggccccaggatactgtggcatatgaggacctatctgtagactacactcagaagaaatggaaaagtctcacactcagtcagagagccctgcagtggaacatgatgccagaaaatcaccatagcatggcctccttgggctggagtacaatggcgtgatcttggctcacttcaatctccagctcccgagttcaagcgattctcctgcctcagactcctgagtagctgggattacaggcgcctgccaccatgcccagctaatttttgtaatatttagtagagacggggtttcaccatgttggccaggctggtttcgaactcctgacctcaggtgatccacccgcctcagcctcccaaagtggtgggattacaggcgtgagccaccacacccagcctattctttttaagtttcttgatgtagtggcagtagtcttgtgctcttcaggagagtgtcccgagttctacgtcccacatcaactgagggtgtgaacttgtggaggacttttgtctgaatctctttttcaatctctatacaatgtggcggagttgtgccacctacatgagccaatggagaagaaagctcctggtatactttaagtactcaacaatatta

SEQ ID NO: 204162 - DNA, 1502 bp, Homo sapiens; identical to SEQ ID NO: 204159
  Payload ID: 20268
  Gene Name: zinc finger with KRAB and SCAN domains 7
  ENST ID: ENST00000627156
  CDS Start-End: 66-1187

SEQ ID NO: 204163 - DNA, 3477 bp, Homo sapiens; identical to SEQ ID NO: 204155
  Payload ID: 20268
  Gene Name: zinc finger with KRAB and SCAN domains 7
  Uniprot ID: Q9P0L1
  ENST ID: ENST00000626497
  CDS Start-End: 430-2694

SEQ ID NO: 204164 - DNA, 2791 bp, Homo sapiens; identical to SEQ ID NO: 204158
  Payload ID: 20268
  Gene Name: zinc finger with KRAB and SCAN domains 7
  Uniprot ID: Q9P0L1
  ENST ID: ENST00000629379
  CDS Start-End: 408-2672

SEQ ID NO: 204165 - DNA, 1692 bp, Homo sapiens; identical to SEQ ID NO: 204161
  Payload ID: 20268
  Gene Name: zinc finger with KRAB and SCAN domains 7
  Uniprot ID: Q9P0L1
  ENST ID: ENST00000625422
  CDS Start-End: 408-1238

SEQ ID NO: 204166 - DNA, 1757 bp, Homo sapiens; identical to SEQ ID NO: 204156
  Payload ID: 20268
  Gene Name: zinc finger with KRAB and SCAN domains 7
  Uniprot ID: Q9P0L1
  ENST ID: ENST00000629459
  CDS Start-End: 435-1265

SEQ ID NO: 204167 - DNA, 476 bp, Homo sapiens; identical to SEQ ID NO: 204157
  Payload ID: 20268
  Gene Name: zinc finger with KRAB and SCAN domains 7
  ENST ID: ENST00000627589
  CDS Start-End: 1-366

SEQ ID NO: 204168 - DNA, 1294 bp, Homo sapiens; identical to SEQ ID NO: 204160
  Payload ID: 20268
  Gene Name: zinc finger with KRAB and SCAN domains 7
  ENST ID: ENST00000627201
  CDS Start-End: 372-980

SEQ ID NO: 204169 - DNA, 7376 bp, Homo sapiens
  Payload ID: 20269
  Gene Name: zinc finger with KRAB and SCAN domains 8
  Uniprot ID: Q15776
  ENST ID: ENST00000330236
  CDS Start-End: 185-1921
gctttcatcgcctttactccccgaccttccttcgagtctgtttatccgttgcagcctcccttccccacgacggggcgcctctgcaactcacaaagtacccttagaaagaggccctcagaagagtcttctcttaagaagataaagaaggtagtggaaacgaacttcctgagcttttcaggctctaatggctgaagaatcaagaaagccttcagccccatccccaccagaccagactcctgaagaggatcttgtaatcgtcaaggtagaggaggatcatggttgggaccaggaatctagtctgcatgaaagtaaccctcttggccaagaagtgttccgcctgcgcttcaggcagttacgctaccaggagacactaggaccccgagaagctctgatccaactacgggccctttgccatcagtggctgaggccagatttgaacaccaaggaacagatcctggagctgctggtgctggagcagttcttgaccatcctacctgaggagctccagacactggttaaggaacatcagctagagaacggagaggaggtggtgaccctattagaggatttggaaaggcagattgatatactaggacgaccagtctcagctcgcgtacatggacatagggtactctgggaggaggtagtacattcagcatctgcaccagagcctccaaatactcagctccaatctgaggcaacccaacataaatctccagtgccccaagagtcacaagagagagccatgtctacttcccagagtcctactcgttcccagaaaggaagttctggagaccaggaaatgacagctacacttctcacagcagggttccagactttggagaagattgaagacatggctgtgtcccttattcgagaggagtggcttcttgatccatcacagaaggatctgtgtagagataacaggccagaaaatttcagaaacatgttctccctgggtggtgagaccaggagtgagaacagggaattagcttcaaaacaggtaatatctactggaatccagccacatggagagacagctgccaaatgcaacggggatgttatcaggggtcttgagcatgaagaagcccgagaccttctgggcagattagagaggcagcggggaaatcccacacaagagagacgacataaatgtgatgaatgtgggaaaagctttgctcagagctcaggccttgttcgccactggagaatccacactggggagaaaccctatcagtgtaatgtgtgtggtaaagccttcagttacaggtcagcccttctttcacatcaggatatccacaacaaagtaaaacgctatcactgtaaggagtgtggcaaagccttcagtcagaacacaggcctgattctgcaccagagaatccacactggggagaagccatatcagtgcaatcagtgtgggaaggctttcagtcagagtgcgggccttattctgcaccagagaatccacagtggagagagaccctatgaatgtaatgagtgtgggaaagctttcagtcatagctcacacctcattggacatcagagaatccacactggggagaagccctatgagtgtgatgagtgtgggaaaaccttcaggcggagctcacatcttattggtcatcagaggagccacactggggagaaaccctacaaatgcaatgagtgtgggagggccttcagtcagaagtcaggccttattgaacatcagagaatccacactggagaaagaccctataaatgtaaagaatgtgggaaagctttcaatgggaacactggtctcattcaacacctgagaattcacacaggggagaagccctaccaatgtaatgagtgtgggaaagcctttattcagaggtcaagtctcattcgacatcagagaatccacagtggtgaaaaatctgaatccataagcgtttaggaacaacatcagttagagtttgagcattattcagcattagggaaaccacacactggtgagaggtctttcagtgtactaaaaggcagaaaggtcatcacaactttagtgtcagaatctatagtggtggcaaagttaggatagctctttagtaatttgggcccagtgccttggtgaaggttgattagcttgactgtctttgaaagtatctgatggagctcctgatgacctaatgtatcctttagaaatttaaaatagcattagagcaagttgcttgtcatggcttgaagagcttaactttgtcttttgggtgagtagctataggtttgagagaggctggctactcctagttcctgtgcttcttcccatctcctgtgatccccctctcccatttattcccttgaaggtgcccttgtattcctaatctgatctaagaagctgctgtagagtcagaagtagcttctgtgtgaaacttatatttgtatgtagctttctaggaaaattttacagacacttaaagtatttatgcttaagtgtgcatttttttattctaatattccttctagtcagtggaaatttgtattcccatacaaactcagaatgctatatttttaacagcactccagcatttttcttcatgtatcaccttcactgactccattgagtcattgagcatctgtacatatccttcaccacccccagtcccagcacctgtgtcagtaaagaaagtggacacattagtaatggttatgggagtaatacagagaaagaggtgagtggagactcagcccagctgctcttgagcttggatagttatacattttggtgacttctgactctccttccacctccccactgtacactgtggtacagatagttggcactatcctagttatggcatcaggtaggagaaggagacgaagatgctttaggaagataaaaaccttacaaagaatgtatactcatcttttttggcccattacaatactgctttctcaggttcttaacagcctgtgcaaactccctgactagatggtctgtcactcctatcattaccttgcacccatctctttagatggcctcagcacctcactcgttattctccatctgtttcttgccattagtttatatgactttaatatccacagtggtaatctaataccttacctcacaggttttcattcttttgaactctggtgcactccatctgtaatccatgtctataatctaccaacaaagatgtactcttaaactcagtatcaccaggcactatatttcatctttgaggcttttgttataccaaggaatactatataaagtaatgagactggtttaaagtaacatgccagaacttacgcatccaatgtgggttgtcacttgttattcccaagtactattattccatactactatattcttccaaatatttggaacactcttagaattcccatttaataaaccatatgagaaaaccctctattactcttacactttagttttaccatttgagtagccacttattcaccagagttggaattgagaaattttgggctttccaaaattaacctttaaacttaaaattgattacattgagcctattcagaaaaaaaattatataggttctgatgaaagcttcataatttcaccctgtgactatcctgaaaagaaataataatcattttatgattgatgggccaaaaaaagcaatcaaagtcttacgtcatagaggaccaccttttggatcataaattctttccctataacattccttctctgcctctctatggcccactttgaccactaacaacatcagaattatctacatcaatttcattgagccattggtgaatgaagacacccatcacttgtcatgttggtttccaacagtcctttcgattatcctttattttcttatcctcccttctcttgtttcttttatttataagttaccattcctagtttctttgtacttgaaattttaagaaaccagaaacaagtaaatctggttgtatctagatctttgctctgtgtttcagttgtgccttaccctctgtaagatactgattcttcctggggccagtattaccttgtatgcaaatattacatatgatgggtgcattgtcagagggaaaatatatgtgtatgtacacatgtgtatgtacacacacacacacacctgccatacactttagaagaacgcttctcttctattccaataaaaagtccttttagcaatgcaacatattaacaaaattgggtgcattcagggtggtatggccatagaccagagcaacacattgaaatgtatacagatgtactagctaaagtctctttatgtgtcagtattaagagtaatatgtagccagattacttaaatctcagaattactaagcatgtggcataaatttggagaaaataatatgactagaaaaattagtgttatattgggtgtgagaaaagactgtgtcttgaaagaattatcaaagctgatacagcacatatacagaattagccaaatggtataagacaatagaaaaaggctgtggattctttgaggacatcactagaaatcattctttgtctcaagttcacactcttagcatagaatattattgactaggctgtatgacattttgagctcttaactgtgaatggcattcattaagctcctttatcctatagattctatctttatgttcatctgaaatgaactattcatcagtactttctcctcccatcctaagcttctcattttaggaactgacatgataaggtggttctttcataactctaatgccatccaacatagccctgggagaggcatgttaggtttcagagattttctccatggagcaaggtgcagtgctagaatatggtggttgattcccaaacagagcagttaactttactcttggttctgagtctccaaataataatagccgacgtttattgagcacttactatgtgcccaaccctgttatgcctttctcaggctcatgataaatgtattagtctgttctcatgctgctattaaagacatacctgacactgggtaatttataaaggaaagaggtttaatggactcagttccacatggctggggacgcctcacaatcatggtggaaggcaaggaggagcaaatcatgtcttatacatggatggcagcaggcaaagagagaacttgtgcaggggaactctttataaaaccgtccgatcttgtgagacttattcactatcacaagaacagcacaggaaagttctgcccccgtgattcaattacctcccacttggtcccacccacgacacgtgggaattgtgggagctacaattcaagatgagatttggatgggacacagccaaaccatatcaataggtattattttatcccccattttataaatgaggaaacggaggcttagttgagtgagctgaccaatatcacccagccagtatgtgataaaactgattctgacccacacagtttgattctagagcctgttctgactactgtgctaaggtgtgtataatgaacatggtaattctaaccagctttttaaaaatatgtagcgcttgtcatgagaggtactggggaaaagaatgtgcagtagagtgcaaatacattacaattactggaaaattggtggaaaatgctttttggggttacaattatatcatttttaagtgttgatgctttgtagtactacaaagctaaattgtgcaaacaaaacatatttaacagagtaattgggaggataaagcaataataaattcaaatatatttttctccaaactgccaaagggaaagtagaattgtggagggaaatgaaatatccatgtaccaggccaggcagatggtcagttaggatgacaatagtaagttcatctacagcataaaatgtgaaatgctttcatcctcattgcccatttccaactaccattctgtttctcctctattgttcatggtttttcaaacatatctttgatttttcaacccccctttttcattaatctgttcttaaaacttctttttactggctttcatacttagcattccagtgaaatgttcttagactcaccagtggacaaataataaggcctttttttattattatttcttgtcttttttgatctaatttatattttatattgttgaattctccctcctttggcttgtgggatcctttttctctaatatctgtctttctttttttagttgatctttccacccactcccctttctcctcttctccactgagaataatctccctgtcttttattcacttcattttctatactcctatttatccattttgattgtttatacctactatttgtattcgaatgacttcatttttcccaccctgtgggtcagtttgtgacttttggaattttccacaggtacctgtacaacttgatatttgaaaacaggattcatcaccatatatccccagcccccgttttctttttaaacaggcctcattgcgtaattcctttgccctgaaaagtgtcaccacctttatatttttaccccagccttggagttatctttttctgctctccattctccatgtccaaaaacttgctgtcagtccagtttttaatcagttttctccttgaggcttgatctcccatttctctcatcccattatagcttttcatgtagatctgaggcccaggttactgtaattcttttttttccaatttccttgctcccaggatccccatcttgtataaagtttctaaggtgctcctcctcaaactccatttttacaatatccgtattgtaaaattttcattttcagtaacacccagtagataatttttcaaagacgatcctcctcaaacacccatttttacaatatctctattgtaaaatttcattttcactaagtaacacccagtagataattcctatggagcagtggtgttccaaattctccattacctctatgcctaatattcatcagccttcattactctctagcatattcaccttgattcaacagattcaaacttcctacagccttctactgatgtcttacaagctcttgcctctgtgcctttctcatgctattctttttgcttagattgctctttggtcccagctcatgttcatcactcccttcaaagcctttcttcctttatatcttctgactgagctctccctgattgacatcacctcatgcgatgacctccctcattctgtgctgcctcagcacttatcttttgagtttgtactgtggtccatgtacttactaatatgttgctttgtaattattttctagcactctgtgttacagtttcatatttgtatttatttccaaaattaaattgtaagctccttgagggcaggaataataacttttacatttgtatctctgcacccccgagtgcctagtatagtgctgagcacatagtaggcgtttaataaatgcttgttgaagtattgtgtggatta

SEQ ID NO: 204170 - DNA, 2071 bp, Homo sapiens
  Payload ID: 20269
  Gene Name: zinc finger with KRAB and SCAN domains 8
  Uniprot ID: Q15776
  ENST ID: ENST00000457389
  CDS Start-End: 279-2015
gctttcatcgcctttactccccgaccttccttcgagtctgtttatccgttgcagcctcccttccccacgacggggcgcctctgcaactcacagttgaagagtctataaaccaacccccctcgccccgtgccacaactccaaaaactgaaaagataagcactgccttgatgatccgtatggggaactaagtacccttagaaagaggccctcagaagagtcttctcttaagaagataaagaaggtagtggaaacgaacttcctgagcttttcaggctctaatggctgaagaatcaagaaagccttcagccccatccccaccagaccagactcctgaagaggatcttgtaatcgtcaaggtagaggaggatcatggttgggaccaggaatctagtctgcatgaaagtaaccctcttggccaagaagtgttccgcctgcgcttcaggcagttacgctaccaggagacactaggaccccgagaagctctgatccaactacgggccctttgccatcagtggctgaggccagatttgaacaccaaggaacagatcctggagctgctggtgctggagcagttcttgaccatcctacctgaggagctccagacactggttaaggaacatcagctagagaacggagaggaggtggtgaccctattagaggatttggaaaggcagattgatatactaggacgaccagtctcagctcgcgtacatggacatagggtactctgggaggaggtagtacattcagcatctgcaccagagcctccaaatactcagctccaatctgaggcaacccaacataaatctccagtgccccaagagtcacaagagagagccatgtctacttcccagagtcctactcgttcccagaaaggaagttctggagaccaggaaatgacagctacacttctcacagcagggttccagactttggagaagattgaagacatggctgtgtcccttattcgagaggagtggcttcttgatccatcacagaaggatctgtgtagagataacaggccagaaaatttcagaaacatgttctccctgggtggtgagaccaggagtgagaacagggaattagcttcaaaacaggtaatatctactggaatccagccacatggagagacagctgccaaatgcaacggggatgttatcaggggtcttgagcatgaagaagcccgagaccttctgggcagattagagaggcagcggggaaatcccacacaagagagacgacataaatgtgatgaatgtgggaaaagctttgctcagagctcaggccttgttcgccactggagaatccacactggggagaaaccctatcagtgtaatgtgtgtggtaaagccttcagttacaggtcagcccttctttcacatcaggatatccacaacaaagtaaaacgctatcactgtaaggagtgtggcaaagccttcagtcagaacacaggcctgattctgcaccagagaatccacactggggagaagccatatcagtgcaatcagtgtgggaaggctttcagtcagagtgcgggccttattctgcaccagagaatccacagtggagagagaccctatgaatgtaatgagtgtgggaaagctttcagtcatagctcacacctcattggacatcagagaatccacactggggagaagccctatgagtgtgatgagtgtgggaaaaccttcaggcggagctcacatcttattggtcatcagaggagccacactggggagaaaccctacaaatgcaatgagtgtgggagggccttcagtcagaagtcaggccttattgaacatcagagaatccacactggagaaagaccctataaatgtaaagaatgtgggaaagctttcaatgggaacactggtctcattcaacacctgagaattcacacaggggagaagccctaccaatgtaatgagtgtgggaaagcctttattcagaggtcaagtctcattcgacatcagagaatccacagtggtgaaaaatctgaatccataagcgtttaggaacaacatcagttagagtttgagcattattcagcattagggaaaccacacactgg

SEQ ID NO: 204171 - DNA, 1052 bp, Homo sapiens
  Payload ID: 20269
  Gene Name: zinc finger with KRAB and SCAN domains 8
  Uniprot ID: Q15776
  ENST ID: ENST00000536028
  CDS Start-End: 240-716
ctttttgcgagggaaccttttatgaagctttcttcatagataatcgtgttgtggttgaagagtctataaaccaacccccctcgccccgtgccacaactccaaaaactgaaaagataagcactgccttgatgatccgtatggggaactaagtacccttagaaagaggccctcagaagagtcttctcttaagaagataaagaaggtagtggaaacgaacttcctgagcttttcaggctctaatggctgaagaatcaagaaagccttcagccccatccccaccagaccagactcctgaagaggatcttgtaatcgtcaaggtagaggaggatcatggttgggaccaggaatctagtctgcatgaaagtaaccctcttggccaagaagtgttccgcctgcgcttcaggcagttacgctaccaggagacactaggaccccgagaagctctgatccaactacgggccctttgccatcagtggctgaggccagatttgaacaccaaggaacagatcctggagctgctggtgctggagcagttcttgaccatcctacctgaggagctccagacactggttaaggaacatcagctagagaacggagaggaggtggtgaccctattagaggatttggaaaggcagattgatatactaggacgaccagtaagtagaaggaggtctcagctcgcgtacatggacatagggtactctgggaggaggtagtacattcagcatctgcaccagagcctccaaatactcagctccaatctgaggcaacccaacataaatctccagtgccccaagagtcacaagagagagccatgtctacttcccagagtcctactcgttcccagaaaggaagttctggagaccaggaaatgacagctacacttctcacagcagggttccagactttggagaagattgaagacatggctgtgtcccttattcgagaggagtggcttcttgatccatcacagaaggatctgtgtagagataacaggccagaaaatttcagaaacatgttctccctgggtggtgagaccaggagtgagaaca

SEQ ID NO: 204172 - DNA, 2057 bp, Homo sapiens
  Payload ID: 20269
  Gene Name: zinc finger with KRAB and SCAN domains 8
  Uniprot ID: Q15776
  ENST ID: ENST00000606198
  CDS Start-End: 213-689
gtggccggaggggcctggtccgagtacagctttcatcgcctttactccccgaccttccttcgagtctgtttatccgttgcagcctcccttccccacgacggggcgcctctgcaactcacaaagtacccttagaaagaggccctcagaagagtcttctcttaagaagataaagaaggtagtggaaacgaacttcctgagcttttcaggctctaatggctgaagaatcaagaaagccttcagccccatccccaccagaccagactcctgaagaggatcttgtaatcgtcaaggtagaggaggatcatggttgggaccaggaatctagtctgcatgaaagtaaccctcttggccaagaagtgttccgcctgcgcttcaggcagttacgctaccaggagacactaggaccccgagaagctctgatccaactacgggccctttgccatcagtggctgaggccagatttgaacaccaaggaacagatcctggagctgctggtgctggagcagttcttgaccatcctacctgaggagctccagacactggttaaggaacatcagctagagaacggagaggaggtggtgaccctattagaggatttggaaaggcagattgatatactaggacgaccagtaagtagaaggaggtctcagctcgcgtacatggacatagggtactctgggaggaggtagtacattcagcatctgcaccagagcctccaaatactcagctccaatctgaggcaacccaacataaatctccagtgccccaagagtcacaagagagagccatgtctacttcccagagtcctactcgttcccagaaaggaagttctggagaccaggaaatgacagctacacttctcacagcagggttccagactttggagaagattgaagacatggctgtgtcccttattcgagaggagtggcttcttgatccatcacagaaggatctgtgtagagataacaggccagaaaatttcagaaacatgttctccctgggtggtgagaccaggagtgagaacagggaattagcttcaaaacaggtaatatctactggaatccagccacatggagagacagctgccaaatgcaacggggatgttatcaggggtcttgagcatgaagaagcccgagaccttctgggcagattagagaggcagcggggaaatcccacacaagagagacgacataaatgtgatgaatgtgggaaaagctttgctcagagctcaggccttgttcgccactggagaatccacactggggagaaaccctatcagtgtaatgtgtgtggtaaagccttcagttacaggtcagcccttctttcacatcaggatatccacaacaaagtaaaacgctatcactgtaaggagtgtggcaaagccttcagtcagaacacaggcctgattctgcaccagagaatccacactggggagaagccatatcagtgcaatcagtgtgggaaggctttcagtcagagtgcgggccttattctgcaccagagaatccacagtggagagagaccctatgaatgtaatgagtgtgggaaagctttcagtcatagctcacacctcattggacatcagagaatccacactggggagaagccctatgagtgtgatgagtgtgggaaaaccttcaggcggagctcacatcttattggtcatcagaggagccacactggggagaaaccctacaaatgcaatgagtgtgggagggccttcagtcagaagtcaggccttattgaacatcagagaatccacactggagaaagaccctataaatgtaaagaatgtgggaaagctttcaatgggaacactggtctcattcaacacctgagaattcacacaggggagaagccctaccaatgtaatgagtgtgggaaagcctttattcagaggtcaagtctcattcgacatcagagaatccacagtggtgaaaaatctgaatccataagcgtttaggaacaacatcagttagagtttgagcattattcagcattagggaaaccacacactggtgagaggtctttcagtgtactaaaaggcagaaaggtca

SEQ ID NO: 204173 - DNA, 1225 bp, Homo sapiens
  Payload ID: 20270
  Gene Name: zinc finger with UFM1-specific peptidase domain
  ENST ID: ENST00000368573
  CDS Start-End: 245-1087
ttttccgtgggagtaaggaagtgcttttgaatgaggtactgagggccaaggtgttggaagttcctaattctttcctcggttaactgtgaaactctgcgtattgggaaggcctggcctcagtcatcaggccaggagaggtactggacgccgcgcacgcactcgtctgccagcgaggcccaaaggggaagcctagcggagctcagtgtggcagctgctggcctctgggccgctacttgtcaataccatgctttcctgtaatatttgtggtgaaacagtaacctcagaaccagacatgaaagctcacctaattgttcacatggaaagtgaaattatatgtccattttgcaagttgtcaggtgtgaattatgatgaaatgtgttttcatatcgaaacagctcattttgagcagaatacacttgaaagaaactttgagaggataaatacagtacaatatggaacttcagataacaagaaagacaacaccctacagtgtggaatggaagttaattcaagtattctttcaggttgtgcatctaatcatccaaaaaattcagctcaaaacctgactaaagatagtactttaaaacatgaaggcttctattcagagaacttaactgaatctagaaaattcctgaaaagtagggaaaaacagtccagcctgaccgaaataaaaggatctgtttatgaaacaacatacagtcctcctgaatgtccattctgtggaaaaatagaggagcacagtgaagatatggaaactcatgtgaaaacaaagcatgccaatcttttagacattccattggaagactgtgatcaaccactctatgattgtcctatgtgtgggctcatatgtacaaattaccatattcttcaggaacatgttgacttgcatttggaagaaaacagctttcagcaaggcatggatagagtccagtgttctggtgatctacaattggctcaccagcttcagcaagaagaagacagaaagaggagatctgaagaatcaagacaagaaatagaagaatttcagaagctgcaggaattattgaagcacttcataggtattatcagaatgctgccacagatgtgagacgggtgtggctttcttcagtggtggatcactttcattcatctttaggcgacaaaggttggggttgtggttacagaaatttccaaatgctactttcatcattattacaaaatgatgcttacaacgattgcttaaaag

SEQ ID NO: 204174 - DNA, 2195 bp, Homo sapiens
  Payload ID: 20270
  Gene Name: zinc finger with UFM1-specific peptidase domain
  Uniprot ID: Q96AP4
  ENST ID: ENST00000368576
  CDS Start-End: 245-1981
ttttccgtgggagtaaggaagtgcttttgaatgaggtactgagggccaaggtgttggaagttcctaattctttcctcggttaactgtgaaactctgcgtattgggaaggcctggcctcagtcatcaggccaggagaggtactggacgccgcgcacgcactcgtctgccagcgaggcccaaaggggaagcctagcggagctcagtgtggcagctgctggcctctgggccgctacttgtcaataccatgctttcctgtaatatttgtggtgaaacagtaacctcagaaccagacatgaaagctcacctaattgttcacatggaaagtgaaattatatgtccattttgcaagttgtcaggtgtgaattatgatgaaatgtgttttcatatcgaaacagctcattttgagcagaatacacttgaaagaaactttgagaggataaatacagtacaatatggaacttcagataacaagaaagacaacaccctacagtgtggaatggaagttaattcaagtattctttcaggttgtgcatctaatcatccaaaaaattcagctcaaaacctgactaaagatagtactttaaaacatgaaggcttctattcagagaacttaactgaatctagaaaattcctgaaaagtagggaaaaacagtccagcctgaccgaaataaaaggatctgtttatgaaacaacatacagtcctcctgaatgtccattctgtggaaaaatagaggagcacagtgaagatatggaaactcatgtgaaaacaaagcatgccaatcttttagacattccattggaagactgtgatcaaccactctatgattgtcctatgtgtgggctcatatgtacaaattaccatattcttcaggaacatgttgacttgcatttggaagaaaacagctttcagcaaggcatggatagagtccagtgttctggtgatctacaattggctcaccagcttcagcaagaagaagacagaaagaggagatctgaagaatcaagacaagaaatagaagaatttcagaagctgcagagacaatatggtttagataattctggaggatacaaacaacaacaactacgaaatatggagatagaagtaaataggggaagaatgcctccatctgaatttcataggagaaaagctgatatgatggaatcattagctcttggttttgacgatggaaaaacaaaaacttccggaattattgaagcacttcataggtattatcagaatgctgccacagatgtgagacgggtgtggctttcttcagtggtggatcactttcattcatctttaggcgacaaaggttggggttgtggttacagaaatttccaaatgctactttcatcattattacaaaatgatgcttacaacgattgcttaaaaggtatgttgattccttgcattccaaaaattcaatctatgattgaagatgcatggaaggaaggttttgatcctcagggggcctctcaacttaataacaggttacagggaacaaaggcctggattggagcatgtgaagtatatatactcctgacctccctaagggtaaagtgtcatattgttgattttcacaaatcaactggtcctttgggtacacaccctcgcttatttgaatggatattgaactattattcttcagagggagaagggagtccaaaggtagtgtgtacatctaaacctcctatctatcttcagcatcaaggtcacagtcgaactgttattggaattgaagagaaaaaaaaccgaacattatgcttactaatacttgatcctggatgtccttctcgagaaatgcagaaattattaaagcaagacatagaggctagcagtctcaagcaacttcggaaatctatgggaaatttaaaacataagcaataccagatattggcagtagagggtgctctttctctagaggagaaacttgccaggagacaagcttctcaagtctttacagccgagaagattccttgaagaatcaagcatttaagcatttcagtgattgagaacaatactttgttttctaaatgtagatattgaactccttaatacaattatgaatctgtgaattctcttaagtcttaacatataatttaatttctaaaatgcctgtgttaattgaattatacctatcatacttcattgtttggtaaattatttcaataaaatgtcttgtttttgcattgtg

SEQ ID NO: 204175 - DNA, 1798 bp, Homo sapiens
  Payload ID: 20271
  Gene Name: zinc finger, AN1-type domain 1
  Uniprot ID: Q8TCF1
  ENST ID: ENST00000220669
  CDS Start-End: 20-826
cccttacggcgccggagagatggcggagttggacatcgggcagcactgccaggtggagcattgccggcagcgagattttcttccatttgtgtgtgatgattgttcaggaatattttgccttgaacacagaagcagggagtctcatggttgtcctgaggtgactgtaatcaatgagagactgaagacagatcaacatacatcttacccatgctctttcaaagactgtgctgagagagaacttgtggcagttatatgtccttattgtgagaagaatttttgcctgagacaccgtcatcagtcagatcatgagtgtgaaaaactggaaatcccaaagcctcgaatggctgccactcagaaacttgttaaagacattattgattccaagacaggagaaacagcaagtaaacgatggaaaggtgccaaaaatagtgaaacagctgcaaaggttgcattgatgaaattaaagatgcatgctgatggcgataagtcattaccacagacagaaagaatttactttcaggttttcttacctaaagggagcaaagagaagagcaaaccaatgttcttttgccaccgatggagcattggaaaggccatagactttgccgcttctctagccaggcttaaaaatgacaataacaaatttacagctaagaaattaaggctgtgtcacattacttcaggagaagccttacccttggatcatactttggaaacctggattgctaaggaggattgtcctttatataatggtggaaatataatcttggaatatcttaatgatgaagaacaattctgtaaaaatgttgaatcttacttggaatagtcattcaaagattcaagtcagaaatcacagggaaaattctattacatgtttaagtccatttattttactacaaatactatttttgtaatttttaaaagttgctttttaacttatttccccttatgtcacattttaaattatgagttttctattagagttttttggttttaagtttaattgtgtacggatcctcaattattagcaaattcttatatttaattagctttcattagtttatgctgtagtgacaacaacaaagatgtatttcctggtgggggatgtcagctgttgattggctgtgacactgctttgtgtcatcttcttaccatgatcaaaggcaaaggaagggatctcttttgggacattgtgattgttttagcagagagagaaagagatgaaatacacttcggttttctcttaaaagatgcatgtatcatacgtgctttaagcaagtcatgtggccaagcctagcatcatggagccagaaagtatagccttgctgtctgtctacatcatgatgtataaattgatatatctacatgaattatagaaacttagaagtgatctttattcagtcttataatttttacatgaagaatcttaggcctaggaggagaaaatgattttctttctattacctaactagattggggcatatttctgataaagacccacctctagtgagattcatcttttttgtttgtgtgactatattccatagagaagaaagatgggatagctcaacttcattatataccaaagcaaaacacatgccaaatgatgactacattttaccaacatatttagacgagtattcttgactagtgtttactatctatacccccaaaactactactatatagacagaatggaaagtatttctatttgtcctttttttgttttctgttctaattgtcagggacatatgtagtggctataggtttacttaaaaggaataaatttggaatgctc

SEQ ID NO: 204176 - DNA, 550 bp, Homo sapiens
  Payload ID: 20271
  Gene Name: zinc finger, AN1-type domain 1
  ENST ID: ENST00000517450
  CDS Start-End: 392-550
cccttacggcgccggagagatggcggagttggacatcgggcagcactgccaggtggagcattgccggcagcgagattttcttccatttgtgtgtgatgattgttcaggaatattttggtgactgtaatcaatgagagactgaagacagatcaacatacatcttacccatgctctttcaaagactgtgctgagagagaacttgtggcagttatatgtccttattgtgagaagaatttttgcctgaggtgattgatcacttaggctgttcacactttgtatatctgtttaagtgctatacaaacacatgaactagtgtcactcttctgttgctcatagacaccgtcatcagtcagatcatgagtgtgaaaaactggaaatcccaaagcctcgaatggctgccactcagaaacttgttaaagacattattgattccaagacaggagaaacagcaagtaaacgatggaaaggtgccaaaaatagtgaaacagctgcaaaggttgcattgatgaaattaaagatgcatgctgatggcgataagtcattaccacag

SEQ ID NO: 204177 - DNA, 540 bp, Homo sapiens
  Payload ID: 20271
  Gene Name: zinc finger, AN1-type domain 1
  ENST ID: ENST00000523361
  CDS Start-End: 356-540
gattgtccccaagggaaaggctagaggcagatgggctcccgcctgtgggccagaccccagcctacctcgcttattctgcgtgccgtgcttcttggccagggcgatttctctctggattcgattttccagattttcttccatttgtgtgtgatgattgttcaggaatattttggtgactgtaatcaatgagagactgaagacagatcaacatacatcttacccatgctctttcaaagactgtgctgagagagaacttgtggcagttatatgtccttattgtgagaagaatttttgcctgagacaccgtcatcagtcagatcatgagtgtgaaaaactggaaatcccaaagcctcgaatggctgccactcagaaacttgttaaagacattattgattccaagacaggagaaacagcaagtaaacgatggaaaggtgccaaaaatagtgaaacagctgcaaaggttgcattgatgaaattaaagatgcatgctgatggcgataagtcattaccacagacagaaagaatttactttcaggtttt

SEQ ID NO: 204178 - DNA, 664 bp, Homo sapiens
  Payload ID: 20271
  Gene Name: zinc finger, AN1-type domain 1
  ENST ID: ENST00000520604
  CDS Start-End: 374-664
cagagaaaagttgaaaagaccgacaaagactgtgggaagttggcttttatccacactagggacggtcccaggaacgaggaactagtttgtgaatggctcaaagaaaagcaaaccgatgtccaggggtcttgtgcaggacctgaaagtattttcttccatttgtgtgtgatgattgttcaggaatattttggtgactgtaatcaatgagagactgaagacagatcaacatacatcttacccatgctctttcaaagactgtgctgagagagaacttgtggcagttatatgtccttattgtgagaagaatttttgcctgagacaccgtcatcagtcagatcatgagtgtgaaaaactggaaatcccaaagcctcgaatggctgccactcagaaacttgttaaagacattattgattccaagacaggagaaacagcaagtaaacgatggaaaggtgccaaaaatagtgaaacagctgcaaaggttgcattgatgaaattaaagatgcatgctgatggcgataagtcattaccacagacagaaagaatttactttcaggttttcttacctaaagggagcaaagagaagagcaaaccaatgttcttttgccaccgatggagcattggaaaggccatagactttgccgcttctctagccaggcttaaaaat

SEQ ID NO: 204179 - DNA, 772 bp, Homo sapiens
  Payload ID: 20271
  Gene Name: zinc finger, AN1-type domain 1
  Uniprot ID: Q8TCF1
  ENST ID: ENST00000521287
  CDS Start-End: 274-759
acggcgccggagagatggcggagttggacatcgggcagcactgccagattttcttccatttgtgtgtgatgattgttcaggaatattttggtgactgtaatcaatgagagactgaagacagatcaacatacatcttacccatgctctttcaaagactgtgctgagagagaacttgtggcagttatatgtccttattgtgagaagaatttttgcctgagacaccgtcatcagtcagatcatgagtgtgaaaaactggaaatcccaaagcctcgaatggctgccactcagaaacttgttaaagacattattgattccaagacaggagaaacagcaagtaaacgatggaaaggtgccaaaaatagtgaaacagctgcaaaggttgcattgatgaaattaaagatgcatgctgatggcgataagtcattaccacagacagaaagaatttactttcaggttttcttacctaaagggagcaaagagaagagcaaaccaatgttcttttgccaccgatggagcattggaaaggccatagactttgccgcttctctagccaggcttaaaaatgacaataacaaatttacagctaagaaattaaggctgtgtcacattacttcaggagaagccttacccttggatcatactttggaaacctggattgctaaggaggattgtcctttatataatggtggaaatataatcttggaatatcttaatgatgaagaacaattctgtaaaaatgttgaatcttacttggaatagtcattcaaagatt

SEQ ID NO: 204180 - DNA, 882 bp, Homo sapiens
  Payload ID: 20271
  Gene Name: zinc finger, AN1-type domain 1
  ENST ID: ENST00000520635
  CDS Start-End: 527-882
gaggccaccgctgggacgtcggctggccggcgccacccggccctctgggagttgagcgagagcagagaaaagttgaaaagaccgacaaagactgtgggaagttggcttttatccacactagggacggtcccaggaacgaggaactagtttgtgaatggctcaaagaaaagcaaaccgatgtccaggggtcttgtgcaggacctgaaagtattttcttccatttgtgtgtgatgattgttcaggaatattttggtgactgtaatcaatgagagactgaagacagatcaacatacatcttacccatgctctttcaaagactgtgctgagagagaacttgtggcagttatatgtccttattgtgagaagaatttttgcctgaggtgattgatcacttaggctgttcacactttgtatatctgtttaagtgctatacaaacacatgaactagtgtcactcttctgttgctcatagacaccgtcatcagtcagatcatgagtgtgaaaaactggaaatcccaaagcctcgaatggctgccactcagaaacttgttaaagacattattgattccaagacaggagaaacagcaagtaaacgatggaaaggtgccaaaaatagtgaaacagctgcaaaggttgcattgatgaaattaaagatgcatgctgatggcgataagtcattaccacagacagaaagaatttactttcaggttttcttacctaaagggagcaaagagaagagcaaaccaatgttcttttgccaccgatggagcattggaaaggccatagactttgccgcttctctagccaggcttaaaaatgacaataacaaatttacagctaagaaattaaggctgtgtcacattacttcaggagaagccttacc

SEQ ID NO: 204181 - DNA, 1006 bp, Homo sapiens
  Payload ID: 20271
  Gene Name: zinc finger, AN1-type domain 1
  ENST ID: ENST00000519464
  CDS Start-End: 7-504
ggagagatggcggagttggacatcgggcagcactgccaggtggagcattgccggcagcgagattttcttccatttgtgtgtgatgattgttcaggaatattttgccttgaacacagaagcagggagtctcatggttgtcctgaggtgactgtaatcaatgagagactgaagacagatcaacatacatcttacccatgctctttcaaagactgtgctgagagagaacttgtggcagttatatgtccttattgtgagaagaatttttgcctgagacaccgtcatcagtcagatcatgagtgtgaaaaactggaaatcccaaagcctcgaatggctgccactcagaaacttgttaaagacattattgattccaagacaggagaaacagcaagtaaacgatggaaaggtgccaaaaatagtgaaacagctgcaaaggttgcattgatgaaattaaagatgcatgctgatggcgataagtcattaccacagatgagtaatctggagtgaagtatttttaagagcactaacttgacagaaagaatttactttcaggttttcttacctaaagggagcaaagagaagagcaaaccaatgttcttttgccaccgatggagcattggaaaggccatagactttgccgcttctctagccaggcttaaaaatgacaataacaaatttacagctaagaaattaaggctgtgtcacattacttcaggagaagccttacccttggatcatactttggaaacctggattgctaaggaggattgtcctttatataatggtggaaatataatcttggaatatcttaatgatgaagaacaattctgtaaaaatgttgaatcttacttggaatagtcattcaaagattcaagtcagaaatcacagggaaaattctattacatgtttaagtccatttattttactacaaatactatttttgtaatttttaaaagttgctttttaacttatttccccttatgtcacattttaaattatgagttttcta

SEQ ID NO: 204182 - DNA, 567 bp, Homo sapiens
  Payload ID: 20271
  Gene Name: zinc finger, AN1-type domain 1
  ENST ID: ENST00000518419
  CDS Start-End: 439-567
attgccggcagcgaggtgatccgggagcttccagcccccatccccggccgcgggagaccagggctccgctttggctccgcggatggtggcggcgggtgaagggaggccacaaggctgggcagggcctgaggagcggggtgggagcgtttcttctggggctgcagtgagatcgattttcttccatttgtgtgtgatgattgttcaggaatattttgccttgaacacagaagcagggagtctcatggttgtcctgaggtgactgtaatcaatgagagactgaagacagatcaacatacatcttacccatgctctttcaaagactgtgctgagagagaacttgtggcagttatatgtccttattgtgagaagaatttttgcctgagacaccgtcatcagtcagatcatgagtgtgaaaaactggaaatcccaaagcctcgaatggctgccactcagaaacttgttaaagacattattgattccaagacaggagaaacagcaagtaaacgatggaaaggtgccaaaaatagtgaaacagctgcaaaggttgcattgatgaaattaaagatg

SEQ ID NO: 204183 - DNA, 784 bp, Homo sapiens
  Payload ID: 20271
  Gene Name: zinc finger, AN1-type domain 1
  ENST ID: ENST00000523431
  CDS Start-End: 291-467
gccggagagatggcggagttggacatcgggcagcactgccaggtggagcattgccggcagcgagattttcttccatttgtgtgtgatgattgttcaggaatattttggtgactgtaatcaatgagagactgaagacagatcaacatacatcttacccatgctctttcaaagactgtgctgagagagaacttgtggcagttatatgtccttattgtgagaagaatttttgcctgagacaccgtcatcagtcagatcatgagtgtgaaaaactggaaatcccaaagcctcgaatggctgccactcagaaacttgttaaagacattattgattccaagacaggagaaacagcaagtaaacgatggaaaggtgccaaaaatagtgaaacagctgcaaaggttgcattgatgaaattaaagatgcatgctgatggcgataagtcattaccacagatgagtaatctggagtgaagtatttttaagagcactaacttgacagaaagaatttactttcaggttttcttacctaaagggagcaaagagaagagcaaaccaatgttcttttgccaccgatggagcattggaaaggccatagactttgccgcttctctagccaggcttaaaaatgacaataacaaatttacagctaagaaattaaggctgtgtcacattacttcaggagaagccttacccttggatcatactttggaaacctggattgctaaggaggattgtcctttatataatggtggaaatataatcttggaatatcttaatgatgaagaaca

SEQ ID NO: 204184 - DNA, 698 bp, Homo sapiens
  Payload ID: 20271
  Gene Name: zinc finger, AN1-type domain 1
  Uniprot ID: Q8TCF1
  ENST ID: ENST00000519523
  CDS Start-End: 8-691
cggagagatggcggagttggacatcgggcagcactgccaggtggagcattgccggcagcgagattttcttccatttgtgtgtgatgattgttcaggaatattttgccttgaacacagaagcagggagtctcatggttgtcctgaggtgactgtaatcaatgagagactgaagacagatcaacatacatcttacccatgctctttcaaagactgtgctgagagagaacttgtggcagttatatgtccttattgtgagaagaatttttgcctgagacaccgtcatcagtcagatcatgagtgtgaaaaactggaaatcccaaagcctcgaatggctgccactcagaaacttgttaaagacattattgattccaagacaggagaaacagcaagtaaacgatggaaaggtgccaaaaatagtgaaacagctgcaaaggttgcattgatgaaattaaagatgcatgctgatggcgataagtcattaccacagacagaaagaatttactttcaggttttcttacctaaagggagcaaagagaagagcaaaccaatgttcttttgccaccgatggagcattggaaaggccatagactttgccgcttctctagccaggcttaaaaatgacaataacaaatttacagctaaggtaacatctcattataataatatttctatattaataaaggttttatgatgctcca

SEQ ID NO: 204185 - DNA, 885 bp, Homo sapiens
  Payload ID: 20271
  Gene Name: zinc finger, AN1-type domain 1
  ENST ID: ENST00000521895
  CDS Start-End: 261-641
gatggcggagttggacatcgggcagcactgccagattttcttccatttgtgtgtgatgattgttcaggaatattttggtgactgtaatcaatgagagactgaagacagatcaacatacatcttacccatgctctttcaaagactgtgctgagagagaacttgtggcagttatatgtccttattgtgagaagaatttttgcctgagacaccgtcatcagtcagatcatgagtgtgaaaaactggaaatcccaaagcctcgaatggctgccactcagaaacttgttaaagacattattgattccaagacaggagaaacagcaagtaaacgatggaaaggtgccaaaaatagtgaaacagctgcaaaggttgcattgatgaaattaaagatgcatgctgatggcgataagtcattaccacagacagaaagaatttactttcaggttttcttacctaaagggagcaaagagaagagcaaaccaatgttcttttgccaccgatggagcattggaaaggccatagactttgccgcttctctagccaggcttaaaaatgacaataacaaatttacagctaaggctgtgtcacattacttcaggagaagccttacccttggatcatactttggaaacctggattgctaaggaggattgtcctttatataatggtggaaatataatcttggaatatcttaatgatgaagaacaattctgtaaaaatgttgaatcttacttggaatagtcattcaaagattcaagtcagaaatcacagggaaaattctattacatgtttaagtccatttattttactacaaatactatttttgtaatttttaaaagttgctttttaacttatttccccttatgtcacattttaaattatgagttt

SEQ ID NO: 204186 - DNA, 1705 bp, Homo sapiens
  Payload ID: 20271
  Gene Name: zinc finger, AN1-type domain 1
  Uniprot ID: Q8TCF1
  ENST ID: ENST00000522520
  CDS Start-End: 290-775
ccggagagatggcggagttggacatcgggcagcactgccaggtggagcattgccggcagcgagattttcttccatttgtgtgtgatgattgttcaggaatattttggtgactgtaatcaatgagagactgaagacagatcaacatacatcttacccatgctctttcaaagactgtgctgagagagaacttgtggcagttatatgtccttattgtgagaagaatttttgcctgagacaccgtcatcagtcagatcatgagtgtgaaaaactggaaatcccaaagcctcgaatggctgccactcagaaacttgttaaagacattattgattccaagacaggagaaacagcaagtaaacgatggaaaggtgccaaaaatagtgaaacagctgcaaaggttgcattgatgaaattaaagatgcatgctgatggcgataagtcattaccacagacagaaagaatttactttcaggttttcttacctaaagggagcaaagagaagagcaaaccaatgttcttttgccaccgatggagcattggaaaggccatagactttgccgcttctctagccaggcttaaaaatgacaataacaaatttacagctaagaaattaaggctgtgtcacattacttcaggagaagccttacccttggatcatactttggaaacctggattgctaaggaggattgtcctttatataatggtggaaatataatcttggaatatcttaatgatgaagaacaattctgtaaaaatgttgaatcttacttggaatagtcattcaaagattcaagtcagaaatcacagggaaaattctattacatgtttaagtccatttattttactacaaatactatttttgtaatttttaaaagttgctttttaacttatttccccttatgtcacattttaaattatgagttttctattagagttttttggttttaagtttaattgtgtacggatcctcaattattagcaaattcttatatttaattagctttcattagtttatgctgtagtgacaacaacaaagatgtatttcctggtgggggatgtcagctgttgattggctgtgacactgctttgtgtcatcttcttaccatgatcaaaggcaaaggaagggatctcttttgggacattgtgattgttttagcagagagagaaagagatgaaatacacttcggttttctcttaaaagatgcatgtatcatacgtgctttaagcaagtcatgtggccaagcctagcatcatggagccagaaagtatagccttgctgtctgtctacatcatgatgtataaattgatatatctacatgaattatagaaacttagaagtgatctttattcagtcttataatttttacatgaagaatcttaggcctaggaggagaaaatgattttctttctattacctaactagattggggcatatttctgataaagacccacctctagtgagattcatcttttttgtttgtgtgactatattccatagagaagaaagatgggatagctcaacttcattatataccaaagcaaaacacatgccaaatgatgactacattttaccaacatatttagacgagtattcttgactagtgtttactatctatacccccaaaactactactatatagacagaatggaaagtatttctatttgtcctttttttgttttctgttctaattgtcagggacatatgta

SEQ ID NO: 204187 - DNA, 633 bp, Homo sapiens
  Payload ID: 20271
  Gene Name: zinc finger, AN1-type domain 1
  ENST ID: ENST00000517588
  CDS Start-End: 264-626
gggcagcactgccaggtggagcattgccggcagcgagattttcttccatttgtgtgtgatgattgttcaggaatattttggtgactgtaatcaatgagagactgaagacagatcaacatacatcttacccatgctctttcaaagactgtgctgagagagaacttgtggcagttatatgtccttattgtgagaagaatttttgcctgagacaccgtcatcagtcagatcatgagtgtgaaaaactggaaatcccaaagcctcgaatggctgccactcagaaacttgttaaagacattattgattccaagacaggagaaacagcaagtaaacgatggaaaggtgccaaaaatagtgaaacagctgcaaaggttgcattgatgaaattaaagatgcatgctgatggcgataagtcattaccacagacagaaagaatttactttcaggttttcttacctaaagggagcaaagagaagagcaaaccaatgttcttttgccaccgatggagcattggaaaggccatagactttgccgcttctctagccaggcttaaaaatgacaataacaaatttacagctaaggtaacatctcattataataatatttctatattaataaaggttttatgatgctcca

SEQ ID NO: 204188 - DNA, 614 bp, Homo sapiens
  Payload ID: 20271
  Gene Name: zinc finger, AN1-type domain 1
  ENST ID: ENST00000521742
  CDS Start-End: 456-614
ggctggccggcgccacccggccctctgggagttgagcgagagcagagaaaagttgaaaagaccgacaaagactgtgggaagttggcttttatccacactagggacggtcccaggaacgaggaactagtttgtgaatggctcaaagaaaagcaaaccgatgtccaggggtcttgtgcaggacctgaaagtattttcttccatttgtgtgtgatgattgttcaggaatattttgccttgaacacagaagcagggagtctcatggttgtcctgaggtgactgtaatcaatgagagactgaagacagatcaacatacatcttacccatgctctttcaaagactgtgctgagagagaacttgtggcagttatatgtccttattgtgagaagaatttttgcctgagacaccgtcatcagtcagatcatgagtgtgaaaaactggaaatcccaaagcctcgaatggctgccactcagaaacttgttaaagacattattgattccaagacaggagaaacagcaagtaaacgatggaaaggtgccaaaaatagtgaaacagctgcaaaggttgcattgatgaaattaaagatgcatgctgatggcgataagtcattaccacag

SEQ ID NO: 204189 - DNA, 784 bp, Homo sapiens
  Payload ID: 20271
  Gene Name: zinc finger, AN1-type domain 1
  ENST ID: ENST00000522032
  CDS Start-End: 1-186
gattccaagacaggagaaacagcaagtaaacgatggaaaggtgccaaaaatagtgaaacagctgcaaaggttgcattgatgaaattaaagatgcatgctgatggcgataagtcattaccacagggagcaaagagaagagcaaaccaatgttcttttgccaccgatggagcattggaaaggccatagactttgccgcttctctagccaggcttaaaaatgacaataacaaatttacagctaagaaattaaggctgtgtcacattacttcaggagaagccttacccttggatcatactttggaaacctggattgctaaggaggattgtcctttatataatggtggaaatataatcttggaatatcttaatgatgaagaacaattctgtaaaaatgttgaatcttacttggaatagtcattcaaagattcaagtcagaaatcacagggaaaattctattacatgtttaagtccatttattttactacaaatactatttttgtaatttttaaaagttgctttttaacttatttccccttatgtcacattttaaattatgagttttctattagagttttttggttttaagtttaattgtgtacggatcctcaattattagcaaattcttatatttaattagctttcattagtttatgctgtagtgacaacaacaaagatgtatttcctggtgggggatgtcagctgttgattggctgtgacactgctttgtgtcatcttcttaccatgatcaaaggcaaaggaagggatctcttttgggacattgtgat

SEQ ID NO: 204190 - DNA, 570 bp, Homo sapiens
  Payload ID: 20271
  Gene Name: zinc finger, AN1-type domain 1
  ENST ID: ENST00000520076
  CDS Start-End: 445-570
agatggcggagttggacatcgggcagcactgccaggtggagcattgccggcagcgaggtgatccgggagcttccagcccccatccccggccgcgggagaccagggctccgctttggctccgcggatggtggcggcgggtgaagggaggccacaaggctgggcagggcctgaggagcggggtgggagcgtttcttctggggctgcagtgagatcggttgattttcttccatttgtgtgtgatgattgttcaggaatattttggtgactgtaatcaatgagagactgaagacagatcaacatacatcttacccatgctctttcaaagactgtgctgagagagaacttgtggcagttatatgtccttattgtgagaagaatttttgcctgagacaccgtcatcagtcagatcatgagtgtgaaaaactggaaatcccaaagcctcgaatggctgccactcagaaacttgttaaagacattattgattccaagacaggagaaacagcaagtaaacgatggaaaggtgccaaaaatagtgaaacagctgcaaaggttgcattgatgaaattaaag

SEQ ID NO: 204191 - DNA, 1778 bp, Homo sapiens
  Payload ID: 20271
  Gene Name: zinc finger, AN1-type domain 1
  Uniprot ID: Q8TCF1
  ENST ID: ENST00000523096
  CDS Start-End: 20-805
cccttacggcgccggagagatggcggagttggacatcgggcagcactgccaggtggagcattgccggcagcgagattttcttccatttgtgtgtgatgattgttcaggaatattttgccttgaacacagaagcagggagtctcatggttgtcctgaggtgactgtaatcaatgagagactgaagacagatcaacatacatcttacccatgctctttcaaagactgtgctgagagagaacttgtggcagttatatgtccttattgtgagaagaatttttgcctgagacaccgtcatcagtcagatcatgagtgtgaaaaactggaaatcccaaagcctcgaatggctgccactcagaaacttgttaaagacattattgattccaagacaggagaaacagcaagtaaacgatggaaaggtgccaaaaatagtgaaacagctgcaaaggttgcattgatgaaattaaagatgcatgctgatggcgataagtcattaccacaggttttcttacctaaagggagcaaagagaagagcaaaccaatgttcttttgccaccgatggagcattggaaaggccatagactttgccgcttctctagccaggcttaaaaatgacaataacaaatttacagctaagaaattaaggctgtgtcacattacttcaggagaagccttacccttggatcatactttggaaacctggattgctaaggaggattgtcctttatataatggtggaaatataatcttggaatatcttaatgatgaagaacaattctgtaaaaatgttgaatcttacttggaatagtcattcaaagattcaagtcagaaatcacagggaaaattctattacatgtttaagtccatttattttactacaaatactatttttgtaatttttaaaagttgctttttaacttatttccccttatgtcacattttaaattatgagttttctattagagttttttggttttaagtttaattgtgtacggatcctcaattattagcaaattcttatatttaattagctttcattagtttatgctgtagtgacaacaacaaagatgtatttcctggtgggggatgtcagctgttgattggctgtgacactgctttgtgtcatcttcttaccatgatcaaaggcaaaggaagggatctcttttgggacattgtgattgttttagcagagagagaaagagatgaaatacacttcggttttctcttaaaagatgcatgtatcatacgtgctttaagcaagtcatgtggccaagcctagcatcatggagccagaaagtatagccttgctgtctgtctacatcatgatgtataaattgatatatctacatgaattatagaaacttagaagtgatctttattcagtcttataatttttacatgaagaatcttaggcctaggaggagaaaatgattttctttctattacctaactagattggggcatatttctgataaagacccacctctagtgagattcatcttttttgtttgtgtgactatattccatagagaagaaagatgggatagctcaacttcattatataccaaagcaaaacacatgccaaatgatgactacattttaccaacatatttagacgagtattcttgactagtgtttactatctatacccccaaaactactactatatagacagaatggaaagtatttctatttgtcctttttttgttttctgttctaattgtcagggacatatgtagtggctataggtttacttaaaaggaataaatttggaatgctca

SEQ ID NO: 204192 - DNA, 860 bp, Homo sapiens
  Payload ID: 20272
  Gene Name: zinc finger, AN1-type domain 2A
  Uniprot ID: Q8N6M9
  ENST ID: ENST00000316495
  CDS Start-End: 261-698
agatccgggggctgcggataaatccccgtaggccgcgggcagcgagatgttgcgttccggtgtgggtgtgggtgtgcctccgacggcgtctcggtgccagtgtcgaggttctttctgcttagctacccggagccgactacggaggaggacacctgagtttacgtctcttccatctgctgctcacctcagctgcctgggtccccgacgagagccaggtgacacttaactccgccatctgcgttttgagcactgttctcataatggagtttcctgatttggggaagcattgttcagaaaagacttgcaagcagctagattttcttccagtaaaatgtgatgcatgtaaacaagatttctgtaaagatcattttccatacgctgcacataagtgtccgtttgcattccagaaggatgttcacgtcccagtatgcccactctgtaatacccccatcccagtaaaaaagggccagataccagacgtggtggttggtgatcacattgacagagactgtgactctcaccctgggaagaagaaagagaagatttttacataccgttgctcaaaagagggctgcaagaagaaagagatgctgcagatggtatgtgcccaatgtcacggcaacttctgtatccagcacagacaccctttggaccacagctgcagacacgggagtcgccccaccatcaaagctgggtgagaagagactccgctgcgatggctcggagcacgcagtagcatgcgtggaagcagcttacactctagtgggaagtggagccccattgagcaccatcccacactggctgctgatcttgtttgttgagggagatgggactataataaaattgaatgctgaagttga

SEQ ID NO: 204193 - DNA, 852 bp, Homo sapiens
  Payload ID: 20272
  Gene Name: zinc finger, AN1-type domain 2A
  ENST ID: ENST00000397083
  CDS Start-End: 236-852
ccgtaggccgcgggcagcgagatgttgcgttccggtgtgggtgtgggtgtgcctccgacggcgtctcggtgccagtgtcgaggttctttctgcttagctacccggagccgactacggaggaggacacctgagtttacgtctcttccatctgctgctcacctcagctgcctgggtccccgacgagagccaggtgacacttaactccgccatctgcgttttgagcactgttctcataatggagtttcctgatttggggaagcattgttcagaaaagacttgcaagcagctagattttcttccagtaaaatgtgatgcatgtaaacaagatttctgtaaagatcattttccatacgctgcacataagtgtccgtttgcattccagaaggatgttcacgtcccagtatgcccactctgtaatacccccatcccagtaaaaaagggccagataccagacgtggtggttggtgatcacattgacagagactgtgactctcaccctgggaagaagaaagagaagtcactttgctctcttagatttttacataccgttgctcaaaagagggctgcaagaagaaagagatgctgcagatggtatgtgcccaatgtcacggcaacttctgtatccagcacagacaccctttggaccacagctgcagacacgggagtcgccccaccatcaaagctgggtgagaagagactccgctgcgatggctcggagcacgcagtagcatgcgtggaagcagcttacactctagtgggaagtggagccccattgagcaccatcccacactggctgctgatcttgtttgttgagggagatgggactataataaaattgaatgctgaagttga

SEQ ID NO: 204194 - DNA, 968 bp, Homo sapiens
  Payload ID: 20272
  Gene Name: zinc finger, AN1-type domain 2A
  ENST ID: ENST00000401903
  CDS Start-End: 261-803
agatccgggggctgcggataaatccccgtaggccgcgggcagcgagatgttgcgttccggtgtgggtgtgggtgtgcctccgacggcgtctcggtgccagtgtcgaggttctttctgcttagctacccggagccgactacggaggaggacacctgagtttacgtctcttccatctgctgctcacctcagctgcctgggtccccgacgagagccaggtgacacttaactccgccatctgcgttttgagcactgttctcataatggagtttcctgatttggggaagcattgttcagaaaagacttgcaagcagctagattttcttccagtaaaatgtgatgcatgtaaacaagatttctgtaaagatcattttccatacgctgcacataagtgtccgtttgcattccagaaggatgttcacgtcccagtatgcccactctgtaatacccccatcccagtaaaaaagggccagataccagacgtggtggttggtgatcacattgacagagactgtgactctcaccctgggaagaagaaagagaagatttttacataccgttgctcaaaagagggctgcaagaagaaagagatgctgcagatggtatgtgcccaatgtcacggcaacttctgtatccagcacagacaccctttggaccacagctgcagacacgggagtcgccccaccatcaaagctgggtgctcacccatgacagtctctgaatccaggccgttgggagatttcctcaccctggctcctggcgggctggcccagcgactcgggtactggttcacccggctcatgtgaacgcaatttcgtctgtgtggggtgctgcagctcttggttggtgaacacggaaaggttgctgtgtgtaactgcacagtgtgacgcgatgctccagtggtgcgacttcgtcaggatggatgaaggacacaggactgggaccccaagttacagaagcagctcgctcca

SEQ ID NO: 204195 - DNA, 433 bp, Homo sapiens
  Payload ID: 20272
  Gene Name: zinc finger, AN1-type domain 2A
  ENST ID: ENST00000574135
  CDS Start-End: 1-272
gtgatgcatgtaaacaagatttctgtaaagatcattttccatacgctgcacataagtgtccgtttgcattccagaaggatgttcacgtcccagtatgcccactctgtaatacccccatcccagtaaaaaagggccagataccagacgtggtggttggtgatcacattgacagagactgtgactctcaccctgggaagaagaaagagaagcacagacaccctttggaccacagctgcagacacgggagtcgccccaccatcaaagctgggtgagaagagactccgctgcgatggctcggagcacgcagtagcatgcgtggaagcagcttacactctagtgggaagtggagccccattgagcaccatcccacactggctgctgatcttgtttgttgagggagatgggactataataaaattgaatgctgaagttg

SEQ ID NO: 204196 - DNA, 1314 bp, Homo sapiens
  Payload ID: 20273
  Gene Name: zinc finger, AN1-type domain 2B
  Uniprot ID: Q8WV99
  ENST ID: ENST00000289528
  CDS Start-End: 196-969
gcgcgcgccgagggaggagcgggcgccgggggccggctggcgcgggggctccggtaacccgggctgggcgggggagaggaaggggcggggcagggagcccgccagagtgcggggtcgcggtgcggacttcgagcacgagccctaaagacgctcagcactcgtcgcttctcctagcagaccctgcccggcttggcgatggagtttccggacctcggcgctcactgttcggagccgagctgtcagcgcttggattttctgccgcttaagtgtgatgcctgctcaggcatcttctgcgcagaccatgtggcctacgcccagcatcactgtggatctgcttaccaaaaggatatccaggtacctgtgtgccctctctgtaatgtgcctgtgcctgtggccagaggggagccccctgaccgtgctgtgggagagcacattgacagagactgtcgctctgatccagcacagcaaaaacgtaagatcttcaccaataagtgtgaacgcgctggctgccggcagcgagaaatgatgaaactgacctgtgaacgctgtagccgaaacttctgcatcaagcaccggcatccactggaccatgattgctctggggaggggcacccaaccagccgggcaggacttgctgccatctccagagcacaagctgtggcttctacaagcactgtccccagcccaagtcaaaccatgccttcctgtacctctcccagcagagccacaacccgatctccgtcctggacagcccctccagtgattgctttgcagaatggcctgagtgaggatgaagctctgcagcgggccctggaaatgtccctggcagaaaccaaaccccaggttccaagttgtcaggaggaagaagacctagctttagcacaagcactgtcagccagtgaggcagaataccagcggcagcaggcccagagccgcagctcgaagccgtccaactgcagcctgtgctagggccctgggcttggggagggaggttcacctgaggaggactgtggccctcacacctctagggtacacagggagaggaggcccggagcaccctggagggcagagacaagcgggagtgatgtggaggtcgccctgggagcctctggaaggccttgctagtgctccagctgcatggaagagagcggctagcaactgttccctggttgggccctcagtggatgctggccaggccctactcttagccccttcatcatgtcatctcccttatgctggagctgccccgatgtggagtgggcaggaaggggcctggaaaaaataaaggatcttggcagttgataaaacgtacaa

SEQ ID NO: 204197 - DNA, 886 bp, Homo sapiens
  Payload ID: 20273
  Gene Name: zinc finger, AN1-type domain 2B
  ENST ID: ENST00000409217
  CDS Start-End: 174-848
gcgccgggggccggctggcgcgggggctccggtaacccgggctgggcgggggagaggaaggggcggggcagggagcccgccagagtgcggggtcgcggtgcggacttcgagcacgagccctaaagacgctcagcactcgtcgcttctcctagcagaccctgcccggcttggcgatggagtttccggacctcggcgctcactgttcggagccgagctgtcagcgcttggattttctgccgcttaagtgtgatgcctgctcaggcatcttctgcgcagaccatgtggcctacgcccagcatcactgtggatctgcttaccaaaaggatatccaggtacctgtgtgccctctctgtaatgtgcctgtgcctgtggccagaggggagccccctgaccgtgctgtgggagagcacattgacagagactgtcgctctgatccagcacagcaaaaacgtaagatcttcaccaataagtgtgaacgcgctggctgccggcagcgagaaatgatgaaactgacctgtgaacgctgtagccgaaacttctgcatcaagcaccggcatccactggaccatgattgctctggggaggggcacccaaccagccgggcaggacttgctgccatctccagagcacaagctgtggcttctacaagcactgtccccagcccaagtcaaaccatgccttcctgtacctctcccagcagagccacaacccgatctccgtcctggacagcccctccagtgattgctttgcagaatggcctgagtgaggatgaagctctgcagcgggccctggaaatgtccctggcagaaaccaaaccccaggttccaaggtaccttaccctcttgtgaaagagagcgcaagctgtgggcaagggcttggtctggag

SEQ ID NO: 204198 - DNA, 2021 bp, Homo sapiens
  Payload ID: 20273
  Gene Name: zinc finger, AN1-type domain 2B
  Uniprot ID: Q8WV99
  ENST ID: ENST00000409594
  CDS Start-End: 196-726
gcgcgcgccgagggaggagcgggcgccgggggccggctggcgcgggggctccggtaacccgggctgggcgggggagaggaaggggcggggcagggagcccgccagagtgcggggtcgcggtgcggacttcgagcacgagccctaaagacgctcagcactcgtcgcttctcctagcagaccctgcccggcttggcgatggagtttccggacctcggcgctcactgttcggagccgagctgtcagcgcttggattttctgccgcttaagtgtgatgcctgctcaggcatcttctgcgcagaccatgtggcctacgcccagcatcactgtggatctgcttaccaaaaggatatccaggtacctgtgtgccctctctgtaatgtgcctgtgcctgtggccagaggggagccccctgaccgtgctgtgggagagcacattgacagagactgtcgctctgatccagcacagcaaaaacgtaagatcttcaccaataagtgtgaacgcgctggctgccggcagcgagaaatgatgaaactgacctgtgaacgctgtagccgaaacttctgcatcaagcaccggcatccactggaccatgattgctctggggaggggcacccaaccagccgggcaggacttgctgccatctccagagcacaagctgtggcttctacaagcactgtccccagcccaagtcaaaccatgccttcctgtacctctcccagcaggtaggcctgcccgtttccctgctccccctttttccccttcacacctctgacctccacctcttcaatgtctgtcgtagagccacaacccgatctccgtcctggacagcccctccagtgattgctttgcagaatggcctggtgagttgggcagaggttggatggacagaaacaaacacacagagagtgaagtccaaggacgctggtcttctttctccctttgtagagtgaggatgaagctctgcagcgggccctggaaatgtccctggcagaaaccaaaccccaggttccaaggtaccttaccctcttgtgaaagagagcgcaagctgtgggcaagggcttggtctggaggcaggtaggtgggaccactctgacacaatgcaagataatcgctggcaacttggtctcaaaattaagatgaactatatgatctttgacaagttatttaacccatggagccttcatttcctctataaaacggggacaatactaatacccaccttgtagtgttgctatgaagattgagataatcctcagcagtgctcagcaccatgaggcccaacacacacagatcagatgttcaaatttcagatcttaccatcatccaacttaaactgtttctccctcccagttgtcaggaggaagaagacctagctttagcacaagcactgtcagccagtgaggcagaataccagcggcagcaggtatgaggctgggctgaagatatatgctgcagtggaagggaggaagaagtcagggatgggggttcttcctagtggtgcagagttttggaatggtggttatcgtctggttttcagtatgactccagcccatgctgagctctgaaatgagggctgtccctcatttccttgacgttgcactgtgtcttcccctccttcccctctctttgctctaggcccagagccgcagctcgaagccgtccaactgcagcctgtgctagggccctgggcttggggagggaggttcacctgaggaggactgtggccctcacacctctagggtacacagggagaggaggcccggagcaccctggagggcagagacaagcgggagtgatgtggaggtcgccctgggagcctctggaaggccttgctagtgctccagctgcatggaagagagcggctagcaactgttccctggttgggccctcagtggatgctggccaggccctactcttagccccttcatcatgtcatctcccttatgctggagctgccccgatgtggagtgggcaggaaggggcctggaaaaaataaaggatcttggcagttgataaaacgt

SEQ ID NO: 204199 - DNA, 1159 bp, Homo sapiens
  Payload ID: 20273
  Gene Name: zinc finger, AN1-type domain 2B
  Uniprot ID: Q8WV99
  ENST ID: ENST00000409206
  CDS Start-End: 81-611
cagcgcgccgcgcgcgccgagggaggagcgggcgccgggggccggctggcgcgggggctccgaccctgcccggcttggcgatggagtttccggacctcggcgctcactgttcggagccgagctgtcagcgcttggattttctgccgcttaagtgtgatgcctgctcaggcatcttctgcgcagaccatgtggcctacgcccagcatcactgtggatctgcttaccaaaaggatatccaggtacctgtgtgccctctctgtaatgtgcctgtgcctgtggccagaggggagccccctgaccgtgctgtgggagagcacattgacagagactgtcgctctgatccagcacagcaaaaacgtaagatcttcaccaataagtgtgaacgcgctggctgccggcagcgagaaatgatgaaactgacctgtgaacgctgtagccgaaacttctgcatcaagcaccggcatccactggaccatgattgctctggggaggggcacccaaccagccgggcaggacttgctgccatctccagagcacaagctgtggcttctacaagcactgtccccagcccaagtcaaaccatgccttcctgtacctctcccagcaggtaggcctgcccgtttccctgctccccctttttccccttcacacctctgacctccacctcttcaatgtctgtcgtagagccacaacccgatctccgtcctggacagcccctccagtgattgctttgcagaatggcctggtgagttgggcagaggttggatggacagaaacaaacacacagagagtgaagtccaaggacgctggtcttctttctccctttgtagagtgaggatgaagctctgcagcgggccctggaaatgtccctggcagaaaccaaaccccaggttccaaggtaccttaccctcttgtgaaagagagcgcaagctgtgggcaagggcttggtctggaggcaggtaggtgggaccactctgacacaatgcaagataatcgctggcaacttggtctcaaaattaagatgaactatatgatctttgacaagttatttaacccatggagccttcatttcctctataaaacggggacaatactaatacccaccttgtagtgttgctatgaagattgagataatcctcagcagtgctcagcaccatga

SEQ ID NO: 204200 - DNA, 569 bp, Homo sapiens
  Payload ID: 20273
  Gene Name: zinc finger, AN1-type domain 2B
  ENST ID: ENST00000409412
  CDS Start-End: 58-495
aggagcgggcgccgggggccggctggcgcgggggctccgaccctgcccggcttggcgatggagtttccggacctcggcgctcactgttcggagccgagctgtcagcgcttggattttctgccgcttaagtgtgatgcctgctcaggcatcttctgcgcagaccatgtggcctacgcccagcatcactgtggatctgcttaccaaaaggatatccaggtacctgtgtgccctctctgtaatgtgcctgtgcctgtggccagaggggagccccctgaccgtgctgtgggagagcacattgacagagactgtcgctctgatccagcacagcaaaaacgtaagatcttcaccaataagtgtgaacgcgctggctgccggcagcgagaaatgatgaaactgacctgtgaacgctgtagccgaaacttctgcatcaagcaccggcatccactggaccatgattgctctggggaggggcacccaaccagccgggcagggtaatggcagccaagtcctccacttgcttttgggaagcattcttttggaactgactcaagctctgttgttataaattg

SEQ ID NO: 204201 - DNA, 944 bp, Homo sapiens
  Payload ID: 20273
  Gene Name: zinc finger, AN1-type domain 2B
  Uniprot ID: Q8WV99
  ENST ID: ENST00000409336
  CDS Start-End: 59-832
gagcgggcgccgggggccggctggcgcgggggctccgcagaccctgcccggcttggcgatggagtttccggacctcggcgctcactgttcggagccgagctgtcagcgcttggattttctgccgcttaagtgtgatgcctgctcaggcatcttctgcgcagaccatgtggcctacgcccagcatcactgtggatctgcttaccaaaaggatatccaggtacctgtgtgccctctctgtaatgtgcctgtgcctgtggccagaggggagccccctgaccgtgctgtgggagagcacattgacagagactgtcgctctgatccagcacagcaaaaacgtaagatcttcaccaataagtgtgaacgcgctggctgccggcagcgagaaatgatgaaactgacctgtgaacgctgtagccgaaacttctgcatcaagcaccggcatccactggaccatgattgctctggggaggggcacccaaccagccgggcaggacttgctgccatctccagagcacaagctgtggcttctacaagcactgtccccagcccaagtcaaaccatgccttcctgtacctctcccagcagagccacaacccgatctccgtcctggacagcccctccagtgattgctttgcagaatggcctgagtgaggatgaagctctgcagcgggccctggaaatgtccctggcagaaaccaaaccccaggttccaagttgtcaggaggaagaagacctagctttagcacaagcactgtcagccagtgaggcagaataccagcggcagcaggcccagagccgcagctcgaagccgtccaactgcagcctgtgctagggccctgggcttggggagggaggttcacctgaggaggactgtggccctcacacctctagggtacacagggagaggaggcccggagcaccctggagggcagagacaagcggga

SEQ ID NO: 204202 - DNA, 1765 bp, Homo sapiens
  Payload ID: 20273
  Gene Name: zinc finger, AN1-type domain 2B
  ENST ID: ENST00000409097
  CDS Start-End: 58-735
aggagcgggcgccgggggccggctggcgcgggggctccgaccctgcccggcttggcgatggagtttccggacctcggcgctcactgttcggagccgagctgtcagcgcttggattttctgccgcttaagtgtgatgcctgctcaggcatcttctgcgcagaccatgtggcctacgcccagcatcactgtggatctgcttaccaaaaggatatccaggtacctgtgtgccctctctgtaatgtgcctgtgcctgtggccagaggggagccccctgaccgtgctgtgggagagcacattgacagagactgtcgctctgatccagcacagcaaaaacgtaagatcttcaccaataagtgtgaacgcgctggctgccggcagcgagaaatgatgaaactgacctgtgaacgctgtagccgaaacttctgcatcaagcaccggcatccactggaccatgattgctctggggaggggcacccaaccagccgggcaggacttgctgccatctccagagcacaagctgtggcttctacaagcactgtccccagcccaagtcaaaccatgccttcctgtacctctcccagcagagccacaacccgatctccgtcctggacagcccctccagtgattgctttgcagaatggcctggtgagttgggcagaggttggatggacagaaacaaacacacagagagtgaagtccaaggacgctggtcttctttctccctttgtagagtgaggatgaagctctgcagcgggccctggaaatgtccctggcagaaaccaaaccccaggttccaaggtaccttaccctcttgtgaaagagagcgcaagctgtgggcaagggcttggtctggaggcaggtaggtgggaccactctgacacaatgcaagataatcgctggcaacttggtctcaaaattaagatgaactatatgatctttgacaagttatttaacccatggagccttcatttcctctataaaacggggacaatactaatacccaccttgtagtgttgctatgaagattgagataatcctcagcagtgctcagcaccatgaggcccaacacacacagatcagatgttcaaatttcagatcttaccatcatccaacttaaactgtttctccctcccagttgtcaggaggaagaagacctagctttagcacaagcactgtcagccagtgaggcagaataccagcggcagcaggtatgaggctgggctgaagatatatgctgcagtggaagggaggaagaagtcagggatgggggttcttcctagtggtgcagagttttggaatggtggttatcgtctggttttcagtatgactccagcccatgctgagctctgaaatgagggctgtccctcatttccttgacgttgcactgtgtcttcccctccttcccctctctttgctctaggcccagagccgcagctcgaagccgtccaactgcagcctgtgctagggccctgggcttggggagggaggttcacctgaggaggactgtggccctcacacctctagggtacacagggagaggaggcccggagcaccctggagggcagagacaagcgggagtgatgtggaggtcgccctgggagcctctggaaggccttgctagtgctccagctgcatggaagagagcggctagcaactgttccctggttgggccctcagtggatgctggccaggccctactcttagccccttcatcatgtcatctcccttatgctggagctgccccgatgtggagtgggcaggaagg

SEQ ID NO: 204203 - DNA, 771 bp, Homo sapiens
  Payload ID: 20273
  Gene Name: zinc finger, AN1-type domain 2B
  ENST ID: ENST00000409319
  CDS Start-End: 114-551
gggcggggcagggagcccgccagagtgcggggtcgcggtgcggacttcgagcacgagccctaaagacgctcagcactcgtcgcttctcctagcagaccctgcccggcttggcgatggagtttccggacctcggcgctcactgttcggagccgagctgtcagcgcttggattttctgccgcttaagtgtgatgcctgctcaggcatcttctgcgcagaccatgtggcctacgcccagcatcactgtggatctgcttaccaaaaggatatccaggtacctgtgtgccctctctgtaatgtgcctgtgcctgtggccagaggggagccccctgaccgtgctgtgggagagcacattgacagagactgtcgctctgatccagcacagcaaaaacgtaagatcttcaccaataagtgtgaacgcgctggctgccggcagcgagaaatgatgaaactgacctgtgaacgctgtagccgaaacttctgcatcaagcaccggcatccactggaccatgattgctctggggaggggcacccaaccagccgggcagggtaatggcagccaagtcctccacttgcttttgggaagcattcttttggaactgactcaagctctgttgttataaattggggagcttcaaccctaccctgtcggctaggggagtcttttagcttccttttcaagtgcatgtttttccagaactcccctcctgacttcctgggtaaggctagttcttggagacatgccaaaaatctctcttccctacagacttgct

SEQ ID NO: 204204 - DNA, 1064 bp, Homo sapiens
  Payload ID: 20273
  Gene Name: zinc finger, AN1-type domain 2B
  ENST ID: ENST00000448496
  CDS Start-End: 107-397
gcagggagcccgccagagtgcggggtcgcggtgcggacttcgagcacgagccctaaagacgctcagcactcgtcgcttctcctagcagaccctgcccggcttggcgatggagtttccggacctcggcgctcactgttcggagccgagctgtcagcgcttggattttctgccgcttaagtgtgatgcctgctcaggcatcttctgcgcagaccatgtggcctacgcccagcatcactgtggatctgcttaccaaaaggatatccaggtacctgtgtgccctctctgtaatgtgcctgtgcctgtggccagaggggagccccctgaccgtgctgtgggagagcacattgacagagactgtcgctctgatccagcacagcaaaaacatcttcaccaataagtgtgaacgcgctggctgccggcagcgagaaatgatgaaactgacctgtgaacgctgtagccgaaacttctgcatcaagcaccggcatccactggaccatgattgctctggggaggggcacccaaccagccgggcaggacttgctgccatctccagagcacaagctgtggcttctacaagcactgtccccagcccaagtcaaaccatgccttcctgtacctctcccagcagagccacaacccgatctccgtcctggacagcccctccagtgattgctttgcagaatggcctggtgagttgggcagaggttggatggacagaaacaaacacacagagagtgaagtccaaggacgctggtcttctttctccctttgtagagtgaggatgaagctctgcagcgggccctggaaatgtccctggcagaaaccaaaccccaggttccaaggtaccttaccctcttgtgaaagagagcgcaagctgtgggcaagggcttggtctggaggcaggtaggtgggaccactctgacacaatgcaagataatcgctggcaacttggtctcaaaattaagatgaactatatgatctttgacaagttatttaacccatggagccttcatttcctctataaaacggggacaatactaatacccaccttgtagtgttgctat

SEQ ID NO: 204205 - DNA, 741 bp, Homo sapiens
  Payload ID: 20273
  Gene Name: zinc finger, AN1-type domain 2B
  ENST ID: ENST00000436556
  CDS Start-End: 592-741
aaagacacccccctcctacctccccaccccccaaatatcccctggaggcaaaattgccctggtggatcaccactgatctaactgatagtaccctctggttatatgggaaaactgctaaacttggaagcaggaggcatctaaaatgagcttgtgtccgcaattggtgggttcttggtctcactgacttcaagaatgaagccgcagaccctcgcggtgagtgttacagctcttaagatggcgcgtgtggagtctgtcccttctgatgttcagatgtgttcggagtttcttccttctggtgggttcgtggtctcgctggctcagaagtgaagctgccgaccttcacggaagcaaggaggctacattggggaatggtgactttggtttgtgcgggcactctttttaaatcgtgggatgagaacatcacccagtgagaaagcccctgggctggtaatcagcacagagagcttagtcaggactataacccatcagtcagaaaaatatttgcctgggaagagagatactaccgtgagagcttcattcacttttatcgtggtcgctggggtctctgagcagaccctgcccggcttggcgatggagtttccggacctcggcgctcactgttcggagccgagctgtcagcgcttggattttctgccgcttaagtgtgatgcctgctcaggcatcttctgcgcagaccatgtggcctacgcccagcatcactgtggatctgcttaccaaaag

SEQ ID NO: 204206 - DNA, 705 bp, Homo sapiens
  Payload ID: 20273
  Gene Name: zinc finger, AN1-type domain 2B
  ENST ID: ENST00000422255
  CDS Start-End: 64-705
gggaggagcgggcgccgggggccggctggcgcgggggctccgcagaccctgcccggcttggcgatggagtttccggacctcggcgctcactgttcggagccgagctgtcagcgcttggattttctgccgcttaagtgtgatgcctgctcaggcatcttctgcgcagaccatgtggcctacgcccagcatcactgtggatctgcttaccaaaaggatatccaggtacctgtgtgccctctctgtaatgtgcctgtgcctgtggccagaggggagccccctgaccgtgctgtgggagagcacattgacagagactgtcgctctgatccagcacagcaaaaacgtaagatcttcaccaataagtgtgaacgcgctggctgccggcagcgagaaatgatgaaactgacctgtgaacgctgtagccgaaacttctgcatcaagcaccggcatccactggaccatgattgctctggggaggggcacccaaccagccgggcaggacttgctgccatctccagagcacaagctgtggcttctacaagcactgtccccagcccaagtcaaaccatgccttcctgtacctctcccagcagagccacaacccgatctccgtcctggacagcccctccagtgattgctttgcagaatggcctggtgagttgggcagaggttggatggacagaaacaaacacacagagagtgaagtcc

SEQ ID NO: 204207 - DNA, 1199 bp, Homo sapiens
  Payload ID: 20273
  Gene Name: zinc finger, AN1-type domain 2B
  Uniprot ID: Q8WV99
  ENST ID: ENST00000444522
  CDS Start-End: 81-854
cagcgcgccgcgcgcgccgagggaggagcgggcgccgggggccggctggcgcgggggctccgaccctgcccggcttggcgatggagtttccggacctcggcgctcactgttcggagccgagctgtcagcgcttggattttctgccgcttaagtgtgatgcctgctcaggcatcttctgcgcagaccatgtggcctacgcccagcatcactgtggatctgcttaccaaaaggatatccaggtacctgtgtgccctctctgtaatgtgcctgtgcctgtggccagaggggagccccctgaccgtgctgtgggagagcacattgacagagactgtcgctctgatccagcacagcaaaaacgtaagatcttcaccaataagtgtgaacgcgctggctgccggcagcgagaaatgatgaaactgacctgtgaacgctgtagccgaaacttctgcatcaagcaccggcatccactggaccatgattgctctggggaggggcacccaaccagccgggcaggacttgctgccatctccagagcacaagctgtggcttctacaagcactgtccccagcccaagtcaaaccatgccttcctgtacctctcccagcagagccacaacccgatctccgtcctggacagcccctccagtgattgctttgcagaatggcctgagtgaggatgaagctctgcagcgggccctggaaatgtccctggcagaaaccaaaccccaggttccaagttgtcaggaggaagaagacctagctttagcacaagcactgtcagccagtgaggcagaataccagcggcagcaggcccagagccgcagctcgaagccgtccaactgcagcctgtgctagggccctgggcttggggagggaggttcacctgaggaggactgtggccctcacacctctagggtacacagggagaggaggcccggagcaccctggagggcagagacaagcgggagtgatgtggaggtcgccctgggagcctctggaaggccttgctagtgctccagctgcatggaagagagcggctagcaactgttccctggttgggccctcagtggatgctggccaggccctactcttagccccttcatcatgtcatctcccttatgctggagctgccccgatgtggagtgggcaggaaggggcctggaaaaaataaaggatcttggcagttgataaaacgtacaa

SEQ ID NO: 204208 - DNA, 484 bp, Homo sapiens
  Payload ID: 20273
  Gene Name: zinc finger, AN1-type domain 2B
  ENST ID: ENST00000425849
  CDS Start-End: 1-458
ctccagtgattgctttgcagaatggcctgagtgaggatgaagctctgcagcgggccctggaaatgtccctggcagaaaccaaaccccaggttccaaggcccagagccgcagctcgaagccgtccaactgcagcctgtgctagggccctgggcttggggagggaggttcacctgaggaggactgtggccctcacacctctagggtacacagggagaggaggcccggagcaccctggagggcagagacaagcgggagtgatgtggaggtcgccctgggagcctctggaaggccttgctagtgctccagctgcatggaagagagcggctagcaactgttccctggttgggccctcagtggatgctggccaggccctactcttagccccttcatcatgtcatctcccttatgctggagctgccccgatgtggagtgggcaggaaggggcctggaaaaaataaaggatcttggcagttgataaaacgta

SEQ ID NO: 204209 - DNA, 1070 bp, Homo sapiens
  Payload ID: 20273
  Gene Name: zinc finger, AN1-type domain 2B
  ENST ID: ENST00000621130
  CDS Start-End: 84-725
cagcgcgccgcgcgcgccgagggaggagcgggcgccgggggccggctggcgcgggggctccgcagaccctgcccggcttggcgatggagtttccggacctcggcgctcactgttcggagccgagctgtcagcgcttggattttctgccgcttaagtgtgatgcctgctcaggcatcttctgcgcagaccatgtggcctacgcccagcatcactgtggatctgcttaccaaaagatcttcaccaataagtgtgaacgcgctggctgccggcagcgagaaatgatgaaactgacctgtgaacgctgtagccgaaacttctgcatcaagcaccggcatccactggaccatgattgctctggggaggggcacccaaccagccgggcaggacttgctgccatctccagagcacaagctgtggcttctacaagcactgtccccagcccaagtcaaaccatgccttcctgtacctctcccagcagagccacaacccgatctccgtcctggacagcccctccagtgattgctttgcagaatggcctgagtgaggatgaagctctgcagcgggccctggaaatgtccctggcagaaaccaaaccccaggttccaagttgtcaggaggaagaagacctagctttagcacaagcactgtcagccagtgaggcagaataccagcggcagcaggcccagagccgcagctcgaagccgtccaactgcagcctgtgctagggccctgggcttggggagggaggttcacctgaggaggactgtggccctcacacctctagggtacacagggagaggaggcccggagcaccctggagggcagagacaagcgggagtgatgtggaggtcgccctgggagcctctggaaggccttgctagtgctccagctgcatggaagagagcggctagcaactgttccctggttgggccctcagtggatgctggccaggccctactcttagccccttcatcatgtcatctcccttatgctggagctgccccgatgtggagtgggcaggaaggggcctggaaaaaataaaggatcttggcagttgataaaacgtacaa

SEQ ID NO: 204210 - DNA, 3366 bp, Homo sapiens
  Payload ID: 20274
  Gene Name: zinc finger, AN1-type domain 3
  Uniprot ID: Q9H8U3
  ENST ID: ENST00000287218
  CDS Start-End: 448-1131
gttacggagacagcagggcccggggcttcagagcggccgctgcgactccggagccggcggggggctccggtccttccctgcgccaccgcacaggacatctctctggctggggagcggcggtgagacccgccgagggcgtctgtgtccctcctcccccgcggtcctcggtgcgtccgcacgcccctcctcctcggctccctccttcttctctccgcgcctctccgccccctccccgtctccgcaggccgagtggtgcggcccgcctccagctgaccggcctggaatcccggctccgagccccggactcgcgcccgcccgcgcgcccgctccttccccctccccccgccccgagccccccgacgccgccgccaccgcctcctcagagcggggcccgggcccagccgccgccaccgctgccgccgccgagctccgccgccgccgagcaccatgggagacgctgggagcgagcgcagcaaagcgcccagcctgccgcctcgctgtccctgcggcttctgggggtccagcaagactatgaatctctgttccaaatgctttgctgattttcaaaagaaacagccagacgatgattccgctccaagtacaagtaacagccaatcagatttgttttccgaagagaccaccagtgacaacaacaatacctcgataaccacgccaactcttagtcccagccagcagccgcttccgacagaactgaatgtaacttcaccgagtaaagaggagtgtgggccatgcacagacacagctcatgtctcattaatcacaccaacaaaaagatcctgtggtacagattcacagtctgagaatgaggcttcaccagtaaaacggccacgactacttgagaatacggaacggtccgaggaaaccagtcgatctaaacagaagagtcgacgtcggtgcttccagtgccaaaccaaactggagctggtgcagcaggaattgggatcgtgtcgctgcggttatgtgttctgtatgttacatcgcctccccgagcagcacgactgcacattcgaccacatgggccgtggccgggaggaagccatcatgaaaatggtgaagctggaccggaaagtggggcgctcctgccagcgcatcggggaggggtgctcctgaaggccaggcatggccaccacgtgacgctgttcttagttcactaatgttagccttatttaggacaaagtcagccagacaccttgtactgggcacgcgtcagactgcagccagtccgtttcctttctttagccagccatcctggtactgtagtttaggggttgatggtggttgaaattgatttctggctggttactaaggtgcctgctagccattgtataaaattaaaacatgaagaatattttttttttgagcatggctagtggatttaaaacaacacatacctgtcactgctggagtcaaacttataaaaagccttaagtggaaagtgttccagacggagactctgagttaatagaggagtagaagctggtgttaaagttcccacgacgcacatggctttgccagaaactctgtttaatgatcggcctttcacctcttcacttatccttagtcccagtagccaggatacctgatggccacgtgtgccttggccacgggaggctgctgagattggccacgtggctgggctgggtggtggcctcactctcccacagagctggaaatggggggtgggggacagattcttacggaaatttttttacctgacttgctatgaaaaaactcatcacacaagaagagaaacagtaacctcactttgaaaattagctccactcaagactagtccacgaacgagacccgccttttctacacaggatccaaggtcacgagaagcagccagagtgccccgcctccgccggctctggtctgccattcgccagtgcagggatctggcacggaccagatgtggcgaatggcagcacagcgcggtggctgggtctgcacactggcctctgcagccagatttctatattgggagttttttaaaaagacatttcatagccaacaagaatcagtagaagtgctgggagcagcagctggggaagctgccgcccacgggctctgccccttccagctggagccgcccgtgcctccaggggccaagaggatgatgtcgtggcctccattctcgtttctatgcagccccatagtccaaggacacccagtccacatctaccatatagcaagtttagtaagggaaggcagcatacgtcccagggacagtgggtttggatctgtctagaacagcggtttgtggctgtggcccagctccgagagtgatatttgctctggtaggtgagggcctgagggtacatttctccacctgtgccccctcatgttcacagaggatttcagcagctgcaactgcgcacgccaggtggggaagggtgggggtgggcctggttgccccatgttaggaaatcactaccagtcaggtggggctggggctgggtggacaggatcaggattcccttgaaagcccaggcagggtgagcagtcccagtggtcctagtgccgcatcagatccaggtgggtgagggcaggaggcccctgcggaggcagcgtggatctgcccacacataggctactggaatagtttaacccagcaactttcctttttataaaacaacaaatggttcaactctgtctgcaaattaacagctgaacacctgcaactgcaaatgttttttgatccgacgtactgaaataggaagtcatgctcttcccaccctccacccaccagagtggaacccgctgcaaaatccccagccttaattcttgcttcaggacccagaccggtgtcttgctctagggcaacccagggcagaggggccaggtctgcccagcgtttaccactgctgtcaagccacagcccttggccaccatacgggccatcctcagtgaggcagccccccataggcttccgccaagctctggtcccgaagaggctgtgcgagcccttcccggccctccccagggccccccgccccctcctctgcctgctgcgtggaggcagccatgggaaggagcccaggggagctggcctgggggagcgaagcccatgttcgcttcctgacttagagctggggggggtggggggtggggcttgttcccctgcagtatctgttctgtgaagtttgttaaatgtaaggaaagcttaaattcttgtatctttaaaagagaaaatcttatttaacccttttgtgttctagatttacttacacacatagcctagagctcagttttagttttaacattgtgaaaatattaaaagaatcttgtaactttattcttttttctcctgctgaaaaaaaaaattaaaccaatcgtatgaaa

SEQ ID NO: 204211 - DNA, 531 bp, Homo sapiens
  Payload ID: 20274
  Gene Name: zinc finger, AN1-type domain 3
  ENST ID: ENST00000373389
  CDS Start-End: 1-493
gtccagcaagactatgaatctctgttccaaatgctttgctgattttcaaaagaaacagccagacgatgattccgctccaagtacaagtaacagccaatcagatttgttttccgaagagaccaccagtgacaacaacaatacctcgataaccacgccaactcttagtcccagccagcagccgcttccgacagaactgaatgtaacttcaccgagtaaagaggagtgtgggccatgcacagacacagctcatgtctcattaatcacaccaacaaaaagatcctgtggtacagattcacagtctgagaatgaggcttcaccagtaaaacggccacgactacttgagaatacggaacggtccgaggaaaccagtcgatctaaacagaagagtcgacgtcggtgcttccagtgccaaaccaaactggagctggtgcagcaggaattgggatcgtgtcgctgcggtgtttctctggagagagatgtgtggcatttatagtctgatgccccctgaccacgttgccactcggacattct

SEQ ID NO: 204212 - DNA, 3001 bp, Homo sapiens
  Payload ID: 20274
  Gene Name: zinc finger, AN1-type domain 3
  ENST ID: ENST00000373391
  CDS Start-End: 149-766
ccggactcgcgcccgcccgcgcgcccgctccttccccctccccccgccccgagccccccgacgccgccgccaccgcctcctcagagcggggcccgggcccagccgccgccaccgctgccgccgccgagctccgccgccgccgagcaccatgggagacgctgggagcgagcgcagcaaagcgcccagcctgccgcctcgctgtccctgcggcttctgggggtccagcaagactatgaatctctgttccaaatgctttgctgattttcaaaagaaacagccagacgatgattccgctccaagtacaagtaacagccaatcagatttgttttccgaagagaccaccagtgacaacaacaatacctcgataaccacgccaactcttagtcccagccagcagccgcttccgacagaactgaatgtaacttcaccgagtaaagaggagtattcacagtctgagaatgaggcttcaccagtaaaacggccacgactacttgagaatacggaacggtccgaggaaaccagtcgatctaaacagaagagtcgacgtcggtgcttccagtgccaaaccaaactggagctggtgcagcaggaattgggatcgtgtcgctgcggttatgtgttctgtatgttacatcgcctccccgagcagcacgactgcacattcgaccacatgggccgtggccgggaggaagccatcatgaaaatggtgaagctggaccggaaagtggggcgctcctgccagcgcatcggggaggggtgctcctgaaggccaggcatggccaccacgtgacgctgttcttagttcactaatgttagccttatttaggacaaagtcagccagacaccttgtactgggcacgcgtcagactgcagccagtccgtttcctttctttagccagccatcctggtactgtagtttaggggttgatggtggttgaaattgatttctggctggttactaaggtgcctgctagccattgtataaaattaaaacatgaagaatattttttttttgagcatggctagtggatttaaaacaacacatacctgtcactgctggagtcaaacttataaaaagccttaagtggaaagtgttccagacggagactctgagttaatagaggagtagaagctggtgttaaagttcccacgacgcacatggctttgccagaaactctgtttaatgatcggcctttcacctcttcacttatccttagtcccagtagccaggatacctgatggccacgtgtgccttggccacgggaggctgctgagattggccacgtggctgggctgggtggtggcctcactctcccacagagctggaaatggggggtgggggacagattcttacggaaatttttttacctgacttgctatgaaaaaactcatcacacaagaagagaaacagtaacctcactttgaaaattagctccactcaagactagtccacgaacgagacccgccttttctacacaggatccaaggtcacgagaagcagccagagtgccccgcctccgccggctctggtctgccattcgccagtgcagggatctggcacggaccagatgtggcgaatggcagcacagcgcggtggctgggtctgcacactggcctctgcagccagatttctatattgggagttttttaaaaagacatttcatagccaacaagaatcagtagaagtgctgggagcagcagctggggaagctgccgcccacgggctctgccccttccagctggagccgcccgtgcctccaggggccaagaggatgatgtcgtggcctccattctcgtttctatgcagccccatagtccaaggacacccagtccacatctaccatatagcaagtttagtaagggaaggcagcatacgtcccagggacagtgggtttggatctgtctagaacagcggtttgtggctgtggcccagctccgagagtgatatttgctctggtaggtgagggcctgagggtacatttctccacctgtgccccctcatgttcacagaggatttcagcagctgcaactgcgcacgccaggtggggaagggtgggggtgggcctggttgccccatgttaggaaatcactaccagtcaggtggggctggggctgggtggacaggatcaggattcccttgaaagcccaggcagggtgagcagtcccagtggtcctagtgccgcatcagatccaggtgggtgagggcaggaggcccctgcggaggcagcgtggatctgcccacacataggctactggaatagtttaacccagcaactttcctttttataaaacaacaaatggttcaactctgtctgcaaattaacagctgaacacctgcaactgcaaatgttttttgatccgacgtactgaaataggaagtcatgctcttcccaccctccacccaccagagtggaacccgctgcaaaatccccagccttaattcttgcttcaggacccagaccggtgtcttgctctagggcaacccagggcagaggggccaggtctgcccagcgtttaccactgctgtcaagccacagcccttggccaccatacgggccatcctcagtgaggcagccccccataggcttccgccaagctctggtcccgaagaggctgtgcgagcccttcccggccctccccagggccccccgccccctcctctgcctgctgcgtggaggcagccatgggaaggagcccaggggagctggcctgggggagcgaagcccatgttcgcttcctgacttagagctggggggggtggggggtggggcttgttcccctgcagtatctgttctgtgaagtttgttaaatgtaaggaaagcttaaattcttgtatctttaaaagagaaaatcttatttaacccttttgtgttctagatttacttacacacatagcctagagctcagttttagttttaacattgtgaaaatattaaaagaatcttgtaactttattcttttttctcctgctgaaaaaaaaaattaaaccaatcgtatgaaa

SEQ ID NO: 204213 - DNA, 563 bp, Homo sapiens
  Payload ID: 20274
  Gene Name: zinc finger, AN1-type domain 3
  ENST ID: ENST00000474522
  CDS Start-End: 5-563
caccatgggagacgctgggagcgagcgcagcaaagcgcccagcctgccgcctcgctgtccctgcggcttctgggggtccagcaagactatgaatctctgttccaaatgctttgctgagacggggttttgccatgttgaccaggctggccttgaactcctgagctcaagtgatccacctgcctcagcctcccaaagtgctgggattacagattttcaaaagaaacagccagacgatgattccgctccaagtacaagtaacagccaatcagatttgttttccgaagagaccaccagtgacaacaacaatacctcgataaccacgccaactcttagtcccagccagcagccgcttccgacagaactgaatgtaacttcaccgagtaaagaggagtgtgggccatgcacagacacagctcatgtctcattaatcacaccaacaaaaagatcctgtggtacagattcacagtctgagaatgaggcttcaccagtaaaacggccacgactacttgagaatacggaacggtccgaggaaaccagtcgatctaaacagaagagtcgacgtc

SEQ ID NO: 204214 - DNA, 3241 bp, Homo sapiens
  Payload ID: 20275
  Gene Name: zinc finger, AN1-type domain 4
  Uniprot ID: Q86XD8
  ENST ID: ENST00000344646
  CDS Start-End: 217-2400
cggactgctgtcctccagattcaggccggtgggtctggggagcccggattggtcttggaggagcaacggctgcgcaggtgactcggtggcctcaagtgtgtacaaaactcaaaacatgaacaacaatatatattaccaatcttcaaacctggtttgcctagaactggaatacagttgcctgcgacatattttagaagaactagaaaagtcaaagtaatggataacagaaaagagcctccattcttcaatgatgataacatgggaccattttactacagacttcatttctgtgataccatggagctcttcattgaaacattaactggaacatgttttgagctgagagtttcaccttttgaaactgttatttctgtgaaagcaaaaattcgaagattggaaggtattcccatctgtcgacaacacttaatttggaataacatggaacttgaaaatgattattgcttgaatgattacaacatttcagaagggtgtaccttgaagctagttttggctatgcgtggcggacctataaatactagaagagttcctacagacgatccacttaggaagatggcagagtacttggattccagtcgagttgaggtctgggagaagacctcctgcagcaaacaagttacatttttggtataccaagaaggagatcaattgaatttctttcctgcagtagataggggagatggcactttaacaccgttatctgactcttcaaagaaaatagattttcatttgcatgtcctacggagaaaaggagaacatcgtatgagtggtggttctatgtataattcagatacagatgaggatgaagaaactgagccttcttcttctgggcaacagataattgaaaattcaataactatgaataagatgaagctgctgaaggctaagatgaagaacatgaatctcagcaaaaagcctaagaaagctgtcaagataaaacctcacccacctgtagctcctcgaccttctagtggttccactgcaccatctcgccaccgattgttaagggtcctccccaacattggtcaatcttgttcacctgcttttgggaatgcatatccgcccgaaatctccaggaatggaatttcaagtttggcaactcaactctctgctgagagatacatatcttctatcactggtgaatttcttaaggaagataatagctgggagaataacacactgtctcacttcagtagcaacgtcaaactacctcctcagataccccatttggagttgggaaatgaccaggagcttgctgactctgttctccatcttggatcatccctgcctaggcaaacaaaacattttttaggaaacttgccatctagtaatgggaacattgtcttaccttcagaagaatgtgtaaccgaacaatcacttctacctaaagtgggctcactggcttcatttgcagaaggaaatgctgatgaacagagcagcggcttagaaggtgcgtgcaaagtgaatctggagttgctactcactaatgctgacaaagggttgaaagctccagagcagcatctcaagcatgttgcaggagtgctgaatggggaatcagtagagacttcagttcttaactaccgggaattaagtcctcacaagaatagactcttgtcacctcttcgctgttctgcaccaatgtcgctacataattctctggtgaaaccagagagacagtccaaatgttttgagtttgggaagctacagccttcttcttctcagtcactggatgttcaaaacataactgattcttctttctctaggactacttgctttcaaggtgttaaagttgattcacttgggaaaagatctgatgttatttccaaagttgaggctcgggatatcacagaaatgactaacaaggcttccaaagagcctgttggttgtgtaaataatatcagttttcttgcctcactggccgggagcacaagcagaaatagattacagagcacacgtggggcaggcaggcttcagaactctggaactgggctgtctacaaacctccagcattttcaggaagaaaactttaggaaaagttctccccagttagaacatacaggagtttttttgtctacccatggtgttggaatgaatggaaataatgcagcagcagggaaaagcgtaggagaatgtactactcatcacctcccacctgtgaaagcccctcttcagacaaagaagaaaacaacaaatcattgttttctttgtggaaagaaaacaggactggctagtagctacgaatgcagatgtggaaacaacttctgtgcatctcatcgttatgcagaaactcatggctgtacctatgattacaagagtgcagggaggagatacttgcacgaggcaaatcctgtggttaatgcaccaaagcttccaaaaatctaactcttcctctacatcttactgttctgcccgggattcgtattataatgacagaagaaatgttgtttagactattatttttgttcgactctaaaagatttgccaaataacaaaagcatacaatgcatactgttggagaacaagaatgctactgtattttacatctttatttcttggtgaaacaaaagttttaaaagtagttttaacaactttacactggaatgatttagctttgttattgcatgtcttgtgttaagtgttttgtatatgatattgcagttttactaggcaaatcttcaaaagatgcactttaggaaacgaaatatttcctaaataaccaggcttccacattgtacagaatgagcagtcatgtaatgaatggctctactcagattgaccatatgggttttttctttttctttcttttattcttctccttctttttttttcagaggtgggatgggtggagattttttaaaaatcccacgtgtgaaagtttactggctttattagcaagttcctttttacttcaagctactttttataaaaaagaacatttttccagtgtggtttttaacagataatacatttcttccacattcagattagtattcggacatgaatccattctataaaacacatcgtgttcatgatagtgtatattttactactttttgaatgttaattttaaaatagaagatgtcccacttgccattaaatatagaagccaactttttaccttttgaaatatggctacatttaaaacaaaatctcacagctcggtttttcttatttgttgagtgctattaccaggagaaattcaaataaatattcaatttcatta

SEQ ID NO: 204215 - DNA, 3821 bp, Homo sapiens
  Payload ID: 20275
  Gene Name: zinc finger, AN1-type domain 4
  ENST ID: ENST00000374366
  CDS Start-End: 925-2886
gttgggccctgtcgacctgtaggcgggcgagcgagccagcggacaagactgcgggtgaggctgagctagcgagcggccggcagggggggcgcccgggctgcgagccgctgagcccagccgcgctgccgccgccggccgtcgtggggccggaatggcgcaaggccggagtggcgcgggcgctcggcgctgggctgccgggtagagtcctgtccccgcccctcgccttgcggcctgacgccggccgctgctgcccggggaccggagcggcgggccgcctttgcccaggacacacgctctggcgtttgttcctttgggcgtgacgccagcttcaacgggtacgcggctttcccgacgggtgctgatctccgagtcgctgttgtcacgcggactgctgtcctccagattcaggccggtgggtctggggagcccggattggtcttggaggagcaacggctgcgcaggtgactcggtggcctcaagtgtgtacaaaactcaaaacatgaacaacaatatatattaccaatcttcaaacctggtttgcctagaactggaatacagttgcctgcgacatattttagaagaactagaaaagtcaaagtaatggataacagaaaagagcctccattcttcaatgatgataacatgggaccattttactacagacttcatttctgtgataccatggagctcttcattgaaacattaactggaacatgttttgagctgagagtttcaccttttgaaactgttatttctgtgaaagcaaaaattcgaagattggaagacccaggagatcctactgaagtgagtggctggccgagtccagtgaccacatcagcacattcagtaatgactcttgaagcttttgtctgccctaaatgatttggtattcccatctgtcgacaacacttaatttggaataacatggaacttgaaaatgattattgcttgaatgattacaacatttcagaagggtgtaccttgaagctagttttggctatgcgtggcggacctataaatactagaagagttcctacagacgatccacttaggaagatggcagagtacttggattccagtcgagttgaggtctgggagaagacctcctgcagcaaacaagttacatttttggtataccaagaaggagatcaattgaatttctttcctgcagtagataggggagatggcactttaacaccgttatctgactcttcaaagaaaatagattttcatttgcatgtcctacggagaaaaggagaacatcgtatgagtggtggttctatgtataattcagatacagatgaggatgaagaaactgagccttcttcttctgggcaacagataattgaaaattcaataactatgaataagatgaagctgctgaaggctaagatgaagaacatgaatctcagcaaaaagcctaagaaagctgtcaagataaaacctcacccacctgtagctcctcgaccttctagtggttccactgcaccatctcgccaccgattgttaagggtcctccccaacattggtcaatcttgttcacctgcttttgggaatgcatatccgcccgaaatctccaggaatggaatttcaagtttggcaactcaactctctgctgagagatacatatcttctatcactggtgaatttcttaaggaagataatagctgggagaataacacactgtctcacttcagtagcaacgtcaaactacctcctcagataccccatttggagttgggaaatgaccaggagcttgctgactctgttctccatcttggatcatccctgcctaggcaaacaaaacattttttaggaaacttgccatctagtaatgggaacattgtcttaccttcagaagaatgtgtaaccgaacaatcacttctacctaaagtgggctcactggcttcatttgcagaaggaaatgctgatgaacagagcagcggcttagaaggtgcgtgcaaagtgaatctggagttgctactcactaatgctgacaaagggttgaaagctccagagcagcatctcaagcatgttgcaggagtgctgaatggggaatcagtagagacttcagttcttaactaccgggaattaagtcctcacaagaatagactcttgtcacctcttcgctgttctgcaccaatgtcgctacataattctctggtgaaaccagagagacagtccaaatgttttgagtttgggaagctacagccttcttcttctcagtcactggatgttcaaaacataactgattcttctttctctaggactacttgctttcaaggtgttaaagttgattcacttgggaaaagatctgatgttatttccaaagttgaggctcgggatatcacagaaatgactaacaaggcttccaaagagcctgttggttgtgtaaataatatcagttttcttgcctcactggccgggagcacaagcagaaatagattacagagcacacgtggggcaggcaggcttcagaactctggaactgggctgtctacaaacctccagcattttcaggaagaaaactttaggaaaagttctccccagttagaacatacaggagtttttttgtctacccatggtgttggaatgaatggaaataatgcagcagcagggaaaagcgtaggagaatgtactactcatcacctcccacctgtgaaagcccctcttcagacaaagaagaaaacaacaaatcattgttttctttgtggaaagaaaacaggactggctagtagctacgaatgcagatgtggaaacaacttctgtgcatctcatcgttatgcagaaactcatggctgtacctatgattacaagagtgcagggaggagatacttgcacgaggcaaatcctgtggttaatgcaccaaagcttccaaaaatctaactcttcctctacatcttactgttctgcccgggattcgtattataatgacagaagaaatgttgtttagactattatttttgttcgactctaaaagatttgccaaataacaaaagcatacaatgcatactgttggagaacaagaatgctactgtattttacatctttatttcttggtgaaacaaaagttttaaaagtagttttaacaactttacactggaatgatttagctttgttattgcatgtcttgtgttaagtgttttgtatatgatattgcagttttactaggcaaatcttcaaaagatgcactttaggaaacgaaatatttcctaaataaccaggcttccacattgtacagaatgagcagtcatgtaatgaatggctctactcagattgaccatatgggttttttctttttctttcttttattcttctccttctttttttttcagaggtgggatgggtggagattttttaaaaatcccacgtgtgaaagtttactggctttattagcaagttcctttttacttcaagctactttttataaaaaagaacatttttccagtgtggtttttaacagataatacatttcttccacattcagattagtattcggacatgaatccattctataaaacacatcgtgttcatgatagtgtatattttactactttttgaatgttaattttaaaatagaagatgtcccacttgccattaaatatagaagccaactttttaccttttgaaatatggctacatttaaaacaaaatctcacagctcggtttttcttatttgttgagtgctattaccaggagaaattcaaataaatattcaatttcattatgaatttcattatttatttataatagtttttcttttataaataatttttcttttataaaactatttaattaaatgagtgatttattttacgtgg

SEQ ID NO: 204216 - DNA, 2283 bp, Homo sapiens
  Payload ID: 20275
  Gene Name: zinc finger, AN1-type domain 4
  ENST ID: ENST00000374371
  CDS Start-End: 621-1295
gtgaagttgctcgccgggtcgttgggccctgtcgacctgtaggcgggcgagcgagccagcggacaagactgcgggtgaggctgagctagcgagcggccggcagggggggcgcccgggctgcgagccgctgagcccagccgcgctgccgccgccggccgtcgtggggccggaatggcgcaaggccggagtggcgcgggcgctcggcgctgggctgccgggtagagtcctgtccccgcccctcgccttgcggcctgacgccggccgctgctgcccggggaccggagcggcgggccgcctttgcccaggacacacgctctggcgtttgttcctttgggcgtgacgccagcttcaacgggtacgcggctttcccgacgggtgctgatctccgagtcgctgttgtcacgcggactgctgtcctccagattcaggccggtgggtctggggagcccggattggtcttggaggagcaacggctgcgcaggtgactcggtggcctcaagtgtgtacaaaactcaaaacatgaacaacaatatatattaccaatcttcaaacctggtttgcctagaactggaatacagttgcctgcgacatattttagaagaactagaaaagtcaaagtaatggataacagaaaagagcctccattcttcaatgatgataacatgggaccattttactacagacttcatttctgtgataccatggagctcttcattgaaacattaactggaacatgttttgagctgagagtttcaccttttgaaactgttatttctgtgaaagcaaaaattcgaagattggaaggtattcccatctgtcgacaacacttaatttggaataacatggaacttgaaaatgattattgcttgaatgattacaacatttcagaagggtgtaccttgaagctagttttggctatgcgtggcggacctataaatactagaagagttcctacagacgatccacttaggaagatggcagagtacttggattccagtcgagttgaggtctgggagaagacctcctgcagcaaacaagttacatttttggtataccaagaaggagatcaattgaatttctttcctgcagtagataggggagatggcactttaacaccgttatctgactcttcaaagaaaatagattttcatttgcatgtcctacggagaaaaggagaacatcgtatgaggagaatgtactactcatcacctcccacctgtgaaagcccctcttcagacaaagaagaaaacaacaaatcattgttttctttgtggaaagaaaacaggactggctagtagctacgaatgcagatgtggaaacaacttctgtgcatctcatcgttatgcagaaactcatggctgtacctatgattacaagagtgcagggaggagatacttgcacgaggcaaatcctgtggttaatgcaccaaagcttccaaaaatctaactcttcctctacatcttactgttctgcccgggattcgtattataatgacagaagaaatgttgtttagactattatttttgttcgactctaaaagatttgccaaataacaaaagcatacaatgcatactgttggagaacaagaatgctactgtattttacatctttatttcttggtgaaacaaaagttttaaaagtagttttaacaactttacactggaatgatttagctttgttattgcatgtcttgtgttaagtgttttgtatatgatattgcagttttactaggcaaatcttcaaaagatgcactttaggaaacgaaatatttcctaaataaccaggcttccacattgtacagaatgagcagtcatgtaatgaatggctctactcagattgaccatatgggttttttctttttctttcttttattcttctccttctttttttttcagaggtgggatgggtggagattttttaaaaatcccacgtgtgaaagtttactggctttattagcaagttcctttttacttcaagctactttttataaaaaagaacatttttccagtgtggtttttaacagataatacatttcttccacattcagattagtattcggacatgaatccattctataaaacacatcgtgttcatgatagtgtatattttactactttttgaatgttaattttaaaatagaagatgtcccacttgccattaaatatagaagccaactttttaccttttgaaatatggctacatttaaaacaaaatctcacagctcggtttttcttatttgttgagtgctattaccaggagaaattcaaataaatattcaatttc

SEQ ID NO: 204217 - DNA, 1209 bp, Homo sapiens
  Payload ID: 20275
  Gene Name: zinc finger, AN1-type domain 4
  ENST ID: ENST00000465407
  CDS Start-End: 202-837
agtgccttccgtgaagttgctcgccgggtcgttgggccctgtcgacctgtaggcgggcgagcgagccagcggacaagactgcgggtacaaaactcaaaacatgaacaacaatatatattaccaatcttcaaacctggtttgcctagaactggaatacagttgcctgcgacatattttagaagaactagaaaagtcaaagtaatggataacagaaaagagcctccattcttcaatgatgataacatgggaccattttactacagacttcatttctgtgataccatggagctcttcattgaaacattaactggaacatgttttgagctgagagtttcaccttttgaaactgttatttctgtgaaagcaaaaattcgaagattggaaggtattcccatctgtcgacaacacttaatttggaataacatggaacttgaaaatgattattgcttgaatgattacaacatttcagaagggtgtaccttgaagctagttttggctatgcgtggcggacctataaatactagaagagttcctacagacgatccacttaggaagatggcagagtacttggattccagtcgagttgaggtctgggagaagacctcctgcagcaaacaagttacatttttggtataccaagaaggagatcaattgaatttctttcctgcagtagataggggagatggcactttaacaccgttatctgactcttcaaagaaaatagattttcatttgcatgtcctacggagaaaaggagaacatcgtatgagtgagaatctcctcaggatgactaaaaatctgtacttctctcccgtgccaaatttaaaaaaattctgattcatggaaatctcatcagcctgttgtctgggttgcacaattatcagccttggctgataaaatgaaatcagacattctcatggaaatggattttgcctctttgggaatgatatgtggtggttctatgtataattcagatacagatgaggatgaagaaactgagccttcttcttctgggcaacagataattgaaaattcaataactatgaataagatgaagctgctgaaggctaagatgaagaacatgaatctcagcaaaaaggtgaagctgttggcatttgaccaggcttatctctagcttacccctgcagagcactcagcaatgaggtctgttggtcattgtgaaaaaattataaagtattattcatttca

SEQ ID NO: 204218 - DNA, 689 bp, Homo sapiens
  Payload ID: 20275
  Gene Name: zinc finger, AN1-type domain 4
  ENST ID: ENST00000495747
  CDS Start-End: 144-425
gcaggtgactcggtggcctcaagtgtgtacaaaactcaaaacatgaacaacaatatatattaccaatcttcaaacctggtttgcctagaactggaatacagttgcctgcgacatattttagaagaactagaaaagtcaaagtaatggataacagaaaagagcctccattcttcaatgatgataacatgggaccattttactacagacttcatttctgtgataccatggagctcttcattgaaacattaactggaacatgttttgagctgagagtttcaccttttgaaactgttatttctgtgaaagcaaaaattcgaagattggaagacccaggagatcctactgaagtgagtggctggccgagtccagtgaccacatcagcacattcagtaatgactcttgaagcttttgtctgccctaaatgatttggtattcccatctgtcgacaacacttaatttggaataacatggaacttgaaaatgattattgcttgaatgattacaacatttcagaagggtgtaccttgaagctagttttggctatgcgtggcggacctataaatactagaagagttcctacagacgatccacttaggaagatggcagagtacttggattccagtcgagttgaggtctgggagaagacctcctgcagcaaacaagttacatttttggtataccaagaagga

SEQ ID NO: 204219 - DNA, 5310 bp, Homo sapiens
  Payload ID: 20276
  Gene Name: zinc finger, AN1-type domain 5
  Uniprot ID: O76080
  ENST ID: ENST00000237937
  CDS Start-End: 141-782
aggccgcggatggcggcgtccgggggaggggagcccgcccgccagcccaggaagcacaaagacggaggcgtcatcctgtcgtcgtggcccgagacctggctcccggcgtccctggctcgctccacagcacgcagaaaaatatggctcaggagactaaccagaccccggggcccatgctgtgtagcacaggatgtggcttttatggaaatcctaggacaaatggaatgtgttcagtttgctacaaagaacatcttcagaggcagcaaaatagtggcagaatgagcccaatgggaacagctagtggttccaacagtcctacctcagattctgcatctgtacagagagcagacactagcttaaacaactgtgaaggtgctgctggcagcacatctgaaaaatcaagaaatgtgcctgtggctgccttgcctgtaactcagcaaatgacagaaatgagcatttcaagagaggacaaaataactaccccgaaaacagaggtgtcagagccagttgtcactcagcccagtccatcagtttctcagcccagtacttctcagagtgaagaaaaagctcctgaattgcccaaaccaaagaaaaacagatgtttcatgtgcagaaagaaagttggtcttacagggtttgactgccgatgtggaaatttgttttgtggacttcaccgttactctgacaagcacaactgtccgtatgattacaaagcagaagctgcagcaaaaatcagaaaagagaatccagttgttgtggctgaaaaaattcagagaatataaattacttcttgtgaagagactgaaactttgtttttattttaatatatcgtaggaaaacattaaagagcagatgcatggccatttttctttgatgttctccagagttttacattacacttgtctgtcttataattgatattttaggatgtttgggtgtttgttacaggcagaattggatagatacagccctacaaatgtatatgccctcccctgaaaaaaattggatgaaaatctgcacagcaaagtgaaacacacagataataggaacaaaatgtagttcccatgtgccaaacaaaataaatgaaatctctgcatgtttgcagcatatctgccttttgggaatgtaatcaaggtataatctttggctagtgttatgtgcctgtatttttttaaaatggtacaccagaaaaggactggcagtctacttctaccatagttaaacttcaccctctttaatttcacaacatattctttggaagcaggaagaaatgctcataaagaggatcagaccttctttcccgtgaaaccagtatttggcgccatatataagcctggttaaattggtcatctaaagctgtcaaataagacattctgtgaaaggtaaacatcgaaactggttataagtaaaaccatcaagccaacaacagggtcttgagataacctttgaagcttattgtactggcctgcaccagaagatgtctgcattactcattgctaaaaatgtgtagcacagaactgcactaggattaatttgtttacaagaagaaatttaaactctacgtttggttttcacatacagcagctctattgaataacatgcatctgaattttaagttgcaaaggtatctgaataatttttcatgtgcatcttttgtcgaatgttttggttcaagaaagaatgtttaaagctttttaaaagacttcagttcttaatgtaactgtacccttctgcatggaaaatcataaccaacatggctgcagtagacttcttagtggtatccagcaccacttgcagagggctgctttatcatattgtacttgggtgtaggactctagtgttcttgggtgtattgcatgggctgcattatctacagcattgtacaataacaactagaaaaggcagtatacttcactgatgcttgtctggtaataatcacttctgtgttataatggaaggttttttgtgatgtatgaaacttgtgttttttatatataaatgagtatagttagtgttgtggtaatgcctgttttcatctgtaaatagttaagtatgtacacgaggcactacttctgatttattgcaatgttcagtcctagtttttacttttattcttaaagcattcagttttgctttcaattttatgtaccttagttctgagttagacctgcagatgtgtacagatagttcatatttatgtattgcacataatcatgctattcagcattgatgctatattgtattatgtaaataataaaagccatgtacagagggaaacttcacttgttcattgggtttttaagccatagttggagtcctaaagggggaaaattagaaaatgttactttacatggctatataattttttttcctttgccatcgctgaacttgttcaagtgataatcaagagatattagaagcatttgcaggtatgatacctgataggcagtttatttttgaagaattcaataggcacctttgggattaaaacaattttaaaatttgagaaagatgaaatttgaacaattatggcctacctcgcttctccatgttgtaaaagatgatgttttatgacaattctgaagaagaaagtaggtatgacttagtttacaaaaagagttctgttttatttctgttttgggtttggctctaatacagagattcacccatggacttggtctctgtagcgtttatgccagatcataaagaacaaggggtgacaggtacatgttgactttacctggggtaaatgattaccagagtgcaactgttgcttctctgtgatggagtttggggtggaaataccctagttttatctgtcagttctttgcatgctgctacttttgcttcaagttagggaggtacatatgtatgtcaaagttcctatactgacatagggtagtatttctctgaatatgaaaagtcacaattgagttgaaaatttagaagttgaagatttagaagggcaacttaatttttcaagttaaaaatggaagtaagagtggtatagagaaggtaagatgagccctcggactccatcactctgaaggtctgagtagtagcaagagatagatttttgtttggccaggctgcagtgcaatggcgtaatcttggctcactgcaacctctgcctcctgggttcaagtgattctcctgcctctgcctcctaagtagctgggatcacaggcaccagccaccacgcccagctaatttttgtatttttaatagagacagtttctccatgttggtcaggctggtcttgaactcctgacctcaggtgagctgcccgcctcggcctcccaaagtgctgggattacaggcgtgaggcaccgcacccggccaatcagttttttttgttttttttttgtttgtttgttttacaagaaacattaaaccagatcagaacaaagatttgtcagggttgtccattgactggggagaaagggaatcagtgtgtaaggcacctgagaggactcagttctacccaaattcttgcattcaaacctgaatgcaaggccatgaagtcctttgaaatgtacagatattaagcaatttaataatataccatgtttcccttacataagcagacaaatatttacacccccatgacctgaagttttgttaggctgtgaccacatgaattcgcagtataaatgggtgagtcctttttgaaaacctcatcttcagtgtgcctgatctgtaaaactagagcctcaggtttgatcctaggtaggcttcccacaacgtggggaaaattagtttgtgagggaaagctgtttctgagcattatggcatagtgattaagatgagggaccctggaaccagcccgtgattttgggcaagttattttaggtccactttggactgcttcatctcttaaatgaagacagcaaccaccttcaggagtgtgaaggtgacaacacttaaaactgtgcctggcacattgtatttgctattgtcttaatgttctggaataatggtttccataacttgggaagaaaactttgagaacaggattggttacatcaagttgtatagtgaaaagataaagatttgttatttaaacttgcagtttaaagtcattagaatcattcttttccgtaaggctttctttgcaagagatctgcattaaataaagttgctaggaaataactaaaattggggaaataatctaataatagcaagatgttaagcatactattattgtattttgggggttggtaataacattcacatggatttatcaatacacactgagaagcaaagcctctcaagctgtcccatatcctccatttcaaaggcacacatacattttaggtaactcataatttagaaaggttatttaatcttttccacatgtaaatatttgaatatgtacaaagacttgatttgactcttgtctgtttttgttttgttttgtttgtttgagacagaggctccgtcgcccaggctggagtaaaatggcatggtctcagctcactgcaagttccgcctcccgggttcacgccattctcctggctcagcctccggagtagttgggactacaggcacccgtcaccacacctggctaatgttttttgttttttgggtttttttgtatttttagtagagagagggtttcaccgtgttagccagggtggtctcgatctcctgacctcatgatccgcccaccccggcctcccaaaatgctgggattacaggtgtgagccactgcgcctggccgactcttgtctgtttgaatgcaaagttctcaatagtggtttttgtccataagtattaacttataattttggagagtgataggtatggttgctggttgattagcaataagattatgtagccttaaactagctagaagagtttgcatgggtgaggcaacaggctgttaacaaaaagaaactggaaatacagtttcccctgtttgtttctcctgtttgtacaatctgctttaaaaacaagtgaacatgcaccatgtcagtcatggtgaatcggccaacagccagcccttgccagttgacatcacagtctaagatgggaaactggtacagatagacatgaagagagcttagcagtggttgaggtggtgactaaatatacagtcattgaataaataccgtgtagcaaatgtaaaaaaaaaaaaaaaagtacaacagaatacaaaagtgccatttaatattttatagctatttctatgcacaagtgctggttttaaatttatataaaagcaaagactgtttctgtgttttcttccagagtatttctgttacagccatagaagtaaagttaataaatgtaagactttttttgttt

SEQ ID NO: 204220 - DNA, 1073 bp, Homo sapiens
  Payload ID: 20276
  Gene Name: zinc finger, AN1-type domain 5
  Uniprot ID: O76080
  ENST ID: ENST00000343431
  CDS Start-End: 312-953
ccggggcgccgcgggccaatggcgaagccggagcaggccgcggatggcggcgtccgggggaggggagcccgcccgccagcccaggaagcacaaagacggaggcgtcatcctgtcgtcgtggcccgagacctggctcccggcgtccctggctcgctccacagcacggccctgaaaaggagcctttaaaagtcaattctactccatttggcaaagagggaactgaaatctggaaagtaaggacttgcccaaggtcactgacttagtggcagactagagacttgaactcaggtctccattcccagcagaaaaatatggctcaggagactaaccagaccccggggcccatgctgtgtagcacaggatgtggcttttatggaaatcctaggacaaatggaatgtgttcagtttgctacaaagaacatcttcagaggcagcaaaatagtggcagaatgagcccaatgggaacagctagtggttccaacagtcctacctcagattctgcatctgtacagagagcagacactagcttaaacaactgtgaaggtgctgctggcagcacatctgaaaaatcaagaaatgtgcctgtggctgccttgcctgtaactcagcaaatgacagaaatgagcatttcaagagaggacaaaataactaccccgaaaacagaggtgtcagagccagttgtcactcagcccagtccatcagtttctcagcccagtacttctcagagtgaagaaaaagctcctgaattgcccaaaccaaagaaaaacagatgtttcatgtgcagaaagaaagttggtcttacagggtttgactgccgatgtggaaatttgttttgtggacttcaccgttactctgacaagcacaactgtccgtatgattacaaagcagaagctgcagcaaaaatcagaaaagagaatccagttgttgtggctgaaaaaattcagagaatataaattacttcttgtgaagagactgaaactttgtttttattttaatatatcgtaggaaaacattaaagagcagatgcatggccatttttctttgatgttctccagagttttacattacacttg

SEQ ID NO: 204221 - DNA, 690 bp, Homo sapiens
  Payload ID: 20276
  Gene Name: zinc finger, AN1-type domain 5
  ENST ID: ENST00000376956
  CDS Start-End: 57-690
ggctccttgttgccgggccgggggcgggagtgaagggaccggggcgccgcgggccaatggcgaagccggagcaggccgcggatggcggcgtccgggggaggggagcccgcccgccagcccaggaagcacaaagacggaggcgtcatcctgtcgtcgtggcccgagacctggctcccggcgtccctggctcgctccacagcacgcagaaaaatatggctcaggagactaaccagaccccggggcccatgctgtgtagcacaggatgtggcttttatggaaatcctaggacaaatggaatgtgttcagtttgctacaaagaacatcttcagaggcagcaaaatagtggcagaatgagcccaatgggaacagctagtggttccaacagtcctacctcagattctgcatctgtacagagagcagacactagcttaaacaactgtgaaggtgctgctggcagcacatctgaaaaatcaagaaatgtgcctgtggctgccttgcctgtaactcagcaaatgacagaaatgagcatttcaagagaggacaaaataactaccccgaaaacagaggtgtcagagccagttgtcactcagcccagtccatcagtttctcagcccagtacttctcagagtgaagaaaaagctcctgaattgcccaaaccaaagaaaaacagatgtttcatgtgcagaaaga

SEQ ID NO: 204222 - DNA, 2686 bp, Homo sapiens
  Payload ID: 20276
  Gene Name: zinc finger, AN1-type domain 5
  Uniprot ID: O76080
  ENST ID: ENST00000376960
  CDS Start-End: 550-1191
acagcccgggcgccgggcggcgagtgcgttagtcggccgggacgcggagctgtgtgcatctcctacgcgggctcgctcgctcccgggagccgcgcagcttccccggcggtggcaggagcggcgaagagcgccatcagcgggcccttacggccccaggcctcgcggcgcgcggtccgctcgccctcctcgtccgcccaacctgcggcctgtggaggcgtgaggcgacgacaggcgagcgcctcgagcagcgttagccgctgcggccgccggtcctccctccacctcctcctcggccccccctcgcttccctcctcccacttcccgagctccggcgtgtcccggccacgctcgacgctgctgcaggaacaaaggaagaccccgcggcggcggcggcgccacctccgcctgctgctccgacccgctcccggcccgcggcggcggcaccagggcgcccggctcagccttcccggaggcctcggcccggcctcatcgtgccggcttcgcgcgcgaacccggctttcgcatttgggaccctgcaggcagaaaaatatggctcaggagactaaccagaccccggggcccatgctgtgtagcacaggatgtggcttttatggaaatcctaggacaaatggaatgtgttcagtttgctacaaagaacatcttcagaggcagcaaaatagtggcagaatgagcccaatgggaacagctagtggttccaacagtcctacctcagattctgcatctgtacagagagcagacactagcttaaacaactgtgaaggtgctgctggcagcacatctgaaaaatcaagaaatgtgcctgtggctgccttgcctgtaactcagcaaatgacagaaatgagcatttcaagagaggacaaaataactaccccgaaaacagaggtgtcagagccagttgtcactcagcccagtccatcagtttctcagcccagtacttctcagagtgaagaaaaagctcctgaattgcccaaaccaaagaaaaacagatgtttcatgtgcagaaagaaagttggtcttacagggtttgactgccgatgtggaaatttgttttgtggacttcaccgttactctgacaagcacaactgtccgtatgattacaaagcagaagctgcagcaaaaatcagaaaagagaatccagttgttgtggctgaaaaaattcagagaatataaattacttcttgtgaagagactgaaactttgtttttattttaatatatcgtaggaaaacattaaagagcagatgcatggccatttttctttgatgttctccagagttttacattacacttgtctgtcttataattgatattttaggatgtttgggtgtttgttacaggcagaattggatagatacagccctacaaatgtatatgccctcccctgaaaaaaattggatgaaaatctgcacagcaaagtgaaacacacagataataggaacaaaatgtagttcccatgtgccaaacaaaataaatgaaatctctgcatgtttgcagcatatctgccttttgggaatgtaatcaaggtataatctttggctagtgttatgtgcctgtatttttttaaaatggtacaccagaaaaggactggcagtctacttctaccatagttaaacttcaccctctttaatttcacaacatattctttggaagcaggaagaaatgctcataaagaggatcagaccttctttcccgtgaaaccagtatttggcgccatatataagcctggttaaattggtcatctaaagctgtcaaataagacattctgtgaaaggtaaacatcgaaactggttataagtaaaaccatcaagccaacaacagggtcttgagataacctttgaagcttattgtactggcctgcaccagaagatgtctgcattactcattgctaaaaatgtgtagcacagaactgcactaggattaatttgtttacaagaagaaatttaaactctacgtttggttttcacatacagcagctctattgaataacatgcatctgaattttaagttgcaaaggtatctgaataatttttcatgtgcatcttttgtcgaatgttttggttcaagaaagaatgtttaaagctttttaaaagacttcagttcttaatgtaactgtacccttctgcatggaaaatcataaccaacatggctgcagtagacttcttagtggtatccagcaccacttgcagagggctgctttatcatattgtacttgggtgtaggactctagtgttcttgggtgtattgcatgggctgcattatctacagcattgtacaataacaactagaaaaggcagtatacttcactgatgcttgtctggtaataatcacttctgtgttataatggaaggttttttgtgatgtatgaaacttgtgttttttatatataaatgagtatagttagtgttgtggtaatgcctgttttcatctgtaaatagttaagtatgtacacgaggcactacttctgatttattgcaatgttcagtcctagtttttacttttattcttaaagcattcagttttgctttcaattttatgtaccttagttctgagttagacctgcagatgtgtacagatagttcatatttatgtattgcacataatcatgctattcagcattgatgctatattgtattatgtaaataataaaagccatgtacagagggaaa

SEQ ID NO: 204223 - DNA, 2785 bp, Homo sapiens
  Payload ID: 20276
  Gene Name: zinc finger, AN1-type domain 5
  Uniprot ID: O76080
  ENST ID: ENST00000376962
  CDS Start-End: 649-1290
gggacgcggagctgtgtgcatctcctacgcgggctcgctcgctcccgggagccgcgcagcttccccggcggtggcaggagcggcgaagagcgccatcagcgggcccttacggccccaggcctcgcggcgcgcggtccgctcgccctcctcgtccgcccaacctgcggcctgtggaggcgtgaggcgacgacaggcgagcgcctcgagcagcgttagccgctgcggccgccggtcctccctccacctcctcctcggccccccctcgcttccctcctcccacttcccgagctccggcgtgtcccggccacgctcgacgctgctgcaggaacaaaggaagaccccgcggcggcggcggcgccacctccgcctgctgctccgacccgctcccggcccgcggcggcggcaccagggcgcccggctcagccttcccggaggcctcggcccggcctcatcgtgccggcttcgcgcgcgaacccggctttcgcatttgggaccctgcagggccctgaaaaggagcctttaaaagtcaattctactccatttggcaaagagggaactgaaatctggaaagtaaggacttgcccaaggtcactgacttagtggcagactagagacttgaactcaggtctccattcccagcagaaaaatatggctcaggagactaaccagaccccggggcccatgctgtgtagcacaggatgtggcttttatggaaatcctaggacaaatggaatgtgttcagtttgctacaaagaacatcttcagaggcagcaaaatagtggcagaatgagcccaatgggaacagctagtggttccaacagtcctacctcagattctgcatctgtacagagagcagacactagcttaaacaactgtgaaggtgctgctggcagcacatctgaaaaatcaagaaatgtgcctgtggctgccttgcctgtaactcagcaaatgacagaaatgagcatttcaagagaggacaaaataactaccccgaaaacagaggtgtcagagccagttgtcactcagcccagtccatcagtttctcagcccagtacttctcagagtgaagaaaaagctcctgaattgcccaaaccaaagaaaaacagatgtttcatgtgcagaaagaaagttggtcttacagggtttgactgccgatgtggaaatttgttttgtggacttcaccgttactctgacaagcacaactgtccgtatgattacaaagcagaagctgcagcaaaaatcagaaaagagaatccagttgttgtggctgaaaaaattcagagaatataaattacttcttgtgaagagactgaaactttgtttttattttaatatatcgtaggaaaacattaaagagcagatgcatggccatttttctttgatgttctccagagttttacattacacttgtctgtcttataattgatattttaggatgtttgggtgtttgttacaggcagaattggatagatacagccctacaaatgtatatgccctcccctgaaaaaaattggatgaaaatctgcacagcaaagtgaaacacacagataataggaacaaaatgtagttcccatgtgccaaacaaaataaatgaaatctctgcatgtttgcagcatatctgccttttgggaatgtaatcaaggtataatctttggctagtgttatgtgcctgtatttttttaaaatggtacaccagaaaaggactggcagtctacttctaccatagttaaacttcaccctctttaatttcacaacatattctttggaagcaggaagaaatgctcataaagaggatcagaccttctttcccgtgaaaccagtatttggcgccatatataagcctggttaaattggtcatctaaagctgtcaaataagacattctgtgaaaggtaaacatcgaaactggttataagtaaaaccatcaagccaacaacagggtcttgagataacctttgaagcttattgtactggcctgcaccagaagatgtctgcattactcattgctaaaaatgtgtagcacagaactgcactaggattaatttgtttacaagaagaaatttaaactctacgtttggttttcacatacagcagctctattgaataacatgcatctgaattttaagttgcaaaggtatctgaataatttttcatgtgcatcttttgtcgaatgttttggttcaagaaagaatgtttaaagctttttaaaagacttcagttcttaatgtaactgtacccttctgcatggaaaatcataaccaacatggctgcagtagacttcttagtggtatccagcaccacttgcagagggctgctttatcatattgtacttgggtgtaggactctagtgttcttgggtgtattgcatgggctgcattatctacagcattgtacaataacaactagaaaaggcagtatacttcactgatgcttgtctggtaataatcacttctgtgttataatggaaggttttttgtgatgtatgaaacttgtgttttttatatataaatgagtatagttagtgttgtggtaatgcctgttttcatctgtaaatagttaagtatgtacacgaggcactacttctgatttattgcaatgttcagtcctagtttttacttttattcttaaagcattcagttttgctttcaattttatgtaccttagttctgagttagacctgcagatgtgtacagatagttcatatttatgtattgcacataatcatgctattcagcattgatgctatattgtattatgtaaataataaaagccatgtacagagggaaa

SEQ ID NO: 204224 - DNA, 1814 bp, Homo sapiens
  Payload ID: 20277
  Gene Name: zinc finger, AN1-type domain 6
  Uniprot ID: Q6FIF0
  ENST ID: ENST00000261749
  CDS Start-End: 423-1049
aataattagcgggcgggcggggcccgcgcgtcagccgcgggagccggccaatccagtggctctcctccgcggtcgcgtcataggccgaacaaccaaacagaaaagtttaataaacagcggacggaggggccggcggtggcggagccggagcaagcaggggttcggcggcattacctgtacccattcaccggcggctaccggcggcggcgcgcagcgtgtcaggcggagagacccgccgccaggaatgaatctgaagtctgctgcagtaaaacacagaaggctttaaaatgttttcttgcataaaattcaaaacttttaagtagctgcttatgagaatagggaaggcagaaagctaatgtctgtctcaagatacaggacagctgtttgctcatcaacctcaactgtgtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggcttcagtatcagacacagcacagcagccatctgaagagcaaagcaagtctcttgaaaaaccgaaacaaaaaaagaatcgctgtttcatgtgcaggaagaaagtgggacttactgggtttgaatgccggtgtggaaatgtttactgtggtgtacaccgttactcagatgtacacaattgctcttacaattacaaagccgatgctgctgagaaaatcagaaaagaaaatccagtagttgttggtgaaaagatccaaaagatttgaactcctgctggaatacaaaattcttgagcatctgcaaactaaaaattgacttgaggttttttttttcctagtcattgggaatgtagagcagtgtatcttgcatgtcatcggaagaatagatttttgttttggttttgttttgaaaatgactctgaacatttatttccattgcaatttctgtggctgaggagacttaaactttacaagtattatccttttaagatcattttaattttagttgagtgcagagggcttttataacaaacgtgcagaaattttggagggctgtgatttttccagtattaaacatgcatgcattaatcttgcagtttattttctcattgtgtatgtatatatcgcttttctctgcagcacgatttctcttttgataatgccctttagggcacaactagttatcagtaactgaatgtatcttaatcattatggctgcttctgttttttcattaacaaaggttattcatatgttagcatatagtttctttgcacccactatttatgtctgaatcatttgtcacaagagagtgtgtgctgatgagattgtaagtttgtgtgtttaaacttttttttgagcgagggaagaaaaagctgtatgcatttcattgctgtctacaggtttctttcagattatgttcatgggtttgtgtgtatacaatatgaagaatgatctgaagtaattgtgctgtatttatgtttattcaccagtctttgattaaataaaaaggaaaaccagaatgctcccttgta

SEQ ID NO: 204225 - DNA, 621 bp, Homo sapiens
  Payload ID: 20277
  Gene Name: zinc finger, AN1-type domain 6
  ENST ID: ENST00000558724
  CDS Start-End: 98-621
gaagagagaaatttaaaattaaaaattttccatatttctatcacaaatattggtaatttgacaacatgtaatttgattgtcgtcttaataaaatttaatgttattgctaccaaatagagataaaggtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggcttcagtatcagacacagcacagcagccatctgaagagcaaagcaagtctcttgaaaaaccgaaacaaaaaaagaatcgctgtttcatgtgcaggaagaaagtgggacttactgg

SEQ ID NO: 204226 - DNA, 780 bp, Homo sapiens
  Payload ID: 20277
  Gene Name: zinc finger, AN1-type domain 6
  ENST ID: ENST00000558688
  CDS Start-End: 79-612
tacagcttcaagtgaagttaatctgaggtgaagcaaacagaaaattgtggaggttttgttggtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggcttcagtatcagacacagcacagcagccatctgaagagcaaagcaagtctcttgaaaaaccgaaacaaaaaaagaatcgctgtttcatgtgcaggaagaaagtgggacttactggtaaggacctaaatcaaatgtttaaaattaaaatgatgttttataataatgcatagcttactgttgttgacttcaattaagattgttcctgttcccttgagagttaatattggatatacttcaccttctgaattttcttaaggaaataaaaatagctttgattatacacctaaaagtgaaatgaatagcttttttaaaaaaagttttatttcagttgaatttag

SEQ ID NO: 204227 - DNA, 891 bp, Homo sapiens
  Payload ID: 20277
  Gene Name: zinc finger, AN1-type domain 6
  Uniprot ID: Q6FIF0
  ENST ID: ENST00000561060
  CDS Start-End: 215-841
ggccaatccagtggctctcctccgcggtcgcgtcataggccgaacaaccaaacagaaaagtttaataaacagcggacggaggggccggcggtggcggagccggagcaagcaggggttcggcggcattacctgtacccattcaccggcggctaccggcggcggcgcgcagcgtgtcaggcggagagacccgccgccaggtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggcttcagtatcagacacagcacagcagccatctgaagagcaaagcaagtctcttgaaaaaccgaaacaaaaaaagaatcgctgtttcatgtgcaggaagaaagtgggacttactgggtttgaatgccggtgtggaaatgtttactgtggtgtacaccgttactcagatgtacacaattgctcttacaattacaaagccgatgctgctgagaaaatcagaaaagaaaatccagtagttgttggtgaaaagatccaaaagatttgaactcctgctggaatacaaaattcttgagcatctgcaaactaaaaattgac

SEQ ID NO: 204228 - DNA, 1446 bp, Homo sapiens
  Payload ID: 20277
  Gene Name: zinc finger, AN1-type domain 6
  Uniprot ID: Q6FIF0
  ENST ID: ENST00000559835
  CDS Start-End: 88-714
gctttggagtacagcttcaagtgaagttaatctgaggtgaagcaaacagaaaattgtggaggttttgttggtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggcttcagtatcagacacagcacagcagccatctgaagagcaaagcaagtctcttgaaaaaccgaaacaaaaaaagaatcgctgtttcatgtgcaggaagaaagtgggacttactgggtttgaatgccggtgtggaaatgtttactgtggtgtacaccgttactcagatgtacacaattgctcttacaattacaaagccgatgctgctgagaaaatcagaaaagaaaatccagtagttgttggtgaaaagatccaaaagatttgaactcctgctggaatacaaaattcttgagcatctgcaaactaaaaattgacttgaggttttttttttcctagtcattgggaatgtagagcagtgtatcttgcatgtcatcggaagaatagatttttgttttggttttgttttgaaaatgactctgaacatttatttccattgcaatttctgtggctgaggagacttaaactttacaagtattatccttttaagatcattttaattttagttgagtgcagagggcttttataacaaacgtgcagaaattttggagggctgtgatttttccagtattaaacatgcatgcattaatcttgcagtttattttctcattgtgtatgtatatatcgcttttctctgcagcacgatttctcttttgataatgccctttagggcacaactagttatcagtaactgaatgtatcttaatcattatggctgcttctgttttttcattaacaaaggttattcatatgttagcatatagtttctttgcacccactatttatgtctgaatcatttgtcacaagagagtgtgtgctgatgagattgtaagtttgtgtgtttaaacttttttttgagcgagggaagaaaaagctgtatgcatttcattgctgtctacaggtttctttcagattatgttcatgggtttgtgtgtatacaatatgaagaatgatctgaagtaattgtgctgtatttatgtttattcaccagtctttgatt

SEQ ID NO: 204229 - DNA, 566 bp, Homo sapiens
  Payload ID: 20277
  Gene Name: zinc finger, AN1-type domain 6
  ENST ID: ENST00000558390
  CDS Start-End: 93-566
agcttcaagtgaagttaatctgaggtgaagcaaacagaaaattgtggaggttttgttggtggagataagtaattaacatttcgaaacaggaaatgaaaggatttatatttttaaaagctataggtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggcttcagtatcagacacagcacagcagccatctgaagagcaaagcaagtctcttgaaaaaccg

SEQ ID NO: 204230 - DNA, 741 bp, Homo sapiens
  Payload ID: 20277
  Gene Name: zinc finger, AN1-type domain 6
  ENST ID: ENST00000558997
  CDS Start-End: 263-741
cagatactttggtgttgaacatttgggatagaagagagaaatttaaaattaaaaattttccatatttctatcacaaatattggaatgaatctgaagtctgctgcagtaaaacacagaaggctttaaaatgttttcttgcataaaattcaaaacttttaagtagctgcttatgagaatagggaaggcagaaagctaatgtctgtctcaagatacaggacagctgtttgctcatcaacctcaactgtgtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggcttcagtatcagacacagcacagcagccatctgaagagcaaagcaagtctcttgaaaaaccgaaacaaaaaaagaatcgctgtttcatgtgcaggaagaaagtgggacttactgg

SEQ ID NO: 204231 - DNA, 585 bp, Homo sapiens
  Payload ID: 20277
  Gene Name: zinc finger, AN1-type domain 6
  ENST ID: ENST00000561012
  CDS Start-End: 370-585
aataaacagcggacggaggggccggcggtggcggagccggagcaagcaggggttcggcggcattacctgtacccattcaccggcggctaccggcggcggcgcgcagcgtgtcaggcggagagacccgccgccaggaatgaatctgaagtctgctgcagtaaaacacagaaggctttaaaatgttttcttgcataaaattcaaaacttttaagtagctgcttatgagaatagggaaggcagaaagctaatgtctgtctcaagatacaggacagctgtttgctcatcaacctcaactgtgtttcacatcctgggaatactgtattttcaatctgaggttggtggagtcgccggtagccacctaagataggaatgtcaatcagaagttttctagaatctatcttcagatgcaaacaatacagtggcctcttgttggagatccaaaggctcagaactcggaattactgtatgcaacaggaaacactaatctcaagcacctatgccaagttaggtgtgcaactgaggaacatggctcaagaaactaatcacagccaagtgcctatgctttgttccactggctgtggattt

SEQ ID NO: 204232 - DNA, 1602 bp, Homo sapiens
  Payload ID: 20277
  Gene Name: zinc finger, AN1-type domain 6
  Uniprot ID: Q6FIF0
  ENST ID: ENST00000559775
  CDS Start-End: 246-872
ggagtacagcttcaagtgaagttaatctgaggtgaagcaaacagaaaattgtggaggttttgttggaatgaatctgaagtctgctgcagtaaaacacagaaggctttaaaatgttttcttgcataaaattcaaaacttttaagtagctgcttatgagaatagggaaggcagaaagctaatgtctgtctcaagatacaggacagctgtttgctcatcaacctcaactgtgtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggcttcagtatcagacacagcacagcagccatctgaagagcaaagcaagtctcttgaaaaaccgaaacaaaaaaagaatcgctgtttcatgtgcaggaagaaagtgggacttactgggtttgaatgccggtgtggaaatgtttactgtggtgtacaccgttactcagatgtacacaattgctcttacaattacaaagccgatgctgctgagaaaatcagaaaagaaaatccagtagttgttggtgaaaagatccaaaagatttgaactcctgctggaatacaaaattcttgagcatctgcaaactaaaaattgacttgaggttttttttttcctagtcattgggaatgtagagcagtgtatcttgcatgtcatcggaagaatagatttttgttttggttttgttttgaaaatgactctgaacatttatttccattgcaatttctgtggctgaggagacttaaactttacaagtattatccttttaagatcattttaattttagttgagtgcagagggcttttataacaaacgtgcagaaattttggagggctgtgatttttccagtattaaacatgcatgcattaatcttgcagtttattttctcattgtgtatgtatatatcgcttttctctgcagcacgatttctcttttgataatgccctttagggcacaactagttatcagtaactgaatgtatcttaatcattatggctgcttctgttttttcattaacaaaggttattcatatgttagcatatagtttctttgcacccactatttatgtctgaatcatttgtcacaagagagtgtgtgctgatgagattgtaagtttgtgtgtttaaacttttttttgagcgagggaagaaaaagctgtatgcatttcattgctgtctacaggtttctttcagattatgttcatgggtttgtgtgtatacaatatgaagaatgatctgaagtaattgtgctgtatttatgtttattcaccagtctttga

SEQ ID NO: 204233 - DNA, 560 bp, Homo sapiens
  Payload ID: 20277
  Gene Name: zinc finger, AN1-type domain 6
  ENST ID: ENST00000560976
  CDS Start-End: 95-560
acagcttcaagtgaagttaatctgaggtgaagcaaacagaaaattgtggaggttttgttggtggagataagtaattaacatttcgaaacaggaaatgaaaggatttatatttttaaaagctataggtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggcttcagtatcagacacagcacagcagccatctgaagagcaaagcaagtctcttg

SEQ ID NO: 204234 - DNA, 909 bp, Homo sapiens
  Payload ID: 20277
  Gene Name: zinc finger, AN1-type domain 6
  Uniprot ID: Q6FIF0
  ENST ID: ENST00000558087
  CDS Start-End: 100-726
cagatactttggtgttgaacatttgggatagaagagagaaatttaaaattaaaaattttccatatttctatcacaaatattggtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggcttcagtatcagacacagcacagcagccatctgaagagcaaagcaagtctcttgaaaaaccgaaacaaaaaaagaatcgctgtttcatgtgcaggaagaaagtgggacttactgggtttgaatgccggtgtggaaatgtttactgtggtgtacaccgttactcagatgtacacaattgctcttacaattacaaagccgatgctgctgagaaaatcagaaaagaaaatccagtagttgttggtgaaaagatccaaaagatttgaactcctgctggaatacaaaattcttgagcatctgcaaactaaaaattgacttgaggttttttttttcctagtcattgggaatgtagagcagtgtatcttgcatgtcatcggaagaatagatttttgttttggttttgttttgaaaatgactctgaacatttatttccattgcaatttctgtgg

SEQ ID NO: 204235 - DNA, 1472 bp, Homo sapiens
  Payload ID: 20277
  Gene Name: zinc finger, AN1-type domain 6
  Uniprot ID: Q6FIF0
  ENST ID: ENST00000558494
  CDS Start-End: 114-740
ggagcaagcaggggttcggcggcattacctgtacccattcaccggcggctaccggcggcggcgcgcagcgtgtcaggcggagagacccgccgccaggtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggcttcagtatcagacacagcacagcagccatctgaagagcaaagcaagtctcttgaaaaaccgaaacaaaaaaagaatcgctgtttcatgtgcaggaagaaagtgggacttactgggtttgaatgccggtgtggaaatgtttactgtggtgtacaccgttactcagatgtacacaattgctcttacaattacaaagccgatgctgctgagaaaatcagaaaagaaaatccagtagttgttggtgaaaagatccaaaagatttgaactcctgctggaatacaaaattcttgagcatctgcaaactaaaaattgacttgaggttttttttttcctagtcattgggaatgtagagcagtgtatcttgcatgtcatcggaagaatagatttttgttttggttttgttttgaaaatgactctgaacatttatttccattgcaatttctgtggctgaggagacttaaactttacaagtattatccttttaagatcattttaattttagttgagtgcagagggcttttataacaaacgtgcagaaattttggagggctgtgatttttccagtattaaacatgcatgcattaatcttgcagtttattttctcattgtgtatgtatatatcgcttttctctgcagcacgatttctcttttgataatgccctttagggcacaactagttatcagtaactgaatgtatcttaatcattatggctgcttctgttttttcattaacaaaggttattcatatgttagcatatagtttctttgcacccactatttatgtctgaatcatttgtcacaagagagtgtgtgctgatgagattgtaagtttgtgtgtttaaacttttttttgagcgagggaagaaaaagctgtatgcatttcattgctgtctacaggtttctttcagattatgttcatgggtttgtgtgtatacaatatgaagaatgatctgaagtaattgtgctgtatttatgtttattcaccagtctttgatt

SEQ ID NO: 204236 - DNA, 1559 bp, Homo sapiens
  Payload ID: 20277
  Gene Name: zinc finger, AN1-type domain 6
  Uniprot ID: Q6FIF0
  ENST ID: ENST00000559157
  CDS Start-End: 237-827
cgcggtcgcgtcataggccgaacaaccaaacagaaaagtttaataaacagcggacggaggggccggcggtggcggagccggagcaagcaggggttcggcggcattacctgtacccattcaccggcggctaccggcggcggcgcgcagcgtgtcaggcggagagacccgccgccagatcaaaagacactgacttagctgcttaccagaaggggaacttgggtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggcttcagtatcagacacagcacagcagccatctgaagagcaaagcaagtctcttgaaaaaccgaaacaaaaaaagaatcgctgtttcatgtgcaggaagaaagtgggacttactgggtttgaatgccggtgtggaaatgtttactgtggtgtacaccgttactcagatgtacacaattgctcttacaattacaaagccgatgctgctgagaaaatcagaaaagaaaatccagtagttgttggtgaaaagatccaaaagatttgaactcctgctggaatacaaaattcttgagcatctgcaaactaaaaattgacttgaggttttttttttcctagtcattgggaatgtagagcagtgtatcttgcatgtcatcggaagaatagatttttgttttggttttgttttgaaaatgactctgaacatttatttccattgcaatttctgtggctgaggagacttaaactttacaagtattatccttttaagatcattttaattttagttgagtgcagagggcttttataacaaacgtgcagaaattttggagggctgtgatttttccagtattaaacatgcatgcattaatcttgcagtttattttctcattgtgtatgtatatatcgcttttctctgcagcacgatttctcttttgataatgccctttagggcacaactagttatcagtaactgaatgtatcttaatcattatggctgcttctgttttttcattaacaaaggttattcatatgttagcatatagtttctttgcacccactatttatgtctgaatcatttgtcacaagagagtgtgtgctgatgagattgtaagtttgtgtgtttaaacttttttttgagcgagggaagaaaaagctgtatgcatttcattgctgtctacaggtttctttcagattatgttcatgggtttgtgtgtatacaatatgaagaatgatctgaagtaattgtgctgtatttatgtttattcaccagtctttgatt

SEQ ID NO: 204237 - DNA, 582 bp, Homo sapiens
  Payload ID: 20277
  Gene Name: zinc finger, AN1-type domain 6
  ENST ID: ENST00000564367
  CDS Start-End: 138-582
ggaggggccggcggtggcggagccggagcaagcaggggttcggcggcattacctgtacccattcaccggcggctaccggcggcggcgcgcagcgtgtcaggcggagagacccgccgccaggtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggggtttgaatgccggtgtggaaatgtttactgtggtgtacaccgttactcagatgtacacaattgctcttacaattacaaag

SEQ ID NO: 204238 - DNA, 492 bp, Homo sapiens
  Payload ID: 20277
  Gene Name: zinc finger, AN1-type domain 6
  ENST ID: ENST00000560228
  CDS Start-End: 397-492
attcaggtttggttgctttggagtacagcttcaagtgaagttaatctgaggtgaagcaaacagaaaattgtggaggttttgttggaatgaatctgaagtctgctgcagtaaaacacagaaggctttaaaatgttttcttgcataaaattcaaaacttttaagtagctgcttatgagaatagggaaggcagaaagctaatgtctgtctcaagatacaggacagctgtttgctcatcaacctcaactgtgtttcacatcctgggaatactgtattttcaatctgaggttggtggagtcgccggtagccacctaagataggaatgtcaatcagaagttttctagaatctatcttcagatgcaaacaatacagtggcctcttggtgtgcaactgaggaacatggctcaagaaactaatcacagccaagtgcctatgctttgttccactggctgtggattttatggaaaccctcgtacaaatggcatgtgttcagta

SEQ ID NO: 204239 - DNA, 568 bp, Homo sapiens
  Payload ID: 20277
  Gene Name: zinc finger, AN1-type domain 6
  ENST ID: ENST00000560392
  CDS Start-End: 306-568
acagcttcaagtgaagttaatctgaggtgaagcaaacagaaaattgtggaggttttgttggtggagataagtaattaacatttcgaaacaggaaatgaaaggatttatatttttaaaagctataggaatgaatctgaagtctgctgcagtaaaacacagaaggctttaaaatgttttcttgcataaaattcaaaacttttaagtagctgcttatgagaatagggaaggcagaaagctaatgtctgtctcaagatacaggacagctgtttgctcatcaacctcaactgtgtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttcaatgcacagatggcagtgtgccagaagcccagtcagcattagactctacatcttcatctatgcagcccag

SEQ ID NO: 204240 - DNA, 558 bp, Homo sapiens
  Payload ID: 20277
  Gene Name: zinc finger, AN1-type domain 6
  ENST ID: ENST00000560470
  CDS Start-End: 498-558
taagttttagctacctaaaaaagtatgaaagaatattgtgtttgaaatctttttaacttggtttttaagtcacgtgctaactatcctacacagttgggacgctatgatttaccttcacatctcggaagttgtaaccagttgtgaggaagttaggaccttggggttacctaaagataatttatattaagttgttgggccataaaaactgggcagaattggccacgcgcggtgactcaacgcctgtaatcccagcactttgggaggccgacgcggactaatcacgaggtcaggagatcgagaccatcctggccaacatggaatgaatctgaagtctgctgcagtaaaacacagaaggctttaaaatgttttcttgcataaaattcaaaacttttaagtagctgcttatgagaatagggaaggcagaaagctaatgtctgtctcaagatacaggacagctgtttgctcatcaacctcaactgtgtgtgcaactgaggaacatggctcaagaaactaatcacagccaagtgcctatgctttgttccactggctgtggatttt

SEQ ID NO: 204241 - DNA, 583 bp, Homo sapiens
  Payload ID: 20277
  Gene Name: zinc finger, AN1-type domain 6
  ENST ID: ENST00000558272
  CDS Start-End: 391-583
agcttcaagtgaagttaatctgaggtgaagcaaacagaaaattgtggaggttttgttgatactttggtgttgaacatttgggatagaagagagaaatttaaaattaaaaattttccatatttctatcacaaatattggtaatttgacaacatgtaatttgattgtcgtcttaataaaatttaatgttattgctaccaaatagagataaaggaatgaatctgaagtctgctgcagtaaaacacagaaggctttaaaatgttttcttgcataaaattcaaaacttttaagtagctgcttatgagaatagggaaggcagaaagctaatgtctgtctcaagatacaggacagctgtttgctcatcaacctcaactgtgtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttc

SEQ ID NO: 204242 - DNA, 1653 bp, Homo sapiens
  Payload ID: 20277
  Gene Name: zinc finger, AN1-type domain 6
  Uniprot ID: Q6FIF0
  ENST ID: ENST00000616533
  CDS Start-End: 263-889
cagatactttggtgttgaacatttgggatagaagagagaaatttaaaattaaaaattttccatatttctatcacaaatattggaatgaatctgaagtctgctgcagtaaaacacagaaggctttaaaatgttttcttgcataaaattcaaaacttttaagtagctgcttatgagaatagggaaggcagaaagctaatgtctgtctcaagatacaggacagctgtttgctcatcaacctcaactgtgtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggcttcagtatcagacacagcacagcagccatctgaagagcaaagcaagtctcttgaaaaaccgaaacaaaaaaagaatcgctgtttcatgtgcaggaagaaagtgggacttactgggtttgaatgccggtgtggaaatgtttactgtggtgtacaccgttactcagatgtacacaattgctcttacaattacaaagccgatgctgctgagaaaatcagaaaagaaaatccagtagttgttggtgaaaagatccaaaagatttgaactcctgctggaatacaaaattcttgagcatctgcaaactaaaaattgacttgaggttttttttttcctagtcattgggaatgtagagcagtgtatcttgcatgtcatcggaagaatagatttttgttttggttttgttttgaaaatgactctgaacatttatttccattgcaatttctgtggctgaggagacttaaactttacaagtattatccttttaagatcattttaattttagttgagtgcagagggcttttataacaaacgtgcagaaattttggagggctgtgatttttccagtattaaacatgcatgcattaatcttgcagtttattttctcattgtgtatgtatatatcgcttttctctgcagcacgatttctcttttgataatgccctttagggcacaactagttatcagtaactgaatgtatcttaatcattatggctgcttctgttttttcattaacaaaggttattcatatgttagcatatagtttctttgcacccactatttatgtctgaatcatttgtcacaagagagtgtgtgctgatgagattgtaagtttgtgtgtttaaacttttttttgagcgagggaagaaaaagctgtatgcatttcattgctgtctacaggtttctttcagattatgttcatgggtttgtgtgtatacaatatgaagaatgatctgaagtaattgtgctgtatttatgtttattcaccagtctttgattaaataaaaaggaaaaccagaatgctcccttgt

SEQ ID NO: 204243 - DNA, 1729 bp, Homo sapiens
  Payload ID: 20277
  Gene Name: zinc finger, AN1-type domain 6
  Uniprot ID: Q6FIF0
  ENST ID: ENST00000613266
  CDS Start-End: 339-965
aataattagcgggcgggcggggcccgcgcgtcagccgcgggagccggccaatccagtggctctcctccgcggtcgcgtcataggccgaacaaccaaacagaaaagtttaataaacagcggacggaggggccggcggtggcggagccggagcaagcaggggttcggcggcattacctgtacccattcaccggcggctaccggcggcggcgcgcagcgtgtcaggcggagagacccgccgccagatactttggtgttgaacatttgggatagaagagagaaatttaaaattaaaaattttccatatttctatcacaaatattggtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggcttcagtatcagacacagcacagcagccatctgaagagcaaagcaagtctcttgaaaaaccgaaacaaaaaaagaatcgctgtttcatgtgcaggaagaaagtgggacttactgggtttgaatgccggtgtggaaatgtttactgtggtgtacaccgttactcagatgtacacaattgctcttacaattacaaagccgatgctgctgagaaaatcagaaaagaaaatccagtagttgttggtgaaaagatccaaaagatttgaactcctgctggaatacaaaattcttgagcatctgcaaactaaaaattgacttgaggttttttttttcctagtcattgggaatgtagagcagtgtatcttgcatgtcatcggaagaatagatttttgttttggttttgttttgaaaatgactctgaacatttatttccattgcaatttctgtggctgaggagacttaaactttacaagtattatccttttaagatcattttaattttagttgagtgcagagggcttttataacaaacgtgcagaaattttggagggctgtgatttttccagtattaaacatgcatgcattaatcttgcagtttattttctcattgtgtatgtatatatcgcttttctctgcagcacgatttctcttttgataatgccctttagggcacaactagttatcagtaactgaatgtatcttaatcattatggctgcttctgttttttcattaacaaaggttattcatatgttagcatatagtttctttgcacccactatttatgtctgaatcatttgtcacaagagagtgtgtgctgatgagattgtaagtttgtgtgtttaaacttttttttgagcgagggaagaaaaagctgtatgcatttcattgctgtctacaggtttctttcagattatgttcatgggtttgtgtgtatacaatatgaagaatgatctgaagtaattgtgctgtatttatgtttattcaccagtctttgattaaataaaaaggaaaaccagaatgctcccttgt

SEQ ID NO: 204244 - DNA, 1659 bp, Homo sapiens
  Payload ID: 20277
  Gene Name: zinc finger, AN1-type domain 6
  Uniprot ID: Q6FIF0
  ENST ID: ENST00000618205
  CDS Start-End: 269-895
agcgggttgcgagcggttggctggcgggggtcggaagggccccgggcacactggggcgcgtcagttccccgcctcctccgagtctcaggaatgaatctgaagtctgctgcagtaaaacacagaaggctttaaaatgttttcttgcataaaattcaaaacttttaagtagctgcttatgagaatagggaaggcagaaagctaatgtctgtctcaagatacaggacagctgtttgctcatcaacctcaactgtgtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggcttcagtatcagacacagcacagcagccatctgaagagcaaagcaagtctcttgaaaaaccgaaacaaaaaaagaatcgctgtttcatgtgcaggaagaaagtgggacttactgggtttgaatgccggtgtggaaatgtttactgtggtgtacaccgttactcagatgtacacaattgctcttacaattacaaagccgatgctgctgagaaaatcagaaaagaaaatccagtagttgttggtgaaaagatccaaaagatttgaactcctgctggaatacaaaattcttgagcatctgcaaactaaaaattgacttgaggttttttttttcctagtcattgggaatgtagagcagtgtatcttgcatgtcatcggaagaatagatttttgttttggttttgttttgaaaatgactctgaacatttatttccattgcaatttctgtggctgaggagacttaaactttacaagtattatccttttaagatcattttaattttagttgagtgcagagggcttttataacaaacgtgcagaaattttggagggctgtgatttttccagtattaaacatgcatgcattaatcttgcagtttattttctcattgtgtatgtatatatcgcttttctctgcagcacgatttctcttttgataatgccctttagggcacaactagttatcagtaactgaatgtatcttaatcattatggctgcttctgttttttcattaacaaaggttattcatatgttagcatatagtttctttgcacccactatttatgtctgaatcatttgtcacaagagagtgtgtgctgatgagattgtaagtttgtgtgtttaaacttttttttgagcgagggaagaaaaagctgtatgcatttcattgctgtctacaggtttctttcagattatgttcatgggtttgtgtgtatacaatatgaagaatgatctgaagtaattgtgctgtatttatgtttattcaccagtctttgattaaataaaaaggaaaaccagaatgctcccttgt

SEQ ID NO: 204245 - DNA, 3071 bp, Homo sapiens
  Payload ID: 20278
  Gene Name: zinc finger, B-box domain containing
  Uniprot ID: A8MT70
  ENST ID: ENST00000307529
  CDS Start-End: 88-2607
cctctgccataattcttttgtctttgttacttttacagaagtgtttacaaatcagaataacttttagacaatattaaggtggtaatcatgaacagaaaagattttgtagttcttccatggggaaaacctggaaattctgtaaagctaaaatatagaaatgctcaagaactgcgaatggagaaagtacagttagagtttgagaaccaagagatggagaagaaactgcaagaattccgatccacaagaaacaaagaaaaggaagatagagagtcaagcgagtattactggaaatctggaaaagtgggcaaattggtcaatcaatcatatatgatgtcacaaaataaaggaaatgttgttaagttttctgctggaaaagtgaaattaaaattgctgaaggaacagattcaagagccagtgaaaccaacagttaattataaaatggcaaattcttcagaatgtgaaaaacccaagataaatgggaaagtatgtggacagtgtgagaacaaagctgctctactggtatgccttgaatgtggagaagattattgttcaggatgctttgctaaagttcaccagaaaggggcactaaagctccacagaacaactcttttgcaggcaaaatctcaaatattattcaatgtattggatgttgcccatcagtttataaaggatgttaatccagatgaacccaaagaggagaataattctacaaaggaaaccagtaaaattcaacataaacccaaatctgtacttctccagaggagcagctctgaggtagaaattacaacgatgaaaagagcacaacgtacaaaaccaagaaagagtctgttgtgtgaagggtcattcgatgaagaagcttctgcacagtcctttcaggaagtgttaagtcaatggagaaccggaaatcatgatgacaacaagaaacagaatttacatgcagcagtaaaagactcattggaagaatgcgaagtacagactaatctgaaaatttggagagaaccacttaatattgaacttaaagaagacattctatcctatatggaaaaattatggcttaaaaaacacaggagaactccacaagagcaactttttaaaatgctaccagatacgttcccacatccacatgaaaccactggtgatgcacagtgttctcaaaatgaaaacgatgaagatagtgatggtgaggagaccaaagtacaacacacagctcttttattgccagtagaaacattaaacatagagagacctgaaccatctctaaagatagtcgaactggatgatacttatgaagaggaatttgaagaagcagaaaatattgtgccttacaaagttaaattagctgatgcagacagtcaacgaagttgtgcttttcatgattgtcagaagaatagctttccatatgaaaatggcatccatcaacatcatgttttcgataagggaaagagagacttcttaaatctttgtctgagaaacagctctacttattataaagataattcaaaagcagaaacttcaaacacagattttgacaacatcgtggatcctgatgtgtattcttctgacattgaaaaaattgaggaaagcacctcctttgaaagaaatttaaaggagaaaaatataggtttagaaagtaatcaaaagtctgatgattcctgtgtatcacttgaaagcaaggacactttgctaggtagagatttagaaaaagctcccattgaggagaaattatctcaagacatcaaagaatccttggaattgagcaatctgtataagaggccaagctttgaagaatcaaaaactacaaagtcatcactgttgttacaagaaatagcctgcagaagtaagcctataacaaaacaatatcaaggacttgagagattctttatttttgatacaaatgaaagactcaacttacttccttctcatcgtttagaatgcaacaattccagtactaggattacacttgcagaagacagagaatggattccagaccatagcttaagtgaatatgctgataatgcaattgtcttgggtgttctgcagggtgctcagagtccatcatcaagtagaaaacagcaaaagatgggtcagaaatcacagagaccttcaacagcaaattttccactttccaactctgttaaagaaagctccagttgcctttcatcctctcatcctcgatcaagaagtgcagctgctcaatcatcatctagagctgcttctgaaatttcagaaattgaatatattgatattactgaccagaatgagctttccttagatgacactactgatcaacatactttagacaatttggaaaaagaattacaagtgctgagatctcttgcagatacttcagaaaagctttacagcttaacctcagaagagttcccagatttcagcagccaatcactgaatataagtcagatttccacagatttccttaagacctcacatgtgaggggtccctgtggagttgaggaattgagctgttctggaagagataccaaaattcagtctttgctgtcactttctgagagcagtacagatgaggaggaggaagattttctcaacaagcaacatgtcatcacactaccgtggtcaaagagtacttaaagattatttgttcattactgtttccattttgtacccagagtaaagcaaacaactgagaaaagtaaccaagtgattacctatccaagtgctggagattttgattactaatgtctttgatgtttcaaggctacaaactaataaaagtaaaattataagttcaagggcttattcttccaatgatatattatatgtcaaccactaatctatattgcagattatgttagtaaaatatggtgaatttgaagaaataactgttacaactgtgtctataaaacctactatagggcagaacatgattatacttaaagaaatatttcatcgtccaattatattttaaataattatgtcatcaacaagagtgtgcatttgacagccaagtcacactagttagtatcatcaattgaacctataattacactgtttattttctggtttttaacatttatagaagttctggtatcttc

SEQ ID NO: 204246 - DNA, 2849 bp, Homo sapiens
  Payload ID: 20278
  Gene Name: zinc finger, B-box domain containing
  Uniprot ID: A8MT70
  ENST ID: ENST00000392764
  CDS Start-End: 373-2688
atccggcggtggtgacgcgagaggctggggtctccaggaccaactcctcttcatcttcgtcttcctcagcctgctcaatgtgaagcccctgatcatgattcacttccacttaataaataaagtgtttacaaatcagaataacttttagacaatattaaggtggtaatcatgaacagaaaagattttgtagttcttccatggggaaaacctggaaattctgtaaagctaaaatatagcaatgtaataattaaaacaaaagtctaagatttgaagagataatttgcttcaggattttgatggaaggcaaatgctaactttaaaaaccagatttcggagaagtacaaaagaaatagaaatgctcaagaactgcgaatggagaaagtacagttagagtttgagaaccaagagatggagaagaaactgcaagaattccgatccacaagaaacaaagaaaaggaagatagagagtcaagcgagtattactggaaatctggaaaagtgggcaaattggtcaatcaatcatatatgatgtcacaaaataaaggaaatgttgttaagttttctgctggaaaagtgaaattaaaattgctgaaggaacagattcaagagccagtgaaaccaacagttaattataaaatggcaaattcttcagaatgtgaaaaacccaagataaatgggaaagtatgtggacagtgtgagaacaaagctgctctactggtatgccttgaatgtggagaagattattgttcaggatgctttgctaaagttcaccagaaaggggcactaaagctccacagaacaactcttttgcaggcaaaatctcaaatattattcaatgtattggatgttgcccatcagtttataaaggatgttaatccagatgaacccaaagaggagaataattctacaaaggaaaccagtaaaattcaacataaacccaaatctgtacttctccagaggagcagctctgaggtagaaattacaacgatgaaaagagcacaacgtacaaaaccaagaaagagtctgttgtgtgaagggtcattcgatgaagaagcttctgcacagtcctttcaggaagtgttaagtcaatggagaaccggaaatcatgatgacaacaagaaacagaatttacatgcagcagtaaaagactcattggaagaatgcgaagtacagactaatctgaaaatttggagagaaccacttaatattgaacttaaagaagacattctatcctatatggaaaaattatggcttaaaaaacacaggagaactccacaagagcaactttttaaaatgctaccagatacgttcccacatccacatgaaaccactggtgatgcacagtgttctcaaaatgaaaacgatgaagatagtgatggtgaggagaccaaagtacaacacacagctcttttattgccagtagaaacattaaacatagagagacctgaaccatctctaaagatagtcgaactggatgatacttatgaagaggaatttgaagaagcagaaaatattgtgccttacaaagttaaattagctgatgcagacagtcaacgaagttgtgcttttcatgattgtcagaagaatagctttccatatgaaaatggcatccatcaacatcatgttttcgataagggaaagagagacttcttaaatctttgtctgagaaacagctctacttattataaagataattcaaaagcagaaacttcaaacacagattttgacaacatcgtggatcctgatgtgtattcttctgacattgaaaaaattgaggaaagcacctcctttgaaagaaatttaaaggagaaaaatataggtttagaaagtaatcaaaagtctgatgattcctgtgtatcacttgaaagcaaggacactttgctaggtagagatttagaaaaagctcccattgaggagaaattatctcaagacatcaaagaatccttggaattgagcaatctgtataagaggccaagctttgaagaatcaaaaactacaaagtcatcactgttgttacaagaaatagcctgcagaagtaagcctataacaaaacaatatcaaggacttgagagattctttatttttgatacaaatgaaagactcaacttacttccttctcatcgtttagaatgcaacaattccagtactaggattacacttgcaggtcagaaatcacagagaccttcaacagcaaattttccactttccaactctgttaaagaaagctccagttgcctttcatcctctcatcctcgatcaagaagtgcagctgctcaatcatcatctagagctgcttctgaaatttcagaaattgaatatattgatattactgaccagaatgagctttccttagatgacactactgatcaacatactttagacaatttggaaaaagaattacaagtgctgagatctcttgcagatacttcagaaaagctttacagcttaacctcagaagagttcccagatttcagcagccaatcactgaatataagtcagatttccacagatttccttaagacctcacatgtgaggggtccctgtggagttgaggaattgagctgttctggaagagataccaaaattcagtctttgctgtcactttctgagagcagtacagatgaggaggaggaagattttctcaacaagcaacatgtcatcacactaccgtggtcaaagagtacttaaagattatttgttcattactgtttccattttgtacccagagtaaagcaaacaactgagaaaagtaaccaagtgattacctatccaagtgctggagattttgattactaatgtctttgatgtttcaaggctacaaactaataaaagtaaaattataagttcaa

SEQ ID NO: 204247 - DNA, 3250 bp, Homo sapiens
  Payload ID: 20278
  Gene Name: zinc finger, B-box domain containing
  Uniprot ID: A8MT70
  ENST ID: ENST00000392766
  CDS Start-End: 342-2744
cggcagctatccgcggccatccggcggtggtgacgcgagaggctggggtctccagcctttagtctgcctgcgcgttcacatgcacccacttacttcttgaagtctactcctcacaagtaagggctatggtgcggggtgcccgattcctgagaaatctgaagatgtggaagtttattttttcttcccaaaatcagcagtagagggactcaggaccaactcctcttcatcttcgtcttcctcagcctgctcaatgtgaagcccctgatcatgattcacttccacttaataaataaagtgtttacaaatcagaataacttttagacaatattaaggtggtaatcatgaacagaaaagattttgtagttcttccatggggaaaacctggaaattctgtaaagctaaaatatagaaatgctcaagaactgcgaatggagaaagtacagttagagtttgagaaccaagagatggagaagaaactgcaagaattccgatccacaagaaacaaagaaaaggaagatagagagtcaagcgagtattactggaaatctggaaaagtgggcaaattggtcaatcaatcatatatgatgtcacaaaataaaggaaatgttgttaagttttctgctggaaaagtgaaattaaaattgctgaaggaacagattcaagagccagtgaaaccaacagttaattataaaatggcaaattcttcagaatgtgaaaaacccaagataaatgggaaagtatgtggacagtgtgagaacaaagctgctctactggtatgccttgaatgtggagaagattattgttcaggatgctttgctaaagttcaccagaaaggggcactaaagctccacagaacaactcttttgcaggcaaaatctcaaatattattcaatgtattggatgttgcccatcagtttataaaggatgttaatccagatgaacccaaagaggagaataattctacaaaggaaaccagtaaaattcaacataaacccaaatctgtacttctccagaggagcagctctgaggtagaaattacaacgatgaaaagagcacaacgtacaaaaccaagaaagagtctgttgtgtgaagggtcattcgatgaagaagcttctgcacagtcctttcaggaagtgttaagtcaatggagaaccggaaatcatgatgacaacaagaaacagaatttacatgcagcagtaaaagactcattggaagaatgcgaagtacagactaatctgaaaatttggagagaaccacttaatattgaacttaaagaagacattctatcctatatggaaaaattatggcttaaaaaacacaggagaactccacaagagcaactttttaaaatgctaccagatacgttcccacatccacatgaaaccactggtgatgcacagtgttctcaaaatgaaaacgatgaagatagtgatggtgaggagaccaaagtacaacacacagctcttttattgccagtagaaacattaaacatagagagacctgaaccatctctaaagatagtcgaactggatgatacttatgaagaggaatttgaagaagcagaaaatattgtgccttacaaagttaaattagctgatgcagacagtcaacgaagttgtgcttttcatgattgtcagaagaatagctttccatatgaaaatggcatccatcaacatcatgttttcgataagggaaagagagacttcttaaatctttgtctgagaaacagctctacttattataaagataattcaaaagcagaaacttcaaacacagattttgacaacatcgtggatcctgatgtgtattcttctgacattgaaaaaattgaggaaagcacctcctttgaaagaaatttaaaggagaaaaatataggtttagaaagtaatcaaaagtctgatgattcctgtgtatcacttgaaagcaaggacactttgctaggtagagatttagaaaaagctcccattgaggagaaattatctcaagacatcaaagaatccttggaattgagcaatctgtataagaggccaagctttgaagaatcaaaaactacaaagtcatcactgttgttacaagaaatagcctgcagaagtaagcctataacaaaacaatatcaaggacttgagagattctttatttttgatacaaatgaaagactcaacttacttccttctcatcgtttagaatgcaacaattccagtactaggattacacttgcaggtcagaaatcacagagaccttcaacagcaaattttccactttccaactctgttaaagaaagctccagttgcctttcatcctctcatcctcgatcaagaagtgcagctgctcaatcatcatctagagctgcttctgaaatttcagaaattgaatatattgatattactgaccagaatgagctttccttagatgacactactgatcaacatactttagacaatttggaaaaagaattacaagtgctgagatctcttgcagatacttcagaaaagctttacagcttaacctcagaagagttcccagatttcagcagccaatcactgaatataagtcagatttccacagatttccttaagacctcacatgtgaggggtccctgtggagttgaggaattgagctgttctggaagagataccaaaattcagtctttgctgtcactttctgagagcagtacagatgaggaggaggaagattttctcaacaagcaacatgtcatcacactaccgtggtcaaagagtacttaaagattatttgttcattactgtttccattttgtacccagagtaaagcaaacaactgagaaaagtaaccaagtgattacctatccaagtgctggagattttgattactaatgtctttgatgtttcaaggctacaaactaataaaagtaaaattataagttcaagggcttattcttccaatgatatattatatgtcaaccactaatctatattgcagattatgttagtaaaatatggtgaatttgaagaaataactgttacaactgtgtctataaaacctactatagggcagaacatgattatacttaaagaaatatttcatcgtccaattatattttaaataattatgtcatcaacaagagtgtgcatttgacagccaagtcacactagttagtatcatcaattgaacctataattacactgtttattttctggtttttaacatttatagaagttctggtatcttcaaaaatttgcaataaaagaaaaaaagaggaccaaaaataaaa

SEQ ID NO: 204248 - DNA, 3071 bp, Homo sapiens
  Payload ID: 20278
  Gene Name: zinc finger, B-box domain containing
  Uniprot ID: A8MT70
  ENST ID: ENST00000392767
  CDS Start-End: 292-2607
cctctgccataattcttttgtctttgttacttttacagaagtgtttacaaatcagaataacttttagacaatattaaggtggtaatcatgaacagaaaagattttgtagttcttccatggggaaaacctggaaattctgtaaagctaaaatatagcaatgtaataattaaaacaaaagtctaagatttgaagagataatttgcttcaggattttgatggaaggcaaatgctaactttaaaaaccagatttcggagaagtacaaaagaaatagaaatgctcaagaactgcgaatggagaaagtacagttagagtttgagaaccaagagatggagaagaaactgcaagaattccgatccacaagaaacaaagaaaaggaagatagagagtcaagcgagtattactggaaatctggaaaagtgggcaaattggtcaatcaatcatatatgatgtcacaaaataaaggaaatgttgttaagttttctgctggaaaagtgaaattaaaattgctgaaggaacagattcaagagccagtgaaaccaacagttaattataaaatggcaaattcttcagaatgtgaaaaacccaagataaatgggaaagtatgtggacagtgtgagaacaaagctgctctactggtatgccttgaatgtggagaagattattgttcaggatgctttgctaaagttcaccagaaaggggcactaaagctccacagaacaactcttttgcaggcaaaatctcaaatattattcaatgtattggatgttgcccatcagtttataaaggatgttaatccagatgaacccaaagaggagaataattctacaaaggaaaccagtaaaattcaacataaacccaaatctgtacttctccagaggagcagctctgaggtagaaattacaacgatgaaaagagcacaacgtacaaaaccaagaaagagtctgttgtgtgaagggtcattcgatgaagaagcttctgcacagtcctttcaggaagtgttaagtcaatggagaaccggaaatcatgatgacaacaagaaacagaatttacatgcagcagtaaaagactcattggaagaatgcgaagtacagactaatctgaaaatttggagagaaccacttaatattgaacttaaagaagacattctatcctatatggaaaaattatggcttaaaaaacacaggagaactccacaagagcaactttttaaaatgctaccagatacgttcccacatccacatgaaaccactggtgatgcacagtgttctcaaaatgaaaacgatgaagatagtgatggtgaggagaccaaagtacaacacacagctcttttattgccagtagaaacattaaacatagagagacctgaaccatctctaaagatagtcgaactggatgatacttatgaagaggaatttgaagaagcagaaaatattgtgccttacaaagttaaattagctgatgcagacagtcaacgaagttgtgcttttcatgattgtcagaagaatagctttccatatgaaaatggcatccatcaacatcatgttttcgataagggaaagagagacttcttaaatctttgtctgagaaacagctctacttattataaagataattcaaaagcagaaacttcaaacacagattttgacaacatcgtggatcctgatgtgtattcttctgacattgaaaaaattgaggaaagcacctcctttgaaagaaatttaaaggagaaaaatataggtttagaaagtaatcaaaagtctgatgattcctgtgtatcacttgaaagcaaggacactttgctaggtagagatttagaaaaagctcccattgaggagaaattatctcaagacatcaaagaatccttggaattgagcaatctgtataagaggccaagctttgaagaatcaaaaactacaaagtcatcactgttgttacaagaaatagcctgcagaagtaagcctataacaaaacaatatcaaggacttgagagattctttatttttgatacaaatgaaagactcaacttacttccttctcatcgtttagaatgcaacaattccagtactaggattacacttgcaggtcagaaatcacagagaccttcaacagcaaattttccactttccaactctgttaaagaaagctccagttgcctttcatcctctcatcctcgatcaagaagtgcagctgctcaatcatcatctagagctgcttctgaaatttcagaaattgaatatattgatattactgaccagaatgagctttccttagatgacactactgatcaacatactttagacaatttggaaaaagaattacaagtgctgagatctcttgcagatacttcagaaaagctttacagcttaacctcagaagagttcccagatttcagcagccaatcactgaatataagtcagatttccacagatttccttaagacctcacatgtgaggggtccctgtggagttgaggaattgagctgttctggaagagataccaaaattcagtctttgctgtcactttctgagagcagtacagatgaggaggaggaagattttctcaacaagcaacatgtcatcacactaccgtggtcaaagagtacttaaagattatttgttcattactgtttccattttgtacccagagtaaagcaaacaactgagaaaagtaaccaagtgattacctatccaagtgctggagattttgattactaatgtctttgatgtttcaaggctacaaactaataaaagtaaaattataagttcaagggcttattcttccaatgatatattatatgtcaaccactaatctatattgcagattatgttagtaaaatatggtgaatttgaagaaataactgttacaactgtgtctataaaacctactatagggcagaacatgattatacttaaagaaatatttcatcgtccaattatattttaaataattatgtcatcaacaagagtgtgcatttgacagccaagtcacactagttagtatcatcaattgaacctataattacactgtttattttctggtttttaacatttatagaagttctggtatcttc

SEQ ID NO: 204249 - DNA, 3185 bp, Homo sapiens
  Payload ID: 20278
  Gene Name: zinc finger, B-box domain containing
  Uniprot ID: A8MT70
  ENST ID: ENST00000455345
  CDS Start-End: 285-2804
tttagtctgcctgcgcgttcacatgcacccacttacttcttgaagtctactcctcacaagtaagggctatggtgcggggtgcccgattcctgagaaatctgaagatgtggaagtttattttttcttcccaaaatcagcagtagagggactcaggaccaactcctcttcatcttcgtcttcctcagcctgctcaatgtgaagcccctgatcatgattcacttccacttaataaataaagtgtttacaaatcagaataacttttagacaatattaaggtggtaatcatgaacagaaaagattttgtagttcttccatggggaaaacctggaaattctgtaaagctaaaatatagaaatgctcaagaactgcgaatggagaaagtacagttagagtttgagaaccaagagatggagaagaaactgcaagaattccgatccacaagaaacaaagaaaaggaagatagagagtcaagcgagtattactggaaatctggaaaagtgggcaaattggtcaatcaatcatatatgatgtcacaaaataaaggaaatgttgttaagttttctgctggaaaagtgaaattaaaattgctgaaggaacagattcaagagccagtgaaaccaacagttaattataaaatggcaaattcttcagaatgtgaaaaacccaagataaatgggaaagtatgtggacagtgtgagaacaaagctgctctactggtatgccttgaatgtggagaagattattgttcaggatgctttgctaaagttcaccagaaaggggcactaaagctccacagaacaactcttttgcaggcaaaatctcaaatattattcaatgtattggatgttgcccatcagtttataaaggatgttaatccagatgaacccaaagaggagaataattctacaaaggaaaccagtaaaattcaacataaacccaaatctgtacttctccagaggagcagctctgaggtagaaattacaacgatgaaaagagcacaacgtacaaaaccaagaaagagtctgttgtgtgaagggtcattcgatgaagaagcttctgcacagtcctttcaggaagtgttaagtcaatggagaaccggaaatcatgatgacaacaagaaacagaatttacatgcagcagtaaaagactcattggaagaatgcgaagtacagactaatctgaaaatttggagagaaccacttaatattgaacttaaagaagacattctatcctatatggaaaaattatggcttaaaaaacacaggagaactccacaagagcaactttttaaaatgctaccagatacgttcccacatccacatgaaaccactggtgatgcacagtgttctcaaaatgaaaacgatgaagatagtgatggtgaggagaccaaagtacaacacacagctcttttattgccagtagaaacattaaacatagagagacctgaaccatctctaaagatagtcgaactggatgatacttatgaagaggaatttgaagaagcagaaaatattgtgccttacaaagttaaattagctgatgcagacagtcaacgaagttgtgcttttcatgattgtcagaagaatagctttccatatgaaaatggcatccatcaacatcatgttttcgataagggaaagagagacttcttaaatctttgtctgagaaacagctctacttattataaagataattcaaaagcagaaacttcaaacacagattttgacaacatcgtggatcctgatgtgtattcttctgacattgaaaaaattgaggaaagcacctcctttgaaagaaatttaaaggagaaaaatataggtttagaaagtaatcaaaagtctgatgattcctgtgtatcacttgaaagcaaggacactttgctaggtagagatttagaaaaagctcccattgaggagaaattatctcaagacatcaaagaatccttggaattgagcaatctgtataagaggccaagctttgaagaatcaaaaactacaaagtcatcactgttgttacaagaaatagcctgcagaagtaagcctataacaaaacaatatcaaggacttgagagattctttatttttgatacaaatgaaagactcaacttacttccttctcatcgtttagaatgcaacaattccagtactaggattacacttgcagaagacagagaatggattccagaccatagcttaagtgaatatgctgataatgcaattgtcttgggtgttctgcagggtgctcagagtccatcatcaagtagaaaacagcaaaagatgggtcagaaatcacagagaccttcaacagcaaattttccactttccaactctgttaaagaaagctccagttgcctttcatcctctcatcctcgatcaagaagtgcagctgctcaatcatcatctagagctgcttctgaaatttcagaaattgaatatattgatattactgaccagaatgagctttccttagatgacactactgatcaacatactttagacaatttggaaaaagaattacaagtgctgagatctcttgcagatacttcagaaaagctttacagcttaacctcagaagagttcccagatttcagcagccaatcactgaatataagtcagatttccacagatttccttaagacctcacatgtgaggggtccctgtggagttgaggaattgagctgttctggaagagataccaaaattcagtctttgctgtcactttctgagagcagtacagatgaggaggaggaagattttctcaacaagcaacatgtcatcacactaccgtggtcaaagagtacttaaagattatttgttcattactgtttccattttgtacccagagtaaagcaaacaactgagaaaagtaaccaagtgattacctatccaagtgctggagattttgattactaatgtctttgatgtttcaaggctacaaactaataaaagtaaaattataagttcaagggcttattcttccaatgatatattatatgtcaaccactaatctatattgcagattatgttagtaaaatatggtgaatttgaagaaataactgttacaactgtgtctataaaacctactatagggcagaacatgattatacttaaagaaatatttcatcgtccaattatattttaaataattatgtcatcaacaagagtgtgcatttgacagccaagtca

SEQ ID NO: 204250 - DNA, 751 bp, Homo sapiens
  Payload ID: 20278
  Gene Name: zinc finger, B-box domain containing
  ENST ID: ENST00000485651
  CDS Start-End: 546-751
cggcagctatccgcggccatccggcggtggtgacgcgagaggctggggtctccagcctttagtctgcctgcgcgttcacatgcacccacttacttcttgaagtctactcctcacaagtaagggctatggtgcggggtgcccgattcctgagaaatctgaagatgtggaagtttattttttcttcccaaaatcagcagtagagggactcaggaccaactcctcttcatcttcgtcttcctcagcctgctcaatgtgaagcccctgatcatgattcacttccacttaataaataaagtgtttacaaatcagaataacttttagacaatattaaggtggtaatcatgaacagaaaagattttgtagttcttccatggggaaaacctggaaattctgtaaagctaaaatatagcaatgtaataattaaaacaaaagtctaagatttgaagagataatttgcttcaggattttgatggaaggcaaatgctaactttaaaaaccagatttcggagaagtacaaaagaaatagaaatgctcaagaactgcgaatggagaaagtacagttagagtttgagaaccaagagatggagaagaaactgcaagaattccgatccacaagaaacaaagaaaaggaagatagagagatgacaaagtttattatgtgtcttgctgcttttaatgacccagtggccaattcttttaccttcactgatttggacttagtttggacttctaaatggatcatgatactcat

SEQ ID NO: 204251 - DNA, 718 bp, Homo sapiens
  Payload ID: 20278
  Gene Name: zinc finger, B-box domain containing
  ENST ID: ENST00000494898
  CDS Start-End: 1-136
aaagaaagctccagttgcctttcatcctctcatcctcgatcaagaagtgcagctgctcaatcatcatctagagctgcttctgaaatttcagaaattgaatatattgatattactgaccagaatgagctttccttagatgacactactgatcaacatactttagacaatttggaaaaagaattacaagtgctgagatctcttgcaggatgcatccacttcttctttctaagttctatgaaaaacaaccatgttaaggagctgggagaataagacagaaaataactacattagatacttcagaaaagctttacagcttaacctcagaagagttcccagatttcagcagccaatcactgaatataagtcagatttccacagatttccttaagacctcacatgtgaggggtccctgtggagttgaggaattgagctgttctggaagagataccaaaattcagtctttgctgtcactttctgagagcagtacagatgaggaggaggaagattttctcaacaagcaacatgtcatcacactaccgtggtcaaagagtacttaaagattatttgttcattactgtttccattttgtacccagagtaaagcaaacaactgagaaaagtaaccaagtgattacctatccaagtgctggagattttgattactaatgtctttgatgtttcaaggctacaaactaataaaagtaaaattataagttcaa

SEQ ID NO: 204252 - DNA, 691 bp, Homo sapiens
  Payload ID: 20278
  Gene Name: zinc finger, B-box domain containing
  ENST ID: ENST00000492642
  CDS Start-End: 1-260
cactttccaactctgttaaagaaagctccagttgcctttcatcctctcatcctcgatcaagaagtgcagctgctcaatcatcatctagagctgcttctgaaatttcagaaattgaatatattgatattactgaccagaatgagctttccttagatgacactactgatcaacatactttagacaatttggaaaaagaattacaagtgctgagatctcttgcagggcctcagcctgaagcttggagtccagtttgggactgaaaagatacttcagaaaagctttacagcttaacctcagaagagttcccagatttcagcagccaatcactgaatataagtcagatttccacagatttccttaagacctcacatgtgaggggtccctgtggagttgaggaattgagctgttctggaagagataccaaaattcagtctttgctgtcactttctgagagcagtacagatgaggaggaggaagattttctcaacaagcaacatgtcatcacactaccgtggtcaaagagtacttaaagattatttgttcattactgtttccattttgtacccagagtaaagcaaacaactgagaaaagtaaccaagtgattacctatccaagtgctggagattttgattactaatgtctttgatgtttcaaggctacaaactaataaaagtaaaattataagttcaa

SEQ ID NO: 204253 - DNA, 633 bp, Homo sapiens
  Payload ID: 20278
  Gene Name: zinc finger, B-box domain containing
  ENST ID: ENST00000464922
  CDS Start-End: 1-149
atgagctttccttagatgacactactgatcaacatactttagacaatttggaaaaagaattacaagtgctgagatctcttgcaggatgcatccacttcttctttctaagttctatgaaaaacaaccatgttaaggagctgggagaataagacagaaaataactacattagggcctcagcctgaagcttggagtccagtttgggactgaaaagatacttcagaaaagctttacagcttaacctcagaagagttcccagatttcagcagccaatcactgaatataagtcagatttccacagatttccttaagacctcacatgtgaggggtccctgtggagttgaggaattgagctgttctggaagagataccaaaattcagtctttgctgtcactttctgagagcagtacagatgaggaggaggaagattttctcaacaagcaacatgtcatcacactaccgtggtcaaagagtacttaaagattatttgttcattactgtttccattttgtacccagagtaaagcaaacaactgagaaaagtaaccaagtgattacctatccaagtgctggagattttgattactaatgtctttgatgtttcaaggctacaaactaataaaagtaaaattataa

SEQ ID NO: 204254 - DNA, 746 bp, Homo sapiens
  Payload ID: 20278
  Gene Name: zinc finger, B-box domain containing
  ENST ID: ENST00000474464
  CDS Start-End: 256-746
agctatccgcggccatccggcggtggtgacgcgagaggctggggtctccagcctttagtctgcctgcgcgttcacatgcacccacttacttcttgaagtctactcctcacaagtaagggctatggtgcggggtgcccgattcctgagaaatctgaagatgtggaagtttattttttcttcccaaaatcagcagtagagggactcagaagtgtttacaaatcagaataacttttagacaatattaaggtggtaatcatgaacagaaaagattttgtagttcttccatggggaaaacctggaaattctgtaaagctaaaatatagaaatgctcaagaactgcgaatggagaaagtacagttagagtttgagaaccaagagatggagaagaaactgcaagaattccgatccacaagaaacaaagaaaaggaagatagagagtcaagcgagtattactggaaatctggaaaagtgggcaaattggtcaatcaatcatatatgatgtcacaaaataaaggaaatgttgttaagttttctgctggaaaagtgaaattaaaattgctgaaggaacagattcaagagccagtgaaaccaacagttaattataaaatggcaaattcttcagaatgtgaaaaacccaagataaatgggaaagtatgtggacagtgtgagaacaaagctgctctactggtatgccttgaatgtggagaagattattgttcaggatgctttgctaaagttcaccagaa

SEQ ID NO: 204255 - DNA, 2832 bp, Homo sapiens
  Payload ID: 20279
  Gene Name: zinc finger, BED-type containing 1
  Uniprot ID: O96006
  ENST ID: ENST00000381218
  CDS Start-End: 299-2383
gcgcgtgtggcctccccgcctgtcccgggtcgggctccaaccaagcagcccccgtgcagccgcccccccgcgcaccctgacacctccgggccatggccggggacccgggggctcgcacgccccgcgcccaagacatcaggcggctctgcctgccgcctgcggtcggccagtgaccgcgcgcccccgccaggccccggaggggaggagcgggcgtcccagggacctcgacccctacccaccccaggcaggtccccacgcatgagcagccgtccagcaggcaggctccggtggagaagcaatggagaataaaagcctggagagctcccagacagacctgaagctggtggcccacccccgcgccaagagcaaggtgtggaagtatttcggcttcgacaccaacgccgagggatgcatcctgcagtggaagaaaatctactgccgcatctgcatggcccagatcgcctactccggaaacacctccaacctgtcctaccacctggagaagaaccaccccgaggaattctgcgagttcgtcaagagcaacacggagcagatgcgtgaagccttcgccaccgccttctccaagctgaagcccgagtcgtcccagcagcccgggcaggacgcgctggccgtcaaggccggccacggctacgacagcaagaagcagcaggagctgacggccgccgtgctgggcctcatctgcgaggggctgtacccagcctccatcgtggacgagcccaccttcaaggtgctgctgaagacggccgacccccggtatgagctgcccagccggaagtacatctctaccaaggccatccctgagaagtacggggccgtccgggaggtgatcctgaaggagctggccgaggccacctggtgtggcatctccaccgacatgtggaggagtgagaatcagaaccgcgcctacgtcacgctggccgcccacttcctgggcctgggcgcccccaactgcctgtccatgggctcccgctgcctgaagaccttcgaggtgcccgaagagaacacggcggagaccatcacgcgagtgctctatgaggtcttcatcgagtggggcatcagcgccaaggtcttcggggccaccaccaactatggcaaggacatcgtgaaggcgtgctccctgctggacgtcgcagtgcacatgccctgcctgggccacaccttcaatgccggcatccagcaggccttccagctcccgaagctgggggcgctgctgtcgcgctgccgcaaactggtggagtacttccagcagtctgccgtggccatgtacatgctctatgagaagcagaagcagcagaacgtggcccactgcatgctggtgagcaaccgcgtctcctggtgggggagcacgctggccatgctgcagcgcctcaaggagcagcagttcgtcatcgccggggtcttggtggaggacagcaacaaccaccacctcatgctggaggccagcgagtgggccaccatcgaggggctggtggagctcctgcagcccttcaagcaggtggccgagatgctgtcggcctccaggtaccccaccatcagcatggtgaagccgctgctgcacatgctcctgaacaccacgctcaacatcaaggagaccgactccaaggagctcagcatggccaaggaggtcatcgccaaggagctttccaagacctaccaggagacgcccgagatcgacatgtttctcaacgtggccaccttcctggacccccgctacaagaggctgcccttcctctccgccttcgagcggcagcaggtggagaatcgcgtggtggaagaggccaagggcctgctggacaaggtcaaagacggcggctaccggccggctgaggacaagatcttcccggtgcccgaggagcctcccgtcaagaagctcatgcggacatccacgccgccgcccgccagcgtcatcaacaacatgctggccgagatcttctgccagacaggcggcgtggaggaccaggaagagtggcatgcccaggtggtggaggagctgagcaacttcaagtcccagaaggtgcttggcctcaacgaagaccccctcaagtggtggtcagaccgcctggccctcttccccctgctgcccaaggtgctgcagaagtactggtgcgtgacggccacgcgcgtcgcccctgagcgtctcttcggatccgccgccaacgtggtcagcgccaagaggaaccggctggctcccgcgcacgtggacgagcaggtgtttctgtatgagaacgcccggagtggggcagaggcggaacccgaggaccaggacgagggggagtggggcctggaccaggagcaggtgttctccttgggggatggcgtcagcggcggtttctttggcattagggacagcagcttcctgtagcgaggaagcgtgttgtcttacaagtcatccccgcagcagcccattggatgctttgctgtaaatacttacccggtcagcttggttttgaacctcagagaccatccactgtctttgacacctagaaggtggaaaaaggaaagagatttgagaagtgagagagggtcgggggcggtggctcctgtctataatcgcagcactttgggaggccgaggtgggcagatcagctgaggtcaggagatcgagaccagcctggccaacatggcgaaaccccgtctctactaaaaatacaaaaattagccaggactgatggcatgtgcctgtaatcccagcttctggaggctgaggccagagaatcgcttgaacctgggaggtggaggttgcagtaagctgagatcgctgcactccagcctgggcgacaagagcgagactctctcaaaaagaaaaaagaa

SEQ ID NO: 204256 - DNA, 4485 bp, Homo sapiens
  Payload ID: 20279
  Gene Name: zinc finger, BED-type containing 1
  Uniprot ID: O96006
  ENST ID: ENST00000381222
  CDS Start-End: 202-2286
cgcgggcggcgcggaagcggcggcggcgcggccggggcagccatgtcgccattgtctgcggcgcgggcggccctgcgggtctacgcggtaggcgccgcggtgatcctggcgcagctgctgcggcgctgccgcgggggcttcctggagccaggtccccacgcatgagcagccgtccagcaggcaggctccggtggagaagcaatggagaataaaagcctggagagctcccagacagacctgaagctggtggcccacccccgcgccaagagcaaggtgtggaagtatttcggcttcgacaccaacgccgagggatgcatcctgcagtggaagaaaatctactgccgcatctgcatggcccagatcgcctactccggaaacacctccaacctgtcctaccacctggagaagaaccaccccgaggaattctgcgagttcgtcaagagcaacacggagcagatgcgtgaagccttcgccaccgccttctccaagctgaagcccgagtcgtcccagcagcccgggcaggacgcgctggccgtcaaggccggccacggctacgacagcaagaagcagcaggagctgacggccgccgtgctgggcctcatctgcgaggggctgtacccagcctccatcgtggacgagcccaccttcaaggtgctgctgaagacggccgacccccggtatgagctgcccagccggaagtacatctctaccaaggccatccctgagaagtacggggccgtccgggaggtgatcctgaaggagctggccgaggccacctggtgtggcatctccaccgacatgtggaggagtgagaatcagaaccgcgcctacgtcacgctggccgcccacttcctgggcctgggcgcccccaactgcctgtccatgggctcccgctgcctgaagaccttcgaggtgcccgaagagaacacggcggagaccatcacgcgagtgctctatgaggtcttcatcgagtggggcatcagcgccaaggtcttcggggccaccaccaactatggcaaggacatcgtgaaggcgtgctccctgctggacgtcgcagtgcacatgccctgcctgggccacaccttcaatgccggcatccagcaggccttccagctcccgaagctgggggcgctgctgtcgcgctgccgcaaactggtggagtacttccagcagtctgccgtggccatgtacatgctctatgagaagcagaagcagcagaacgtggcccactgcatgctggtgagcaaccgcgtctcctggtgggggagcacgctggccatgctgcagcgcctcaaggagcagcagttcgtcatcgccggggtcttggtggaggacagcaacaaccaccacctcatgctggaggccagcgagtgggccaccatcgaggggctggtggagctcctgcagcccttcaagcaggtggccgagatgctgtcggcctccaggtaccccaccatcagcatggtgaagccgctgctgcacatgctcctgaacaccacgctcaacatcaaggagaccgactccaaggagctcagcatggccaaggaggtcatcgccaaggagctttccaagacctaccaggagacgcccgagatcgacatgtttctcaacgtggccaccttcctggacccccgctacaagaggctgcccttcctctccgccttcgagcggcagcaggtggagaatcgcgtggtggaagaggccaagggcctgctggacaaggtcaaagacggcggctaccggccggctgaggacaagatcttcccggtgcccgaggagcctcccgtcaagaagctcatgcggacatccacgccgccgcccgccagcgtcatcaacaacatgctggccgagatcttctgccagacaggcggcgtggaggaccaggaagagtggcatgcccaggtggtggaggagctgagcaacttcaagtcccagaaggtgcttggcctcaacgaagaccccctcaagtggtggtcagaccgcctggccctcttccccctgctgcccaaggtgctgcagaagtactggtgcgtgacggccacgcgcgtcgcccctgagcgtctcttcggatccgccgccaacgtggtcagcgccaagaggaaccggctggctcccgcgcacgtggacgagcaggtgtttctgtatgagaacgcccggagtggggcagaggcggaacccgaggaccaggacgagggggagtggggcctggaccaggagcaggtgttctccttgggggatggcgtcagcggcggtttctttggcattagggacagcagcttcctgtagcgaggaagcgtgttgtcttacaagtcatccccgcagcagcccattggatgctttgctgtaaatacttacccggtcagcttggttttgaacctcagagaccatccactgtctttgacacctagaaggtggaaaaaggaaagagatttgagaagtgagagagggtcgggggcggtggctcctgtctataatcgcagcactttgggaggccgaggtgggcagatcagctgaggtcaggagatcgagaccagcctggccaacatggcgaaaccccgtctctactaaaaatacaaaaattagccaggactgatggcatgtgcctgtaatcccagcttctggaggctgaggccagagaatcgcttgaacctgggaggtggaggttgcagtaagctgagatcgctgcactccagcctgggcgacaagagcgagactctctcaaaaagaaaaaagaagacacaagagaggtggctttgagtgggtttcctttcctcccctattcccggggcccggacgacttctgcttgggaactgccaacgcttctgcttgggaattgcgtgcagcagagcctagaggagctgttccttccttcacagatacttaagacctccaccatgtctgattcgagttctccctgggagggtttagaagaaacgcaggaacattctgggtggcgtcgaaggagcctttcccgatcatcatgtgtgacttctgcgaggtccagatcactgaattcatgtttacattctcgtgcaagcagggacctcttgcttctgagaaatggggaagagaccttttagccaaaatgcccttcttaaaaagagagacctttttttttaatgttcggttaaaaatgtgacagatgagtacaaaaatgcagacacttaacaaaaagcaaacagaaaaaaaagtgtggaatgtgttgtattttcgacaggttgctgccagagagcctgcttcctgctgcctgccgaaatttcactttgcggagttggtccttaaaactgggcggtggccgggcgtggtggctcacgctgaggtcaggagttcgagaccagcctggccaaccaacatggtgaaacctcgtgtctactaaaaatacaagaaactagccagatgcggtggcacccgcctgtaatcccagctactcgggaggctgaggcggaagattcgcttgagcccaggaggtggaggttgcagtgagccaagactacgccactgcactccagcctggaggccagagtgagactccgtctcaaaacaaaacaaaagtgggtggctcacgggtccggaggttatgtcttcggtgtctcagccctaaaagtccagttcccccgtgcggccagcttttccacataaggtgtttttgatttgattaccggaaaggactcttgattcttctcttttaaactgaataccataggggaaatgaattttaaaatattgcccccggaggggttttccgtggctggattcctgcgagttgctttcagtcattcagggaaacagaaagacgttttccaacatgtagaactgctttttaactggaggaaaaatacttcaggaggcttagcatattgcttggattctacgtgcagcgggttctctgcctccgtgaagacaagctgggctggggagaacggtgtctaggagggatgaccccactcagctccaggcagtgttctgccgagaccccaagaactcggggtgtcagagggcaaaggaactacctgcctttcacggctgctgacttctcagggctgcaagcagcacagaatgttatccttacgtcctgagccggtttaagtctgtggaaaaggaagcacgggagaaatccacgtaacctttgctttctttttaagggaagcggttccgccgtgaacttggaaccctcagctccgggtgttctcggcagaagggcagctggaagggacacagtggggcaggctttggggttgctccctgttctgccccgaggccggggacgcagggcagcccacgcctccgtgggctccattctgtagcattgccagcgttctcttcacgtctctaacaatccttcgcttttcctcactcacgtggaaatgtgaactgtcccggctctgtcttcatttttatttttaagccatcgttcccctcctgaacggttgccccttatttaatgctgtaaagttggactgttgttcaataaaccagagcaatgc

SEQ ID NO: 204257 - DNA, 4510 bp, Homo sapiens
  Payload ID: 20279
  Gene Name: zinc finger, BED-type containing 1
  Uniprot ID: O96006
  ENST ID: ENST00000381223
  CDS Start-End: 205-2289
cgcgggcggcgcggaagcggcggcggcgcggccggggcagccatgtcgccattgtctgcggcgcgggcggccctgcgggtctacgcggtaggcgccgcggtgatcctggcgcagctgctgcggcgctgccgcgggggcttcctggagccagcaggtccccacgcatgagcagccgtccagcaggcaggctccggtggagaagcaatggagaataaaagcctggagagctcccagacagacctgaagctggtggcccacccccgcgccaagagcaaggtgtggaagtatttcggcttcgacaccaacgccgagggatgcatcctgcagtggaagaaaatctactgccgcatctgcatggcccagatcgcctactccggaaacacctccaacctgtcctaccacctggagaagaaccaccccgaggaattctgcgagttcgtcaagagcaacacggagcagatgcgtgaagccttcgccaccgccttctccaagctgaagcccgagtcgtcccagcagcccgggcaggacgcgctggccgtcaaggccggccacggctacgacagcaagaagcagcaggagctgacggccgccgtgctgggcctcatctgcgaggggctgtacccagcctccatcgtggacgagcccaccttcaaggtgctgctgaagacggccgacccccggtatgagctgcccagccggaagtacatctctaccaaggccatccctgagaagtacggggccgtccgggaggtgatcctgaaggagctggccgaggccacctggtgtggcatctccaccgacatgtggaggagtgagaatcagaaccgcgcctacgtcacgctggccgcccacttcctgggcctgggcgcccccaactgcctgtccatgggctcccgctgcctgaagaccttcgaggtgcccgaagagaacacggcggagaccatcacgcgagtgctctatgaggtcttcatcgagtggggcatcagcgccaaggtcttcggggccaccaccaactatggcaaggacatcgtgaaggcgtgctccctgctggacgtcgcagtgcacatgccctgcctgggccacaccttcaatgccggcatccagcaggccttccagctcccgaagctgggggcgctgctgtcgcgctgccgcaaactggtggagtacttccagcagtctgccgtggccatgtacatgctctatgagaagcagaagcagcagaacgtggcccactgcatgctggtgagcaaccgcgtctcctggtgggggagcacgctggccatgctgcagcgcctcaaggagcagcagttcgtcatcgccggggtcttggtggaggacagcaacaaccaccacctcatgctggaggccagcgagtgggccaccatcgaggggctggtggagctcctgcagcccttcaagcaggtggccgagatgctgtcggcctccaggtaccccaccatcagcatggtgaagccgctgctgcacatgctcctgaacaccacgctcaacatcaaggagaccgactccaaggagctcagcatggccaaggaggtcatcgccaaggagctttccaagacctaccaggagacgcccgagatcgacatgtttctcaacgtggccaccttcctggacccccgctacaagaggctgcccttcctctccgccttcgagcggcagcaggtggagaatcgcgtggtggaagaggccaagggcctgctggacaaggtcaaagacggcggctaccggccggctgaggacaagatcttcccggtgcccgaggagcctcccgtcaagaagctcatgcggacatccacgccgccgcccgccagcgtcatcaacaacatgctggccgagatcttctgccagacaggcggcgtggaggaccaggaagagtggcatgcccaggtggtggaggagctgagcaacttcaagtcccagaaggtgcttggcctcaacgaagaccccctcaagtggtggtcagaccgcctggccctcttccccctgctgcccaaggtgctgcagaagtactggtgcgtgacggccacgcgcgtcgcccctgagcgtctcttcggatccgccgccaacgtggtcagcgccaagaggaaccggctggctcccgcgcacgtggacgagcaggtgtttctgtatgagaacgcccggagtggggcagaggcggaacccgaggaccaggacgagggggagtggggcctggaccaggagcaggtgttctccttgggggatggcgtcagcggcggtttctttggcattagggacagcagcttcctgtagcgaggaagcgtgttgtcttacaagtcatccccgcagcagcccattggatgctttgctgtaaatacttacccggtcagcttggttttgaacctcagagaccatccactgtctttgacacctagaaggtggaaaaaggaaagagatttgagaagtgagagagggtcgggggcggtggctcctgtctataatcgcagcactttgggaggccgaggtgggcagatcagctgaggtcaggagatcgagaccagcctggccaacatggcgaaaccccgtctctactaaaaatacaaaaattagccaggactgatggcatgtgcctgtaatcccagcttctggaggctgaggccagagaatcgcttgaacctgggaggtggaggttgcagtaagctgagatcgctgcactccagcctgggcgacaagagcgagactctctcaaaaagaaaaaagaagacacaagagaggtggctttgagtgggtttcctttcctcccctattcccggggcccggacgacttctgcttgggaactgccaacgcttctgcttgggaattgcgtgcagcagagcctagaggagctgttccttccttcacagatacttaagacctccaccatgtctgattcgagttctccctgggagggtttagaagaaacgcaggaacattctgggtggcgtcgaaggagcctttcccgatcatcatgtgtgacttctgcgaggtccagatcactgaattcatgtttacattctcgtgcaagcagggacctcttgcttctgagaaatggggaagagaccttttagccaaaatgcccttcttaaaaagagagacctttttttttaatgttcggttaaaaatgtgacagatgagtacaaaaatgcagacacttaacaaaaagcaaacagaaaaaaaagtgtggaatgtgttgtattttcgacaggttgctgccagagagcctgcttcctgctgcctgccgaaatttcactttgcggagttggtccttaaaactgggcggtggccgggcgtggtggctcacgctgaggtcaggagttcgagaccagcctggccaaccaacatggtgaaacctcgtgtctactaaaaatacaagaaactagccagatgcggtggcacccgcctgtaatcccagctactcgggaggctgaggcggaagattcgcttgagcccaggaggtggaggttgcagtgagccaagactacgccactgcactccagcctggaggccagagtgagactccgtctcaaaacaaaacaaaagtgggtggctcacgggtccggaggttatgtcttcggtgtctcagccctaaaagtccagttcccccgtgcggccagcttttccacataaggtgtttttgatttgattaccggaaaggactcttgattcttctcttttaaactgaataccataggggaaatgaattttaaaatattgcccccggaggggttttccgtggctggattcctgcgagttgctttcagtcattcagggaaacagaaagacgttttccaacatgtagaactgctttttaactggaggaaaaatacttcaggaggcttagcatattgcttggattctacgtgcagcgggttctctgcctccgtgaagacaagctgggctggggagaacggtgtctaggagggatgaccccactcagctccaggcagtgttctgccgagaccccaagaactcggggtgtcagagggcaaaggaactacctgcctttcacggctgctgacttctcagggctgcaagcagcacagaatgttatccttacgtcctgagccggtttaagtctgtggaaaaggaagcacgggagaaatccacgtaacctttgctttctttttaagggaagcggttccgccgtgaacttggaaccctcagctccgggtgttctcggcagaagggcagctggaagggacacagtggggcaggctttggggttgctccctgttctgccccgaggccggggacgcagggcagcccacgcctccgtgggctccattctgtagcattgccagcgttctcttcacgtctctaacaatccttcgcttttcctcactcacgtggaaatgtgaactgtcccggctctgtcttcatttttatttttaagccatcgttcccctcctgaacggttgccccttatttaatgctgtaaagttggactgttgttcaataaaccagagcaatgcattagctcctcattcatttgtc

SEQ ID NO: 204258 - DNA, 947 bp, Homo sapiens
  Payload ID: 20279
  Gene Name: zinc finger, BED-type containing 1
  ENST ID: ENST00000461691
  CDS Start-End: 133-947
ctgcgggtctacgcggtaggcgccgcggtgatcctggcgcagctgctgcggcgctgccgcgggggcttcctggagccagcaggtccccacgcatgagcagccgtccagcaggcaggctccggtggagaagcaatggagaataaaagcctggagagctcccagacagacctgaagctggtggcccacccccgcgccaagagcaaggtgtggaagtatttcggcttcgacaccaacgccgagggatgcatcctgcagtggaagaaaatctactgccgcatctgcatggcccagatcgcctactccggaaacacctccaacctgtcctaccacctggagaagaaccaccccgaggaattctgcgagttcgtcaagagcaacacggagcagatgcgtgaagccttcgccaccgccttctccaagctgaagcccgagtcgtcccagcagcccgggcaggacgcgctggccgtcaaggccggccacggctacgacagcaagaagcagcaggagctgacggccgccgtgctgggcctcatctgcgaggggctgtacccagcctccatcgtggacgagcccaccttcaaggtgctgctgaagacggccgacccccggtatgagctgcccagccggaagtacatctctaccaaggccatccctgagaagtacggggccgtccgggaggtgatcctgaaggagctggccgaggccacctggtgtggcatctccaccgacatgtggaggagtgagaatcagaaccgcgcctacgtcacgctggccgcccacttcctgggcctgggcgcccccaactgcctgtccatgggctcccgctgcctgaagaccttcgaggtgcccgaagagaacacggcggagaccatcacgcgagtgctctatgaggtcttcatcgagtggggcatcagcgccaaggtcttcggggccaccaccaactatgg

SEQ ID NO: 204259 - DNA, 2311 bp, Homo sapiens
  Payload ID: 20280
  Gene Name: zinc finger, BED-type containing 2
  Uniprot ID: Q9BTP6
  ENST ID: ENST00000317012
  CDS Start-End: 1010-1666
gcttccctagaagtgggaggaaaccagaactggaggtgccctccttctgggggtaggagtcagctaatagacatccaaggtgtgcaggagtgctttcactctgcgcaggaaagatcagagagaagtccagagccttgcctgcttgtgatcctggtggagaaggtggagtatggtgagctgcttgctaaggacagccaggcaacgctgtgtttgtgaagatgtgctccaccttctcctctgtgcatcccagctcctcctgctgaaacagctgagcttgctttttggatttcttagactcctggcctctgagagacacctctaaggacaaactgaccttgcattgggaactttattatccagatcctcataggctttgtctactctggattgcttgttgcaacagttcttaggaagcaagattgtctcctgcaccagcatctgcctgtgtttgcttttacctactttgagcaagacccagtgaggccctagctctgttggtcctgaaaagcctgaaccctgaggctgtttctcctgcctccaaaatgcaattataggaaataagaagcacagaaacagtggaaacaaccaggaggagaaacaagaaaacctaaaattttcaatattcaaaaatacctgtcgtggtggttgatgcagaaaacactgagttcatcaaagagctttgtaattgttggaccagagaacccctttgctacaggaactgatatgttttgtctttctggcctagtcaagggaggataagtaagtatctggggcatggaaggaatgcactcttgggctgttttgcttgtatctgactcacccctgactctccagtgaagcagaaaggaagaaacctcacaccacccaggtgtggccagactttggccattattgtgaatccccaagagttaccacaggcccttcccaaatatatatttaatcttgtggttcaaataagcttttggctcacatctaagcacatcataaagaacgctgtagaagaggtgacatgatgaggcgggaagacgaggaagaggagggaacaatgatgaaggcaaaaggggacttagagatgaaggaggaggaagagattagtgagacaggagaactggttggcccttttgtgagtgctatgcccactccaatgccccacaacaagggcacccggttctctgaggcatgggaatatttccacctagctcctgctcgtgctgggcaccatcccaaccagtatgccacctgccgcctgtgtggcaggcaggtgagccgtggccctggggtcaacgtgggcaccactgcactgtggaagcatctgaaaagcatgcacagagaggagctggagaagagtggccatggtcaggctgggcagcgccaggatccaaggccccacgggccccagctccccacaggcattgagggtaactggggtaggctcctggagcaggtgggcaccatggctttgtgggccagccaaagggaaaaggaggtgcttaggagggaaagggcagtggaatggcgggagagggctgtggaaaaaagggagcgagccctggaggaggtggaaagggccatcctggagatgaagtggaaggtgagggctgagaaggaggcatgccagcgggagaaagagctgcctgcagcagtacatcccttccattttgtttaaattgggcttggagaatctattctgaaaacattgactctagacttgtagaaaagagccattttagtttcaactcaaatgtaaagcaaagtagtttggtgacattttgcttttatgtgaaatagtgcacagtatgagttaatctgagcaggtctgaattgaccaaatgcttatctacgaggttcctagagctctgctgacccttggccgaaactctaaaatgtacctattaaagataaatgcttctaccaaagtaaaactctgtgagttgtttcagggcagaatgtaccagccagtcagcgttgtttaacaaaataatcagatttttgcctagcactcggttttggtggagctgacgattttgagggctgaggctggttaggtagctggaatgtgcctatgtgaccagctcacttgcagacaccctgccggaagcagagcttaatcttcctaggactgaggtcttagcacatgtactggtggagtttccagaccaccagtatgaataaaagcttgttctgtgtgacccagcaagtggaaggacaaagaactgtgagcctcagatctttggacctttccaatgcgtctctttctcctgttattgctgcaatgtattttcttgcttatattaaagttgtttcatcagta

SEQ ID NO: 204260 - DNA, 6172 bp, Homo sapiens
  Payload ID: 20281
  Gene Name: zinc finger, BED-type containing 3
  Uniprot ID: Q96IU2
  ENST ID: ENST00000255198
  CDS Start-End: 366-1070
tttcagagcgactcccctaccgctttcgggcgaaggccacacgtgacggcccccctttccccgcagacgtgtgaatgcagcgctgtgtctttaaggggcacgcgcggaggttttccgtccgggacaaaatgtcagcgaggcgcctggagggggatctaccatctcggactcccgacccgccgccggctccggccgcgtttcccgggtaaagggcactgctgatggttcttcagaactcaggaatcgtgttgcatgcattgtttctacccacctgagatggttggaaaccctgaggcaatgacagggaccccagaatccttgggaaattacccactgtctaatttaaagcgtgcgggcgccgcagaatgaggagtggcgagccggcctgcaccatggaccaggcccgcgggctggacgacgcggcggcgcggggcggtcagtgtccgggactggggccggcgccgacgccgacgcctcccggccgcctgggggcgccatactccgaggcctggggctacttccacctggcgccggggcgccccgggcatccgtcgggccactgggccacctgccgtctgtgcggggagcaggtgggccgcggcccgggcttccacgcggggacctcggcgttgtggaggcacctgaggagcgcgcaccggcgggagctggagagcagcggcgccgggagctccccacctgccgcgccctgcccgccgccgcccggccccgctgcggcccccgagggcgactgggcgcgcctgctggaacagatgggcgcgctggccgtgcgcggcagccggcgggagcgggagctggagcggcgcgagctggccgtggagcagggcgagcgcgccctggagcggaggcggagggcgctgcaggaggaagagcgcgccgcggcccaggcgcgccgggaactgcaggccgagcgggaggcgctgcaggcgcggctgcgggatgtgagccgccgtgagggcgccctgggctgggcccccgctgcgccgccgccgctcaaggacgaccccgagggtgacagggacggctgcgtcatcacaaaggtcctcctgtaggggtgtggccacttccccaccccaggacagcgcttctccgtccaatgccaatgccttcagaccccgctgggaccgaagccgtaaccgaagccaggcccgcagccgctactcactcggaagctccagctaactgtaggatcttccacaccctaaggcttcagcttgagaagcacttcgaagccagagcagaaccaaaactcacttccatggggtcaccgggggtgcctgggcggcctttcgtgggcatgcacgcaaggaattggggtggcacacgggacacccgagagctccaggagccccgtgaacccagaccacccagtgccatggccacttagggctgggaacccgaacctggtgactttgaaaggatagagcttcattccataccaaagacttatcacaccatgtgcctatacacccagcagcccaaggtggagggtgcgtggaaatgagaaagctttttacccaaaaaaaaaaaaaaaagagttcctaatgcataatctgcccaacaccaagttctgaagggtgggtgagggacgtcccctctagtttccatgactgctgtagacccgcatcatctctagccctcatcggggcagtcccagagcccgcttttttactgcccatattattcaaccaataccaggtgcactctgtctcccctcggccatccttcccttgcttcagacctaatgacaagtgtggcacatatgtccactttcaggcctcacatctgccaccttagcaagacatcacctcatccccttgtcactaggaagagggcttcttccccacatgtcgtcatagtgctcacctctgggctgaaggggaaagcatccctccgcttaaggccacatctacctgtcattttccatcccattcctctcccacgtttactgggtctttcctcctgtagtattccccctttcgctgtctcagtccctccctttcccccaggctcttcttcctcagcaatgtgcagtctccctttcttactgaaaagaaagacttaacccagaagggccaacaagtcctggctgcctatccttcctccccagtttttactccctcactctgggtcagttttcttttctttttttctttatgtgtgtatatattatatatatatatacatatatacatatatatatacatatatacatatatatatacatatatacatatatatatacatatatacatatacatatatatatatatatatatatgtatatataatactttaagttctagggtgcatgtcagttttctatgcttcaccagactatttccaagctgccacaatctcccagtgaccaaatatgatgatctatttgcagccttcattttgcttaatctctcccttgaaattgctctcttggtaggtggatcctgtttttccttcaaagaattccttttcctgttgcatactggttcccagtttttccataggcctcttttttttcttatttttttatattgaaaaattccacacatccagaaaaagttgaaaggctagcacaatgaatactcagatacatactctccacttggattgaatagttgttaacattttgccagatttactattctctccaccccatgcatgtgtacatagaatgacatttcgacccctgagtattaccacatagatttcctgagcacaaagacaccgttctacatgattacattaagatgatcatgcctaaaaatataaacagtaacttctttatagcctctaatacagagcccttaatcagtattcaacaattgtctccagaatgtttgtctttaaaaacaacgacaacaaccaggtcccatcaaggttcatacattcttttggtttcaactctagtcactttcagtctacaacaaccccaacatattttcccatgatactttttgaagcatccaggccagctgtcttagcaaatgtcctctattctggaagtgtctgattgcttccttaggcctatgtctacactccactcgtggctcatatccctgcagagttgtaatctcctctgggccagggactcctgaatatctccaggccgagtgttctccccgggcctggagaaaaccttcatgcccaatcccttgctgcatgtctccacccctccttgcacatcctgcctctatgagtggacgaggcaaatctactcaaccccacatcccacccctcacctgataactaacatttactgggcactaacaatgtatcaggcacatactacacacttaacatgcattgctttcacataccagctccatggtaacattgcgctggctttacagctaaagaaactgagctagaaaggggttaagtatcctgtacaagatcacagctggccagcaatagaggtgggatcccactgcagacagtctcccccacagatgccatgctcccactgtaccaccatgtactgcttcctgagatctctgcttccttcagtcgacccagctgacacctgtttccttcctaactccaactaattaattccagttaatggaattgactggaattagtgacattaatatttactgagcattccccatgtgtcatcagagctgtgctaaatgctttacaagaataattacctgccataaagcaaccctatgacataggtgctactatgcccattttgtagatgagacaggttcaggggagttagtatcaccttcaagtcatacagtggctaagaatctgtggtctcgctgaatgctgggcgcctgctctgctaagtctatttctacaaaacattgcactgccttcctgttgcctgccaagctcagggcccatttatcatgcatcttcccatccttgtctcccccaactgtcccttacctgagtcacaatttcgccaaagccaaagggattgtcctaagccaatgttgatttatcactcttcctgctcaaaagcccccaagatcacctatcaatcacctacttgagtgcaagctttgactctgtcacctgacattcaagtccccctctgcccccatgccagtcttatcccctcccctacatatgccctatcctgcagccaaattggactctgttcttcctgacaagacctggtattggcatctctatgcctcagtttgccttccctccactttaaaaagcctcttcagtctcgatacaaaaaacatcccacacatgttctaaaaccatgctttccttgatttctcctcatgtcaagacatttcttacttctctagtctcctagcattttgtgcctcacaaccctcaggacaggccagctagtgtatggctgtgggtttttatctcacctcccctgcctgaccctgagcccttgtggggagtatactcaccctactcctacagtgccttgcattccgtagctgctcagtacattaacccattcaatgtctttaagatttttacaagttagttttcctgtaattactaatcatttatctttaattctgagtaaaattcacaacaacaaataaaaggaaatagtagtaattttttaagctgtttagtcaataaagatttaatgcgtcagttattggactgtttggtttgaagccaatcaaccattctggtatgtaaatctacttttttattatacaagtaacacaaaatgtattgcctcagtcaaggaagaagaacagaaaaaaacaacaccccaaaatcctgtcacctctgtaaaactgctattaattaacattttaatatattttcttttgtcttttgcaatttttatattactctaagttattttcaagtattggaacttaacttcttcatatggatttataaattgggctagatgatctgaatttcctttttagaaggaaaaaaaaagacttccacaaatgttactcttctatctcaccaattgtaagaaccattaaaacataggaaaggatttagaatcttaactactccctcaaagatggctagtgcgagcctgaatgtcctgttcaggagacagagaacaattaacctgagtgctgagttaagggaagaggtttttactttctgctttatacacttctgcattgttgtaattttttacacaaagtatgaattacttttatgataaaaaaattttgtttgtagacaacattcctctccttcagcattcagcatccttagttaaaataaaatctccaacgaaagcatggatataatccccatttccagaaaatcccagaaagaaatgcagcccttgttcagtccaactccatcatttgatagattaggaaaataggttctagagagtgacttgtccactgtcaggagatggtgactgtggcgcgtcatctgactccagcctacttaatgcatttcagtctctttggccttaagggctcctgctgctcacctgaaatcattcccaaggaacccacaagagcaggttccctgggaggattcctgagaacacctacacacaagcctcagagatctgccaagacattctctttctgataaatactattaaatatttttctatcaaatagttgccaaatgacctgctccagtcaaaactcaatctgacttgtgactacaaagtaatctgaggaatcccaaaggtatataaaaatctatccatctaagtcatctctcttcaaagtagaagacctggaagactatacagttattcccaaaatgcttcaacatttctggaactcctcttttagagtggccatgagtccctagcacattctttaaaacatccttgagttggcaaatactcctctttccaggataaatttgattttttaaaagaactgccaattattcagtctggtgaatatggtagatgattaaccagattaacatttctggttaataaggtgagattataataaaacaatgataattattttagtgtggctcataaattggtcttgatagtggtatattaaggttaagtaaaggcagcatggtcaccatacagattaaagcccattttagttggtttatgatgtgaatgaattcaggtagcactgggagtcattatatgtttaaatagtattaaaggtttctttttataaaaatcttaattatgacattctctgaaatctggtttcacagtattaaaatgaggctttaaggaaaaaca

SEQ ID NO: 204261 - DNA, 542 bp, Homo sapiens
  Payload ID: 20281
  Gene Name: zinc finger, BED-type containing 3
  ENST ID: ENST00000511587
  CDS Start-End: 91-542
cgcctggagggggatctaccatctcggactcccgacccgccgccggctccggccgcgtttcccgggtaaagggcgtgcgggcgccgcagaatgaggagtggcgagccggcctgcaccatggaccaggcccgcgggctggacgacgcggcggcgcggggcggtcagtgtccgggactggggccggcgccgacgccgacgcctcccggccgcctgggggcgccatactccgaggcctggggctacttccacctggcgccggggcgccccgggcatccgtcgggccactgggccacctgccgtctgtgcggggagcaggtgggccgcggcccgggcttccacgcggggacctcggcgttgtggaggcacctgaggagcgcgcaccggcgggagctggagagcagcggcgccgggagctccccacctgccgcgccctgcccgccgccgcccggccccgctgcggcccccgagggcgactgggcgcgcctgctggaacagatgggcgcgctggccgtgcgcggcagccggcgggagcgggagctgga

SEQ ID NO: 204262 - DNA, 6893 bp, Homo sapiens
  Payload ID: 20282
  Gene Name: zinc finger, BED-type containing 4
  Uniprot ID: O75132
  ENST ID: ENST00000216268
  CDS Start-End: 478-3993
gcgcagcgtccggcggcgtcgcgggcggcgggcggcggggccgcgggaggggcgcgggggcagacaaagccgcggtaatgaatggagcgtccgcccgcgccgccgtcgtccgcagccggccgggagccgccccagaggccgggccgaggtaatgcacaagggtcacgtgtatgctctcaagatgatcaggcagatcctgtcctcaggaccagaagcacgtctctgctgcacacattgttgtctacaccatgagtgtttagtagcaggactcttggaaagcagtgatctatgctgtaagaccatgagtcacagattctttttttcagtactatttatgattagccatatttctagaaacatcctgaaagatggaattatgacgaaaaagtgaagataatctacattcgggggcacaaatgagcacttggatcagtgttttatgaacctaagatacagccggagtagttatggtcagtcatggagaataacttgaaaacttgtcccaaagaggacggtgatttcgtttctgataaaataaagtttaaaatagaagaggaagatgatgatggaattcctcctgatagtttggaaagaatggactttaaaagcgagcaggaggacatgaagcagacagacagcggtggggagcgagcgggcctcggtgggacgggttgcagctgcaagcccccggggaagtacttgtctgcagagagtgaggatgactatggcgcgctgttctcccagtacagcagcaccctatacgacgtggccatggaggccgtgacccagagcctcctttccagccggaacatgagctccaggaagaagtctccagcctggaagcatttttttatctctccccgagacagcactaaagcaatatgcatgtactgtgtgaaggagttcagcagaggcaaaaacgagaaagacttgagtaccagttgtctcatgaggcacgtgaggcgcgcacacccgaccgtgctcattcaggaaaatggcagtgtgtctgccgtgtcctcgttcccctctccctcactcctgcttccaccacagcctgcggacgcgggtgacctcagcaccatcctctcacccatcaaacttgtccagaaagtggcgtctaagatcccgtcccccgatcgaataacagaggagtctgtgtctgtagtttcttctgaagaaatctcctctgacatgtccgtttcggagaagtgcggcagagaagaagccctggtggggtcgtctccccacctccctgctctccattacgatgaacctgcagagaacttagcggagaagagccttccacttccaaagagcacctctgggtccaggagaaggtccgctgtctggaagcacttctacctgtcgccactggacaactccaaagctgtctgcattcactgcatgaacgagttcagccgggggaagaatgggaaggacctgggcacgagctgcctcatcaggcacatgtggagggcacaccgcgccatcgtgttgcaggagaacgggggcacgggcatcccgccactgtactccacccctcccactctgctgccttccttgctgccgccggagggggagctcagctctgtgtcctcgtctccagtaaagccggtcagagagtccccttcggcctcctcctcccctgacaggctgactgaggacttgcagtctcacttgaaccctggagatgggctgatggaagacgtggcggccttctcatcttccgatgacataggggaggcctcggcgtcctctcctgagaagcagcaggctgatgggctgagtcctagattgtttgaatctggcgccatcttccagcagaataaaaaggtcatgaaaagactgaagtcggaggtctggcatcacttctccctggcccccatggacagcctcaaggccgagtgtcggtactgcggctgtgccatcagccgggggaagaagggtgatgtgggcaccagctgcctgatgagacatctctaccggcgccatccagaagttgtcgggagccagaagggcttcctgggtgcaagtctggcaaactctccgtatgccactttggcctctgcagaaagttcctcttccaaattgactgacttgccaacagtggtcacaaaaaacaatcaagttatgtttcctgttaatagcaaaaagacctcgaagctgtggaatcatttttctatttgctccgcagactccacaaaagtcgtgtgcttgcactgtggccggaccatcagccgggggaagaagccgactaacttgggtaccagctgtcttctgagacatttacagcggttccatagcaacgtgctgaaaactgaggtctcggagacggctcggccctcctctccggacacccgggtgccgcggggcacagaattatcaggcgcttcctcttttgatgacaccaatgagaagttttacgattctcacccagttgccaaaaaaatcacaagtctcatagctgaaatgattgcacttgacctccagccatattcttttgtagacaacgttggctttaacaggctgcttgaatacttgaaacctcagtactccctccccgccccttcctacttctccaggacagctatcccaggtatgtatgataatgtgaagcagataattatgtcccaccttaaggaagctgagagtggtgtgatccacttcacgtctggaatatggatgagtaaccagacccgtgagtacctgaccctcacggcccactgggtttccttcgagtcgccagcccggccgcgctgtgacgaccaccactgctcggcgctgttggacgtgtcgcaggtggactgcgactacagtggcaacagcattcagaagcagctggagtgctggtgggaagcgtgggtgacctccaccggccttcaggtgggcatcaccgtcaccgacaacgccagcatcgggaagacgctgaacgagggggagcactcgagcgtgcagtgcttcagccatacggtgaacctgatcgtcagcgaggccattaagagccagcggatggtgcagaacctgctgagcctcgcccggaagatctgcgagcgggtgcaccggtcgcccaaggcgaaggagaaactggccgagctgcagagggagtacgcgctgcctcagcatcacctcatccaggacgtcccgtccaagtggagcacttccttccacatgctcgagcggctcattgagcagaaaagggccattaacgagatgtccgtcgagtgtaacttccgagagctgatcagctgcgaccagtgggaggtcatgcagtccgtgtgccgtgcgctaaagcccttcgaggctgcgagccgggagatgagcacgcagatgtccaccctcagccaggtcatccccatggtacacatcctcaacaggaaggtggagatgctcttcgaggagacgatgggcatcgacaccatgctgcgctctctgaaggaggccatggtgagccgcctgtctgccaccctccacgacccgcggtacgtcttcgccacgctgctggatcctcgctacaaggcctccctgtttacggaggaggaggcggagcagtacaaacaggatttaatcagggaactcgaactcatgaattctacctcagaggacgtggctgcctcccacaggtgtgatgctggctccccgtcgaaagactctgccgcagaggagaacctgtggtcacttgtggccaaggtgaagaagaaagacccaagagaaaagctgcctgaagccatggtgcttgcgtatctggaggaggaggtgcttgaacacagctgtgacccgctcacctactggaacctgaagaaggcgtcctggccggggctgtccgcgctggccgtcagatttttgggctgccccccaagcatcgtcccttcagaaaagctgttcaacacacccactgagaacggtagccttggccaatccaggctcatgatggaacattttgaaaaacttatctttttgaaagtgaatcttcccttaatatactttcagtattgaaactcacgacggcaccactaggccagaggcgtggctgccccagcgttagcagcctgtaccaggtctatgacccgctctgcccacggctgtgtacgacatcagaccaggcactctcagggccgctctccagctcaccacagtgtctccacgtgccttaccccttctccttcaggccaagtttcgcggggtgttttattaagacgtccactagaaatagcttgtcctgtcaactatgaaatatggtgactagattttaattcataaccgtaaagttttttaaagttttgggttagtaatttgttttactagaatgacaaagaagatgtaaaccattttattctgtaggctttttactcaattatgtacaaaccacaaatcaggtactgtattttagtgaagcattgctttaattgcaacagaatagcttttgtggctatcaaatgaaatctgtaaataggaggtggagggcaagccatcctgactgagcagtttttaaccgcaggttctaaagtgtcccgcggagtacagataatattctggaaggtaactgtttactacgacagagacgtggcatttggaaacgaaacttagatgtttcatggagcttattttgagaactttcccatttcaggtttctgcattcaggctttacatggtcagttaactcagagataccccagctgtttatcatcagctcctctgaaatgtgatccctttgtaactgtgctcatcacttcgccagtgcgttcaatgacacgctgatggcaggtggtccctgctgaaacccccacgcctccgcttcagcatctccacgctctgaagctgtctttcaaaatgtgtgcactgacccccttgtttgatcaaatttgtgtaaaatttttttagaagagatggcttattaacagggaagaagcttgttatattccagttgtaagaatagccttagtgtttagatttttttatgatagggaagatgcggccatcactgggatattttcaaatcccaaggacatcagagtgaagtgtcagttgtcagatgattttaaaagttatgtcttcagagaaaaaaagattcattttctcattttaaaccaattaaatattctgagtgagactaatcactcatttgcctacgaccttttagaaaagttgttttgttgaaatactgtacgtacgcttaatctaaatttgcattgactatgttttagtgtatttataaatggtgaactcagtttctgaaattaaacttcttatttgcaattttctagtgctggcagacactggctttttatttttaggataagaaaacaggcatattctttgtggtccattatctagagcccatacttgggcagcatttgaaatttcaccttaaccccagacagggctccagggaagtggagatgtaattcttacaacaacagttctgatcatggccatggtgatgactttccaggtctcgtgttcaagtggtgccagaatgcaggagccggtgggcagccctgaggggttgccttggccgcagcctctgtgcacgctcttcctggtgtcctcttacccggtagctgtgcgcttgttcccgtgagaacagcctgcttccagagtgcccaggagtgctggtcagggacagtgcccgtgaggctgcagaggaggtggggtccatggcccacccatctctccctcgccagcagccctggccagtgtcatcctggtgtagaaagggttgcgcacaggataggagggagccacagttcttgcttagctgtgctcacgaccagcttgcagtcctgtgtttcttaagattgtatttggaatggtaatatccttagaattttgggatattgagcttcatggattttctctccaaaacaagccagcacaactaactgtagcagaattgtatccactcattcattcaactgagatgaagtgccctcccttttccagggcctgggctagttcctggaatgcaacagagatttccgtggacacagtctctagtctcacagagcatatagtctagtccacgattggcaagctgcaaccacagacccagtccggcactctgcccatttttctaagtgaaattttcttggaatacagtcacagctgtttttttaacatggtgtcttggctactttcaggctgcgacgggagaactgaatagttgtgacagagaccacaggcccactgaaagggacaaacagggctgaaaatactcactgtttggccctttccagaatagcaagtttgctggcccttgagctagcctgcctttatggggttttttttgtttgtttttttaagctttcagcttcatgctgctgtatttttagttgaagtgttctgagtaacagtcagtgtataaaaggggattgcagaaaaaaatgagggcttgctttactcaacagaaaatatggcccttcctgaatgacactaggagagtcattttatctcatacattcccttcatttcgttggtggacatttgttgaaaccggcactcaatggtcaaaccgtctctgccctccagttgctgacagtcctgcaggaagatggacaagaggcccagtgctgacagtcacacgactctcactacttgaatgaggggactgtgggtgcaactagaaaatatgttgattcttagccattcccaccttgcctctccgttcagaaccccagctgcgagctgtttgtttccctgcctggaaatgatgttttaggcaggttccttaatttctcaggtctgtctcagataataaaaagctctttgtatgagcctcagaactgtctcttcagtgaatgaaattaccagtcattatacgaagggactttaaaaaatttgtggaaatactgaagtaaaagatgataaaaaaataaaaactttatttcttggctggg

SEQ ID NO: 204263 - DNA, 2741 bp, Homo sapiens
  Payload ID: 20283
  Gene Name: zinc finger, BED-type containing 5
  Uniprot ID: Q49AG3
  ENST ID: ENST00000432999
  CDS Start-End: 500-2581
agagtgctaaatttatcttcagaccggcgaccgcgccagccgcgaatcggatctctatggagatggcctaggcgatatccctgagctgagagcatcaccctgtccccgaatccttctttcctctctgttttgtttttcattcccctccctctctcccctccccctccagtccacgacgactggctgttgaccctgttcaggcctcggtgaaggcttttggttactccccttcccaccccatcccttaattttattcttttgaagagtgcatttcaagctgccaaggtggagagagggattacagaaaggagaacaccttatttcagcttttatttttatgtgataatctacctttaagaaaaggtgtaccatacctgagagcaccaggaagtcgcatgagagatcacctgatacatgaacgtatgatgttccatctgcgcattgatgaataggcagcatttacaaattaactgatgtgttgctgtatatcatctctttgatgattgctcctcttctttgtatcctgtcttataatttcaacacatttgcgatactcaatgtctattctaaattaaccatgttttgtaccacaaactcattgcccatggatctgttgctgaaacaaggaagtcttaaacaagaagtggaatctttctgttatcagattgtgtctgaatcaaatgatcagaaggttggaatattacaaagtgaagataagcagttgcaaccttcagtttctaaaaaatcagaaggtgagctttccagggtcaaatttatatccaattccaacaaaataacatttagtaaaaaaccaaaaagaagaaaatatgatgaaagttatttgtcttttggatttacttacttcggaaatagagatgcacctcatgctcagtgtgtattatgtaagaaaattttatcaaatagctctttagcccctagtaagcttcgaagacatttggaaactaaacatgctgcatataaagacaaagacataagctttttcaagcaacatctcgattcacctgaaaataataaacccccaacacctaaaattgtgaatacagataatgaaagtgctacagaagcatcatacaatgtaagttaccatatagcgctgagtggagaggctcatactattggagaattgcttatcaaaccttgtgcaaaagatgtagtgatgcggatgtttgatgaacaatatagtaaaaaaatagatgcagtacagctatcaaacagtactgttgcacgtcgaattaaggatctagctgctgacattgaagaagagcttgtttgtagactgaaaatttgcgatgggttttcactgcaactagatgaatcagctgatgtttcaggacttgctgtgctgcttgtgtttgttcgttataggtttaataagtctattgaggaagacctactcctgtgtgaatctttgcaaagtaatgctaccggtgaagaaatattcaactgtatcaacagttttatgcagaaacatgaaattgaatgggaaaaatgtgttgatgtttgtagtgatgcttctagggcagtggatgggaaaattgccgaagctgtcaccttaataaaatatgtggctcccgaaagcaccagtagtcactgcctattatacagacatgcactggcagttaaaataatgcctacatctctaaaaaatgtgctagaccaggcagtacaaatcatcaattatattaaagctcgaccacatcaatccagactattaaaaattttatgtgaggaaatgggtgctcagcacacagcacttcttctaaatacagaggtgaggtggctttctcgaggtaaagttcttgtaagactttttgaacttcgtcgtgaacttttggttttcatggattctgcttttcgactatctgattgtttaacaaattcatcttggctgctaagacttgcatatcttgcagatatttttactaaattaaatgaagttaatttgtcaatgcaaggaaaaaatgtgaccgtttttacagtatttgataaaatgtcgtcattgttaagaaaattggaattttgggcctcatctgtagaagaagaaaactttgattgttttcctacactcagtgattttttgactgaaattaattctacagttgataaagatatttgcagtgccattgtgcagcacctaaggggtttgcgcgctactctgttaaaatactttcctgtaacaaatgacaataatgcttgggttagaaatccatttacagttactgttaaaccagcttcattagtagcacgggactatgagagcctgattgatttaacatctgattctcaagtgaagcaaaattttagtgaactttcactaaatgatttttggagtagcctaattcaggaatacccaagcattgcaaggcgtgcagtgcgtgtacttcttccttttgctacaatgcacctgtgtgaaacggggttttcatattacgctgcaacaaaaacaaaatataggaaaagacttgatgctgcacctcatatgcgaatccgacttagcaatattacacctaatattaagcggatatgtgataaaaagacacaaaaacactgttctcattaaaattggaggagtttgcatgtctcatgataaccaaatgtaagatgaaaataaaagatgatttacttcatctctggtatttgggggatttaaataaaatgattccatttttttatactatttagattttaagaaggctaaagaatcaaacgttttaaacata

SEQ ID NO: 204264 - DNA, 2512 bp, Homo sapiens
  Payload ID: 20283
  Gene Name: zinc finger, BED-type containing 5
  Uniprot ID: Q49AG3
  ENST ID: ENST00000413761
  CDS Start-End: 431-2512
agccgcgaatcggatctctatggagatggcctaggcgatatccctgagctgagagcatcaccctgtccccgaatccttctttcctctctgttttgtttttcattcccctccctctctcccctccccctccagtccacgacgactggctgttgaccctgttcaggcctcggtgaaggcttttggttactccccttcccaccccatcccttaattttattcttttgaagagtgcatttcaagctgccaaggtggagagagggattacagaaaggagaacaccttatttcagaaaaggtgtaccatacctgagagcaccaggaagtcgcatgagagatcacctgatacatgaacgtatgatgttccatctgcgcattgatgaataggcagcatttacaaattaactgatgtgttgctgtatatcatctctttgatgattgctcctcttctttgtatcctgtcttataatttcaacacatttgcgatactcaatgtctattctaaattaaccatgttttgtaccacaaactcattgcccatggatctgttgctgaaacaaggaagtcttaaacaagaagtggaatctttctgttatcagattgtgtctgaatcaaatgatcagaaggttggaatattacaaagtgaagataagcagttgcaaccttcagtttctaaaaaatcagaaggtgagctttccagggtcaaatttatatccaattccaacaaaataacatttagtaaaaaaccaaaaagaagaaaatatgatgaaagttatttgtcttttggatttacttacttcggaaatagagatgcacctcatgctcagtgtgtattatgtaagaaaattttatcaaatagctctttagcccctagtaagcttcgaagacatttggaaactaaacatgctgcatataaagacaaagacataagctttttcaagcaacatctcgattcacctgaaaataataaacccccaacacctaaaattgtgaatacagataatgaaagtgctacagaagcatcatacaatgtaagttaccatatagcgctgagtggagaggctcatactattggagaattgcttatcaaaccttgtgcaaaagatgtagtgatgcggatgtttgatgaacaatatagtaaaaaaatagatgcagtacagctatcaaacagtactgttgcacgtcgaattaaggatctagctgctgacattgaagaagagcttgtttgtagactgaaaatttgcgatgggttttcactgcaactagatgaatcagctgatgtttcaggacttgctgtgctgcttgtgtttgttcgttataggtttaataagtctattgaggaagacctactcctgtgtgaatctttgcaaagtaatgctaccggtgaagaaatattcaactgtatcaacagttttatgcagaaacatgaaattgaatgggaaaaatgtgttgatgtttgtagtgatgcttctagggcagtggatgggaaaattgccgaagctgtcaccttaataaaatatgtggctcccgaaagcaccagtagtcactgcctattatacagacatgcactggcagttaaaataatgcctacatctctaaaaaatgtgctagaccaggcagtacaaatcatcaattatattaaagctcgaccacatcaatccagactattaaaaattttatgtgaggaaatgggtgctcagcacacagcacttcttctaaatacagaggtgaggtggctttctcgaggtaaagttcttgtaagactttttgaacttcgtcgtgaacttttggttttcatggattctgcttttcgactatctgattgtttaacaaattcatcttggctgctaagacttgcatatcttgcagatatttttactaaattaaatgaagttaatttgtcaatgcaaggaaaaaatgtgaccgtttttacagtatttgataaaatgtcgtcattgttaagaaaattggaattttgggcctcatctgtagaagaagaaaactttgattgttttcctacactcagtgattttttgactgaaattaattctacagttgataaagatatttgcagtgccattgtgcagcacctaaggggtttgcgcgctactctgttaaaatactttcctgtaacaaatgacaataatgcttgggttagaaatccatttacagttactgttaaaccagcttcattagtagcacgggactatgagagcctgattgatttaacatctgattctcaagtgaagcaaaattttagtgaactttcactaaatgatttttggagtagcctaattcaggaatacccaagcattgcaaggcgtgcagtgcgtgtacttcttccttttgctacaatgcacctgtgtgaaacggggttttcatattacgctgcaacaaaaacaaaatataggaaaagacttgatgctgcacctcatatgcgaatccgacttagcaatattacacctaatattaagcggatatgtgataaaaagacacaaaaacactgttctcattaa

SEQ ID NO: 204265 - DNA, 586 bp, Homo sapiens
  Payload ID: 20283
  Gene Name: zinc finger, BED-type containing 5
  ENST ID: ENST00000528289
  CDS Start-End: 408-586
aaatttatcttcagaccggcgaccgcgccagccgcgaatcggatctctatggagatggcctaggcgatatccctgagctgagagcatcaccctgtccccgaatccttctttcctctctgttttgtttttcattcccctccctctctcccctccccctccagtccacgacgactggctgttgaccctgttcaggcctcggtgaagagtgcatttcaagctgccaaggtggagagagggattacagaaaggagaacaccttatttcagaaaaggtgtaccatacctgagagcaccaggaagtcgcatgagagatcacctgatacatgaacgtatgatgttccatctgcgcattgatgaataggcagcatttacaaattaactgatgtgttgctgtatatcatctctttgatgattgctcctcttctttgtatcctgtcttataatttcaacacatttgcgatactcaatgtctattctaaattaaccatgttttgtaccacaaactcattgcccatggatctgttgctgaaacaaggaagtcttaaacaagaagtggaatctttctgttatcagattgtgtctgaatc

SEQ ID NO: 204266 - DNA, 1512 bp, Homo sapiens
  Payload ID: 20283
  Gene Name: zinc finger, BED-type containing 5
  ENST ID: ENST00000526020
  CDS Start-End: 1186-1512
ggacgctgcggtgccgctttccctatccagtcctgttcccgcggctccccagcctaccccgggccgaccaagaggtccggcggggtctgcgccgcatcagcgcccgctcgtcaggcctagccctccgcacagccaaggccgaccagacctctagacactccgtcgtcgggtgtggggcggagaagtaaagggcgagttttcttcctagattccagtgggaaccaagaaaaggagttggcagctgtgtaaactggacctggggtgcggcctccgggaacaaaagaggtgataaatgcacagcagccgaggttctgcgtgctcctttggggccactacgaatccccgtgaatcaccccagcccgggcagagggccagaaatgatgaaaatgcagattcatggcttccactccagccctacaagatcaccaaccgtatctggcagtacccaggaatctgcattctcgacaagcgtccgcgccgacggggctagtgaagtttgagaacaattgcttcctacccagccgctccgctatcacctaggtagcacggccgctgcggctgaggctgtgactgcggctgcggctgggccgcgcctcaaccgagcttggtcctttcctttggtcccgccccgctgctcagcgcggattggtggcgggacgcaaatctggcgctgattgggcggcggcagagtcgctcgtgaagattgtagggttcgggtgctctagagtgctaaatttatcttcagaccggcgaccgcgccagccgcgaatcggatctctatggagatggcctaggcgatatccctgagctgagagcatcaccctgtccccgaatccttctttcctctctgttttgtttttcattcccctccctctctcccctccccctccagtccacgacgactggctgttgaccctgttcaggcctcggtgaaggcttttggttactccccttcccaccccatcccttaattttattcttttgaagagtgcatttcaagctgccaaggtggagagagggattacagaaaggagaacaccttatttcaggtgtaccatacctgagagcaccaggaagtcgcatgagagatcacctgatacatgaacgtatgatgttccatctgcgcattgatgaataggcagcatttacaaattaactgatgtgttgctgtatatcatctctttgatgattgctcctcttctttgtatcctgtcttataatttcaacacatttgcgatactcaatgtctattctaaattaaccatgttttgtaccacaaactcattgcccatggatctgttgctgaaacaaggaagtcttaaacaagaagtggaatctttctgttatcagattgtgtctgaatcaaatgatcagaaggttggaatattacaaagtgaagataagcagttgcaaccttcagtttctaaaaaatcagaaggtgagctttccagggtcaaatttatatccaattccaacaaaataacatttagtaaaaaaccaaaaagaagaaaa

SEQ ID NO: 204267 - DNA, 879 bp, Homo sapiens
  Payload ID: 20283
  Gene Name: zinc finger, BED-type containing 5
  ENST ID: ENST00000534690
  CDS Start-End: 671-879
gggacgcgagagaagacctgaggcgagggtgggctgcgactggtagggagccccccagtcgtggcaatctgtgggcagcgcgcacctgtgacagggaggagctgagggatagttggccctggctgcacatccaggtgaccgtttaaaaaagcatttaggtgttggaaggagcatctgttcccacctttttggctggcctgcactcagatcctgtcctcctgaccctgagggtattgttcccagccggaaccgcccgaagataggggagaaaggattgtgatacttgtcagtttaaccggaaggagactaaagacggaagttttccccgctcttcagggagtggaaaggaaactttactctcaaaggagtccagattctttgtcctcgagaaattcggggaaacaccttcgaagaggcttttggttactccccttcccaccccatcccttaattttattcttttgaagagtgcatttcaagctgccaaggtggagagagggattacagaaaggagaacaccttatttcagaaaaggtgtaccatacctgagagcaccaggaagtcgcatgagagatcacctgatacatgaacgtatgatgttccatctgcgcattgatgaataggcagcatttacaaattaactgatgtgttgctgtatatcatctctttgatgattgctcctcttctttgtatcctgtcttataatttcaacacatttgcgatactcaatgtctattctaaattaaccatgttttgtaccacaaactcattgcccatggatctgttgctgaaacaaggaagtcttaaacaagaagtggaatctttctgttatcagattgtgtctgaatcaaatgatcagaaggttggaatattacaaag

SEQ ID NO: 204268 - DNA, 789 bp, Homo sapiens
  Payload ID: 20283
  Gene Name: zinc finger, BED-type containing 5
  ENST ID: ENST00000526852
  CDS Start-End: 512-789
aaatggccgcttcctggaactgcctaagatggcggtcgcgggctctgctgtggaccgcggcgctgctgtgcagcccagccgcggcaaaatccgttctctccatcgctgatggagatgaaatagagagatggtgttgggtgctgagacgttttcatgtggtcgttagcgcaggcggccgcccggggacgcgagagaagacctgaggcgagggtgggctgcgactggcttttggttactccccttcccaccccatcccttaattttattcttttgaagagtgcatttcaagctgccaaggtggagagagggattacagaaaggagaacaccttatttcagcttttatttttatgtgataatctacctttaagaaaaggtgtaccatacctgagagcaccaggaagtcgcatgagagatcacctgatacatgaacgtatgatgttccatctgcgcattgatgaataggcagcatttacaaattaactgatgtgttgctgtatatcatctctttgatgattgctcctcttctttgtatcctgtcttataatttcaacacatttgcgatactcaatgtctattctaaattaaccatgttttgtaccacaaactcattgcccatggatctgttgctgaaacaaggaagtcttaaacaagaagtggaatctttctgttatcagattgtgtctgaatcaaatgatcagaaggttggaatattacaaagtgaagataagcagttgcaaccttcagtttctaaaaaatcagaaggtgagctttccagggtcaaatttat

SEQ ID NO: 204269 - DNA, 4250 bp, Homo sapiens
  Payload ID: 20284
  Gene Name: zinc finger, BED-type containing 6
  Uniprot ID: P86452
  ENST ID: ENST00000550078
  CDS Start-End: 1215-4154
agcttgtctcaaactccacatacagaaagccaccgaccttattccggtatcctacacccattccccactctcattacactcccacccctggccctcagcgtcggagtcaagagcaacagggacacttccgttctccttgtaggactggtgaaaccgtaatgaagaacacccctaaactcccataatcggtgcggattcctatggggaaggcctatattgttgacatcttccaggccttggttctggaccttgagaaagaggctgtggaactagagatagcgatgctttttagggtaaatgtatgtaggtattgggggaaggggagggatcaatcgaaaaatggaagtggtttaaagttcatatttcactttttgctatctctatagcgtacaacttgtgagttacttacaggctgtaaaagcttctcaagtctaaaaatatctgaaaactaaacttgaattaactcttaatacaaacagtactttgaaaatgcagcatttaaccttgttttaaaatttttttctcaaagcatttttttccagccactcacattttaaaaggttgtattacttttagttagaactgaaagggctcaactagcatttgctgtgaccagtatgcggagtctgtgttggctttccagaattgactttttgggttgtattggcaaatcacagtcctaaatgatgaatgttgaatgatgcactatgtttttgtttaaatgagatttcctgaaaatagttaatttcagaattaagggaaattgatgtcgctatcatgaggcatcataaaaatatgtattttacaaggtgaaggcatttcaagtagatatagttcttgatgaagcaggaagaacatggatctgggatttggaagacctggcttctagctgctactaaccaactctgtgactctgggaaagggggactcagttcttacttctgtaacatgaggacactggactatttgaattcagaacttagaaaattggaagggaccttaaagccctctaagaaagagttcgggaatgttctccattgctgtcagttttcctccaaaaataacctggcttggaagttattggtccagtgggaatttgattccccatagaaactggagaaaaggtaatgcaagtagagaggaacagctgtatttctgcttgagtaataaacccactaacagattctggtacgaattgtggagacataaagagaatgagtgtatgtactctaagtgtaccagtttcttcactctctcctggcagaagatgcaacacttttagtgattctgggattctgggatgtgttcctattaattctaatacagatgaagaagatgtggtagaggaaaagatggtagcagaaggagtgaataaagaggcaaaacagcctgctaaaaagaaaagaaagaagggtttgcgaattaaggggaaaaggcgtcgaaaaaaattgattcttgccaaaaagtttagtaaggatttgggatctgggaggcctgttgcagatgcccctgctttgttagcttccaatgaccctgagcaggatgaagaaagtctttttgagagcaatatagaaaaacagatctatctacctagtactagagccaagacctccattgtgtggcacttctttcatgttgacccccagtacacctggcgggccatttgtaacctctgtgagaaaagcgtcagcaggggtaaaccaggtagccatcttggtacatctactcttcaacgacatctgcaagcaaggcattcacctcattggaccagggccaacaagtttggagttgctagtggagaggaggactttaccttggatgtgtctttatctccctcttctggaagcaatggaagctttgaatatattcctactgatccattagatgataatagaatgggcaagaagcatgataaatcagcatctgatgccctaagggcagaaagagggagatttctcatcaaaagtaacattgtcaagcatgctttaattcctggaactagagccaagacatctgccgtttggaattttttttacactgatcctcagcacatctcaagagctgtgtgtaatatatgtaaaagaagtgtgagccggggtaggccagggtcccacttagggacttcaacacttcaacgacacctgcaagccacacatcctatccattgggctgttgccaacaaagacagtggtgctgttgcaaatggattagatgaagctgagactgagagaagtgatctcttgagtgataccttgcatggagaaaagtctacaggcagccaagatttaacagctgaggaccttagtgactctgattcagatgaacctatgttagaggttgaaaacagatctgaaagtcctattcccgttgcagagcaaggcactctgatgcgtgcgcaggagagagaaacaacatgttgtggaaatccagtctcaagtcacataagtcaggcaattatccaaatgattgtggaggatatgcatccttacaactatttctcaaccccagcctttcagaggttcatgcagattgtggcccctgattataggttgccatcagagacttactttttcactaaggctgtacctcagttatatgattgtgtcagagaaaaaattttcttaactttagagaatgttcaaagccaaaagatacacctgactgttgacatatggacccatgacccatccactgactattttattgtgactgtacactgggtttctttggaaactgcgtcttttctcaataatggcaggatccccgattttagaaagtgggcagtgctttgtgttacaggtttggctaaagactgtttgataaccaatattttacaagaattaaatgaccagattggtctgtggctttctccaaatttccttatccctagcttcattgtttctgacaattcctctaatgtggtacatgcaatcaaagatggtggttttacccatgtgccatgcttcctgcattgtttaaatatggtcattcaggactttttctgcgagcacaaaagcattgagaatatgttagtggctgccaggaaaacttgtcatcattttagtcattcggtcaaggcccgtcagatactgcaagagttccaaaatgatcaccaacttccatggaagaatttgaagcaggacgaaactggccattggatttctactttttatatgttaaaatggctcttggagcattgctactcagttcaccatagtcttggtagagccagtggagttgtgctcacctcccttcagtggactctaatgacttatgtttgtgatattcttaagccatttgaggaggctacccagaaagtgagcgtgaagaccgcaggattgaatcaggtgctacccctaatccatcatctactcctttccctgcagaaactcagagaagattttcaagtcagaggtattactcaggccctcaatctggtggatagtttatctctgaaacttgaaacagataccctactaagtgccatgcttaaatccaagccctgtatcttggctactttgttagatccttgctttaaaaacagtttggaagacttttttcctcaaggtgctgatttagaaacttataagcagttccttgcagaagaggtctgtaattatatggaatcttcaccagagatctgccaaattccaacttcagaagcttcttgtccctcagttacagtgggagctgattcatttacctcatctctaaaagaaggcacctccagttcaggttctgttgatagctcagctgtagacaatgttgcccttggaagcaaaagcttcatgttcccttctgctgtagcagttgtggatgagtacttcaaagagaagtattcagagttctcaggaggtgatgaccctttaatttactggcagaggaagataagcatatggccggctttgacccaggttgccatccagtatctaagttgccccatgtgtagttggcaatctgaatgtatctttactaaaaatagccactttcatccaaaacagatcatgagcctggactttgacaatatagaacaactgatgtttctgaaaatgaacttgaaaaatgttaactacgattattctacgttggttctgagctgggatcctgagcagaatgaagttgttcaaagcagtgaaaaagaaatactgccttaatttctttttctccatttaaaatgggcaactttttgctgtgttactgtatcttaatagctgtagttgttaaatataatcattatctttataaacaca

SEQ ID NO: 204270 - DNA, 2851 bp, Homo sapiens
  Payload ID: 20285
  Gene Name: zinc finger, BED-type containing 8
  Uniprot ID: Q8IZ13
  ENST ID: ENST00000408953
  CDS Start-End: 509-2293
gtgtgggagacgcctctcccagtttgcgggcgggaagcaccctggagaacccggatggaacccgggcctggctgaggcggaggttgttgcggatgcttctctctccaggcgcaccgcagattcctgcccgggggttggacccgaggaaccgccgtctctactggttccgacggccagaggctgggccctaggctgagcggagagtgggactggagcctgaaacgggcgcctaaaagaagcccgtgcatcccataggcctgcgcctcaggcttggagacgggcgggcggagaccgcgctgagtcttttttttttttttcctagcagctggcgttcttatctcacccgggaggctgtaaaaatctccgtccttaacagtaacaccatcaggtcctatcagttaagagctgcttgttatttgcatgcattcttataattaaatctcctaacaaccctgtaagcaaaattctgtggcatctctggaatactacctgagaatttttgtgtgccatgtcgaagaaacgcaaatgggatgatgactatgttcgctactggttcacctgtacaacggaagtagatggaactcagcgtccacagtgtgtgttgtgtaactcagtattttcaaatgctgacctcagaccatcaaaactgtcagaccattttaacagacagcatggtggtgtagctgggcatgatctcaatagcctgaagcatatgccagcaccatctgatcagagtgaaaccttgaaagcatttggagttgcatctcatgaggatactttattacaagcatcgtatcaatttgcgtatttatgtgccaaggagaagaatcctcatacagtagctgaaaagttagtgaaaccttgtgcactggaaatagcacaaatagttttgggaccagatgcacaaaaaaagcttcagcaggtacccttatcagatgatgtgatccattctagaattgatgaaatgagccaggatatcttacagcaagttctagaagatatcaaagccagtcctcttaaagtgggtattcagcttgctgagacaactgacatggatgactgcagtcagctaatggcatttgtgcgctatataaaagaaagagagatcgtagaagaatttctcttctgtgaaccattgcagctatccatgaaaggaatagatgtgttcaatctcttcagagacttctttctgaagcataagatagcacttgatgtatgtggctctgtttgtactgatggtgcctcctctatgctaggagaaaattccgagtttgttgcctacgtgaaaaaagagatacctcatatcgtagttacacattgtttattgaatcctcatgcacttgtcataaagacattgcctacaaaactgagggatgctctgtttactgtggtgagggtaataaatttcatcaaagggagagctccaaatcatcgcctatttcaggctttctttgaagaaattggcatagaatatagtgtcctccttttccatactgaaatgaggtggctttcccgaggccaaatacttactcacatttttgaaatgtatgaagaaataaatcagtttcttcaccacaagagcagtaatttagttgatggctttgaaaataaagagtttaaaattcacctagcataccttgcagatttattcaaacacttaaatgaactcagtgcatctatgcagaggactgggatgaacacagtatcagctagagagaagttatctgcttttgttaggaagtttccattttggcaaaaacgaattgagaaaagaaattttaccaattttccttttcttgaagaaataattgtttcagataatgaaggcatattcattgcagctgaaataacactgcatctgcaacaattgagcaacttcttccatggatatttttccattggagatcttaatgaggcaagtaaatggatattggatccatttctttttaatatcgattttgttgatgatagttatttaatgaaaaatgatcttgctgaattacgagctagtggccaaatcctaatggaatttgagacaatgaagcttgaggatttctggtgtgcccaattcacagcatttccaaacctggcaaagacagctctagaaatccttatgccatttgcaactacatacctttgtgagttgggattttcatcacttttacatttcaaaacaaagtccagaagctgctttaatctgagtgatgatatccgtgtggctatttcaaaaaaagttcctcgtttctcggacatcattgaacaaaagctacagctacagcagaagtcactgtaagctgatatacttttttaatgaataatttcaatcttaatatcattgtaaaattaagctgtaattctgtctctttcatatttatgatatactgaattctatgtctaaaaaacttaagaactttaattttgaatgaggcatgtgaaaatatgttttgagaataaaaacacagcagaaaagattaagtactactgcctagttgctatcatgagattttcccaattctaagtatctgtttaacctgttcgtgtggtatatgaaaaagatacctaagcactagaatatccagctaaatggtgcaataggctaggaattgagccaggagaaaagagaagatatcccagaagtcaaaaaggcaaaatgaaagattgagttcgcccgtctttgttatggagaggttaatgaaatcagaagaggattatgaaatataatgggaaaaggaatgatctggcttatgtaagacttacttttaaatatactctttggagttagtctcacaatgtccattcccctagctcctgtgctatgaatatcatattaataaatagcctaatatattaa

SEQ ID NO: 204271 - DNA, 2484 bp, Homo sapiens
  Payload ID: 20285
  Gene Name: zinc finger, BED-type containing 8
  Uniprot ID: Q8IZ13
  ENST ID: ENST00000523213
  CDS Start-End: 522-2306
ccgggcctggctgaggcggaggttgttgcggatgcttctctctccaggcgcaccgcagattcctgcccgggggttggacccgaggaaccgccgtctctactggttccgacggccagaggctgggccctaggctgagcggagagtgggactggagcctgaaacgggcgcctaaaagaagcccgtgcatcccataggcctgcgcctcaggcttggagacgggcgggcggagaccgcgctgagtcttttttttttttttcctagcagctggcgttcttatctcacccgggaggctgtaaaaatctccgtccttaacagtaacaccatcaggtcctatcagttaagagctgcttgttatttgcatgcattcttataattaaatctcctaacaaccctgtaagccacattctctggcacagaactttggaaactttggggatcacttacttatcttggagatagaatgttttctaagcaaaattctgtggcatctctggaatactacctgagaatttttgtgtgccatgtcgaagaaacgcaaatgggatgatgactatgttcgctactggttcacctgtacaacggaagtagatggaactcagcgtccacagtgtgtgttgtgtaactcagtattttcaaatgctgacctcagaccatcaaaactgtcagaccattttaacagacagcatggtggtgtagctgggcatgatctcaatagcctgaagcatatgccagcaccatctgatcagagtgaaaccttgaaagcatttggagttgcatctcatgaggatactttattacaagcatcgtatcaatttgcgtatttatgtgccaaggagaagaatcctcatacagtagctgaaaagttagtgaaaccttgtgcactggaaatagcacaaatagttttgggaccagatgcacaaaaaaagcttcagcaggtacccttatcagatgatgtgatccattctagaattgatgaaatgagccaggatatcttacagcaagttctagaagatatcaaagccagtcctcttaaagtgggtattcagcttgctgagacaactgacatggatgactgcagtcagctaatggcatttgtgcgctatataaaagaaagagagatcgtagaagaatttctcttctgtgaaccattgcagctatccatgaaaggaatagatgtgttcaatctcttcagagacttctttctgaagcataagatagcacttgatgtatgtggctctgtttgtactgatggtgcctcctctatgctaggagaaaattccgagtttgttgcctacgtgaaaaaagagatacctcatatcgtagttacacattgtttattgaatcctcatgcacttgtcataaagacattgcctacaaaactgagggatgctctgtttactgtggtgagggtaataaatttcatcaaagggagagctccaaatcatcgcctatttcaggctttctttgaagaaattggcatagaatatagtgtcctccttttccatactgaaatgaggtggctttcccgaggccaaatacttactcacatttttgaaatgtatgaagaaataaatcagtttcttcaccacaagagcagtaatttagttgatggctttgaaaataaagagtttaaaattcacctagcataccttgcagatttattcaaacacttaaatgaactcagtgcatctatgcagaggactgggatgaacacagtatcagctagagagaagttatctgcttttgttaggaagtttccattttggcaaaaacgaattgagaaaagaaattttaccaattttccttttcttgaagaaataattgtttcagataatgaaggcatattcattgcagctgaaataacactgcatctgcaacaattgagcaacttcttccatggatatttttccattggagatcttaatgaggcaagtaaatggatattggatccatttctttttaatatcgattttgttgatgatagttatttaatgaaaaatgatcttgctgaattacgagctagtggccaaatcctaatggaatttgagacaatgaagcttgaggatttctggtgtgcccaattcacagcatttccaaacctggcaaagacagctctagaaatccttatgccatttgcaactacatacctttgtgagttgggattttcatcacttttacatttcaaaacaaagtccagaagctgctttaatctgagtgatgatatccgtgtggctatttcaaaaaaagttcctcgtttctcggacatcattgaacaaaagctacagctacagcagaagtcactgtaagctgatatacttttttaatgaataatttcaatcttaatatcattgtaaaattaagctgtaattctgtctctttcatatttatgatatactgaattctatgtctaaaaaacttaagaactttaattttgaatgaggcatgtgaaaatatgttttgagaataaaaacacagcagaaaaga

SEQ ID NO: 204272 - DNA, 4877 bp, Homo sapiens
  Payload ID: 20286
  Gene Name: zinc finger, BED-type containing 9
  Uniprot ID: Q6R2W3
  ENST ID: ENST00000452236
  CDS Start-End: 619-4596
gagcgtggctcaccgggcccggccggaacctacgggcacagctgcgggtgtgtctgcggaacctccacctgagctgtagagtgtttccctcgacccactagtctgggttccacagggtctgagctcctcagaggtgggagctgcggccgagggaagggtgcatgtgcgcggcgacaatcgggcctcttccccaggcagcttgtgagcccctctccctctccgccctcgcccaggctgctccgatcttcgtttccttgcctaggctcatacacccaggctttatttagggccaaagtatccgtcataacctcggttttctgtctcgcaagtatcttgccgctcaatttgtgaccctgaagctttagtgagtcgctctgtgctcactatttctggtcttttcagaggatggcttcactttcaatggaattgcccgagtaactgccctgtgttgtcacgtaaacaagtccttttaaactgagtctgtagttgtcctgtgttgagtgttttcttatatcaaaaactttcctgaccaagaacaaaaaaggagctcaagtaaaatcacccatttgcctagaccccaactggagagaacctttgcctgagctgtctaagctcgggatggaagcagtctctagggtcttcccagccttggctggccaggctccagaagaacaaggggagattatcaaagtaaaggttaaagaagaagaccacacttgggatcaggaatcagccctacgtaggaatttgtcttataccagggaactctctcgtcagcgcttcaggcagttctgctatcaggagacacctgggcccagggaggctctgagtcaactgcgggaactttgccgtcagtggctgaacccagagatacataccaaggagcagatcctggaattgttggtgctggagcagttcctgaccatcctgcctgaggagctccagtcttgggtgcgggagcataatcctgagagtggagaagaggtggtgactttgctggaagatttggagagggagcttgatgaacctagacagcaggtctcacagggcacatatgggcaggaagtttctatggaagaaatgatccctctggattctgcaaaggagtctttaggcacccagcttcagtctatggaagatagaatggaatgtgaatctccagagccacacccacttcaagataatgggtcatttttgtggttttccatgatgtctcaaagcatgggtggtgataacctcagtagcttagatactaatgaagcagaaattgaaccagaaaacatgagagaaaagttcttcagaagcttagcaaggttactggaaaacaaaagtaataatactaagatattttctaaagcaaagtactgtcagttgataaaggaagtgaaagaagctaaagctaaggcgaaaaaggaatcagttgactaccgtcgcttggctagatttgatgttatccttgtacaaggaaatgagaagctaattgaggctgtaaatggggaaacagataaaatacggtattacttacacagtgaggacttatttgacattctgcataatacacatctcagcattggacatggtggacgtactcgcatggagaaagagttacaagcgaaatacaagaacatcacaaaagaagttataatgctgtatctgaccctctgtaaaccatgccaacagaaaaattcaaaactcaagaaggttctaacatcaaaatcaattaaggaagttagttcaagatgccaagtagatcttatagacatgcagttgaatcctgatggggagtacagatttattttgcattatcaagatctctgtacaaagttaacttttttgcggtcattaaagtctaaaaggcctacggaagttgcacatgctcttttagatatatttacaattattggagcacccagtgtcctacaatctgacaatgggagggaattttcaagccaggttgtcagtgaactcagtaatatttggccagaattgaaaattgtccatgggaagtctcagacctgccaaagccagagttctgcagaacaaactgaggatatccgaaagaggattttctcctggatgcaaactaacaactcatcacactggactgaatttttgtggttcattcagatgtcccaaaatcagccctatcacagaagcatgcaacagactccatgtgaaagtgcatttagctctgaagctaaactgggcttgtcccattctcagctaactgaagaacttgttgccagcttgcatacagaaaatgaattagatcaggctgacaaagagttagaaaatactttaagagcccagtatgaagaaaacattgagactggaacagacagtagtgatattgaagagaatctttctgtcactcctaaggtggctgaaaaaagccctcctgagagcagactaagatttttatcctgtgtagtttgtgaaaaagaatgcacaggtgttaatagttgtatatcatgtgatggaaatatccatgcaatttgtggagtgccctctcaacatgggactgagggctgtggtcggcaaataacttgtagcctttgctatgaaaccagcacaatgaagaggaaacatgatgagattcaaagaagtttgcctgttaaaccttccaaaatgctaaagccatcagggacaccattttcaccagacaaagtaggagactggatggcgaaacaagcttcactggacttttttgtcaagaaaagacatgccttttctgaacacagtagtagtaataaaagaaatgttaacaatagaagttatcctgaagaagggaaaaccaaaagagttcatgctagtttcactcggaaatatgatccttcatatattgagtttggttttgtagctgtaattgatggtgaagtactaaaaccacagtgtattatttgtggagatgtactggctaatgaagcaatgaaaccatcaaaacttaagcgacatttatattcaaaacataaagaaataagttcacaaccaaaagaattctttgaaagaaagagtagtgaattgaaaagccaaccaaagcaggtgttcaacgtttctcatataaacattagtgctttgcgggcttcatataaagtagcacttccggttgccaagtctaaaacaccatacacaattgctgagacactagtgaaagactgcatcaaagaagtttgcttggaaatgttgggtgaatctgcagcaaagaaggtagctcaggtaccactttccaatgacaccatagctcgacgtattcaggaactggctaatgatatggaagatcaactcatagaacaaataaaactagcaaagtatttttcattgcaacttgatgaatgcagagatattgctaacatgataattcttttagtctatgtgaggtttgaacatgatgatgatataaaggaagagttctttttttcagcctctttgcctacaaacacaactagctcagaactgtatgaagctgtaaagaattatattgttaacaaatgtggtttggaatttaaattttgtgtaggagtatgttctgatggtgcagcttcaatgacaggaaaacattctgaagtggtaacccagattaaggaacttgcgccagaatgtaaaacaacacattgcttcattcatcgagaaagtcttgccatgaaaaaaatatcagctgaactaaatagtgtacttaatgatatagtaaaaattgtgaattatataaaatctaattcattgaattcaagattattctctttattatgtgataatatggaagctgatcataagcaactgttactgcatgctgagatacggtggttatcacggggaaaagttctgtcaagaatgtttgaaatacgaaatgaactcttagtgtttctgcaaggcaagaaacccatgtggtcccaactttttaaagatgtgaattggacagccagacttgcttatttgtctgatatcttcagtatttttaatgatcttaatgcttctatgcaagggaagaatgcaacttatttttcaatggcagataaagttgaaggacaaaaacagaagttagaagcttggaaaaacagaatttctacagattgttatgacatgtttcataatttaacaacaattatcaatgaagtaggtaatgatcttgatattgcacatctgcgaaaagttatcagtgaacatcttacaaatttgttagaatgttttgaattttattttccatcaaaagaagatccacgcataggaaatttgtggatccaaaatccatttctttcatcaaaagataacttaaatttaactgtaactctacaggataagttgttgaagctggctaccgacgaaggattgaaaatcagttttgaaaatacagcatcacttccttcattttggataaaagctaaaaatgactatcctgagcttgctgagattgctttaaaattgctgcttcttttcccctcaacatacctctgtgagaccggattctctactttaagtgttattaaaacaaaacatagaaacagtttaaatatacattatcccctgagggtagcattgtcatcaatccaacctagattagacaaattaacaagcaagaagcaagctcacttatcacattaaaagctttaaatattgatatgtaaggtattggttcaaagtatgcatataagcattgagtgtgaggaatttgctatttcactttaaactttctgtctagttacagttatggaagtatgagaagttatgagtgaaacagcaattttctatataaattgcctatatgtatattttcaattaagaatgtgtacagtttttataattctatttttcctcatatttgtcgtatttattaaaatataattttaaatctgttgattctaatattaaaacatttgatctta

SEQ ID NO: 204273 - DNA, 3000 bp, Homo sapiens
  Payload ID: 20286
  Gene Name: zinc finger, BED-type containing 9
  ENST ID: ENST00000508341
  CDS Start-End: 619-3000
gagcgtggctcaccgggcccggccggaacctacgggcacagctgcgggtgtgtctgcggaacctccacctgagctgtagagtgtttccctcgacccactagtctgggttccacagggtctgagctcctcagaggtgggagctgcggccgagggaagggtgcatgtgcgcggcgacaatcgggcctcttccccaggcagcttgtgagcccctctccctctccgccctcgcccaggctgctccgatcttcgtttccttgcctaggctcatacacccaggctttatttagggccaaagtatccgtcataacctcggttttctgtctcgcaagtatcttgccgctcaatttgtgaccctgaagctttagtgagtcgctctgtgctcactatttctggtcttttcagaggatggcttcactttcaatggaattgcccgagtaactgccctgtgttgtcacgtaaacaagtccttttaaactgagtctgtagttgtcctgtgttgagtgttttcttatatcaaaaactttcctgaccaagaacaaaaaaggagctcaagtaaaatcacccatttgactagaccccaactggagagaacctttgcctgagctgtctaagctcgggatggaagcagtctctagggtcttcccagccttggctggccaggctccagaagaacaaggggagattatcaaagtaaaggttaaagaagaagaccacacttgggatcaggaatcagccctacgtaggaatttgtcttataccagggaactctctcgtcagcgcttcaggcagttctgctatcaggagacacctgggcccagggaggctctgagtcaactgcgggaactttgccgtcagtggctgaacccagagatacataccaaggagcagatcctggaattgttggtgctggagcagttcctgaccatcctgcctgaggagctccagtcttgggtgcgggagcataatcctgagagtggagaagaggtggtgactttgctggaagatttggagagggagcttgatgaacctagacagcaggtctcacagggcacatatgggcaggaagtttctatggaagaaatgatccctctggattctgcaaaggagtctttaggcacccagcttcagtctatggaagatagaatggaatgtgaatctccagagccacacccacttcaagataatgggtcatttttgtggttttccatgatgtctcaaagcatgggtggtgataacctcagtagcttagatactaatgaagcagaaattgaaccagaaaacatgagagaaaagttcttcagaagcttagcaaggttactggaaaacaaaagtaataatactaagatattttctaaagcaaagtactgtcagttgataaaggaagtgaaagaagctaaagctaaggcgaaaaaggaatcagttgactaccgtcgcttggctagatttgatgttatccttgtacaaggaaatgagaagctaattgaggctgtaaatggggaaacagataaaatacggtattacttacacagtgaggacttatttgacattctgcataatacacatctcagcattggacatggtggacgtactcgcatggagaaagagttacaagcgaaatacaagaacatcacaaaagaagttataatgctgtatctgaccctctgtaaaccatgccaacagaaaaattcaaaactcaagaaggttctaacatcaaaatcaattaaggaagttagttcaagatgccaagtagatcttatagacatgcagttgaatcctgatggggagtacagatttattttgcattatcaagatctctgtacaaagttaacttttttacggtcattaaagtctaaaaggcctacggaagttgcacatgctcttttagatatatttacaattattggagcacccagtgtcctacaatctgacaatgggagggaattttcaagccaggttgtcagtgaactcagtaatatttggccagaattgaaaattgtccatgggaagtctcagacctgccaaagccagagttctgcagaacaaactgaggatatccgaaagaggattttctcctggatgcaaactaacaactcatcacactggactgaatttttgtggttcattcagatgtcccaaaatcagccctatcacagaagcatgcaacagactccatgtgaaagtgcatttagctctgaagctaaactgggcttgtcccattctcagctaactgaagaacttgttgccagcttgcatacagaaaatgaattagatcaggctgacaaagagttagaaaatactttaagagcccagtatgaagaaaacattgagactggaacagacagtagtgatattgaagagaatctttctgtcactcctaaggtggctgaaaaaagccctcctgagagcagactaagatttttatcctgtgtagtttgtgaaaaagaatgcacaggtgttaatagttgtatatcatgtgatggaaatatccatgcaatttgtggagtgccctctcaacatgggactgagggctgtggtcggcaaataacttgtagcctttgctatgaaaccagcacaatgaaaaggaaacatgatgagattcaaagaagtttgcctgttaaaccttccaaaatgctaaagccatcagggacaccattttcaccagacaaagtaggagattggatggcgaaacaagcttcactggacttttttgtcaagaaaagacatgccttttctgaacacagtagtagtaataaaagaaatgttaacaatagaagttatcctgaagaagggaaaaccaaaagagttcatgctagtttcactcggaaatatgatccttcatatattgagtttggttttgtagctgtaattgatggtgaagtactaaaaccacagtgtattatttgtggagatgtactggctaatgaagcaatgaaaccatcaaaacttaagcgacatttatattcaaaacataaagaaataagttcacaaccaaaagaattc

SEQ ID NO: 204274 - DNA, 3352 bp, Homo sapiens
  Payload ID: 20287
  Gene Name: zinc finger, C2HC-type containing 1A
  Uniprot ID: Q96GY0
  ENST ID: ENST00000263849
  CDS Start-End: 103-1080
ggaatgttagcgggtgggaggtgcggctgggttgctacagccagagctgggcggtggcgggcgctgctgaaggagtctcgctgagctcgaggaggtggcgcgatggagggactggaagagaatggaggtgttgtccaagttggagaattgttaccttgcaagatttgtggaagaacattctttccagtagcattaaaaaaacatggacccatttgccagaagactgcaactaaaaaacggaagacttttgattcaagcagacagagagctgaaggaactgatattccaacagtaaaacctctcaaaccgaggccagaaccaccaaagaaaccatctaattggagaaggaaacatgaagaattcattgctaccataagagcagctaaaggccttgatcaggccctcaaagagggtggcaaacttcctcctcctcctccaccttcttatgatcctgattatattcaatgtccatattgtcagaggagattcaatgaaaatgcagctgatagacatataaatttctgtaaagaacaggcagcacgtattagtaataaagggaaattttctacagataccaaaggaaaaccaacttctcggacacaggtgtataagccacccgcacttaaaaagtcaaattctcctggaactgcatcatcaggatcttcacgattaccgcagccaagtggcgctggcaaaactgttgtaggtgttccttcaggtaaagtgtcttcaagtagcagctctttgggaaacaaacttcagaccttatctccctctcataaagggatagcagcccctcatgcaggagctaatgtcaaaccccgaaattccacaccacctagtttggcaagaaatcctgccccaggtgtgcttacaaacaaaagaaaaacatatactgagagctacatagccaggccagatggggactgtgcatcttcccttaatggtggaaatattaaaggcattgaaggacattcacctggaaacttaccaaaattctgccatgagtgtgggactaaataccctgtagaatgggccaaattttgctgtgaatgtggcattcgaagaatgattctatgaatagaatctcaaaaaaaaaaaaaagccaagttcagagtttatgattattgctgcttggacagctagagcacatcctctagttagtttgtgctaaaaatactcgaaataccatttccagttaattttgaagtgtaatcttttggctatataatgtgtgtatgtttatatgtgtacatatactgtatataataaatatctgataccccagactgtgtcattcaaggaaatattcacttatctgtcagaaaataatttcaaatggaacaattaatttaggtgttacttttctgttgttgttaaagcacgttaagtacatttccacaaactctcatactctagtgcttagcccttcaagctttaggataagtataactttgagcaaaaaatttggataaacatttgtattattggtgcctatcttcagatagtatcatagtaggatagatgctgggaattttgtaattaaagagaacagttttagttaccattaggtatgttaaggtcactcctgtagagcatgtcaacaaattatttcataaatccgaaaaactaagagaaaaaaaaacccctctattagttacgtaatttaaacatcttacttgttttgtaaaagtgtaattatgcaatttccttttcaaatacacaagactaaaaatacaaatctatcttgttctatttataactgattttttttagttctgtatgtattcgttgaacatatttttttacttccaattgtttttccagatttcacttttcctctttttccataacccgtgaagatagttttaatttgctagttcattttttgctgtatttgaaaatgtaattatttaatatagaaggcacagaattccctgcaaaatcttacatgtttaaaaacatataattttttgtatctgaatttagaataaatcattttaatgcatcttaaatcacgtcacctaatcataatagttgtggtaactaatcattagtgcagagcatgcagataaaaaatatttgaatttttttttcttggaagtacatgtagttatgagtaggttaagagaatatctaattttcctactctttttttcatctttagcatttaatgttgaaacaccattcacgtcacattaaggacccactgaaaatgtattgttttaatgcataattgacttacctaattaaacatacacacaaatttaattatttttttctctttaacctgatcacgacacagctcttaatcattgtcactttcagtatatcatagtagttagtagtagattgccttgatggcagtaattctgtagtaatttctattcaatcaaacctaagagagctttgatcttactgtaaaggtacaaacaaatctcttatataattcctagcttttttttttgtttatgattctgatcaactataagacacaatgtaaagaattgtggcttataatttatctgaaatttattagcttagtttagtttgggcaggagttacaaacttaataggaattgtcattttacttacagtttatttcctgattagttgttaatttttttcccctcagttatctttattcagtcttattggtcaaaacaaagaaacaaatagtccatcaactaaaataagctgtaatgaatttagaagatgaatgcatatattagatttccatttaaatcacttctgttataaatcatataaagaactttaaacttgttttatctaatactgagcactgtttttttgtcaagtatttttttaagaccacataattctttttgtctgctcaaggaaaggatagataaataattggcacacatttgtttctcactgaattttacagtagtaaattaatgttataatgtaccacatggagatgagttggtaagaaatcatctagttccagagcccagagattataaacagtaggtgaaatagatttatgacttacgaaatatgttgtgacaatatatttaaatgcatttttatattacttgcatattctcacattgatttgtgcaatagttcagttttaaaaaaaatcttcctatgcatcatgtattttatttttatttattttcacaagtatttgacagtatggtagaataaaagatgattgtaagattaaaaatgtaaaaattgcttatgtattattctgaattgtgttaggttgaaaaagatgattgtggtgactattatttcttgtccactatttgttttttgttttttcaccaataatgtcttcatatttgaacctattcaataaagacatgaagcataaaaa

SEQ ID NO: 204275 - DNA, 601 bp, Homo sapiens
  Payload ID: 20287
  Gene Name: zinc finger, C2HC-type containing 1A
  ENST ID: ENST00000519307
  CDS Start-End: 1-592
gtataagccacccgcacttaaaaagtcaaattctcctggaactgcatcatcaggatcttcacgattaccgcagccaagtggcgctggcaaaactgttgtaggtgttccttcaggtaaagtgtcttcaagtagcagctctttgggaaacaaacttcagaccttatctccctctcataaagggatagcagcccctcatgcaggtaatatggacaagttaggccctccacttcgaacgggaagacttgtgcaaaggttgtatgacagtgatacaaaatcagacagtgccatcaaaagacatgagttattacctatttacaaagctaatgtcaaaccccgaaattccacaccacctagtttggcaagaaatcctgccccaggtgtgcttacaaacaaaagaaaaacatatactgagagctacatagccaggccagatggggactgtgcatcttcccttaatggtggaaatattaaaggcattgaaggacattcacctggaaacttaccaaaattctgccatgagtgtgggactaaataccctgtagaatgggccaaattttgctgtgaatgtggcattcgaagaatgattctatgaatagaatct

SEQ ID NO: 204276 - DNA, 1002 bp, Homo sapiens
  Payload ID: 20288
  Gene Name: zinc finger, C2HC-type containing 1B
  Uniprot ID: Q5TFG8
  ENST ID: ENST00000237275
  CDS Start-End: 105-773
ttgcaacagattagtggtcctggtttatgttcttgactagtatgatgttatctggactgggctgtaaaaatctgtgaacactgttgctctgagttaggaacagaatggctggggcagaaccatttttggcagatggcaatcaggaattgtttccctgtgaagtctgtggaagacgttttgcagcagatgttctggaaaggcatggaccaatatgtaagaaactcttcaacagaaagcgtaaacctttcagttctttgaagcaaagattacagggcactgacattcctactgtgaagaagactccacaatccaagtctccacctgtgaggaagtctaactggagacaacaacatgaagactttattaatgcaatccgatcagcaaagcagtgtatgctagccattaaagaaggccgacccctcccacctccaccccctccatccttgaacccagattatattcaacgtccatattgtatgagaaggtttaatgaaagcgcagctgagcgacatactaatttctgcaaggatcagtcttctcgccgagtctttaatccagctcagacagcagccaaattggcatccagagctcagggtagggctcagatgggtccaaaaaaagaaccaactgttaccagtgctgtgggagctttgctgcagaacagggtcctggtggccacgaatgaagtcccaaccaagtcaggattagctatggaccctgcttctggagcaaaactcagacaaggatttagtaaatcttctaaaaaagattaactcctagaagccagactgcctccctgaaacccatcagcctggatggttgcgtacccgagaatgccacctaaggggaaggaacggtagatgtgatgtctgtttttacacccttgattcttcttgaagcatcacttagaacaagtaaaacttgcttcagatttttatttactccctttgaagttttcaaaacaaaagcattaaacacatcaacctgtataatgcatgattc

SEQ ID NO: 204277 - DNA, 2249 bp, Homo sapiens
  Payload ID: 20289
  Gene Name: zinc finger, C2HC-type containing 1C
  ENST ID: ENST00000238686
  CDS Start-End: 193-1362
gagttcgcggcgaggggcggagcttggcgcgccagtgcctcggtttccaggcaccgggaataacagaagccagctgagagcgcctgcgcggctgtcggttgatggggaggtcaggtctgggaaactaggccctggggttttccctgagcaggagcggtgcccgagggcctcaggcgtcagtccaggccctgaatggctggtctccagcggttggcgtcacatctgcctgtgggcgttatgctcccacataatacaacggaagctccagggccccactcagccaagcaagactcttacgaacaaggtgactcttcccagcagtccttgaaggggcacctgaggaacaatttccagaagcagcttttgagcaacaaagagttgattctggataaagtctatactcaccccaaatggaacacccaaacaaaagcccggagctactcctatccccactgtactggaatcagccagcaagatccagaaagtgattcccagggccaaggaaatggtttgttttactcgtcaggccctcaatcctggtatcccaaagccaataaccaggactttatcccctttacaaagaaacgagttggagtggaccgggcgttcccattgaaacccatggtccacaggaagtcgtgcagtacaggtgaggctggcactgatggggaccataatgtctacccaaggccccctgagccgagagagttttcatctaggaactttggtgtgaggaaccagggcaacttttctgtggttggtactgttcttgctgccacgcaggcggagaaggccgtggcaaactttgacaggacggagtgggtgcagatccgaagactagaagctgcaggggagagcttagaggaggaaatccgaagaaagcagattctcctgaggggaaagctgaagaagacagaggaggaactcagaaggatccagacgcaaaaggaacaggccaaggaaaatgaaaacggagagctacagaaaattatactccccaggagcagagttaaaggtaataaaagcaacaccatgtacaaacctatcttctccccagaatttgagtttgaggaagaatttagtagagacaggagagaggatgaaacttggggacggtctcaacaaaattcaggtccattccagttctctgattatagaatccagaggctcaaaagggaaaggctggtagcaagcaataataaaattcgagacccagtctcagagccatcggtggagaaattctccccgccttcagaaacaccagtcggtgctttgcagggatccgccagaaattccagcctgtccatggcaccagactcctcaggttccagcggctccattgaagagccacagctgggctgaacctcctcagaagagcaactggagatagaagcatgaatcttttatccatacgttccgccaggctcgagaggtccagcaggtaactgccaaaggtggaaactgttcacacttgcctcccatcctgcctgcagaaaacccagactgcattcagtgtcctcagtgtagccaccactttgctcccaaggtggctgagcaacacattcccaagtgtaagaccatcaagaactgtcttccacctctaaggaagcattatagttgagcagacaacaatggaaacttttggatagttcagaaagctctgcttctcttcagcagtaaatgggagtagaatttgatgcaaagcagaaagaaatcaaacagctcccagatctgcctgcagagctaaaatctgtgaggagagagccactgctaagcagcaggaggcagaaggaagccccagcttcccactaaattacaaccttgggctggtatgctttatgttattgccctcagaattgatgggtgaagacactgaagagtcatgagcaggctccattaaagctcttttcttgcatgcctgacttgtggtttgtgctagttaagtgcctgcatctggttctgccttcttgtcactgcatgtatgttcagagttcctgttaactcttgcttttgtagaagctggagttattaggatgtgttggtgtcagaggggcatgatcacccagatagtaactcttataaaagataatacaattttgctataaggcattattaatggaaatctatccttggtctccctggtgcataagcctggccaaaacccaatacaagtatgtaaggttaaggcaccaatgtctcctaaaccttccctatggtgtactgtgtaataaaggaaagatctttatgta

SEQ ID NO: 204278 - DNA, 1509 bp, Homo sapiens
  Payload ID: 20289
  Gene Name: zinc finger, C2HC-type containing 1C
  Uniprot ID: Q53FD0
  ENST ID: ENST00000439583
  CDS Start-End: 129-956
agaagccagctgagagcgcctgcgcggctgtcggttgatggggaggtcaggtctgggaaactaggccctggggttttccctgagcaggagcggtgcccgagggcctcaggcgtcagtccaggccctgaatggctggtctccagcggttggcgtcacatctgcctgtgggcgttatgctcccacataatacaacggaagctccagggccccactcagccaagcaagactcttacgaacaaggtgactcttcccagcagtccttgaaggggcacctgaggaacaatttccagaagcagcttttgagcaacaaagagttgattctggataaagtctatactcaccccaaatggaacacccaaacaaaagcccggagctactcctatccccactgtactggaatcagccagcaagatccagaaagtgattcccagggccaaggaaatggtttgttttactcgtcaggccctcaatcctggtatcccaaagccaataaccaggactttatcccctttacaaagaaacgagttggagtggaccgggcgttcccattgaaacccatggtccacaggaagtcgtgcagtacaggtgaggctggcactgatggggaccataatgtctacccaaggccccctgagccgagagagttttcatctaggaactttggtgtgaggaaccagggcaacttttctgtggttggtactgttcttgctgccacgcaggcggagaaggccgtggcaaactttgacaggacggagtgggtgcagatccgaagactagaagctgcaggggagagcttagaggaggaaatccgaagaaagcagattctcctgaggggaaagctgaagaagacagaggaggaactcagaaggatccagacgcaaaaggaacaggccaaggaaaatgaaaacggagagctacagaaaattatactccccaggagcagagttaaaggctgaacctcctcagaagagcaactggagatagaagcatgaatcttttatccatacgttccgccaggctcgagaggtccagcaggtaactgccaaaggtggaaactgttcacacttgcctcccatcctgcctgcagaaaacccagactgcattcagtgtcctcagtgtagccaccactttgctcccaaggtggctgagcaacacattcccaagtgtaagaccatcaagaactgtcttccacctctaaggaagcattatagttgagcagacaacaatggaaacttttggatagttcagaaagctctgcttctcttcagcagtaaatgggagtagaatttgatgcaaagcagaaagaaatcaaacagctcccagatctgcctgcagagctaaaatctgtgaggagagagccactgctaagcagcaggaggcagaaggaagccccagcttcccactaaattacaaccttgggctggtatgctttatgttattgccctcagaattgatgggtgaagacactgaagagtcatgagcaggctccattaaagctcttttcttgca

SEQ ID NO: 204279 - DNA, 776 bp, Homo sapiens
  Payload ID: 20289
  Gene Name: zinc finger, C2HC-type containing 1C
  ENST ID: ENST00000532198
  CDS Start-End: 1-473
gagtggaccgggcgttcccattgaaacccatggtccacaggaagtcgtgcagtacaggtgaggctggcactgatggggaccataatgtctacccaaggccccctgagccgagagagttttcatctaggaactttggtgtgaggaaccagggcaacttttctgtggttggtactgttcttgctgccacgcaggcggagaaggccgtggcaaactttgacaggacggagtgggtgcagatccgaagactagaagctgcaggggagagcttagaggaggaaatccgaagaaagcagattctcctgaggggaaagctgaagaagacagaggaggaactcagaaggatccagacgcaaaaggaacaggccaaggaaaatgaaaacggagagctacagaaaattatactccccaggagcagagttaaagtgctgtgcctttggaagctgagtggttgtaccttcctgtcattcctctagagtactcaagaacaggctgaacctcctcagaagagcaactggagatagaagcatgaatcttttatccatacgttccgccaggctcgagaggtccagcaggtaactgccaaaggtggaaactgttcacacttgcctcccatcctgcctgcagaaaacccagactgcattcagtgtcctcagtgtagccaccactttgctcccaaggtggctgagcaacacattcccaagtgtaagaccatcaagaactgtcttccacctctaaggaagcattatagttgagcagacaacaatggaaacttttgg

SEQ ID NO: 204280 - DNA, 564 bp, Homo sapiens
  Payload ID: 20289
  Gene Name: zinc finger, C2HC-type containing 1C
  ENST ID: ENST00000534151
  CDS Start-End: 285-564
aaaagctttgggttggggatctgtccaggaactcggctgggcctccacaaacctagccctcatcgcatctcagtcaacaagcgcaaccctcttctcattttctcatgaggagaaaggcatagacgaagaagtacatggggatacattcaatcattcaattaaatactgactgacagctactgtgtgccaggcacctgttctaggtgaccaggcaaacatcagtgaacaaaacaggatccctgtcctgaggagcttaattctggaggcgtcagtccaggccctgaatggctggtctccagcggttggcgtcacatctgcctgtgggcgttatgctcccacataatacaacggaagctccagggccccactcagccaagcaagactcttacgaacaaggtgactcttcccagcagtccttgaaggggcacctgaggaacaatttccagaagcagcttttgagcaacaaagagttgattctggataaagtctatactcaccccaaatggaacacccaaacaaaagcccggagctactcctatccccactgtactggaatcagccagc

SEQ ID NO: 204281 - DNA, 4283 bp, Homo sapiens
  Payload ID: 20289
  Gene Name: zinc finger, C2HC-type containing 1C
  Uniprot ID: Q53FD0
  ENST ID: ENST00000524913
  CDS Start-End: 490-1860
ggacgccggcatcctgcggcggaagcacgcggaggcacagccagggcctccgccctttgccagacaagggcacaccccaaggtctgggagcgtcgttctcagaaaagtacaagttcttctttgaaggagctccagaaaagcctctcccgcccctccccggctccccaagggcagggctggaccgagctgcagagttggccggacactgactgggtcaagtgaccttgggctgaccgcacccccacccccggtcgccccgggtcgctggtgcactgcgcctgcgcgcgtctccccgaggagttcgcggcgaggggcggagcttggcgcgccagtgcctcggtttccaggcaccgggaataacagaagccagctgagagcgcctgcgcggctgtcggttgatggggaggtcaggtctgggaaactaggccctggggttttccctgagcaggagcggtgcccgagggcctcaggcgtcagtccaggccctgaatggctggtctccagcggttggcgtcacatctgcctgtgggcgttatgctcccacataatacaacggaagctccagggccccactcagccaagcaagactcttacgaacaaggtgactcttcccagcagtccttgaaggggcacctgaggaacaatttccagaagcagcttttgagcaacaaagagttgattctggataaagtctatactcaccccaaatggaacacccaaacaaaagcccggagctactcctatccccactgtactggaatcagccagcaagatccagaaagtgattcccagggccaaggaaatggtttgttttactcgtcaggccctcaatcctggtatcccaaagccaataaccaggactttatcccctttacaaagaaacgagttggagtggaccgggcgttcccattgaaacccatggtccacaggaagtcgtgcagtacaggtgaggctggcactgatggggaccataatgtctacccaaggccccctgagccgagagagttttcatctaggaactttggtgtgaggaaccagggcaacttttctgtggttggtactgttcttgctgccacgcaggcggagaaggccgtggcaaactttgacaggacggagtgggtgcagatccgaagactagaagctgcaggggagagcttagaggaggaaatccgaagaaagcagattctcctgaggggaaagctgaagaagacagaggaggaactcagaaggatccagacgcaaaaggaacaggccaaggaaaatgaaaacggagagctacagaaaattatactccccaggagcagagttaaaggtaataaaagcaacaccatgtacaaacctatcttctccccagaatttgagtttgaggaagaatttagtagagacaggagagaggatgaaacttggggacggtctcaacaaaattcaggtccattccagttctctgattatagaatccagaggctcaaaagggaaaggctggtagcaagcaataataaaattcgagacccagtctcagagccatcggtggagaaattctccccgccttcagaaacaccagtcggtgctttgcagggatccgccagaaattccagcctgtccatggcaccagactcctcaggttccagcggctccattgaagagccacagctgggtgagtgcagccactgtgggcgcaaattcctctcgttcaggctggagagacactccaacatctgcagcaggatgcggggttccaagaggaaagtgtttgactcctccagggcccgggctaagggcacagaactagagcagtacttgaactggaaggggccagcttcagccaaggctgaacctcctcagaagagcaactggagatagaagcatgaatcttttatccatacgttccgccaggctcgagaggtccagcaggtaactgccaaaggtggaaactgttcacacttgcctcccatcctgcctgcagaaaacccagactgcattcagtgtcctcagtgtagccaccactttgctcccaaggtggctgagcaacacattcccaagtgtaagaccatcaagaactgtcttccacctctaaggaagcattatagttgagcagacaacaatggaaacttttggatagttcagaaagctctgcttctcttcagcagtaaatgggagtagaatttgatgcaaagcagaaagaaatcaaacagctcccagatctgcctgcagagctaaaatctgtgaggagagagccactgctaagcagcaggaggcagaaggaagccccagcttcccactaaattacaaccttgggctggtatgctttatgttattgccctcagaattgatgggtgaagacactgaagagtcatgagcaggctccattaaagctcttttcttgcatgcctgacttgtggtttgtgctagttaagtgcctgcatctggttctgccttcttgtcactgcatgtatgttcagagttcctgttaactcttgcttttgtagaagctggagttattaggatgtgttggtgtcagaggggcatgatcacccagatagtaactcttataaaagataatacaattttgctataaggcattattaatggaaatctatccttggtctccctggtgcataagcctggccaaaacccaatacaagtatgtaaggttaaggcaccaatgtctcctaaaccttccctatggtgtactgtgtaataaaggaaagatctttatgtactttacagggtagggatgggtgttgggggggaaacacattatacttctctctacttgttcttttctaatgggtttcatatgttaagaaagaaacctccattttagctgttagtagcactctactttcaaatcggtttggctaaatgactgtttagaggcagcaaaatctaccatcaaagcaagctgagacaggctggtcatggtggctcattcctataattccagcactttgggaggctgaagtgggaggattgcttgaggccaggagttcaagagcggcctcgacaacaaagcaagaccccatctcaaaacaaaacaaagctgggacactgcacagtgtcacatgcccttggcaattatagcatagtcaacttctatttcagagagtaaactttgaagggaaagggatcaaatctttttaattttctctgtgtagaatattgcctagcacaagttagaccttcaattagtgaggtctggagatttaaaattaaacaagaagatgagtgagtcctacactagtgaaatcagagaactgataagttaatgtctgcgagagtattatcagttcagataggagtgaagttagcacaacagatagaaatcttaggattactgttctgtattactcaaattgttagtttaaaatactggagaaaaactgctcaatttgagctagtcaacagggctagacagacaacaaaatcctattttactaagtaacaaatggccactcactcttgctccatttccactgcactccagcctggtgacctagtgagactccatctcaaaaaaaaaaaaaaaaaaaagaaaaaaaaattgggctaacagatcagaccaatttgaaatgtgagttaaggctttagcggtgaagctgcaggacacaggctgggaaaaaatcctatatatttaaataggagcacacatttctttgcactctttttaattgttccaaaggaaaggaggtatcacataataaagctttatggttagccccttaaggaaacctcacacagagataatggatatttaacctaataggtacattccctaggcaagttcaatgaaatgtacactttaagtgggaatgtaaaccagtacattgcaatagatggcaagagtaagctgtggccaaggtcacaaaatggcaacatgtggattgctttgctccacagatgttttatttcgctggcctagcattcataatatgatctgacatttaaaaactgggatatggaacatctcttgaaaaactggaagttctggaaacactgggccagcaacccgcatggcacaaattgggtggggtttagaatcagatgctcctccagatgggaatggtagcaccagaccactgcagtctcacttggcctgcttcacttctttaccttatctgcctggtaccacaggcacttggatttgggatcgctggatgttagtaaggtcatagatccgggccctccagagagaacaaattgttgttatatgtggggagtgctttctaaaaaggaagcagttgtttgctctcattttgctaaagaaataaaacaatagtcaatgc

SEQ ID NO: 204282 - DNA, 544 bp, Homo sapiens
  Payload ID: 20289
  Gene Name: zinc finger, C2HC-type containing 1C
  ENST ID: ENST00000525046
  CDS Start-End: 269-544
gatggggaggtcaggtctgggaaactaggccctggggttttccctgagcaggagcggtgcccgagggcctcaggtacgcagaagggcggggagacatgggatcagcacctccacctcctaagggaccgaagggcaggagagcgagaggacttgtccccagaggtggagtccgaagtgggggcgccccagttgacccttcgggacaaaacgtgacttcagccttaaggatctaaaaccggccgcggtcaggcgtcagtccaggccctgaatggctggtctccagcggttggcgtcacatctgcctgtgggcgttatgctcccacataatacaacggaagctccagggccccactcagccaagcaagactcttacgaacaaggtgactcttcccagcagtccttgaaggggcacctgaggaacaatttccagaagcagcttttgagcaacaaagagttgattctggataaagtctatactcaccccaaatggaacacccaaacaaaagcccggagctactcctatccccactgtactggaatcagc

SEQ ID NO: 204283 - DNA, 809 bp, Homo sapiens
  Payload ID: 20289
  Gene Name: zinc finger, C2HC-type containing 1C
  ENST ID: ENST00000526130
  CDS Start-End: 296-809
ggttgatggggaggtcaggtctgggaaactaggccctggggttttccctgagcaggagcggtgcccgagggcctcaggtacgcagaagggcggggagacatgggatcagcacctccacctcctaagggaccgaagggcaggagagcgagaggacttgtccccagaggtggagtccgaagtgggggcgccccagttgacccttcgggacaaaacgtgacttcagccttaaggatctaaaaccggccgcggtcaggtcaggtggccctcaacgctcaggcgtcagtccaggccctgaatggctggtctccagcggttggcgtcacatctgcctgtgggcgttatgctcccacataatacaacggaagctccagggccccactcagccaagcaagactcttacgaacaaggtgactcttcccagcagtccttgaaggggcacctgaggaacaatttccagaagcagcttttgagcaacaaagagttgattctggataaagtctatactcaccccaaatggaacacccaaacaaaagcccggagctactcctatccccactgtactggaatcagccagcaagatccagaaagtgattcccagggccaaggaaatggtttgttttactcgtcaggccctcaatcctggtatcccaaagccaataaccaggactttatcccctttacaaagaaacgagttggagtggaccgggcgttcccattgaaacccatggtccacaggaagtcgtgcagtacaggtgaggctggcactgatggggaccataatgtctacccaaggccccctgagccgagag

SEQ ID NO: 204284 - DNA, 547 bp, Homo sapiens
  Payload ID: 20289
  Gene Name: zinc finger, C2HC-type containing 1C
  ENST ID: ENST00000554763
  CDS Start-End: 65-547
agaagccagctgagagcgcctgcgcggctgtcggttgatggggaggcgtcagtccaggccctgaatggctggtctccagcggttggcgtcacatctgcctgtgggcgttatgctcccacataatacaacggaagctccagggccccactcagccaagcaagactcttacgaacaaggtgactcttcccagcagtccttgaaggggcacctgaggaacaatttccagaagcagcttttgagcaacaaagagttgattctggataaagtctatactcaccccaaatggaacacccaaacaaaagcccggagctactcctatccccactgtactggaatcagccagcaagatccagaaagtgattcccagggccaaggaaatggtttgttttactcgtcaggccctcaatcctggtatcccaaagccaataaccaggactttatcccctttacaaagaaacgagttggagtggaccgggcgttcccattgaaacccatggtccacaggaagtcgtgcagtacaggtgaggctggcactgatggggaccat

SEQ ID NO: 204285 - DNA, 7285 bp, Homo sapiens
  Payload ID: 20290
  Gene Name: zinc finger, C3H1-type containing
  Uniprot ID: O60293
  ENST ID: ENST00000378743
  CDS Start-End: 360-6329
tcctagtgagtatcgagttggtcttattatcgcgtgaactgggagcctttgtttcctgcgtgtcgcaggaagtgacgtttcgggtacagccgctaccagagtccctttctcgcgaggcggaagaaccccgatcgctgaggagcaagggggcgctaggaaagggaactgggttgcgacggtccggcgagagagagctggggtgctggggtgcggggaagttggggagcagaggccgcttggtgtccgagtagggtaagaccgcaccgacccagtccgttaggaaagaagggaaacgaggcaattgtcgggcggatccccggacggagggctaaggttgtgtggaaggcgctgctccccggatggcgaccgcagatactccggccccggcctccagtggcctctcgccgaaggaagaaggggagcttgaagatggggaaatcagtgacgacgataataacagccagatacggagtcggagcagcagcagcagcagcggcggcgggctgttaccctatccgcggcgaaggcctcctcactcggcccggggcggtggatctggcggaggcggtggctcttcctcgtcatcgtcctcttctcagcagcagctgaggaatttctcacgctcgcggcacgcgtctgagcggggccacctcaggggacccagcagctaccgacccaaagaaccgttccggtctcatccgccttctgtacggatgccttcgagctcactgtccgaaagcagtccccggccgtctttctgggagcggagccacctcgccttggaccgtttccgctttcgaggcaggccttaccggggtgggagtcgctggagtcgggggcgaggagtgggtgagcgaggaggcaagccggggtgcagacctcctctgggaggaggagcaggatccgggttcagcagcagtcagagctggcgagagccctctccacctcggaagagctccaaaagttttggaaggtctccatcaagaaaacaaaattattcatcaaaaaatgaaaactgtgtggaagaaacttttgaagatttgcttttaaagtataaacaaatacagttggaactagaatgcatcaataaggatgaaaaactagcattgagtagcaaagaagagaatgtgcaggaagatcctaaaacattgaacttcgaggaccaaactagcactgataatgtcagtattacaaaggattcaagtaaagaagtagctcctgaggagaaaacacaagtcaaaacttttcaggcatttgaattaaaaccactcaggcaaaaattgactttaccaggagataagaaccgtttgaaaaaagttaaagatggagcaaaaccactttccctgaaatccgacactactgattctagtcaaggattacaagataaagaacaaaatttaacaagaagaattagtacctcagatattctgtctgaaaagaaacttggtgaagatgaagaggaactatctgaattacagcttcgccttttggctcttcagtcagccagtaaaaaatggcaacaaaaagaacagcaggtgatgaaagaaagcaaagaaaagttgactaagacgaaaactgtacagcaaaaagttaaaacaagtacaaaaacacattcggccaaaaaagttagcactacagctaaacaagcattgaggaagcagcaaacaaaggcatggaagaaactacaacaacaaaaagagcaggaaagacagaaagaagaggatcagcggaaacaagctgaagaagaagagagaaggaaaagagaggaagaaatcagaaaaattcgagatctctcaaatcaggaagaacagtacaatcgattcatgaaattggttggtggcaagaggagatcaagaagtaaatcttcagatcctgacctgaggcgatccttagataagcaacctactgatagtggaggaggcatttatcagtatgataactatgaagaagttgctatggatacagatagtgaaaccagttctccagctccttcaccagtgcaaccgccatttttctctgaatgttcattggggtatttttctccagcaccatctctttctttgcctccaccacctcaggtttcttctctgccacctttgagccagccttatgtggaaggcttgtgtgtttctcttgaacctctacctcctctaccaccattaccacctctcccacctgaagatccagaacagcctccaaaaccaccttttgcagatgaggaagaggaggaagaaatgctgcttcgagaagaactacttaaatctctagcaaataaaagagcttttaagccagaggaaacatccagtaatagtgacccaccttcacctccagttctgaacaattcacatcctgtgccaagaagcaatctatcaatagtcagtattaacacagtgtctcagcctaggatacagaatccaaagtttcacagaggaccccgtcttccacgaactgtgatctcgcttccaaagcataaatcagtggttgtaacactaaatgattcagatgatagtgaatctgatggagaggcttccaagtcaacaaatagtgtttttggtggattagagtccatgattaaagaagcaagacgaactgctgagcaagcttcaaaaccgaaagtacctccaaaatctgaaaaagaaaatgatcctctgcgaacaccggaggctttgcctgaagaaaagaagattgaatatagattgttaaaggaagagattgccaaccgtgagaaacagcgtttgattaaatcagatcagctgaagacaagttcatcatccccagcaaactctgatgtggaaattgatggtattggcaggatagcaatggttactaagcaggttacagatgcagaatcaaaactgaaaaaacataggattctcttgatgaaagatgaatctgttttaaagaatttagtgcaacaagaagctaagaagaaagaatctgttagaaatgctgaagcaaagattacaaaacttacagaacagcttcaagcaactgaaaaaattcttaatgttaacagaatgtttttgaagaagcttcaggaacaaattcacagagttcaacagcgtgttacaattaagaaagctttgactctaaaatatggagaagagcttgctcgggcaaaggcagtggccagtaaagaaataggaaaacgtaaactggaacaagatcgctttgggccaaacaaaatgatgagactggacagttctccagtatcaagtccaagaaagcattcagcagaactaattgctatggagaaaagacggttacaaaagctagaatatgaatatgccctgaaaattcaaaaattaaaagaagcccgtgcccttaaagcaaaggaacaacaaaatatctctccagttgtggaagaggaacccgaattttctttacctcaaccctcacttcatgatctgacacaagataaattaaccctggacactgaagaaaatgatgttgatgatgaaattttgtctggttcaagcagagagcgaagaagatcttttttagaatccaattattttactaaacctaaccttaagcacactgatactgctaacaaagaatgcataaacaaacttaataaaaatactgtagaaaaaccagaactttttctagggttaaaaattggtgaattgcaaaaattgtattcaaaagctgacagcctaaaacagctgattttaaaaaccaccacaggcattacagagaaggttttgcatggtcaggagatttctgtagatgtggattttgtcacagcacaaagtaaaacaatggaagtgaagccatgtccttttagaccctaccatagtcctcttctagtttttaagtcctacagatttagtccatattatcgaaccaaggaaaaacttcccctgagctcagtatcatacagtaatatgattgaaccggatcagtgtttctgccgttttgatttaacaggaacatgtaatgatgatgattgtcaatggcagcatatacaagactatacacttagccgaaaacagttattccaggacattctgtcatataatctgtctttgattggttgtgcagagacaagtactaatgaagaaattactgcttcagcagaaaaatatgttgagaaactttttggagtaaacaaagatcgaatgtcaatggaccagatggctgttctccttgttagcaatatcaatgaaagtaaaggtcatactcctccatttacaacctacaaagataaaagaaagtggaagccaaagttttggagaaaacctatttcagataatagcttcagtagtgatgaggaacagtctacaggaccaattaagtatgctttccagccagagaaccaaataaatgttccagctctggatacagttgtcactccagatgatgtcagatactttacaaatgagactgatgacatcgctaatttagaagcaagtgtgcttgaaaatccttctcatgtacaactttggctcaagcttgcgtacaagtacttgaatcaaaatgagggggagtgctcagaatccttggattctgctttaaatgttctggcgcgagcattggaaaataacaaagacaatccagaaatttggtgccattacctcagattgttctcaaaaagaggaaccaaggacgaggtgcaggaaatgtgtgaaacagctgttgaatatgctccagattatcaaagcttttggacttttctacacctagaaagtacctttgaagaaaaggattacgtatgtgagagaatgttggagtttctgatgggagcagccaagcaggaaacatccaatattttgtcctttcagcttttagaggctcttttgtttagagttcagctgcacatatttactggaagatgccaaagtgcactggcaattttacagaatgcattgaaatctgctaatgatggaatagtagctgaataccttaaaaccagtgatcgatgtttggcatggttggcctacatacatcttattgaattcaacattctcccttcaaaattttatgatccatctaatgataatccttcaagaattgttaacactgaatcatttgtaatgccatggcaagctgttcaagatgtaaagactaatcctgacatgttgttagcagtttttgaagatgcagtgaaagcttgcacagatgagagccttgctgttgaggaaagaatagaggcctgccttccactttacacaaacatgattgctctgcaccaactcctggagaggtatgaggctgcaatggagctttgtaaatctttattggaatcatgtcctattaactgccagttgctggaagctcttgttgcattatatttgcaaacaaatcagcatgacaaagccagagcagtgtggcttactgcatttgaaaaaaatcctcagaatgcagaggttttttatcatatgtgcaaattcttcatcttacagaatcgaggcgataatcttcttccatttttgcggaaatttattgcatccttctttaaaccggggtttgagaagtataataacttggatctgtttcggtatctcttaaatattccaggaccaattgacattccatctcgtttatgtaaagggaattttgatgatgatatgtttaaccaccaagttccttatttgtggctgatttactgcctttgtcatcctcttcaatcaagtattaaagaaacagtggaggcatatgaggcagcattaggggtggctatgagatgtgatatagtacagaagatatggatggattatcttgtctttgcaaataatagagctgctggatccagaaacaaagttcaagaattcaaattttttactgatttagtgaatagatgtttggttacagtccctgcccgataccccattccttttagcagtgctgattactggtccaactatgaatttcataatagggttattttcttttatttgagctgtgttccaaagacccagcattccaaaaccttggaacggttttgttcagttatgccagctaattctggacttgcattgaggttacttcaacatgaatgggaagaaagcaatgttcagattctgaaacttcaagccaagatgtttacatataatatcccaacatgcctggccacctggaaaatagccattgctgctgagattgttctaaagggacaaagagaggtccaccgtttatatcagagagccttacagaagttacctctttgtgcatcactgtggaaagatcaactcttgtttgaagcatcagaaggaggtaaaactgataacctgagaaaactagtttccaagtgccaagagattggagtcagcctaaatgagctcttaaatttaaacagtaacaaaacagaaagcaagaatcactgaacactgggtgcagtcagttctaagtccttataataattgccaaaattatttgaatgattcttcaagattaggctgatccctggctaaggtctgtgtaaggcagacaagcgttattgatcatatcaagttccctacaatatcctgtcctcaaaaccggaagcaatgaacatgatcctcttcggttggataaatgaacttcctgtttggcctgcttctaggccctgccagattctcataacatcatatacgtaagtatagttcctcaaagtgactgacatttattttaattttgctttgtttttttttattttctcccccattcctttattttgtgttattcctgactcacttgacactctctgatgcctgagagattcctgtttgggatttaatatccagggctgtgtttacagtaaaaaaagcaggcagtcccttttagtttttcctttttaaatttttttgagattcttcatttcaggatttaaaactatagcagtccatcttaaggaaagtgtaactgccatggccacaagtctgctagttgcacttgaatgctctatcagggttgtttattaccctttctacgttctggactccttgccgagactgtttaacttgaagattaaagaaactattgcaaatgccagtgcatcagaacctaagagtggtcaaatattatgtgcaatttttttgtaaagaaattttaatttataataaagtttaacagtttaaagaacagttaatatttgaactgctttgtattgaaatactactttgtagtattgaaattgtttatatacttttttaatataagttaactttctaaaaactcttgctgtctttattcacttttcacactggtgggaaagggttgaagtcggagatacggatattcaccataacttatagcaatacttttttatcttgaaactgctttcccattaaaaaaaaaaaaa

SEQ ID NO: 204286 - DNA, 7597 bp, Homo sapiens
  Payload ID: 20290
  Gene Name: zinc finger, C3H1-type containing
  Uniprot ID: O60293
  ENST ID: ENST00000552994
  CDS Start-End: 210-5942
cgctaggaaagggaactgggttgcgacggtccggcgagagagagctggggtgctggggtgcggggaagttggggagcagaggccgcttggtgtccgagtagggtaagaccgcaccgacccagtccgttaggaaagaagggaaacgaggcaattgtcgggcggatccccggacggagggctaaggttgtgtggaaggcgctgctccccggatggcgaccgcagatactccggccccggcctccagtggcctctcgccgaaggaagaaggggagcttgaagatggggaaatcagtgacgacgataataacagccagatacggagtcggagcagcagcagcagcagcggcggcgggctgttaccctatccgcggcgaaggcctcctcactcggcccggggcggtggatctggcggaggcggtggctcttcctcgtcatcgtcctcttctcagcagcagctgaggaatttctcacgctcgcggcacgcgtctgagcggggccacctcaggggacccagcagctaccgacccaaagaaccgttccggtctcatccgccttctgtacggatgccttcgagctcactgtccgaaagcagtccccggccgtctttctgggagcggagccacctcgccttggaccgtttccgctttcgaggcaggccttaccggggtgggagtcgctggagtcgggggcgaggagtgggtgagcgaggaggcaagccggggtgcagacctcctctgggaggaggagcaggatccgggttcagcagcagtcagagctggcgagagccctctccacctcggaagagctccaaaagttttggaaggtctccatcaagaaaacaaaattattcatcaaaaaatgaaaactgtgtggaagaaacttttgaagatttgcttttaaagtataaacaaatacagttggaactagaatgcatcaataaggatgaaaaactagcattgagtagcaaagaagagaatgtgcaggaagatcctaaaacattgaacttcgaggaccaaactagcactgataatgtcagtattacaaaggattcaagtaaagaagtagctcctgaggagaaaacacaagtcaaaacttttcaggcatttgaattaaaaccactcaggcaaaaattgactttaccaggagataagaaccgtttgaaaaaagttaaagatggagcaaaaccactttccctgaaatccgacactactgattctagtcaaggattacaagataaagaacaaaatttaacaagaagaattagtacctcagatattctgtctgaaaagaaacttggtgaagatgaagaggaactatctgaattacagcttcgccttttggctcttcagtcagccagtaaaaaatggcaacaaaaagaacagcaggtgatgaaagaaagcaaagaaaagttgactaagacgaaaactgtacagcaaaaagttaaaacaagtacaaaaacacattcggccaaaaaagttagcactacagctaaacaagcattgaggaagcagcaaacaaaggcatggaagaaactacaacaacaaaaagagcaggaaagacagaaagaagaggatcagcggaaacaagctgaagaagaagagagaaggaaaagagaggaagaaatcagaaaaattcgagatctctcaaatcaggaagaacagtacaatcgattcatgaaattggttggtggcaagaggagatcaagaagtaaatcttcagatcctgacctgaggcgatccttagataagcaacctactgatagtggaggaggcatttatcagtatgataactatgaagaagttgctatggatacagatagtgaaaccagttctccagctccttcaccagtgcaaccgccatttttctctgaatgttcattggggtatttttctccagcaccatctctttctttgcctccaccacctcaggtttcttctctgccacctttgagccagccttatgtggaaggcttgtgtgtttctcttgaacctctacctcctctaccaccattaccacctctcccacctgaagatccagaacagcctccaaaaccaccttttgcagatgaggaagaggaggaagaaatgctgcttcgagaagaactacttaaatctctagcaaataaaagagcttttaagccagaggaaacatccagtaatagtgacccaccttcacctccagttctgaacaattcacatcctgtgccaagaagcaatctatcaatagtcagtattaacacagtgtctcagcctaggatacagaatccaaagtttcacagaggaccccgtcttccacgaactgtgatctcgcttccaaagcataaatcagtggttgtaacactaaatgattcagatgatagtgaatctgatggagaggcttccaagtcaacaaatagtgtttttggtggattagagtccatgattaaagaagcaagacgaactgctgagcaagcttcaaaaccgaaagtacctccaaaatctgaaaaagaaaatgatcctctgcgaacaccggaggctttgcctgaagaaaagaagattgaatatagattgttaaaggaagagattgccaaccgtgagaaacagcgtttgattaaatcagatcagctgaagacaagttcatcatccccagcaaactctgatgtggaaattgatggtattggcaggatagcaatggttactaagcaggttacagatgcagaatcaaaactgaaaaaacataggattctcttgatgaaagatgaatctgttttaaagaatttagtgcaacaagaagctaagaagaaagaatctgttagaaatgctgaagcaaagattacaaaacttacagaacagcttcaagcaactgaaaaaattcttaatgttaacagaatgtttttgaagaagcttcaggaacaaattcacagagttcaacagcgtgttacaattaagaaagctttgactctaaaatatggagaagagcttgctcgggcaaaggcagtggccagtaaagaaataggaaaacgtaaactggaacaagatcgctttgggccaaacaaaatgatgagactggacagttctccagtatcaagtccaagaaagcattcagcagaactaattgctatggagaaaagacggttacaaaagctagaatatgaatatgccctgaaaattcaaaaattaaaagaagcccgtgcccttaaagcaaaggaacaacaaaatatctctccagttgtggaagaggaacccgaattttctttacctcaaccctcacttcatgatctgacacaagataaattaaccctggacactgaagaaaatgatgttgatgatgaaattttgtctggttcaagcagagagcgaagaagatcttttttagaatccaattattttactaaacctaaccttaagcacactgatactgctaacaaagaatgcataaacaaacttaataaaaatactgtagaaaaaccagaactttttctagggttaaaaattggtgaattgcaaaaattgtattcaaaagctgacagcctaaaacagctgattttaaaaaccaccacaggcattacagagaaggttttgcatggtcaggagatttctgtagatgtggattttgtcacagcacaaagtaaaacaatggaagtgaagccatgtccttttagaccctaccatagtcctcttctagtttttaagtcctacagatttagtccatattatcgaaccaaggaaaaacttcccctgagctcagtatcatacagtaatatgattgaaccggatcagtgtttctgccgttttgatttaacaggaacatgtaatgatgatgattgtcaatggcagcatatacaagactatacacttagccgaaaacagttattccaggacattctgtcatataatctgtctttgattggttgtgcagagacaagtactaatgaagaaattactgcttcagcagaaaaatatgttgagaaactttttggagtaaacaaagatcgaatgtcaatggaccagatggctgttctccttgttagcaatatcaatgaaagtaaaggtcatactcctccatttacaacctacaaagataaaagaaagtggaagccaaagttttggagaaaacctatttcagataatagcttcagtagtgatgaggaacagtctacaggaccaattaagtatgctttccagccagagaaccaaataaatgttccagctctggatacagttgtcactccagatgatgtcagatactttacaaatgagactgatgacatcgctaatttagaagcaagtgtgcttgaaaatccttctcatgtacaactttggctcaagcttgcgtacaagtacttgaatcaaaatgagggggagtgctcagaatccttggattctgctttaaatgttctggcgcgagcattggaaaataacaaagacaatccagaaatttggtgccattacctcagattgttctcaaaaagaggaaccaaggacgaggtgcaggaaatgtgtgaaacagctgttgaatatgctccagattatcaaagcttttggacttttctacacctagaaagtacctttgaagaaaaggattacgtatgtgagagaatgttggagtttctgatgggagcagccaagcaggaaacatccaatattttgtcctttcagcttttagaggctcttttgtttagagttcagctgcacatatttactggaagatgccaaagtgcactggcaattttacagaatgcattgaaatctgctaatgatggaatagtagctgaataccttaaaaccagtgatcgatgtttggcatggttggcctacatacatcttattgaattcaacattctcccttcaaaattttatgatccatctaatgataatccttcaagaattgttaacactgaatcatttgtaatgccatggcaagctgttcaagatgtaaagactaatcctgacatgttgttagcagtttttgaagatgcagtgaaagcttgcacagatgagagccttgctgttgaggaaagaatagaggcctgccttccactttacacaaacatgattgctctgcaccaactcctggagaggtatgaggctgcaatggagctttgtaaatctttattggaatcatgtcctattaactgccagttgctggaagctcttgttgcattatatttgcaaacaaatcagcatgacaaagccagagcagtgtggcttactgcatttgaaaaaaatcctcagaatgcagaggttttttatcatatgtgcaaattcttcatcttacagaatcgaggcgataatcttcttccatttttgcggaaatttattgcatccttctttaaaccggggtttgagaagtataataacttggatctgtttcggtatctcttaaatattccaggaccaattgacattccatctcgtttatgtaaagggaattttgatgatgatatgtttaaccaccaagttccttatttgtggctgatttactgcctttgtcatcctcttcaatcaagtattaaagaaacagtggaggcatatgaggcagcattaggggtggctatgagatgtgatatagtacagaagatatggatggattatcttgtctttgcaaataatagagctgctggatccagaaacaaagttcaagaattcaaattttttactgatttagtgaatagatgtttggttacagtccctgcccgataccccattccttttagcagtgctgattactggtccaactatgaatttcataatagggttattttcttttatttgagctgtgttccaaagacccagcattccaaaaccttggaacggttttgttcagttatgccagctaattctggacttgcattgaggttacttcaacatgaatgggaagaaagcaatgttcagattctgaaacttcaagccaagatgtttacatataatatcccaacatgcctggccacctggaaaatgtaatgcaacaatcatgtacatgtttttatagctattgcttttatttataaggtttgctccagacaggtaaatctgaaatgacatctatatatatatatatatatatatttttttttttttttttcctggacagattgctattcttaatttagatttgtttttagcatttactgaggtttaatgagagtgagtactcattgaatagcctctaaaagcaaaaagcgtagacttttaattttctttgaaggacaacatttaggtgacagtactgttatcaaacaaatctgctacagacattttaagaccacctcttgaaatggtggtgtgtcacctgttgtagtctgatttcttctttcttttaaaggtgttagtgctaggtatttttgactagtaattatgaggtgttttttttttgttgttgttgttgttttttttttctcctgtgaacgttatttatgttcaaaacactggtctgcttttttcttgtaaagttgataaaaattgttgaatttttcttttcactataggttttcctccttggaagtttagcctgttaactttcaggaagttttgtactcagattcccacagtcagtattctgccagtggtggtgtttcattttgttcaaagatatataaatttttcttttcctttttctatatttctttttttttttttttctcttagagccattgctgctgagattgttctaaagggacaaagagaggtccaccgtttatatcagagagccttacagaagttacctctttgtgcatcactgtggaaagatcaactcttgtttgaagcatcagaaggaggtaaaactgataacctgagaaaactagtttccaagtgccaagagattggagtcagcctaaatgagctcttaaatttaaacagtaacaaaacagaaagcaagaatcactgaacactgggtgcagtcagttctaagtccttataataattgccaaaattatttgaatgattcttcaagattaggctgatccctggctaaggtctgtgtaaggcagacaagcgttattgatcatatcaagttccctacaatatcctgtcctcaaaaccggaagcaatgaacatgatcctcttcggttggataaatgaacttcctgtttggcctgcttctaggccctgccagattctcataacatcatatacgtaagtatagttcctcaaagtgactgacatttattttaattttgctttgtttttttttattttctcccccattcctttattttgtgttattcctgactcacttgacactctctgatgcctgagagattcctgtttgggatttaatatccagggctgtgtttacagtaaaaaaagcaggcagtcccttttagtttttcctttttaaatttttttgagattcttcatttcaggatttaaaactatagcagtccatcttaaggaaagtgtaactgccatggccacaagtctgctagttgcacttgaatgctctatcagggttgtttattaccctttctacgttctggactccttgccgagactgtttaacttgaagattaaagaaactattgcaaatgccagtgcatcagaacctaagagtggtcaaatattatgtgcaatttttttgtaaagaaattttaatttataataaagtttaacagttt

SEQ ID NO: 204287 - DNA, 1484 bp, Homo sapiens
  Payload ID: 20290
  Gene Name: zinc finger, C3H1-type containing
  ENST ID: ENST00000552037
  CDS Start-End: 249-1325
gcgaggcggaagaaccccgatcgctgaggagcaagggggcgctaggaaagggaactgggttgcgacggtccggcgagagagagctggggtgctggggtgcggggaagttggggagcagaggccgcttggtgtccgagtagggtaagaccgcaccgacccagtccgttaggaaagaagggaaacgaggcaattgtcgggcggatccccggacggagggctaaggttgtgtggaaggcgctgctccccggatggcgaccgcagatactccggccccggcctccagtggcctctcgccgaaggaagaaggggagcttgaagatggggaaatcagtgacgacgataataacagccagatacggagtcggagcagcagcagcagcagcggcggcgggctgttaccctatccgcggcgaaggcctcctcactcggcccggggcggtggatctggcggaggcggtggctcttcctcgtcatcgtcctcttctcagcagcagctgaggaatttctcacgctcgcggcacgcgtctgagcggggccacctcaggggacccagcagctaccgacccaaagaaccgttccggtctcatccgccttctgtacggatgccttcgagctcactgtccgaaagcagtccccggccgtctttctgggagcggagccacctcgccttggaccgtttccgctttcgaggcaggccttaccggggtgggagtcgctggagtcgggggcgaggagtgggtgagcgaggaggcaagccggggtgcagacctcctctgggaggaggagcaggatccgggttcagcagcagtcagagctggcgagagccctctccacctcggaagagctccaaaagttttggaaggtctccatcaagaaaacaaaattattcatcaaaaaatgaaaactgtgtggaagaaacttttgaagatttgcttttaaagtataaacaaatacagttggaactagaatgcatcaataaggatgaaaaactagcattgagtagcaaagaagagaatgtgcaggaagatcctaaaacattgaacttcgaggaccaaactagcactgataatgtcagtattacaaaggattcaagtaaagaagtagctcctgaggagaaaacacaagtcaaaacttttcaggcatttgaattaaaaccactcaggcaaaaattgactttaccaggagataagaaccgtttgaaaaaagttaaagatggagcaaaaccactttccctgaaatccgacactactgattctagtcaaggtatcccttatcgggtaaaggagggttttactcctattcctggtttgaaattttcagcgtgaatggatgttgaagtttacaaaatctgttttcttcattattgggatgagcatctaatttattttaatttgttagtgtaatgaattatataatttatttctagtattaaaccacccttgtatgcttgcgtttaatacagtttatgatataccatttttaaa

SEQ ID NO: 204288 - DNA, 1771 bp, Homo sapiens
  Payload ID: 20290
  Gene Name: zinc finger, C3H1-type containing
  Uniprot ID: O60293
  ENST ID: ENST00000548100
  CDS Start-End: 215-1255
gggggcgctaggaaagggaactgggttgcgacggtccggcgagagagagctggggtgctggggtgcggggaagttggggagcagaggccgcttggtgtccgagtagggtaagaccgcaccgacccagtccgttaggaaagaagggaaacgaggcaattgtcgggcggatccccggacggagggctaaggttgtgtggaaggcgctgctccccggatggcgaccgcagatactccggccccggcctccagtggcctctcgccgaaggaagaaggggagcttgaagatggggaaatcagtgacgacgataataacagccagatacggagtcggagcagcagcagcagcagcggcggcgggctgttaccctatccgcggcgaaggcctcctcactcggcccggggcggtggatctggcggaggcggtggctcttcctcgtcatcgtcctcttctcagcagcagctgaggaatttctcacgctcgcggcacgcgtctgagcggggccacctcaggggacccagcagctaccgacccaaagaaccgttccggtctcatccgccttctgtacggatgccttcgagctcactgtccgaaagcagtccccggccgtctttctgggagcggagccacctcgccttggaccgtttccgctttcgaggcaggccttaccggggtgggagtcgctggagtcgggggcgaggagtgggtgagcgaggaggcaagccggggtgcagacctcctctgggaggaggagcaggatccgggttcagcagcagtcagagctggcgagagccctctccacctcggaagagctccaaaagttttggaaggtctccatcaagaaaacaaaattattcatcaaaaaatgaaaactgtgtggaagaaacttttgaagatttgcttttaaagtataaacaaatacagttggaactagaatgcatcaataaggatgaaaaactagcattgagtagcaaagaagagaatgtgcaggaagatcctaaaacattgaacttcgaggaccaaactagcactgataatgtcagtattacaaaggattcaagtaaagaagtagctcctgaggagaaaacacaagtcaaaacttttcaggcatttgaattaaaaccactcaggcaaaaattgactttaccaggagataagaaccgtttgaaaaaagttaaagatggagcaaaaccactttccctgaaatccgacactactgattctagtcaaggtaatggaattaaatatttcagttagtaatgactcttcttcctctaaagtagtaactacttgttttggcagtgtacttcattgaaatgattgtaattatctgtaaattcttttgtactttctatgtagacattcatatcattgaataattactaattttgtttacttttagtctttatttatttatttattttttgcctgacattctggcctctataatagaatgttatacataagtgataatagtggacacctttgtttcctaatttaaagaaaatggttttgacatttaccattaaatatgatgttaatttttttgtaggtatcccttatcgggtaaaggagggttttactcctattcctggtttgaaattttcagcgtgaatggatgttgaagtttacaaaatctgttttcttcattattgggatgagcatctaatttattttaatttgttagtgtaatgaattatataatttatttctagtattaaaccacccttgtatgcttgcgtttaatacagtttatgatataccatttttaaa

SEQ ID NO: 204289 - DNA, 2017 bp, Homo sapiens
  Payload ID: 20291
  Gene Name: zinc finger, C3HC-type containing 1
  Uniprot ID: Q86WB0
  ENST ID: ENST00000311873
  CDS Start-End: 195-1640
gcctcaagaggcggatattaacctcccaggacggaagttccggagccttcaaactctcggggaagcaactcggcagcggaccaagatggcggcgccctgtgagggacaagcgtttgccgtaggggttgaaaagaattggggtgcagtagttcgctccccagaagggaccccccagaaaatccggcagctgatagatgaggggattgccccggaagagggaggcgtggacgcaaccacacccgcttgaggctctctatgaatctctgagagtcttagagaaggacacgtctgccacatcccagtcagttaatggatcaccccaagcggaacaaccttcattggaatctacaagcaaagaagccttctttagcagagtggaaacattttcttctttgaaatgggcaggtaagccctttgagctgtctccactcgtctgtgcaaaatatggctgggtcacagtggaatgtgatatgctcaagtgctctagctgtcaagcttttctctgtgccagtttacaaccagcttttgactttgacagatataagcaacgatgtgctgagctgaagaaagccttgtgtactgcccatgagaagttctgtttctggccagacagcccatccccagaccgatttgggatgttgcccctggatgagcctgctattcttgttagtgaattcctagatcgttttcaaagcctttgtcacttggacctccagcttccttccctaaggccggaggacttgaaaactatgtgcttgacagaagacaagatcagtcttctcctacacttgcttgaagatgaacttgatcaccgaactgatgagagaaaaactacaatcaaattaggctcagacatccaagtccacgtcactgcctgtattctctctgtgtgtggctgggcgtgtagttcctctttggaatccatgcagctctccctgataacatgttcgcaatgtatgaggaaggtggggctctggggcttccagcagattgaatcgtccatgactgacctggatgcatcctttggcctgaccagctccccaatcccaggccttgaggggcgaccagagcgcttacctctggtgcctgaatctcctcggaggatgatgacccggagccaggatgccactttctccccaggctcagagcaggctgaaaagagccctggtcccattgtctctcgaactcggagctgggactcttccagtcctgttgaccgtcctgagccagaggctgctagccccaccaccagaactcgcccagtgacccgaagcatgggaacaggagacacccctggcctggaggtaccatctagccctctgcggaaagccaagcgagctcgcctctgctcctccagcagttcggacacatcttcccgaagcttctttgatcccacctctcagcatagagactggtgcccttgggtgaatatcacacttggcaaagaaagcagggagaatggtggaactgaaccagatgccagcgccccagcagagccaggctggaaagcagtgctgaccatcctcttggcgcacaaacagtctagccagccagctgaaacggactccatgagtctctctgagaaatcaaggaaagtattccgaatatttcggcagtgggaatctctgtgctcatgctgaagatactccagcgccttcctggagatagctggaatgagagtgactttttgaaaaattaaggctgagttcctttcggtcagctgacactaagtttttcctgttctgggttaatcataaggagccccctgccatagcaaaggcagtgagtgtcaactatctgcatctggctgagagagacccgtttcctttcagggatgtggacagggtaagggcagcaagcatggttctgttaaaggagtgtgggattaacagactagaaggaagactaaggacctgaccacccatttcagcatcttcaatgtggagcagtgttctgaggactcttctatcctaggactatgacagtgtgtattaataaaatatttgctaagattctc

SEQ ID NO: 204290 - DNA, 1972 bp, Homo sapiens
  Payload ID: 20291
  Gene Name: zinc finger, C3HC-type containing 1
  Uniprot ID: Q86WB0
  ENST ID: ENST00000358303
  CDS Start-End: 86-1594
gcctcaagaggcggatattaacctcccaggacggaagttccggagccttcaaactctcggggaagcaactcggcagcggaccaagatggcggcgccctgtgagggacaagcgtttgccgtaggggttgaaaagaattggggtgcagtagttcgctccccagaagggaccccccagaaaatccggcagctgatagatgaggggattgccccggaagagggaggcgtggacgcgaaggacacgtctgccacatcccagtcagttaatggatcaccccaagcggaacaaccttcattggaatctacaagcaaagaagccttctttagcagagtggaaacattttcttctttgaaatgggcaggtaagccctttgagctgtctccactcgtctgtgcaaaatatggctgggtcacagtggaatgtgatatgctcaagtgctctagctgtcaagcttttctctgtgccagtttacaaccagcttttgactttgacagatataagcaacgatgtgctgagctgaagaaagccttgtgtactgcccatgagaagttctgtttctggccagacagcccatccccagaccgatttgggatgttgcccctggatgagcctgctattcttgttagtgaattcctagatcgttttcaaagcctttgtcacttggacctccagcttccttccctaaggccggaggacttgaaaactatgtgcttgacagaagacaagatcagtcttctcctacacttgcttgaagatgaacttgatcaccgaactgatgagagaaaaactacaatcaaattaggctcagacatccaagtccacgtcactgcctgtattctctctgtgtgtggctgggcgtgtagttcctctttggaatccatgcagctctccctgataacatgttcgcaatgtatgaggaaggtggggctctggggcttccagcagattgaatcgtccatgactgacctggatgcatcctttggcctgaccagctccccaatcccaggccttgaggggcgaccagagcgcttacctctggtgcctgaatctcctcggaggatgatgacccggagccaggatgccactttctccccaggctcagagcaggctgaaaagagccctggtcccattgtctctcgaactcggagctgggactcttccagtcctgttgaccgtcctgagccagaggctgctagccccaccaccagaactcgcccagtgacccgaagcatgggaacaggagacacccctggcctggaggtaccatctagccctctgcggaaagccaagcgagctcgcctctgctcctccagcagttcggacacatcttcccgaagcttctttgatcccacctctcagcatagagactggtgcccttgggtgaatatcacacttggcaaagaaagcagggagaatggtggaactgaaccagatgccagcgccccagcagagccaggctggaaagcagtgctgaccatcctcttggcgcacaaacagtctagccagccagctgaaacggactccatgagtctctctgagaaatcaaggaaagtattccgaatatttcggcagtgggaatctctgtgctcatgctgaagatactccagcgccttcctggagatagctggaatgagagtgactttttgaaaaattaaggctgagttcctttcggtcagctgacactaagtttttcctgttctgggttaatcataaggagccccctgccatagcaaaggcagtgagtgtcaactatctgcatctggctgagagagacccgtttcctttcagggatgtggacagggtaagggcagcaagcatggttctgttaaaggagtgtgggattaacagactagaaggaagactaaggacctgaccacccatttcagcatcttcaatgtggagcagtgttctgaggactcttctatcctaggactatgacagtgtgtattaataaaatatttgctaagattctca

SEQ ID NO: 204291 - DNA, 1676 bp, Homo sapiens
  Payload ID: 20291
  Gene Name: zinc finger, C3HC-type containing 1
  Uniprot ID: Q86WB0
  ENST ID: ENST00000360708
  CDS Start-End: 9-1304
ggaccaagatggcggcgccctgtgagggacaagcgtttgccgtaggggttgaaaagaattggggtgcagtagttcgctccccagaagggaccccccagaaaatccggcagctgatagatgaggggattgccccggaagagggaggcgtggacgcgaaggacacgtctgccacatcccagtcagttaatggatcaccccaagcggaacaaccttcattggaatctacaagcaaagaagccttctttagcagagtggaaacattttcttctttgaaatgggcaggtaagccctttgagctgtctccactcgtctgtgcaaaatatggctgggtcacagtggaatgtgatatgctcaagtgctctagctgtcaagcttttctctgtgccagtttacaaccagcttttgactttgacagatataagcaacgatgtgctgagctgaagaaagccttgtgtactgcccatgagaagttctgtttctggccagacagcccatccccagaccgatttgggatgttgcccctggatgagcctgctattcttgttagtgaattcctagatcgttttcaaagcctttgtcacttggacctccagcttccttccctaaggccggaggacttgaaaactatgtgcttgacagaagacaagatcagtcttctcctacacttgcttgaagatgaacttgatcaccgaactgatgagagaaaaactacaatcaaattaggctcagacatccaagtccacgtcactgcctgtattctctctgtgtgtggctgggcgtgtagttcctctttggaatccatgcagctctccctgataacatgttcgcaatgtatgaggaaggtggggctctggggcttccagcagattgaatcgtccatgactgacctggatgcatcctttggcctgaccagctccccaatcccaggccttgaggggcgaccagagcgcttacctctggtgcctgaatctcctcggaggatgatgacccggagccaggatgccactttctccccaggctcagagcaggacacatcttcccgaagcttctttgatcccacctctcagcatagagactggtgcccttgggtgaatatcacacttggcaaagaaagcagggagaatggtggaactgaaccagatgccagcgccccagcagagccaggctggaaagcagtgctgaccatcctcttggcgcacaaacagtctagccagccagctgaaacggactccatgagtctctctgagaaatcaaggaaagtattccgaatatttcggcagtgggaatctctgtgctcatgctgaagatactccagcgccttcctggagatagctggaatgagagtgactttttgaaaaattaaggctgagttcctttcggtcagctgacactaagtttttcctgttctgggttaatcataaggagccccctgccatagcaaaggcagtgagtgtcaactatctgcatctggctgagagagacccgtttcctttcagggatgtggacagggtaagggcagcaagcatggttctgttaaaggagtgtgggattaacagactagaaggaagactaaggacctgaccacccatttcagcatcttcaatgtggagcagtgttctgaggactcttctatcctaggactatgacagtgtgtattaataaaatatttgctaaga

SEQ ID NO: 204292 - DNA, 559 bp, Homo sapiens
  Payload ID: 20291
  Gene Name: zinc finger, C3HC-type containing 1
  ENST ID: ENST00000484432
  CDS Start-End: 20-307
aactcggcagcggaccaagatggcggcgccctgtgagggacaagcgtttgccgtaggggttgaaaagaattggggtgcagtagttcgctccccagaagggaccccccagaaaatccggcagctgatagatgaggggattgccccggaagagggaggcgtggacgcgaaggacacgtctgccacatcccagtcagttaatggatcaccccaagcggaacaaccttcattggaatctacaagcaaagaagccttctttagcagagtggaaacattttcttactttgatcaatcccctatatgtgcttaatctcccatttctgccatgctgccatcctttcttgcatgaatctctcgtcaccccatttaggtcctagcactccacacttggctgcccgcaagtgaatgcctgttacataccactttggttctgacaccctgggctgagctgcctcttcgcagcctcctggctctgacatcttccttgttcaccgcctaatggctttaagactgaattgctcaggaaagggaagataagcaacgatgtgctgagctgaagaaa

SEQ ID NO: 204293 - DNA, 760 bp, Homo sapiens
  Payload ID: 20291
  Gene Name: zinc finger, C3HC-type containing 1
  ENST ID: ENST00000483827
  CDS Start-End: 9-158
ggaccaagatggcggcgccctgtgagggacaagcgtttgccgtaggggttgaaaagaattggggtgcagtagttcgctccccagaagggaccccccagaaaatccggcagctgatagatgaggggattgccccggaagagggaggcgtggacgcataagcaacgatgtgctgagctgaagaaagccttgtgtactgcccatgagaagttctgtttctggccagacagcccatccccaggtacctggaactcaatgtgtataaaactgaactcttcatcttatacctaaaactttctccatcttggcaaatggcactgacgtcccatccagttgtcctagccagaaacctgaaagtcactttagatgctcttctctatggtcacccactttgacctatccattctacctcctacatggatcttagatataacctttcaattatatgatcccttggtttggttctttaacattcaaaggacatttgtgtggataaaagaacactcagttatttcactttatgcttaaatttattaagcaaaactaataattttgaagaccgatttgggatgttgcccctggatgagcctgctattcttgttagtgaattcctagatcgttttcaaagcctttgtcacttggacctccagcttccttccctaaggccggaggacttgaaaactatgtgcttgacagaagacaagatcagtcttctcctacacttgcttgaagatgaacttgatcaccgaactgatgagagaaa

SEQ ID NO: 204294 - DNA, 1741 bp, Homo sapiens
  Payload ID: 20291
  Gene Name: zinc finger, C3HC-type containing 1
  ENST ID: ENST00000481503
  CDS Start-End: 24-1403
aagcaactcggcagcggaccaagatggcggcgccctgtgagggacaagcgtttgccgtaggggttgaaaagaattggggtgcagtagttcgctccccagaagggaccccccagaaaatccggcagctgatagatgaggggattgccccggaagagggaggcgtggacgcgaaggacacgtctgccacatcccagtcagttaatggatcaccccaagcggaacaaccttcattggaatctacaagcaaagaagccttctttagcagagtggaaacattttcttctttgaaatgggcaggtaagccctttgagctgtctccactcgtctgtgcaaaatatggctgggtcacagtggaatgtgatatgctcaagtgctctagctgtcaagcttttctctgtgccagtttacaaccagcttttgactttgacagatataagcaacgatgtgctgagctgaagaaagccttgtgtactgcccatgagaagttctgtttctggccagacagcccatccccagaccgatttgggatgttgcccctggatgagcctgctattcttgttagtgaattcctagatcgttttcaaagcctttgtcacttggacctccagcttccttccctaaggccggaggacttgaaaactatgtgcttgacagaagacaagatcagtcttctcctacacttgcttgaagatgaacttgatcaccgaactgatgagagaaaaactacaatcaaattaggctcagacatccaagtccacgtcactgcctgtattctctctgtgtgtggctgggcgtgtagctccccaatcccaggccttgaggggcgaccagagcgcttacctctggtgcctgaatctcctcggaggatgatgacccggagccaggatgccactttctccccaggctcagagcaggctgaaaagagccctggtcccattgtctctcgaactcggagctgggactcttccagtcctgttgaccgtcctgagccagaggctgctagccccaccaccagaactcgcccagtgacccgaagcatgggaacaggagacacccctggcctggaggtaccatctagccctctgcggaaagccaagcgagctcgcctctgctcctccagcagttcggacacatcttcccgaagcttctttgatcccacctctcagcatagagactggtgcccttgggtgaatatcacacttggcaaagaaagcagggagaatggtggaactgaaccagatgccagcgccccagcagagccaggctggaaagcagtgctgaccatcctcttggcgcacaaacagtctagccagccagctgaaacggactccatgagtctctctgagaaatcaaggaaagtattccgaatatttcggcagtgggaatctctgtgctcatgctgaagatactccagcgccttcctggagatagctggaatgagagtgactttttgaaaaattaaggctgagttcctttcggtcagctgacactaagtttttcctgttctgggttaatcataaggagccccctgccatagcaaaggcagtgagtgtcaactatctgcatctggctgagagagacccgtttcctttcagggatgtggacagggtaagggcagcaagcatggttctgttaaaggagtgtgggattaacagactagaaggaagactaaggacctgaccacccatttcagcatcttcaatgtggagcagtgttctgaggactcttctatcctaggact

SEQ ID NO: 204295 - DNA, 1934 bp, Homo sapiens
  Payload ID: 20291
  Gene Name: zinc finger, C3HC-type containing 1
  ENST ID: ENST00000467642
  CDS Start-End: 9-170
ggaccaagatggcggcgccctgtgagggacaagcgtttgccgtaggggttgaaaagaattggggtgcagtagttcgctccccagaagggaccccccagaaaatccggcagctgatagatgaggggattgccccggaagagggaggcgtggacgcaaccacacccgcttgaggctctctatgaatctctgagagtcttagagaaggacacgtctgccacatcccagtcagttaatggatcaccccaagcggaacaaccttcattggaatctacaagcaaagaagccttctttagcagagtggaaacattttcttctttgaaatgggcaggtaagccctttgagctgtctccactcgtctgtgcaaaatatggctgggtcacagtggaatgtgatatgctcaagtgctctagctgtcaagcttttctctgtgccagtttacaaccagcttttgactttgacagatataagcaacgatgtgctgagctgaagaaagccttgtgtactgcccatgagaagttctgtttctggccagacagcccatccccagaccgatttgggatgttgcccctggatgagcctgctattcttgttagtgaattcctagatcgttttcaaagcctttgtcacttggacctccagcttccttccctaaggccggaggacttgaaaactatgtgcttgacagaagacaagatcagtcttctcctacacttgcttgaagatgaacttgatcaccgaactgatgagagaaaaactacaatcaaattaggctcagacatccaagtccacgtcactgcctgtattctctctgtgtgtggctgggcgtgtagttcctctttggaatccatgcagctctccctgataacatgttcgcaatgtatgaggaaggtggggctctggggcttccagcagattgaatcgtccatgactgacctggatgcatcctttggcctgaccagctccccaatcccaggccttgaggggcgaccagagcgcttacctctggtgcctgaatctcctcggaggatgatgacccggagccaggatgccactttctccccaggctcagagcaggctgaaaagagccctggtcccattgtctctcgaactcggagctgggactcttccagtcctgttgaccgtcctgagccagaggctgctagccccaccaccagaactcgcccagtgacccgaagcatgggaacaggagacacccctggcctggaggtaccatctagccctctgcggaaagccaagcgagctcgcctctgctcctccagcagttcggacacatcttcccgaagcttctttgatcccacctctcagcatagagactggtgcccttgggtgaatatcacacttggcaaagaaagcagggagaatggtggaactgaaccagatgccagcgccccagcagagccaggctggaaagcagtgctgaccatcctcttggcgcacaaacagtctagccagccagctgaaacggactccatgagtctctctgagaaatcaaggaaagtattccgaatatttcggcagtgggaatctctgtgctcatgctgaagatactccagcgccttcctggagatagctggaatgagagtgactttttgaaaaattaaggctgagttcctttcggtcagctgacactaagtttttcctgttctgggttaatcataaggagccccctgccatagcaaaggcagtgagtgtcaactatctgcatctggctgagagagacccgtttcctttcagggatgtggacagggtaagggcagcaagcatggttctgttaaaggagtgtgggattaacagactagaaggaagactaaggacctgaccacccatttcagcatcttcaatgtggagcagtgttctgaggactcttctatcctaggactatgacagtgtgtattaataaaatatttgctaag

SEQ ID NO: 204296 - DNA, 567 bp, Homo sapiens
  Payload ID: 20291
  Gene Name: zinc finger, C3HC-type containing 1
  ENST ID: ENST00000470651
  CDS Start-End: 12-164
agcggaccaagatggcggcgccctgtgagggacaagcgtttgccgtaggggttgaaaagaattggggtgcagtagttcgctccccagaagggaccccccagaaaatccggcagctgatagatgaggggattgccccggaagagggaggcgtggacgcaccatagaggttgtgaagctgaggatactctactccaacatggccaacatggtactgatgggtagctctgtgaaaggagcagagactgaaggcggaagaaatgtggtaccacaccacgtcttctgcttttcactactttattccctgtgtgcaaggacagaaagacttacatgtcttcattcttcctttgctgatgttggaatgtctttcaaattccttctttgaaatgggcaggtaagccctttgagctgtctccactcgtctgtgcaaaatatggctgggtcacagtggaatgtgatatgctcaagtgctctagctgtcaagcttttctctgtgccagtttacaaccagcttttgactttgacagatataagcaacgatgtgctgagctgaagaaagccttgtgtact

SEQ ID NO: 204297 - DNA, 2363 bp, Homo sapiens
  Payload ID: 20292
  Gene Name: zinc finger, C4H2 domain containing
  Uniprot ID: Q9NQZ6
  ENST ID: ENST00000337990
  CDS Start-End: 357-962
gctgtcggagctcagaccagcaggcctacgacctagaaagtgctcaaaaccccacttcctaaggcctagaaggagcgacgtgaagatataaggtctcactatgttgcccatgctggtttcaaactcctgggctcaagtgatcctcctgcctctgtcttccaaattgctgagattactggcatgagccattgcacctggccttcttttttgagatggcctcaggttggctctgcctggagagggggaagcttgtaaagatggcttagaaaaaaagtcctggctccatttctattttctcccttcttttgctggcctgtttcctgctttttgcaaattgcaggaacaagaccctgcagatggagaagatcaaggctcgtttgaaggctgagtttgaggcacttgagtcagaggaaaggcacctgaaggaatacaagcaggagatggaccttctgctacaggagaagatggcccatgtggaggaactccgactgatccacgctgacatcaatgtgatggaaaacactatcaaacaatctgagaatgacctaaacaagctgctagagtctacaaggaggctgcatgatgagtataagccactgaaagaacatgtggatgccctgcgcatgactctgggcctgcagaggctccctgacttgtgtgaagaagaggagaagctttccttggattactttgagaagcagaaagcagaatggcagacagaacctcaggagccccccatccctgagtccctggccgctgcagccgctgccgcccaacagctccaagtggctaggaagcaggatactcggcagacggccaccttcaggcagcagcccccacctatgaaggcctgcttgtcatgtcaccagcaaattcaccggaatgcacctatatgccctctttgcaaggccaagagtcggtcccggaaccccaaaaagccgaaacggaagcaggatgaataaagaaagggagagcacatgaagctttgctaattataacccctcaccttgaccagagtcattgatgtcctgatgtgaaacaacccttgcccaaccccacgaagtctcctatttaatgtgatggaagcacaacccctctctcactttgctcctatttctttctgctcttgggatttctggtttaggaagagatgtggttcaggtgctaaacagtgtgtctgatgatcccttctctcccactcacatttcaacccctgcccttgtttggagctaagggaagggcaaaaggctcagatatgattctctatctcttgtgcctgaggcctggagcctaaggagctgtagggtctgaggggcaggggaggcccatatcttgtttcaggtaaaggacccagtatttcccctccttgtacttttgccttaggttctcaagggacaatagtcttcatgttggattctccaacaggctgggtgcatgtatccccctactcctaccctcatctcatccttaaggcccagaggtagcttggacaagccctccttttcataatcatttgggaggcatggctgtaattctttagctttctccacttctgtctcccacatatactaaaattcttaggtactaggctgtgtgtcttgggatcttaagatcaatgaacctttccccaatatctagtctttgcaaattctagtagaagatttccacagtgaaatcagtgagccagaccaactctacatctcctgcctaacctactgcctaagtcattagggctgagggctcggctgtaggggcttccttaggctgagagtgcccccaggctgacatctgtgttggcttttgttcagaaccattactctggcacatgctcaatggtatattgcagggaggagaggagtagatttagatttgagtaaatgccaatcactttacacatgaaggtgggtgggactttccttccattcatcccttgctctcttggatctgaactcttctggagcctcagctcaggatagctgctggccactcctgtcctgtggattgtgcaggtggcctttcctcccaaaagaaaaggcatcaggctccccaagccccacagctctcctttccaccaaagccaggtttcctggtaaggtcactcgaagataagggatggggatgggggctgactgacaaaaaattttagccccaggtctcagtacctggctggggagggggatatttttccttccttaagtagttttacattgccacagtgtgtatgtgttcactatataaaatgttcctctgctctttgaaagtaagagtgttgtgtctgtacaaatccttttaacatgcattcattggagtaaattctgagtatctactgtgtattggataatacaaaagatgtaatgtcattt

SEQ ID NO: 204298 - DNA, 2184 bp, Homo sapiens
  Payload ID: 20292
  Gene Name: zinc finger, C4H2 domain containing
  Uniprot ID: Q9NQZ6
  ENST ID: ENST00000374839
  CDS Start-End: 108-782
caggctcatagccccaagcccggaggaggtggctacattgtgtctattgtatcccttggctggtgtatttgtacatctctcgggacgtgaaattgacagtgaaaagtatggcagatgagcaagaaatcatgtgcaaattggaaagcattaaagagatcaggaacaagaccctgcagatggagaagatcaaggctcgtttgaaggctgagtttgaggcacttgagtcagaggaaaggcacctgaaggaatacaagcaggagatggaccttctgctacaggagaagatggcccatgtggaggaactccgactgatccacgctgacatcaatgtgatggaaaacactatcaaacaatctgagaatgacctaaacaagctgctagagtctacaaggaggctgcatgatgagtataagccactgaaagaacatgtggatgccctgcgcatgactctgggcctgcagaggctccctgacttgtgtgaagaagaggagaagctttccttggattactttgagaagcagaaagcagaatggcagacagaacctcaggagccccccatccctgagtccctggccgctgcagccgctgccgcccaacagctccaagtggctaggaagcaggatactcggcagacggccaccttcaggcagcagcccccacctatgaaggcctgcttgtcatgtcaccagcaaattcaccggaatgcacctatatgccctctttgcaaggccaagagtcggtcccggaaccccaaaaagccgaaacggaagcaggatgaataaagaaagggagagcacatgaagctttgctaattataacccctcaccttgaccagagtcattgatgtcctgatgtgaaacaacccttgcccaaccccacgaagtctcctatttaatgtgatggaagcacaacccctctctcactttgctcctatttctttctgctcttgggatttctggtttaggaagagatgtggttcaggtgctaaacagtgtgtctgatgatcccttctctcccactcacatttcaacccctgcccttgtttggagctaagggaagggcaaaaggctcagatatgattctctatctcttgtgcctgaggcctggagcctaaggagctgtagggtctgaggggcaggggaggcccatatcttgtttcaggtaaaggacccagtatttcccctccttgtacttttgccttaggttctcaagggacaatagtcttcatgttggattctccaacaggctgggtgcatgtatccccctactcctaccctcatctcatccttaaggcccagaggtagcttggacaagccctccttttcataatcatttgggaggcatggctgtaattctttagctttctccacttctgtctcccacatatactaaaattcttaggtactaggctgtgtgtcttgggatcttaagatcaatgaacctttccccaatatctagtctttgcaaattctagtagaagatttccacagtgaaatcagtgagccagaccaactctacatctcctgcctaacctactgcctaagtcattagggctgagggctcggctgtaggggcttccttaggctgagagtgcccccaggctgacatctgtgttggcttttgttcagaaccattactctggcacatgctcaatggtatattgcagggaggagaggagtagatttagatttgagtaaatgccaatcactttacacatgaaggtgggtgggactttccttccattcatcccttgctctcttggatctgaactcttctggagcctcagctcaggatagctgctggccactcctgtcctgtggattgtgcaggtggcctttcctcccaaaagaaaaggcatcaggctccccaagccccacagctctcctttccaccaaagccaggtttcctggtaaggtcactcgaagataagggatggggatgggggctgactgacaaaaaattttagccccaggtctcagtacctggctggggagggggatatttttccttccttaagtagttttacattgccacagtgtgtatgtgttcactatataaaatgttcctctgctctttgaaagtaagagtgttgtgtctgtacaaatccttttaacatgcattcattggagtaaattctgagtatctactgtgtattggataatacaaaagatgtaatgtcattta

SEQ ID NO: 204299 - DNA, 2649 bp, Homo sapiens
  Payload ID: 20292
  Gene Name: zinc finger, C4H2 domain containing
  Uniprot ID: Q9NQZ6
  ENST ID: ENST00000447788
  CDS Start-End: 157-687
cctgaagctccggactacagctcccaggcctctccaagcccctaccgcacaggctcatagccccaagcccggaggaggtggctacattgtgtctattgtatcccttggctggtgtatttgtacatctctcgggacgtgaaattgacagtgaaaagtatggcagatgagcaagaaatcatgtgcaaattggaaagcattaaagagatcaggaacaagaccctgcagatggagaagatcaaggctcgtttgaaggctgagtttgaggcacttgagtcagaggaaaggcacctgaaggaatacaagcaggagatggaccttctgctacaggagaagatggcccatgtggaggaactccgactgatccacgctgacatcaatgtgatggaaaacactatcaaacaatctgagaatgacctaaacaagctgctagagtctacaaggaggctgcatgatgagtataagccactgaaagaacatgtggatgccctgcgcatgactctgggcctgcagaggctccctgacttgtgtgaagaagaggagaagctttccttggagcctgcttgtcatgtcaccagcaaattcaccggaatgcacctatatgccctctttgcaaggccaagagtcggtcccggaaccccaaaaagccgaaacggaagcaggatgaataaagaaagggagagcacatgaagctttgctaattataacccctcaccttgaccagagtcattgatgtcctgatgtgaaacaacccttgcccaaccccacgaagtctcctatttaatgtgatggaagcacaacccctctctcactttgctcctatttctttctgctcttgggatttctggtttaggaagagatgtggttcaggtgctaaacagtgtgtctgatgatcccttctctcccactcacatttcaacccctgcccttgtttggagctaagggaagggcaaaaggctcagatatgattctctatctcttgtgcctgaggcctggagcctaaggagctgtagggtctgaggggcaggggaggcccatatcttgtttcaggtaaaggacccagtatttcccctccttgtacttttgccttaggttctcaagggacaatagtcttcatgttggattctccaacaggctgggtgcatgtatccccctactcctaccctcatctcatccttaaggcccagaggtagcttggacaagccctccttttcataatcatttgggaggcatggctgtaattctttagctttctccacttctgtctcccacatatactaaaattcttaggtactaggctgtgtgtcttgggatcttaagatcaatgaacctttccccaatatctagtctttgcaaattctagtagaagatttccacagtgaaatcagtgagccagaccaactctacatctcctgcctaacctactgcctaagtcattagggctgagggctcggctgtaggggcttccttaggctgagagtgcccccaggctgacatctgtgttggcttttgttcagaaccattactctggcacatgctcaatggtatattgcagggaggagaggagtagatttagatttgagtaaatgccaatcactttacacatgaaggtgggtgggactttccttccattcatcccttgctctcttggatctgaactcttctggagcctcagctcaggatagctgctggccactcctgtcctgtggattgtgcaggtggcctttcctcccaaaagaaaaggcatcaggctccccaagccccacagctctcctttccaccaaagccaggtttcctggtaaggtcactcgaagataagggatggggatgggggctgactgacaaaaaattttagccccaggtctcagtacctggctggggagggggatatttttccttccttaagtagttttacattgccacagtgtgtatgtgttcactatataaaatgttcctctgctctttgaaagtaagagtgttgtgtctgtacaaatccttttaacatgcattcattggagtaaattctgagtatctactgtgtattggataatacaaaagatgtaatgtcatttacctttctgggtagctcttgtttgctcttattcattccaccttacaaatgagaaagccaggcaccaaggacaataatttacctaattatcacaataatttccatttatttagcacctactctgtgccaggtacctatgcaagttgcttaatataaatgattgtatttgacttccaaaataccttacaagctaagtattcttatcaccattttaaaaaaaaagggatactgaacctccaaaaacttaaaagctttttcagagttaaacagctagtaagaggaaattgcaggatttggagccagctttgtccaactccagagctcatttttttctacttcttctccatgatcatttttaagaaaacctttctccctttcagaatggcttgatgatgagagtggttgaaataactttggaactgaaatcaagaactgggtgtcaaatgactgattcagggatataaaggccaagggctctctaaataatatcctgtacactaatctgtctctgtgcttgtcagggaattcaacagctaaataaaacctctctgtgcctcagtgtcctcatctggaaaatgggg

SEQ ID NO: 204300 - DNA, 1945 bp, Homo sapiens
  Payload ID: 20293
  Gene Name: zinc finger, CCCH-type with G patch domain
  Uniprot ID: Q8N5A5
  ENST ID: ENST00000328969
  CDS Start-End: 128-1723
gaaaagggggcgccgggccgctctagccggtgaggccggcgggctctctgtggctgcggctgggaaaccgcgcggaggaggtgcccggccggggaccagccctggtccagcgcctccctctctcagcatggacgaggagagcctggagtcggccttgcagacctaccgtgcgcagctgcagcaggtggagctggccttgggcgccggcctggattcgtctgagcaggctgacctgcgccagctgcagggggacctgaaggagctcatcgagctcaccgaggccagcctggtgtctgtcaggaagagcagcttgttggccgcgctggacgaagagcgcccgggccgccaggaagatgctgagtaccaggctttccgggaggccatcactgaggcggtggaggcaccagcagcggcccgtgggtccggatcagagaccgttcctaaagcagaggcggggccagaatctgcggcaggtgggcaggaggaggaagagggagaggacgaggaagagctgagtgggacaaaggtgagcgcgccctactacagctcctggggcactctggagtatcacaacgccatggtggtgggaacggaagaggcggaggatggctcggcgggtgtccgtgtgctttacctgtaccccactcacaagtctctgaagccgtgcccgttcttcctggagggaaagtgccgctttaaggagaactgcaggttctcccatgggcaggtggtctctctggatgagctgcgccccttccaggacccagacctgagctccctgcaggccggctctgcgtgtctggccaagcaccaggatggcctctggcacgcagcacgcatcaccgatgtggacaacggctactacacagtcaagtttgactcgctgctgctgagggaggccgtggtggagggggacggcatcctgcccccactgcgcacagaggccacagagtccgactcagacagcgacggtacgggtgactccagctatgccagagtggtggggtcggacgccgtggactctgcacagtcctctgccctctgtccgtctcttgcagtggtggggtcagatgctgtggactctgggacctgcagctctgcctttgctggctgggaggtgcacacgcgaggtataggctccagactcctcaccaagatgggctatgagtttggcaagggtttgggccgacacgcggaaggccgggtggagcccatccatgctgtggtgttgcctcgagggaagtcgctggaccagtgtgtggagaccctgcagaagcagaccagggttggcaaggctggcaccaacaagccccccaggtgccggggaagaggggccaggcctgggggccgcccagctcctcggaatgtgtttgacttcctcaatgaaaagctgcaaggtcaggctcctggggccctagaagccggggcggccccagcggggaggaggagcaaggacatgtaccatgccagcaagagtgccaagcgggccctgagcctgcggctcttccagactgaggagaagatcgagcgaacccagcgggacatcaggagcatccaggaggctctcgcccgcaacgctggccggcatagcgtggcgtcagcccagctgcaggagaagctggcaggagcccagcgccagctggggcagctccgggctcaggaagccggcctgcagcaggagcagaggaaggcagacacccacaagaagatgactgagttctagagaccccacaagcactatggacgaagcgtgggaccccagcacgggctgccctcaggaagaccagtgttgcccgaggaggggccggcctgctggcctggggcgtgcagacactgctgagtggagacagagctgcggggtcccatctggacacttacttgcccacctgccagtgtcttgggcatttccttggcaaggacattaaagtgatttcatcacagtgtc

SEQ ID NO: 204301 - DNA, 1871 bp, Homo sapiens
  Payload ID: 20293
  Gene Name: zinc finger, CCCH-type with G patch domain
  Uniprot ID: Q8N5A5
  ENST ID: ENST00000355969
  CDS Start-End: 113-1648
aagcacttccggaagcggcggcgctcgggaggaagtgccgatcggctgctggggcgaaaagggggcgccgggccgctctagccgccctggtccagcgcctccctctctcagcatggacgaggagagcctggagtcggccttgcagacctaccgtgcgcagctgcagcaggtggagctggccttgggcgccggcctggattcgtctgagcaggctgacctgcgccagctgcagggggacctgaaggagctcatcgagctcaccgaggccagcctggtgtctgtcaggaagagcagcttgttggccgcgctggacgaagagcgcccgggccgccaggaagatgctgagtaccaggctttccgggaggccatcactgaggcggtggaggcaccagcagcggcccgtgggtccggatcagagaccgttcctaaagcagaggcggggccagaatctgcggcaggtgggcaggaggaggaagagggagaggacgaggaagagctgagtgggacaaaggtgagcgcgccctactacagctcctggggcactctggagtatcacaacgccatggtggtgggaacggaagaggcggaggatggctcggcgggtgtccgtgtgctttacctgtaccccactcacaagtctctgaagccgtgcccgttcttcctggagggaaagtgccgctttaaggagaactgcaggttctcccatgggcaggtggtctctctggatgagctgcgccccttccaggacccagacctgagctccctgcaggccggctctgcgtgtctggccaagcaccaggatggcctctggcacgcagcacgcatcaccgatgtggacaacggctactacacagtcaagtttgactcgctgctgctgagggaggccgtggtggagggggacggcatcctgcccccactgcgcacagaggccacagagtccgactcagacagcgacggtacgggtgactccagctatgccagagtggtggggtcagatgctgtggactctgggacctgcagctctgcctttgctggctgggaggtgcacacgcgaggtataggctccagactcctcaccaagatgggctatgagtttggcaagggtttgggccgacacgcggaaggccgggtggagcccatccatgctgtggtgttgcctcgagggaagtcgctggaccagtgtgtggagaccctgcagaagcagaccagggttggcaaggctggcaccaacaagccccccaggtgccggggaagaggggccaggcctgggggccgcccagctcctcggaatgtgtttgacttcctcaatgaaaagctgcaaggtcaggctcctggggccctagaagccggggcggccccagcggggaggaggagcaaggacatgtaccatgccagcaagagtgccaagcgggccctgagcctgcggctcttccagactgaggagaagatcgagcgaacccagcgggacatcaggagcatccaggaggctctcgcccgcaacgctggccggcatagcgtggcgtcagcccagctgcaggagaagctggcaggagcccagcgccagctggggcagctccgggctcaggaagccggcctgcagcaggagcagaggaaggcagacacccacaagaagatgactgagttctagagaccccacaagcactatggacgaagcgtgggaccccagcacgggctgccctcaggaagaccagtgttgcccgaggaggggccggcctgctggcctggggcgtgcagacactgctgagtggagacagagctgcggggtcccatctggacacttacttgcccacctgccagtgtcttgggcatttccttggcaaggacattaaagtgatttcatcacagtgtca

SEQ ID NO: 204302 - DNA, 1896 bp, Homo sapiens
  Payload ID: 20293
  Gene Name: zinc finger, CCCH-type with G patch domain
  Uniprot ID: Q8N5A5
  ENST ID: ENST00000357119
  CDS Start-End: 165-1673
cggcgctcgggaggaagtgccgatcggctgctggggcgaaaagggggcgccgggccgctctagccggtgaggccggcgggctctctgtggctgcggctgggaaaccgcgcggaggaggtgcccggccggggaccagccctggtccagcgcctccctctctcagcatggacgaggagagcctggagtcggccttgcagacctaccgtgcgcagctgcagcaggtggagctggccttgggcgccggcctggattcgtctgagcaggctgacctgcgccagctgcagggggacctgaaggagctcatcgagctcaccgaggccagcctggtgtctgtcaggaagagcagcttgttggccgcgctggacgaagagcgcccgggccgccaggaagatgctgagtaccaggctttccgggaggccatcactgaggcggtggaggcaccagcagcggcccgtgggtccggatcagagaccgttcctaaagcagaggcggggccagaatctgcggcaggtgggcaggaggaggaagagggagaggacgaggaagagctgagtgggacaaaggtgagcgcgccctactacagctcctggggcactctggagtatcacaacgccatggtggtgggaacggaagaggcggaggatggctcggcgggtgtccgtgtgctttacctgtaccccactcacaagtctctgaagccgtgcccgttcttcctggagggaaagtgccgctttaaggagaactgcaggttctcccatgggcaggtggtctctctggatgagctgcgccccttccaggacccagacctgagctccctgcaggccggctctgcgtgtctggccaagcaccaggatggcctctggcacgcagcacgcatcaccgatgtggacaacggctactacacagtcaagtttgactcgctgctgctgagggaggccgtggtggagggggacggcatcctgcccccactgcgcacagaggccacagagtccgactcagacagcgacgtggtggggtcagatgctgtggactctgggacctgcagctctgcctttgctggctgggaggtgcacacgcgaggtataggctccagactcctcaccaagatgggctatgagtttggcaagggtttgggccgacacgcggaaggccgggtggagcccatccatgctgtggtgttgcctcgagggaagtcgctggaccagtgtgtggagaccctgcagaagcagaccagggttggcaaggctggcaccaacaagccccccaggtgccggggaagaggggccaggcctgggggccgcccagctcctcggaatgtgtttgacttcctcaatgaaaagctgcaaggtcaggctcctggggccctagaagccggggcggccccagcggggaggaggagcaaggacatgtaccatgccagcaagagtgccaagcgggccctgagcctgcggctcttccagactgaggagaagatcgagcgaacccagcgggacatcaggagcatccaggaggctctcgcccgcaacgctggccggcatagcgtggcgtcagcccagctgcaggagaagctggcaggagcccagcgccagctggggcagctccgggctcaggaagccggcctgcagcaggagcagaggaaggcagacacccacaagaagatgactgagttctagagaccccacaagcactatggacgaagcgtgggaccccagcacgggctgccctcaggaagaccagtgttgcccgaggaggggccggcctgctggcctggggcgtgcagacactgctgagtggagacagagctgcggggtcccatctggacacttacttgcccacctgccagtgtcttgggcatttccttggcaaggacattaaagtgatttcatcacagtgtca

SEQ ID NO: 204303 - DNA, 1890 bp, Homo sapiens
  Payload ID: 20293
  Gene Name: zinc finger, CCCH-type with G patch domain
  Uniprot ID: Q8N5A5
  ENST ID: ENST00000369967
  CDS Start-End: 132-1667
gggcgaaaagggggcgccgggccgctctagccggtgaggccggcgggctctctgtggctgcggctgggaaaccgcgcggaggaggtgcccggccggggaccagccctggtccagcgcctccctctctcagcatggacgaggagagcctggagtcggccttgcagacctaccgtgcgcagctgcagcaggtggagctggccttgggcgccggcctggattcgtctgagcaggctgacctgcgccagctgcagggggacctgaaggagctcatcgagctcaccgaggccagcctggtgtctgtcaggaagagcagcttgttggccgcgctggacgaagagcgcccgggccgccaggaagatgctgagtaccaggctttccgggaggccatcactgaggcggtggaggcaccagcagcggcccgtgggtccggatcagagaccgttcctaaagcagaggcggggccagaatctgcggcaggtgggcaggaggaggaagagggagaggacgaggaagagctgagtgggacaaaggtgagcgcgccctactacagctcctggggcactctggagtatcacaacgccatggtggtgggaacggaagaggcggaggatggctcggcgggtgtccgtgtgctttacctgtaccccactcacaagtctctgaagccgtgcccgttcttcctggagggaaagtgccgctttaaggagaactgcaggttctcccatgggcaggtggtctctctggatgagctgcgccccttccaggacccagacctgagctccctgcaggccggctctgcgtgtctggccaagcaccaggatggcctctggcacgcagcacgcatcaccgatgtggacaacggctactacacagtcaagtttgactcgctgctgctgagggaggccgtggtggagggggacggcatcctgcccccactgcgcacagaggccacagagtccgactcagacagcgacggtacgggtgactccagctatgccagagtggtggggtcagatgctgtggactctgggacctgcagctctgcctttgctggctgggaggtgcacacgcgaggtataggctccagactcctcaccaagatgggctatgagtttggcaagggtttgggccgacacgcggaaggccgggtggagcccatccatgctgtggtgttgcctcgagggaagtcgctggaccagtgtgtggagaccctgcagaagcagaccagggttggcaaggctggcaccaacaagccccccaggtgccggggaagaggggccaggcctgggggccgcccagctcctcggaatgtgtttgacttcctcaatgaaaagctgcaaggtcaggctcctggggccctagaagccggggcggccccagcggggaggaggagcaaggacatgtaccatgccagcaagagtgccaagcgggccctgagcctgcggctcttccagactgaggagaagatcgagcgaacccagcgggacatcaggagcatccaggaggctctcgcccgcaacgctggccggcatagcgtggcgtcagcccagctgcaggagaagctggcaggagcccagcgccagctggggcagctccgggctcaggaagccggcctgcagcaggagcagaggaaggcagacacccacaagaagatgactgagttctagagaccccacaagcactatggacgaagcgtgggaccccagcacgggctgccctcaggaagaccagtgttgcccgaggaggggccggcctgctggcctggggcgtgcagacactgctgagtggagacagagctgcggggtcccatctggacacttacttgcccacctgccagtgtcttgggcatttccttggcaaggacattaaagtgatttcatcacagtgtca

SEQ ID NO: 204304 - DNA, 1881 bp, Homo sapiens
  Payload ID: 20293
  Gene Name: zinc finger, CCCH-type with G patch domain
  Uniprot ID: Q8N5A5
  ENST ID: ENST00000448100
  CDS Start-End: 124-1659
cgcctgggccacggcaccctcgagcgccagccccgcgccccacccgggagcagcgagccaccggcgcgctccccaggagcccctgcaggcgccggccctggtccagcgcctccctctctcagcatggacgaggagagcctggagtcggccttgcagacctaccgtgcgcagctgcagcaggtggagctggccttgggcgccggcctggattcgtctgagcaggctgacctgcgccagctgcagggggacctgaaggagctcatcgagctcaccgaggccagcctggtgtctgtcaggaagagcagcttgttggccgcgctggacgaagagcgcccgggccgccaggaagatgctgagtaccaggctttccgggaggccatcactgaggcggtggaggcaccagcagcggcccgtgggtccggatcagagaccgttcctaaagcagaggcggggccagaatctgcggcaggtgggcaggaggaggaagagggagaggacgaggaagagctgagtgggacaaaggtgagcgcgccctactacagctcctggggcactctggagtatcacaacgccatggtggtgggaacggaagaggcggaggatggctcggcgggtgtccgtgtgctttacctgtaccccactcacaagtctctgaagccgtgcccgttcttcctggagggaaagtgccgctttaaggagaactgcaggttctcccatgggcaggtggtctctctggatgagctgcgccccttccaggacccagacctgagctccctgcaggccggctctgcgtgtctggccaagcaccaggatggcctctggcacgcagcacgcatcaccgatgtggacaacggctactacacagtcaagtttgactcgctgctgctgagggaggccgtggtggagggggacggcatcctgcccccactgcgcacagaggccacagagtccgactcagacagcgacggtacgggtgactccagctatgccagagtggtggggtcagatgctgtggactctgggacctgcagctctgcctttgctggctgggaggtgcacacgcgaggtataggctccagactcctcaccaagatgggctatgagtttggcaagggtttgggccgacacgcggaaggccgggtggagcccatccatgctgtggtgttgcctcgagggaagtcgctggaccagtgtgtggagaccctgcagaagcagaccagggttggcaaggctggcaccaacaagccccccaggtgccggggaagaggggccaggcctgggggccgcccagctcctcggaatgtgtttgacttcctcaatgaaaagctgcaaggtcaggctcctggggccctagaagccggggcggccccagcggggaggaggagcaaggacatgtaccatgccagcaagagtgccaagcgggccctgagcctgcggctcttccagactgaggagaagatcgagcgaacccagcgggacatcaggagcatccaggaggctctcgcccgcaacgctggccggcatagcgtggcgtcagcccagctgcaggagaagctggcaggagcccagcgccagctggggcagctccgggctcaggaagccggcctgcagcaggagcagaggaaggcagacacccacaagaagatgactgagttctagagaccccacaagcactatggacgaagcgtgggaccccagcacgggctgccctcaggaagaccagtgttgcccgaggaggggccggcctgctggcctggggcgtgcagacactgctgagtggagacagagctgcggggtcccatctggacacttacttgcccacctgccagtgtcttgggcatttccttggcaaggacattaaagtgatttcatcacagtgtc

SEQ ID NO: 204305 - DNA, 427 bp, Homo sapiens
  Payload ID: 20293
  Gene Name: zinc finger, CCCH-type with G patch domain
  ENST ID: ENST00000431125
  CDS Start-End: 137-427
ggaggaagtgccgatcggctgctggggcgaaaagggggcgccgggccgctctagccggtgaggccggcgggctctctgtggctgcggctgggaaaccgcgcggaggagccctggtccagcgcctccctctctcagcatggacgaggagagcctggagtcggccttgcagacctaccgtgcgcagctgcagcaggtggagctggccttgggcgccggcctggattcgtctgagcaggctgacctgcgccagctgcagggggacctgaaggagctcatcgagctcaccgaggccagcctggtgtctgtcaggaagagcagcttgttggccgcgctggacgaagagcgcccgggccgccaggaagatgctgagtaccaggctttccgggaggccatcactgaggcggtggaggcaccagcagcggcccgt

SEQ ID NO: 204306 - DNA, 2178 bp, Homo sapiens
  Payload ID: 20294
  Gene Name: zinc finger, CCHC domain containing 10
  Uniprot ID: Q8TBK6
  ENST ID: ENST00000324170
  CDS Start-End: 68-580
ggttggaagccccgcccttccgaggagtttcccaaaaccctgcgcggccggctttgaccgcgctaagatggcgactcccatgcatcggctaatagcccggagacaagctgaagcaaataagcaacatgtaagatgtcagaaatgcttggaatttggacattggacttatgaatgcacaggaaaaagaaaatacctacataggccctcaaggacagcagaactaaagaaagctttaaaagaaaaagaaaacagattattattgcaacaaagcattggagaaaccaatgtagaaagaaaggccaagaaaaaaaggtctaagagtgtaaccagttccagtagcagtagcagtgacagttctgccagtgattcttcatcagagagtgaagaaacatctacctcttcctcctcagaggacagtgacactgatgaaagctcctctagttcctcatcctcagcctcctccacaacctcttcctcctcctctgattcagactcagattccagctcttccagtagcagtagcaccagcacagatagcagctctgacgatgaaccaccaaagaagaagaaaaagaaatagagttgctccattcatattggactgatggactgaaaacattgatgtgattcttgaaagggaatttagaatatgttaaggccaagtaggttaactggtgaacatttctagaattcaaaagtttctaaatgttttacattgtaagagcatagagaatattaataatggcttatagagagagacttttatttgaagggtgaatcttgttttttttatctttaaaatatatctctagaacttaaagctgaaatctgcaaatctgtttgtgtgatgaaactatcttttctctctgtgaaataaatgccatactttgttatatatgttagtggtatgtatcagacatattttcaggatggtgcgtcaggatatctggcagtggatttctaatgcttttggctgtatgttatgtaagatttaatatgttgttactgtaagcttaggagttttcctactattaataaatgtgctctatttttacatttatgttcagaaagttatctgactttttgtcctaagtggtatgttcaaggagcctattaatatatttatagtttttgaatgctgtaagtttcaaattgctgtgttacgtcattcattttcttctggttccttaagtttttcaagttatccttttctgaggaaaattattctagaggaacctaaaaagggacaaaaaaattgaaacttcttaggagtctaatcttggtgccttctgttaaaagtcagtgtatcagaaaagaaagcagccatgtaagaggctaacttaaatagaagtgctagaaatatctttgtgtattaacatgcaataaaaggtaccattcaaagcagggggaaaggtaggaagaagaggtaatttttactgaaaattagggcaatgttggtcgccttttattaaaagctttttttaagctttcataaagattgctttttgctatttttgaaaatatggtattatagtttgtatggtaactggtcatatatgacagtctactgcatatatatgaatgactaggattaatctggtgtgtttacataggatatacatagttgaaatctagcatgaaaggttaaaaaggagatactgcacaatatttcttaaaagtaaaatgctgttattgtgatgagtctttggtttaacatcacagtattctgtgatgtctttttaactttttggaaagaggtatcatttgtagaaaaaatttgatttgggttaaatataggtttttaaaactataaatgttgtcttttttatatttttatgaaaaagcagtagaaaattacttttgaagaaaacaggctatttaaatattgaaatatatgtatgttgtgagtttaaggagcctgtaattgtcagttttacaaaaccatctgtgttcaatggttgtaaataaattctcaaaacatcatttcaaaggctgcctacagaatattatcacttgacagatagagttaataaattaccaatcaggcacattttataatgtttgtctctgtaaaggtaatattagcagttaaagaacacggatgagaaaagaatgtgttacataggttgcatcacttgcagttaaataaaactcacaatttgtgctcacaagcttaaa

SEQ ID NO: 204307 - DNA, 2160 bp, Homo sapiens
  Payload ID: 20294
  Gene Name: zinc finger, CCHC domain containing 10
  ENST ID: ENST00000355372
  CDS Start-End: 13-573
gaccgcgctaagatggcgactcccatgcatcggctaatagcccggagacaagcattcgacacagagttgcagcctgtcaagaccttttggatcctgattcagccatccatcgttattagtgaagcaaataagcaacatgtaagatgtcagaaatgcttggaatttggacattggacttatgaatgcacaggaaaaagaaaatacctacataggccctcaaggacagcagaactaaagaaagctttaaaagaaaaagaaaacagattattattgcaacaaagcattggagaaaccaatgtagaaagaaaggccaagaaaaaaagttccagtagcagtagcagtgacagttctgccagtgattcttcatcagagagtgaagaaacatctacctcttcctcctcagaggacagtgacactgatgaaagctcctctagttcctcatcctcagcctcctccacaacctcttcctcctcctctgattcagactcagattccagctcttccagtagcagtagcaccagcacagatagcagctctgacgatgaaccaccaaagaagaagaaaaagaaatagagttgctccattcatattggactgatggactgaaaacattgatgtgattcttgaaagggaatttagaatatgttaaggccaagtaggttaactggtgaacatttctagaattcaaaagtttctaaatgttttacattgtaagagcatagagaatattaataatggcttatagagagagacttttatttgaagggtgaatcttgttttttttatctttaaaatatatctctagaacttaaagctgaaatctgcaaatctgtttgtgtgatgaaactatcttttctctctgtgaaataaatgccatactttgttatatatgttagtggtatgtatcagacatattttcaggatggtgcgtcaggatatctggcagtggatttctaatgcttttggctgtatgttatgtaagatttaatatgttgttactgtaagcttaggagttttcctactattaataaatgtgctctatttttacatttatgttcagaaagttatctgactttttgtcctaagtggtatgttcaaggagcctattaatatatttatagtttttgaatgctgtaagtttcaaattgctgtgttacgtcattcattttcttctggttccttaagtttttcaagttatccttttctgaggaaaattattctagaggaacctaaaaagggacaaaaaaattgaaacttcttaggagtctaatcttggtgccttctgttaaaagtcagtgtatcagaaaagaaagcagccatgtaagaggctaacttaaatagaagtgctagaaatatctttgtgtattaacatgcaataaaaggtaccattcaaagcagggggaaaggtaggaagaagaggtaatttttactgaaaattagggcaatgttggtcgccttttattaaaagctttttttaagctttcataaagattgctttttgctatttttgaaaatatggtattatagtttgtatggtaactggtcatatatgacagtctactgcatatatatgaatgactaggattaatctggtgtgtttacataggatatacatagttgaaatctagcatgaaaggttaaaaaggagatactgcacaatatttcttaaaagtaaaatgctgttattgtgatgagtctttggtttaacatcacagtattctgtgatgtctttttaactttttggaaagaggtatcatttgtagaaaaaatttgatttgggttaaatataggtttttaaaactataaatgttgtcttttttatatttttatgaaaaagcagtagaaaattacttttgaagaaaacaggctatttaaatattgaaatatatgtatgttgtgagtttaaggagcctgtaattgtcagttttacaaaaccatctgtgttcaatggttgtaaataaattctcaaaacatcatttcaaaggctgcctacagaatattatcacttgacagatagagttaataaattaccaatcaggcacattttataatgtttgtctctgtaaaggtaatattagcagttaaagaacacggatgagaaaagaatgtgttacataggttgcatcacttgcagttaaataaaactcacaatttgtgctc

SEQ ID NO: 204308 - DNA, 608 bp, Homo sapiens
  Payload ID: 20294
  Gene Name: zinc finger, CCHC domain containing 10
  ENST ID: ENST00000509008
  CDS Start-End: 13-291
gaccgcgctaagatggcgactcccatgcatcggctaatagcccggagacaagctgaagcaaataagcaacatgtaagatgtcagaaatgcttggaatttggacattggacttatgaatgcacaggaaaaagaaaatacctacataggccctcaaggacagcagaactaaagaaagctttaaaagaaaaagaaaacagattattattgcaacaaaggagcttttttccccctcgtgtttatcagcattggagaaaccaatgtagaaagaaaggccaagaaaaaaaggtctaagagtgtaaccagttccagtagcagtagcagtgacagttctgccagtgattcttcatcagagagtgaagaaacatctacctcttcctcctcagaggacagtgacactgatgaaagctcctctagttcctcatcctcagcctcctccacaacctcttcctcctcctctgattcagactcagattccagctcttccagtagcagtagcaccagcacagatagcagctctgacgatgaaccaccaaagaagaagaaaaagaaatagagttgctccattcatattggactgatggactgaaaacattgatgtgattcttgaa

SEQ ID NO: 204309 - DNA, 794 bp, Homo sapiens
  Payload ID: 20294
  Gene Name: zinc finger, CCHC domain containing 10
  ENST ID: ENST00000513541
  CDS Start-End: 13-357
gaccgcgctaagatggcgactcccatgcatcggctaatagcccggagacaagcattcgacacagagttgcagcctgtcaagaccttttggatcctgattcagccatccatcgttattagtgaagcaaataagcaacatgtaagatgtcagaaatgcttggaatttggacattggacttatgaatgcacaggaaaaagaaaatacctacataggccctcaaggacagcagaactaaagaaagctttaaaagaaaaagaaaacagattattattgcaacaaaggagcttttttccccctcgtgtttatcagcattggagaaaccaatgtagaaagaaaggccaagaaaaaaaggtctaagagtgtaaccagttccagtagcagtagcagtgacagttctgccagtgattcttcatcagagagtgaagaaacatctacctcttcctcctcagaggacagtgacactgatgaaagctcctctagttcctcatcctcagcctcctccacaacctcttcctcctcctctgattcagactcagattccagctcttccagtagcagtagcaccagcacagatagcagctctgacgatgaaccaccaaagaagaagaaaaagaaatagagttgctccattcatattggactgatggactgaaaacattgatgtgattcttgaaagggaatttagaatatgttaaggccaagtaggttaactggtgaacatttctagaattcaaaagtttctaaatgttttacattgtaagagcatagagaatattaataatggcttatagaga

SEQ ID NO: 204310 - DNA, 1070 bp, Homo sapiens
  Payload ID: 20294
  Gene Name: zinc finger, CCHC domain containing 10
  Uniprot ID: Q8TBK6
  ENST ID: ENST00000509437
  CDS Start-End: 9-587
gcgctaagatggcgactcccatgcatcggctaatagcccggagacaagcattcgacacagagttgcagcctgtcaagaccttttggatcctgattcagccatccatcgttattagtgaagcaaataagcaacatgtaagatgtcagaaatgcttggaatttggacattggacttatgaatgcacaggaaaaagaaaatacctacataggccctcaaggacagcagaactaaagaaagctttaaaagaaaaagaaaacagattattattgcaacaaagcattggagaaaccaatgtagaaagaaaggccaagaaaaaaaggtctaagagtgtaaccagttccagtagcagtagcagtgacagttctgccagtgattcttcatcagagagtgaagaaacatctacctcttcctcctcagaggacagtgacactgatgaaagctcctctagttcctcatcctcagcctcctccacaacctcttcctcctcctctgattcagactcagattccagctcttccagtagcagtagcaccagcacagatagcagctctgacgatgaaccaccaaagaagaagaaaaagaaatagagttgctccattcatattggactgatggactgaaaacattgatgtgattcttgaaagggaatttagaatatgttaaggccaagtaggttaactggtgaacatttctagaattcaaaagtttctaaatgttttacattgtaagagcatagagaatattaataatggcttatagagagagacttttatttgaagggtgaatcttgttttttttatctttaaaatatatctctagaacttaaagctgaaatctgcaaatctgtttgtgtgatgaaactatcttttctctctgtgaaataaatgccatactttgttatatatgttagtggtatgtatcagacatattttcaggatggtgcgtcaggatatctggcagtggatttctaatgcttttggctgtatgttatgtaagatttaatatgttgttactgtaagcttaggagttttcctactattaataaatgtgctctatttttacatttatgt

SEQ ID NO: 204311 - DNA, 325 bp, Homo sapiens
  Payload ID: 20294
  Gene Name: zinc finger, CCHC domain containing 10
  ENST ID: ENST00000504170
  CDS Start-End: 53-271
ccttccgaggagtttcccaaaaccctgcgcggccggctttgaccgcgctaagatggcgactcccatgcatcggctaatagcccggagacaagcattcgacacagagttgcagcctgtcaagaccttttggatcctgattcagccatccatcgttattagagacagtgttgcccaggctggtctcaaactcctgagctcgggtgatcctgccttggcctctcaaagtgccaggattataggcgtgagccactgcgtccagcctcatacctgagctttagatgatatttgtgaatgtcgtatttataacaataaaaaacaaactcca

SEQ ID NO: 204312 - DNA, 876 bp, Homo sapiens
  Payload ID: 20294
  Gene Name: zinc finger, CCHC domain containing 10
  ENST ID: ENST00000513848
  CDS Start-End: 35-505
aaaaccctgcgcggccggctttgaccgcgctaagatggcgactcccatgcatcggctaatagcccggagacaagctgaagcaaataagcaacatgtaagatgtcagaaatgcttggaatttggacattggacttatgaatgcacaggaaaaagaaaatacctacataggccctcaaggacagcagaactaaagaaagctttaaaagaaaaagaaaacagattattattgcaacaaaggtctaagagtgtaaccagttccagtagcagtagcagtgacagttctgccagtgattcttcatcagagagtgaagaaacatctacctcttcctcctcagaggacagtgacactgatgaaagctcctctagttcctcatcctcagcctcctccacaacctcttcctcctcctctgattcagactcagattccagctcttccagtagcagtagcaccagcacagatagcagctctgacgatgaaccaccaaagaagaagaaaaagaaatagagttgctccattcatattggactgatggactgaaaacattgatgtgattcttgaaagggaatttagaatatgttaaggccaagtaggttaactggtgaacatttctagaattcaaaagtttctaaatgttttacattgtaagagcatagagaatattaataatggcttatagagagagacttttatttgaagggtgaatcttgttttttttatctttaaaatatatctctagaacttaaagctgaaatctgcaaatctgtttgtgtgatgaaactatcttttctctctgtgaaataaatgccatactttgttatatatgttagtggtatgtatcagacatattttcaggatggtgcgtcaggatatctggc

SEQ ID NO: 204313 - DNA, 5743 bp, Homo sapiens
  Payload ID: 20295
  Gene Name: zinc finger, CCHC domain containing 11
  ENST ID: ENST00000257177
  CDS Start-End: 146-5083
gccactgagatgaggaggcgtcgcgcgcgcctgtagctcgcgggcctcgcagtttgcttgcctaaactggacttgaagcaatttaaactactggagatctgccattttataatatcacaattggaaagaaacagattttcaaataatggaagagtctaaaaccttaaaaagtgaaaatcatgaaccaaagaagaatgttatttgtgaagaaagcaaagcagttcaagttataggtaatcaaacattgaaagctagaaatgataaatccgtaaaagaaattgagaacagctctccaaataggaatagtagtaaaaaaaataagcaaaatgatatttgtatagaaaaaacagaagttaaatcatgtaaagtaaatgctgccaaccttccaggtcctaaagatttggggttagtccttcgagatcaaagtcattgcaaagcaaaaaaatttcctaattcaccggtgaaagccgaaaaggcaaccatttcacaggcaaaatcagaaaaggcaaccagtttacaggcaaaagcagaaaaatcaccaaagtcacctaattcagtgaaagcagaaaaagcatccagttatcagatgaagtcagaaaaagtaccaagttcaccagcagaagcagaaaagggacccagtttactgttgaaagacatgagacagaagacagaattacaacagattggaaaaaaaattccaagctcctttacttctgtggacaaagtgaatattgaagctgtagggggagaaaaatgtgctctgcaaaactcaccacgatctcagaagcaacagacatgtacagataatactggtgattctgatgatagtgcttcaggaattgaagacgtatcggacgatttaagtaaaatgaagaatgatgaatctaataaagaaaattcttcagagatggactacttagaaaatgccactgtgatagatgaatctgcattgacacctgagcagaggctggggttgaaacaagcagaagaacgcttagaaagagatcacatctttcgacttgaaaaacgatcaccagaatataccaattgtcggtatctatgcaaactttgcttaattcacattgaaaatatccagggggctcataaacatataaaggagaaacgacataagaaaaatattttggaaaaacaagaagaaagtgagcttcgttctctgccacctccttcccctgcccacttggctgctttaagtgttgcagtcattgaattagcaaaagaacatggaataacagatgatgacctcagagtccgtcaggaaattgtggaggaaatgtcaaaggttataacgacatttttaccagaatgttcacttaggttgtatggctcatctctgactagatttgctctgaaaagtagtgatgttaatatagatataaaatttcctcccaagatgaatcatccagatcttctgataaaagtacttgggattttaaagaaaaatgtattatatgtagatgtggaatctgattttcacgctaaagttcctgttgtggtgtgcagagatcgaaaaagtggtttactttgtagagtgagtgcaggaaacgatatggcatgtctcactactgatttacttactgcccttggcaaaatagaacctgtctttattcccttggtgttagcctttcgctactgggctaagttgtgctatattgactcccaaactgatggtggaatcccttcttactgttttgctttaatggtgatgttttttctacaacagagaaaaccccctcttcttccttgcttacttggaagttggattgaaggctttgacccaaaaagaatggatgactttcagctgaagggcatagtagaagagaagtttgtgaagtgggaatgtaattcaagtagtgcaactgagaaaaactcaattgctgaggaaaacaaagctaaggcagaccaaccaaaagatgataccaagaagacagaaacagacaaccaaagtaatgccatgaaggaaaaacatggcaaatctcctttagcattggaaacaccaaatcgggtatccttgggacagttatggttagagctgcttaaattctacacactggattttgctttggaggaatatgtcatatgtgtacggatacaagatattttaacaagagaaaataaaaactggcctaaaaggcgaatagccattgaagatccattttcagtcaagaggaatgttgcacggagcttaaacagccagctggtttacgaatatgttgtggagagatttagggcagcttatcggtattttgcctgtcctcagacgaagggtggaaataagtctacagtggatttcaagaaaagagagaaggggaaaataagcaataagaaaccagtcaagtcgaacaatatggcaaccaatggttgtattctgcttggggaaaccacagaaaaaataaatgcagaaagagagcaacctgttcaatgtgatgaaatggactgtacatcacagagatgtattattgacaacaacaatttgttggtaaatgaactagattttgctgaccacggacaggactcttcatctctttctaccagcaaaagcagtgaaatagagccaaaattagataagaaacaagatgatttagcgccttcagaaacttgtttaaaaaaagagctcagccaatgtaattgcattgatttgtctaagtcgcctgacccagataaatctactggaacagactgcaggtcaaatttagaaacagagagttcacatcagagtgtgtgcaccgacacatctgctacctcttgcaactgcaaagctacagaagatgcttctgaccttaatgatgatgataacctccccacccaggaattatattatgtgtttgataagtttattttaacctctggcaagccaccaacgatagtatgcagcatctgcaaaaaggatggccattcaaagaatgattgcccagaggattttaggaaaattgatttaaaacctctaccaccaatgacaaaccgatttcgggaaatacttgatttagtatgtaaaagatgttttgatgagttatcaccaccttgttctgaacaacacaacagggagcaaattttaattggcttggaaaagtttattcaaaaagaatatgatgaaaaggcaaggttgtgcttatttggctcttctaagaatggatttggatttcgtgatagtgatctggatatttgtatgaccctggaaggccatgaaaatgcagagaaattaaattgtaaggaaataattgaaaatttggcaaaaattcttaagagacatccaggtttaagaaacattttgcctataactactgccaaagtgcctatagtaaaatttgaacacaggcgaagtgggttagaaggcgatatcagtttatataatacgttggctcaacataacacaagaatgctagctacttatgcagctattgatcctagagtgcagtatttgggatatactatgaaagtgtttgctaagcgatgtgacattggggatgcttccaggggaagtttatcttcatatgcatatatccttatggtgctgtactttctgcagcagagaaagccacctgttatcccagttctacaagagatctttgatggaaaacagattccacagagaatggttgatggatggaatgctttcttctttgataaaacagaagaactgaaaaagcgtttaccttcacttggaaagaacacagaatcattaggggagctttggctgggactgcttcgtttctatactgaagagtttgatttcaaggaatatgtaattagcattcggcagaaaaagctgttgacaacttttgagaagcagtggacttccaagtgcattgcaattgaagacccttttgacttgaatcataaccttggtgctggagtttccagaaaaatgaccaatttcatcatgaaagcatttatcaatggaaggaaactttttggtacccctttttatccactcattggcagagaagctgagtacttctttgattccagagtattaacagatggagaactggctcccaatgatagatgttgccgtgtgtgtggaaaaataggccactacatgaaagactgccctaaaaggaaaagcagtttactgtttagactaaagaagaaagacagtgaagaagagaaggaagggaatgaagaagagaaagattcccgagatgttcttgacccccgagacctccacgatactcgagactttagagacccgagagacctcagatgttttatatgtggagatgctggacatgtacgaagggagtgcccagaggtcaagctggcccgtcagaggaatagcagtgtggcagcagcccagctggtccgcaaccttgtaaatgctcaacaggtggctggttcagctcagcaacagggtgatcagtccataaggactagacagtcatcagaatgttctgaatcaccatcttattctcctcagcctcagccatttccacagaactcttcccagtcagctgctattactcagccttcatctcagccaggatcccaacctaagcttggcccacctcagcagggagcccaacctccccatcaggtccagatgccactgtataactttccccagtcaccaccagctcagtattctcccatgcacaatatgggattgttgccaatgcaccctctccagatccctgccccgtcctggcccatccatggcccagtgatccactctgcaccaggcagtgcccccagcaatattggcctaaatgatcccagcatcatctttgcacagcctgctgccagacctgtggcaatccctaacacgtctcacgatggacactggccccgtactgtggctccaaattccctggtaaacagtggtgcagtggggaattcagagccaggctttcgaggactgactcctccaattccttgggaacatgcaccgcgtccccatttcccccttgtcccagcttcgtggccttatggtttgcatcaaaacttcatgcatcagggaaatgcccgattccagcccaacaaacctttctatactcaagacagatgtgccacccgtcggtgtagagagcgttgtccccacccaccaagaggaaacgtgtcggagtaatgcgagtccattttctttcagctggtctaccgatgcacagcaaccagccaatcctgctgtctcaagggtatccgtacctcaatgtcagttacattcagcagaaaaagtgacatttaatggaaagcaaaacaaatcaggtcctgatttaaaattttaacacgtttagatagcttatttaaattctaagactgtttttacagactgtattatttgtatataaatatgaactatagtttttactagtatcaccaaattgagtgatacaaatttcatctattttattaccctatttttaagggaattttatgttttgtttaaccttgatgaattgtataaagagagaatttaaaaaattacattctttattttctattagctgtattcatactttggttgcttcagactttatatattgttcttaaaagttaggaaagaatttcatgtgttttaaattgtcacttctattctttacagaaccttgtagtgccaaaaactttttaaaaggtaaaaaaataaaataaaattacaacatgaagattcagattttttttcttttccatacttgtatattgaacattcaaacttgaatggaaagttgattttgtctgtatttgaagtacttctattttaagttaataaatctttttgacaagagttaaa

SEQ ID NO: 204314 - DNA, 2152 bp, Homo sapiens
  Payload ID: 20295
  Gene Name: zinc finger, CCHC domain containing 11
  ENST ID: ENST00000355809
  CDS Start-End: 158-1087
gggagagcaggagccactgagatgaggaggcgtcgcgcgcgcctgtagctcgcgggcctcgcagtttgcttgcctaaactggacttgaagcaatttaaactactggagatctgccattttataatatcacaattggaaagaaacagattttcaaataatggaagagtctaaaaccttaaaaagtgaaaatcatgaaccaaagaagaatgttatttgtgaagaaagcaaagcagttcaagttataggtaatcaaacattgaaagctagaaatgataaatccgtaaaagaaattgagaacagctctccaaataggaatagtagtaaaaaaaataagcaaaatgatatttgtatagaaaaaacagaagttaaatcatgtaaagtaaatgctgccaaccttccaggtcctaaagatttggggttagtccttcgagatcaaagtcattgcaaagcaaaaaaatttcctaattcaccggtgaaagccgaaaaggcaaccatttcacaggcaaaatcagaaaaggcaaccagtttacaggcaaaagcagaaaaatcaccaaagtcacctaattcagtgaaagcagaaaaagcatccagttatcagatgaagtcagaaaaagtaccaagttcaccagcagaagcagaaaagggacccagtttactgttgaaagacatgagacagaagacagaattacaacagattggaaaaaaaattccaagctcctttacttctgtggacaaagtgaatattgaagctgtagggggagaaaaatgtgctctgcaaaactcaccacgatctcagaagcaacagacatgtacagataatactggtgattctgatgatagtgcttcaggaattgaagacgtatcggacgatttaagtaaaatgaagaatgatgaatctaataaagaaaattcttcagagatggactacttagaaaatgccactgtgatagatgaatctgcattgacacctgagcagaggctggggttgaaacaagcagaagaacgcttagaaagagatcacatctttcgacttgaaaaagtatactatgttgttttagttatttggggggaaatgtgtgtttcataactgttttccccaagtacagctttttttatttttcttttattcataagacagaggttgcattcatctttccttacttccctcttctctacctttcttcttctttccctcttttcttccttgcctctctttttcagcagttacttattatctgtgagtctgacttcattcatcccaagagttggcaaactatggtctatcccttgcttttgtttttgaatgggttaaaatacacctagtctccccaccgtttttggtaaacattttattggaatatagccatgcctatttgtttacatgtcgtttatggctactttcatgctacgatgggaaatttgagttgagtagttgtcacagagcttatatggcttgaaaagcataaaatatttagtctttgccaaagcataaaatgtctaccaaaatatttattcgcccctttatagacgaaacttgctgacctctgatttaggcactcatcaaatagacactgagcacttgttttgtgccaggtattctgataggcactggggatgtattggtgaaaatggcagtttcttcccattagaagttaaaagtccattcagattgatggaaataaaatagcattttatttattgaacctgtatttattgaacattaactgcgtaataggaactatcctagccattggtatcttattcctgtgtattaatttcttaatctagaaatacacattcctggcctcaataaaaacactgctaggttttgaaggaaagaatcacaaatcacggccaggcccagtggctcacgcctgtaatcccagcattttgggaagccgaggtgggcaggttgcttgaggtcaggaattcgagaccagcctgaccaacatggtgaaaccccgtctctactaaaaatacaaaaattagcgaggtgtggtagtcggtacctgtagtcccagctacttgggaggctgaggcaggagaattgcttgaacccagggggcagaggttgcggtgagccaagattgtgccactgcacaccagcctgggcgacagagcaagactccatctcaaaaaaaaaaaaaaaaaa

SEQ ID NO: 204315 - DNA, 5858 bp, Homo sapiens
  Payload ID: 20295
  Gene Name: zinc finger, CCHC domain containing 11
  Uniprot ID: Q5TAX3
  ENST ID: ENST00000371544
  CDS Start-End: 264-5198
cacaatgcagttcgcggcgcggcggacatggcggtggagtcctgagctagtcgtgtcccggcctccagcggcggcagcggcgacggcggcggcagcaggaggcggagggagagcaggagccactgagatgaggaggcgtcgcgcgcgcctgtagctcgcgggcctcgcagtttgcttgcctaaactggacttgaagcaatttaaactactggagatctgccattttataatatcacaattggaaagaaacagattttcaaataatggaagagtctaaaaccttaaaaagtgaaaatcatgaaccaaagaagaatgttatttgtgaagaaagcaaagcagttcaagttataggtaatcaaacattgaaagctagaaatgataaatccgtaaaagaaattgagaacagctctccaaataggaatagtagtaaaaaaaataagcaaaatgatatttgtatagaaaaaacagaagttaaatcatgtaaagtaaatgctgccaaccttccaggtcctaaagatttggggttagtccttcgagatcaaagtcattgcaaagcaaaaaaatttcctaattcaccggtgaaagccgaaaaggcaaccatttcacaggcaaaatcagaaaaggcaaccagtttacaggcaaaagcagaaaaatcaccaaagtcacctaattcagtgaaagcagaaaaagcatccagttatcagatgaagtcagaaaaagtaccaagttcaccagcagaagcagaaaagggacccagtttactgttgaaagacatgagacagaagacagaattacaacagattggaaaaaaaattccaagctcctttacttctgtggacaaagtgaatattgaagctgtagggggagaaaaatgtgctctgcaaaactcaccacgatctcagaagcaacagacatgtacagataatactggtgattctgatgatagtgcttcaggaattgaagacgtatcggacgatttaagtaaaatgaagaatgatgaatctaataaagaaaattcttcagagatggactacttagaaaatgccactgtgatagatgaatctgcattgacacctgagcagaggctggggttgaaacaagcagaagaacgcttagaaagagatcacatctttcgacttgaaaaacgatcaccagaatataccaattgtcggtatctatgcaaactttgcttaattcacattgaaaatatccagggggctcataaacatataaaggagaaacgacataagaaaaatattttggaaaaacaagaagaaagtgagcttcgttctctgccacctccttcccctgcccacttggctgctttaagtgttgcagtcattgaattagcaaaagaacatggaataacagatgatgacctcagagtccgtcaggaaattgtggaggaaatgtcaaaggttataacgacatttttaccagaatgttcacttaggttgtatggctcatctctgactagatttgctctgaaaagtagtgatgttaatatagatataaaatttcctcccaagatgaatcatccagatcttctgataaaagtacttgggattttaaagaaaaatgtattatatgtagatgtggaatctgattttcacgctaaagttcctgttgtggtgtgcagagatcgaaaaagtggtttactttgtagagtgagtgcaggaaacgatatggcatgtctcactactgatttacttactgcccttggcaaaatagaacctgtctttattcccttggtgttagcctttcgctactgggctaagttgtgctatattgactcccaaactgatggtggaatcccttcttactgttttgctttaatggtgatgttttttctacaacagagaaaaccccctcttcttccttgcttacttggaagttggattgaaggctttgacccaaaaagaatggatgactttcagctgaagggcatagtagaagagaagtttgtgaagtgggaatgtaattcaagtagtgcaactgagaaaaactcaattgctgaggaaaacaaagctaaggcagaccaaccaaaagatgataccaagaagacagaaacagacaaccaaagtaatgccatgaaggaaaaacatggcaaatctcctttagcattggaaacaccaaatcgggtatccttgggacagttatggttagagctgcttaaattctacacactggattttgctttggaggaatatgtcatatgtgtacggatacaagatattttaacaagagaaaataaaaactggcctaaaaggcgaatagccattgaagatccattttcagtcaagaggaatgttgcacggagcttaaacagccagctggtttacgaatatgttgtggagagatttagggcagcttatcggtattttgcctgtcctcagacgaagggtggaaataagtctacagtggatttcaagaaaagagagaaggggaaaataagcaataagaaaccagtcaagtcgaacaatatggcaaccaatggttgtattctgcttggggaaaccacagaaaaaataaatgcagaaagagagcaacctgttcaatgtgatgaaatggactgtacatcacagagatgtattattgacaacaacaatttgttggtaaatgaactagattttgctgaccacggacaggactcttcatctctttctaccagcaaaagcagtgaaatagagccaaaattagataagaaacaagatgatttagcgccttcagaaacttgtttaaaaaaagagctcagccaatgtaattgcattgatttgtctaagtcgcctgacccagataaatctactggaacagactgcaggtcaaatttagaaacagagagttcacatcagagtgtgtgcaccgacacatctgctacctcttgcaactgcaaagctacagaagatgcttctgaccttaatgatgatgataacctccccacccaggaattatattatgtgtttgataagtttattttaacctctggcaagccaccaacgatagtatgcagcatctgcaaaaaggatggccattcaaagaatgattgcccagaggattttaggaaaattgatttaaaacctctaccaccaatgacaaaccgatttcgggaaatacttgatttagtatgtaaaagatgttttgatgagttatcaccaccttgttctgaacaacacaacagggagcaaattttaattggcttggaaaagtttattcaaaaagaatatgatgaaaaggcaaggttgtgcttatttggctcttctaagaatggatttggatttcgtgatagtgatctggatatttgtatgaccctggaaggccatgaaaatgcagagaaattaaattgtaaggaaataattgaaaatttggcaaaaattcttaagagacatccaggtttaagaaacattttgcctataactactgccaaagtgcctatagtaaaatttgaacacaggcgaagtgggttagaaggcgatatcagtttatataatacgttggctcaacataacacaagaatgctagctacttatgcagctattgatcctagagtgcagtatttgggatatactatgaaagtgtttgctaagcgatgtgacattggggatgcttccaggggaagtttatcttcatatgcatatatccttatggtgctgtactttctgcagcagagaaagccacctgttatcccagttctacaagagatctttgatggaaaacagattccacagagaatggttgatggatggaatgctttcttctttgataaaacagaagaactgaaaaagcgtttaccttcacttggaaagaacacagaatcattaggggagctttggctgggactgcttcgtttctatactgaagagtttgatttcaaggaatatgtaattagcattcggcagaaaaagctgttgacaacttttgagaagcagtggacttccaagtgcattgcaattgaagacccttttgacttgaatcataaccttggtgctggagtttccagaaaaatgaccaatttcatcatgaaagcatttatcaatggaaggaaactttttggtacccctttttatccactcattggcagagaagctgagtacttctttgattccagagtattaacagatggagaactggctcccaatgatagatgttgccgtgtgtgtggaaaaataggccactacatgaaagactgccctaaaaggaaaagtttactgtttagactaaagaagaaagacagtgaagaagagaaggaagggaatgaagaagagaaagattcccgagatgttcttgacccccgagacctccacgatactcgagactttagagacccgagagacctcagatgttttatatgtggagatgctggacatgtacgaagggagtgcccagaggtcaagctggcccgtcagaggaatagcagtgtggcagcagcccagctggtccgcaaccttgtaaatgctcaacaggtggctggttcagctcagcaacagggtgatcagtccataaggactagacagtcatcagaatgttctgaatcaccatcttattctcctcagcctcagccatttccacagaactcttcccagtcagctgctattactcagccttcatctcagccaggatcccaacctaagcttggcccacctcagcagggagcccaacctccccatcaggtccagatgccactgtataactttccccagtcaccaccagctcagtattctcccatgcacaatatgggattgttgccaatgcaccctctccagatccctgccccgtcctggcccatccatggcccagtgatccactctgcaccaggcagtgcccccagcaatattggcctaaatgatcccagcatcatctttgcacagcctgctgccagacctgtggcaatccctaacacgtctcacgatggacactggccccgtactgtggctccaaattccctggtaaacagtggtgcagtggggaattcagagccaggctttcgaggactgactcctccaattccttgggaacatgcaccgcgtccccatttcccccttgtcccagcttcgtggccttatggtttgcatcaaaacttcatgcatcagggaaatgcccgattccagcccaacaaacctttctatactcaagacagatgtgccacccgtcggtgtagagagcgttgtccccacccaccaagaggaaacgtgtcggagtaatgcgagtccattttctttcagctggtctaccgatgcacagcaaccagccaatcctgctgtctcaagggtatccgtacctcaatgtcagttacattcagcagaaaaagtgacatttaatggaaagcaaaacaaatcaggtcctgatttaaaattttaacacgtttagatagcttatttaaattctaagactgtttttacagactgtattatttgtatataaatatgaactatagtttttactagtatcaccaaattgagtgatacaaatttcatctattttattaccctatttttaagggaattttatgttttgtttaaccttgatgaattgtataaagagagaatttaaaaaattacattctttattttctattagctgtattcatactttggttgcttcagactttatatattgttcttaaaagttaggaaagaatttcatgtgttttaaattgtcacttctattctttacagaaccttgtagtgccaaaaactttttaaaaggtaaaaaaataaaataaaattacaacatgaagattcagattttttttcttttccatacttgtatattgaacattcaaacttgaatggaaagttgattttgtctgtatttgaagtacttctattttaagttaataaatctttttgacaagagttaaa

SEQ ID NO: 204316 - DNA, 2047 bp, Homo sapiens
  Payload ID: 20295
  Gene Name: zinc finger, CCHC domain containing 11
  ENST ID: ENST00000473856
  CDS Start-End: 233-1264
cggtggagtcctgagctagtcgtgtcccggcctccagcggcggcagcggcgacggcggcggcagcaggaggcggagggagagcaggagccactgagatgaggaggcgtcgcgcgcgcctgtagctcgcgggcctcgcagtttgcttgcctaaactggacttgaagcaatttaaactactggagatctgccattttataatatcacaattggaaagaaacagattttcaaataatggaagagtctaaaaccttaaaaagtgaaaatcatgaaccaaagaagaatgttatttgtgaagaaagcaaagcagttcaagttataggtaatcaaacattgaaagctagaaatgataaatccgtaaaagaaattgagaacagctctccaaataggaatagtagtaaaaaaaataagcaaaatgatatttgtatagaaaaaacagaagttaaatcatgtaaagtaaatgctgccaaccttccaggtcctaaagatttggggttagtccttcgagatcaaagtcattgcaaagcaaaaaaatttcctaattcaccggtgaaagccgaaaaggcaaccatttcacaggcaaaatcagaaaaggcaaccagtttacaggcaaaagcagaaaaatcaccaaagtcacctaattcagtgaaagcagaaaaagcatccagttatcagatgaagtcagaaaaagtaccaagttcaccagcagaagcagaaaagggacccagtttactgttgaaagacatgagacagaagacagaattacaacagattggaaaaaaaattccaagctcctttacttctgtggacaaagtgaatattgaagctgtagggggagaaaaatgtgctctgcaaaactcaccacgatctcagaagcaacagacatgtacagataatactggtgattctgatgatagtgcttcaggaattgaagacgtatcggacgatttaagtaaaatgaagaatgatgaatctaataaagaaaattcttcagagatggactacttagaaaatgccactgtgatagatgaatctgcattgacacctgagcagaggctggggttgaaacaagcagaagaacgcttagaaagagatcacatctttcgacttgaaaaacgatcaccagaatataccaattgtcggtatctatgcaaactttgcttaattcacattgaaaatatccagggggctcataaacatataaaggagaaacgacataagaaaaatattttgaatgttcacttaggttgtatggctcatctctgactagatttgctctgaaaagtagtgatgttaatatagatataaaatttcctcccaagatgaatcatccagatcttctgataaaagtacttgggattttaaagaaaaatgtattatatgtagatgtggaatctgattttcacgctaaagttcctgttgtggtgtgcagagatcgaaaaagtggtttactttgtagagtgagtgcaggaaacgatatggcatgtctcactactgatttacttactgcccttggcaaaatagaacctgtctttattcccttggtgttagcctttcgctactgggctaagttgtgctatattgactcccaaactgatggtggaatcccttcttactgttttgctttaatggtgatgttttttctacaacagagaaaaccccctcttcttccttgcttacttggaagttggattgaaggctttgacccaaaaagaatggatgactttcagctgaagggcatagtagaagagaagtttgtgaagtgggaatgtaattcaagtagtgcaactgagaaaaactcaattgctgaggaaaacaaagctaaggcagaccaaccaaaagatgataccaagaagacagaaacagacaaccaaagtaatgccatgaaggaaaaacatggcaaatctcctttagcattggaaacaccaaatcgggtatccttgggacagttatggttagagctgcttaaattctacacactggattttgctttggaggaatatgtcatatgtgtacggatacaagatattttaacaagagaaaataaaa

SEQ ID NO: 204317 - DNA, 553 bp, Homo sapiens
  Payload ID: 20295
  Gene Name: zinc finger, CCHC domain containing 11
  ENST ID: ENST00000528457
  CDS Start-End: 1-493
ccagatccctgccccgtcctggcccatccatggcccagtgatccactctgcaccaggcagtgcccccagcaatattggcctaaatgatcccagcatcatctttgcacagcctgctgccagacctgtggcaatccctaacacgtctcacgatggacactggccccgtactgtggctccaaattccctggtaaacagtggtgcagtggggaattcagagccaggctttcgaggactgactcctccaattccttgggaacatgcaccgcgtccccatttcccccttgtcccagcttcgtggccttatggtttgcatcaaaacttcatgcatcagggaaatgcccgattccagcccaacaaacctttctatactcaaggtaagaaagctgcaattgtggaggtagaatgcagcagaagaaagacagctaaaatatggagacctgagttcaagttcccatgctaccatttatggctgtgggaacatcatacatattgatcaactttcaaatatatcatcagtaaaactagaataaaacctatttacctcacaggatta

SEQ ID NO: 204318 - DNA, 3854 bp, Homo sapiens
  Payload ID: 20295
  Gene Name: zinc finger, CCHC domain containing 11
  ENST ID: ENST00000528642
  CDS Start-End: 246-3854
gcggcggacatggcggtggagtcctgagctagtcgtgtcccggcctccagcggcggcagcggcgacggcggcggcagcaggaggcggagggagagcaggagccactgagatgaggaggcgtcgcgcgcgcctgtagctcgcgggcctcgcagtttgcttgcctaaactggacttgaagcaatttaaactactggagatctgccattttataatatcacaattggaaagaaacagattttcaaataatggaagagtctaaaaccttaaaaagtgaaaatcatgaaccaaagaagaatgttatttgtgaagaaagcaaagcagttcaagttataggtaatcaaacattgaaagctagaaatgataaatccgtaaaagaaattgagaacagctctccaaataggaatagtagtaaaaaaaataagcaaaatgatatttgtatagaaaaaacagaagttaaatcatgtaaagtaaatgctgccaaccttccaggtcctaaagatttggggttagtccttcgagatcaaagtcattgcaaagcaaaaaaatttcctaattcaccggtgaaagccgaaaaggcaaccatttcacaggcaaaatcagaaaaggcaaccagtttacaggcaaaagcagaaaaatcaccaaagtcacctaattcagtgaaagcagaaaaagcatccagttatcagatgaagtcagaaaaagtaccaagttcaccagcagaagcagaaaagggacccagtttactgttgaaagacatgagacagaagacagaattacaacagattggaaaaaaaattccaagctcctttacttctgtggacaaagtgaatattgaagctgtagggggagaaaaatgtgctctgcaaaactcaccacgatctcagaagcaacagacatgtacagataatactggtgattctgatgatagtgcttcaggaattgaagacgtatcggacgatttaagtaaaatgaagaatgatgaatctaataaagaaaattcttcagagatggactacttagaaaatgccactgtgatagatgaatctgcattgacacctgagcagaggctggggttgaaacaagcagaagaacgcttagaaagagatcacatctttcgacttgaaaaacgatcaccagaatataccaattgtcggtatctatgcaaactttgcttaattcacattgaaaatatccagggggctcataaacatataaaggagaaacgacataagaaaaatattttggaaaaacaagaagaaagtgagcttcgttctctgccacctccttcccctgcccacttggctgctttaagtgttgcagtcattgaattagcaaaagaacatggaataacagatgatgacctcagagtccgtcaggaaattgtggaggaaatgtcaaaggttataacgacatttttaccagaatgttcacttaggttgtatggctcatctctgactagatttgctctgaaaagtagtgatgttaatatagatataaaatttcctcccaagatgaatcatccagatcttctgataaaagtacttgggattttaaagaaaaatgtattatatgtagatgtggaatctgattttcacgctaaagttcctgttgtggtgtgcagagatcgaaaaagtggtttactttgtagagtgagtgcaggaaacgatatggcatgtctcactactgatttacttactgcccttggcaaaatagaacctgtctttattcccttggtgttagcctttcgctactgggctaagttgtgctatattgactcccaaactgatggtggaatcccttcttactgttttgctttaatggtgatgttttttctacaacagagaaaaccccctcttcttccttgcttacttggaagttggtctcctttagcattggaaacaccaaatcgggtatccttgggacagttatggttagagctgcttaaattctacacactggattttgctttggaggaatatgtcatatgtgtacggatacaagatattttaacaagagaaaataaaaactggcctaaaaggcgaatagccattgaagatccattttcagtcaagaggaatgttgcacggagcttaaacagccagctggtttacgaatatgttgtggagagatttagggcagcttatcggtattttgcctgtcctcagacgaagggtggaaataagtctacagtggatttcaagaaaagagagaaggggaaaataagcaataagaaaccagtcaagtcgaacaatatggcaaccaatggttgtattctgcttggggaaaccacagaaaaaataaatgcagaaagagagcaacctgttcaatgtgatgaaatggactgtacatcacagagatgtattattgacaacaacaatttgttggtaaatgaactagattttgctgaccacggacaggactcttcatctctttctaccagcaaaagcagtgaaatagagccaaaattagataagaaacaagatgatttagcgccttcagaaacttgtttaaaaaaagagctcagccaatgtaattgcattgatttgtctaagtcgcctgacccagataaatctactggaacagactgcaggtcaaatttagaaacagagagttcacatcagagtgtgtgcaccgacacatctgctacctcttgcaactgcaaagctacagaagatgcttctgaccttaatgatgatgataacctccccacccaggaattatattatgtgtttgataagtttattttaacctctggcaagccaccaacgatagtatgcagcatctgcaaaaaggatggccattcaaagaatgattgcccagaggattttaggaaaattgatttaaaacctctaccaccaatgacaaaccgatttcgggaaatacttgatttagtatgtaaaagatgttttgatgagttatcaccaccttgttctgaacaacacaacagggagcaaattttaattggcttggaaaagtttattcaaaaagaatatgatgaaaaggcaaggttgtgcttatttggctcttctaagaatggatttggatttcgtgatagtgatctggatatttgtatgaccctggaaggccatgaaaatgcagagaaattaaattgtaaggaaataattgaaaatttggcaaaaattcttaagagacatccaggtttaagaaacattttgcctataactactgccaaagtgcctatagtaaaatttgaacacaggcgaagtgggttagaaggcgatatcagtttatataatacgttggctcaacataacacaagaatgctagctacttatgcagctattgatcctagagtgcagtatttgggatatactatgaaagtgtttgctaagcgatgtgacattggggatgcttccaggggaagtttatcttcatatgcatatatccttatggtgctgtactttctgcagcagagaaagccacctgttatcccagttctacaagagatctttgatggaaaacagattccacagagaatggttgatggatggaatgctttcttctttgataaaacagaagaactgaaaaagcgtttaccttcacttggaaagaacacagaatcattaggggagctttggctgggactgcttcgtttctatactgaagagtttgatttcaaggaatatgtaattagcattcggcagaaaaagctgttgacaacttttgagaagcagtggacttccaagtgcattgcaattgaagacccttttgacttgaatcataaccttggtgctggagtttccagaaaaatgaccaatttcatcatgaaagcatttatcaatggaaggaaactttttggtacccctttttatccactcattggcagagaagct

SEQ ID NO: 204319 - DNA, 1010 bp, Homo sapiens
  Payload ID: 20295
  Gene Name: zinc finger, CCHC domain containing 11
  ENST ID: ENST00000474453
  CDS Start-End: 1-1010
gattccacagagaatggttgatggatggaatgctttcttctttgataaaacagaagaactgaaaaagcgtttaccttcacttggaaagaacacagaatcattaggggagctttggctgggactgcttcgtttctatactgaagagtttgatttcaaggaatatgtaattagcattcggcagaaaaagctgttgacaacttttgagaagcagtggacttccaagtgcattgcaattgaagacccttttgacttgaatcataaccttggtgctggagtttccagaaaaatgaccaatttcatcatgaaagcatttatcaatggaaggaaactttttggtacccctttttatccactcattggcagagaagctgagtacttctttgattccagagtattaacagatggagaactggctcccaatgatagatgttgccgtgtgtgtggaaaaataggccactacatgaaagactgccctaaaaggaaaagactaaagaagaaagacagtgaagaagagaaggaagggaatgaagaagagaaagattcccgagatgttcttgacccccgagacctccacgatactcgagactttagagacccgagagacctcagatgttttatatgtggagatgctggacatgtacgaagggagtgcccagaggtcaagctggcccgtcagaggaatagcagtgtggcagcagcccagctggtccgcaaccttgtaaatgctcaacaggtggctggttcagctcagcaacagggtgatcagtccataaggactagacagtcatcagaatgttctgaatcaccatcttattctcctcagcctcagccatttccacagaactcttcccagtcagctgctattactcagccttcatctcagccaggatcccaacctaagcttggcccacctcagcagggagcccaacctccccatcaggtccagatgccactgtataactttccccagtcaccaccagctcagtattctcccatgcacaatatgggat

SEQ ID NO: 204320 - DNA, 883 bp, Homo sapiens
  Payload ID: 20295
  Gene Name: zinc finger, CCHC domain containing 11
  ENST ID: ENST00000470626
  CDS Start-End: 623-883
ggcgcggcggacatggcggtggagtcctgagctagtcgtgtcccggcctccagcggcggcagcggcgacggcggcggcagcaggaggcggagggagagcaggagccactgagatgaggaggcgtcgcgcgcgcctgtagctcgcgggcctcgcagacagagtcttgctctgttgcctaggctggagtgcagtggcatgattgcagctcactgtagccttcacctcccaagtgcaagtgatcctcccacttcagcctcctgagactgggactacagagccagctgactatgcaacaagatgactatgcaacaagatgaatgaggagatatctacagcaggcttattgcttggaaatttcagaataccaaagcaaagagatcatcctagaagttttcttagagaaaaaaacagcctgaacgacagagcaagaccatgtctcaagaaagaagaagaagaaaaagattactcaaaatgaaaacctgtcaattttctgagcctgggactctccgggtacattgatctatattagtttgcttgcctaaactggacttgaagcaatttaaactactggagatctgccattttataatatcacaattggaaagaaacagattttcaaataatggaagagtctaaaaccttaaaaagtgaaaatcatgaaccaaagaagaatgttatttgtgaagaaagcaaagcagttcaagttataggtaatcaaacattgaaagctagaaatgataaatccgtaaaagaaattgagaacagctctccaaataggaatagtagtaaaaaaaataagcaaaatgatatttgtatagaaaaaacagaagttaaatcatgtaaagtaaatgctgccaaccttccaggtcctaaagatttgggg

SEQ ID NO: 204321 - DNA, 506 bp, Homo sapiens
  Payload ID: 20295
  Gene Name: zinc finger, CCHC domain containing 11
  ENST ID: ENST00000471623
  CDS Start-End: 1-317
acgatggacactggccccgtactgtggctccaaattccctggtaaacagtggtgcagtggggaattcagagccaggctttcgaggactgactcctccaattccttgggaacatgcaccgcgtccccatttcccccttgtcccagcttcgtggccttatggtttgcatcaaaacttcatgcatcagggaaatgcccgattccagcccaacaaacctttctatactcaagctggtctaccgatgcacagcaaccagccaatcctgctgtctcaagggtatccgtacctcaatgtcagttacattcagcagaaaaagtgacatttaatggaaagcaaaacaaatcaggtcctgatttaaaattttaacacgtttagatagcttatttaaattctaagactgtttttacagactgtattatttgtatataaatatgaactatagtttttactagtatcaccaaattgagtgatacaaatttcatctattttattaccctatttttaaggg

SEQ ID NO: 204322 - DNA, 2910 bp, Homo sapiens
  Payload ID: 20295
  Gene Name: zinc finger, CCHC domain containing 11
  ENST ID: ENST00000484723
  CDS Start-End: 192-2910
gcgcgctcccttccctccgcgtgggtttcgcggcgcggcggacatggcggtggagtcctgagctagtcgtgtcccggcctccagcggcggcagcggcgacggcggcggcagcaggaggcggagggagagcaggagccactgagatgaggaggcgtcgcgcgcgcctgtagctcgcgggcctcgcaggtaaaatgaagaatgatgaatctaataaagaaaattcttcagagatggactacttagaaaatgccactgtgatagatgaatctgcattgacacctgagcagaggctggggttgaaacaagcagaagaacgcttagaaagagatcacatctttcgacttgaaaaacgatcaccagaatataccaattgtcggtatctatgcaaactttgcttaattcacattgaaaatatccagggggctcataaacatataaaggagaaacgacataagaaaaatattttggaaaaacaagaagaaagtgagcttcgttctctgccacctccttcccctgcccacttggctgctttaagtgttgcagtcattgaattagcaaaagaacatggaataacagatgatgacctcagagtccgtcaggaaattgtggaggaaatgtcaaaggttataacgacatttttaccagaatgttcacttaggttgtatggctcatctctgactagatttgctctgaaaagtagtgatgttaatatagatataaaatttcctcccaagatgaatcatccagatcttctgataaaagtacttgggattttaaagaaaaatgtattatatgtagatgtggaatctgattttcacgctaaagttcctgttgtggtgtgcagagatcgaaaaagtggtttactttgtagagtgagtgcaggaaacgatatggcatgtctcactactgatttacttactgcccttggcaaaatagaacctgtctttattcccttggtgttagcctttcgctactgggctaagttgtgctatattgactcccaaactgatggtggaatcccttcttactgttttgctttaatggtgatgttttttctacaacagagaaaaccccctcttcttccttgcttacttggaagttggattgaaggctttgacccaaaaagaatggatgactttcagctgaagggcatagtagaagagaagtttgtgaagtgggaatgtaattcaagtagtgcaactgagaaaaactcaattgctgaggaaaacaaagctaaggcagaccaaccaaaagatgataccaagaagacagaaacagacaaccaaagtaatgccatgaaggaaaaacatggcaaatctcctttagcattggaaacaccaaatcgggtatccttgggacagttatggttagagctgcttaaattctacacactggattttgctttggaggaatatgtcatatgtgtacggatacaagatattttaacaagagaaaataaaaactggcctaaaaggcgaatagccattgaagatccattttcagtcaagaggaatgttgcacggagcttaaacagccagctggtttacgaatatgttgtggagagatttagggcagcttatcggtattttgcctgtcctcagacgaagggtggaaataagtctacagtggatttcaagaaaagagagaaggggaaaataagcaataagaaaccagtcaagtcgaacaatatggcaaccaatggttgtattctgcttggggaaaccacagaaaaaataaatgcagaaagagagcaacctgttcaatgtgatgaaatggactgtacatcacagagatgtattattgacaacaacaatttgttggtaaatgaactagattttgctgaccacggacaggactcttcatctctttctaccagcaaaagcagtgaaatagagccaaaattagataagaaacaagatgatttagcgccttcagaaacttgtttaaaaaaagagctcagccaatgtaattgcattgatttgtctaagtcgcctgacccagataaatctactggaacagactgcaggtcaaatttagaaacagagagttcacatcagagtgtgtgcaccgacacatctgctacctcttgcaactgcaaagctacagaagatgcttctgaccttaatgatgatgataacctccccacccaggaattatattatgtgtttgataagtttattttaacctctggcaagccaccaacgatagtatgcagcatctgcaaaaaggatggccattcaaagaatgattgcccagaggattttaggaaaattgatttaaaacctctaccaccaatgacaaaccgatttcgggaaatacttgatttagtatgtaaaagatgttttgatgagttatcaccaccttgttctgaacaacacaacagggagcaaattttaattggcttggaaaagtttattcaaaaagaatatgatgaaaaggcaaggttgtgcttatttggctcttctaagaatggatttggatttcgtgatagtgatctggatatttgtatgaccctggaaggccatgaaaatgcagagaaattaaattgtaaggaaataattgaaaatttggcaaaaattcttaagagacatccaggtttaagaaacattttgcctataactactgccaaagtgcctatagtaaaatttgaacacaggcgaagtgggttagaaggcgatatcagtttatataatacgttggctcaacataacacaagaatgctagctacttatgcagctattgatcctagagtgcagtatttgggatatactatgaaagtgtttgctaagatctttgatggaaaacagattccacagagaatggttgatggatggaatgctttcttctttgataaaacagaagaactgaaaaagcgtttaccttcacttggaaagaacacagaatcattag

SEQ ID NO: 204323 - DNA, 539 bp, Homo sapiens
  Payload ID: 20295
  Gene Name: zinc finger, CCHC domain containing 11
  ENST ID: ENST00000524582
  CDS Start-End: 309-539
ccctcctcgcgagctaacgagtgtctctcgcgcgctcccttccctccgcgtgggtttcgcggcgcggcggacatggcggtggagtcctgagctagtcgtgtcccggcctccagcggcggcagcggcgacggcggcggcagcaggaggcggagggagagcaggagccactgagatgaggaggcgtcgcgcgcgcctgtagctcgcgggcctcgcagtttgcttgcctaaactggacttgaagcaatttaaactactggagatctgccattttataatatcacaattggaaagaaacagattttcaaataatggaagagtctaaaaccttaaaaagtgaaaatcatgaaccaaagaagaatgttatttgtgaagaaagcaaagcagttcaagttataggtaatcaaacattgaaagctagaaatgataaatccgtaaaagaaattgagaacagctctccaaataggaatagtagtaaaaaaaataagcaaaatgatatttgtatagaaaaaacagaagttaaatcatgtaaagtaaatgct

SEQ ID NO: 204324 - DNA, 1016 bp, Homo sapiens
  Payload ID: 20295
  Gene Name: zinc finger, CCHC domain containing 11
  ENST ID: ENST00000531722
  CDS Start-End: 1-1016
ggatggaatgctttcttctttgataaaacagaagaactgaaaaagcgtttaccttcacttggaaagaacacagaatcattaggggagctttggctgggactgcttcgtttctatactgaagagtttgatttcaaggaatatgtaattagcattcggcagaaaaagctgttgacaacttttgagaagcagtggacttccaagtgcattgcaattgaagacccttttgacttgaatcataaccttggtgctggagtttccagaaaaatgaccaatttcatcatgaaagcatttatcaatggaaggaaactttttggtacccctttttatccactcattggcagagaagctgagtacttctttgattccagagtattaacagatggagaactggctcccaatgatagatgttgccgtgtgtgtggaaaaataggccactacatgaaagactgccctaaaaggaaaagactaaagaagaaagacagtgaagaagagaaggaagggaatgaagaagagaaagattcccgagatgttcttgacccccgagacctccacgatactcgagactttagagacccgagagacctcagatgttttatatgtggagatgctggacatgtacgaagggagtgcccagaggtcaagctggcccgtcagaggaatagcagtgtggcagcagcccagctggtccgcaaccttgtaaatgctcaacaggtggctggttcagctcagcaacagggtgatcagtccataaggactagacagtcatcagaatgttctgaatcaccatcttattctcctcagcctcagccatttccacagaactcttcccagtcagctgctattactcagccttcatctcagccaggatcccaacctaagcttggcccacctcagcagggagcccaacctccccatcagatccctgccccgtcctggcccatccatggcccagtgatccactctgcaccaggcagtgcccccagcaatattggcctaaatgatcccagcatcatctt

SEQ ID NO: 204325 - DNA, 691 bp, Homo sapiens
  Payload ID: 20295
  Gene Name: zinc finger, CCHC domain containing 11
  ENST ID: ENST00000527941
  CDS Start-End: 1-327
gccagacctgtggcaatccctaacacgtctcacgatggacactggccccgtactgtggctccaaattccctggtaaacagtggtgcagtggggaattcagagccaggctttcgaggactgactcctccaattccttgggaacatgcaccgcgtccccatttcccccttgtcccagcttcgtggccttatggtttgcatcaaaacttcatgcatcagggaaatgcccgattccagcccaacaaacctttctatactcaagacagatgtgccacccgtcggtgtagagagcgttgtccccacccaccaagaggaaacgtgtcggagtaatgcgagtccattttctttcagctggtctaccgatgcacagcaaccagccaatcctgctgtctcaaggatggagtcttgctctgtcgcccaggctggaatacagcggcgtgatctcggctcactacaatctccgcctcctggttcaagggattctcctgcctcagcctcctgagtagctgggattacaggtaagaaagctgcaattgtggaggtagaatgcagcagaagaaagacagctaaaatatggagacctgagttcaagttcccatgctaccatttatggctgtgggaacatcatacatattgatcaactttcaaatatatcatcagtaaaactagaataaaacctatttacctcacagga

SEQ ID NO: 204326 - DNA, 827 bp, Homo sapiens
  Payload ID: 20295
  Gene Name: zinc finger, CCHC domain containing 11
  ENST ID: ENST00000494469
  CDS Start-End: 1-455
ctcagcctcagccatttccacagaactcttcccagtcagctgctattactcagccttcatctcagccaggatcccaacctaagcttggcccacctcagcagggagcccaacctccccatcagcctgctgccagacctgtggcaatccctaacacgtctcacgatggacactggccccgtactgtggctccaaattccctggtaaacagtggtgcagtggggaattcagagccaggctttcgaggactgactcctccaattccttgggaacatgcaccgcgtccccatttcccccttgtcccagcttcgtggccttatggtttgcatcaaaacttcatgcatcagggaaatgcccgattccagcccaacaaacctttctatactcaagacagatgtgccacccgtcggtgtagagagcgttgtccccacccaccaagaggaaacgtgtcggagtaatgcgagtccattttctttcagctggtctaccgatgcacagcaaccagccaatcctgctgtctcaagggtatccgtacctcaatgtcagttacattcagcagaaaaagtgacatttaatggaaagcaaaacaaatcaggtcctgatttaaaattttaacacgtttagatagcttatttaaattctaagactgtttttacagactgtattatttgtatataaatatgaactatagtttttactagtatcaccaaattgagtgatacaaatttcatctattttattaccctatttttaagggaattttatgttttgtttaaccttgatgaattgtataaagagagaatttaaaaaattacattctttattttcta

SEQ ID NO: 204327 - DNA, 2231 bp, Homo sapiens
  Payload ID: 20296
  Gene Name: zinc finger, CCHC domain containing 12
  Uniprot ID: Q6PEW1
  ENST ID: ENST00000310164
  CDS Start-End: 508-1716
agaggataaaagccgccgcggctgccttaggaacggcgctgcctcgtctctgctacccctggttgggcggccctgcgaagcagctccttcgggcagccccgggtcgcttagcggccaaggaggcttcagttctttgccgcctgcaaggcggagaccagaaggcggaatccacagctggcgacgcgggagcatctgctgtccaccagcggagcacaggccatcaaagccgcatctgaacttgaattctgtgcagctgattgcagagctggacccggatctgcgaccccctgtggacagaggttgaccgtaccccggagaggagctttctcacggagggcactggttgcagaggctggaagtgaaataaagacgcgctcttgtttcagagttcgtcccctgctgagataggaaggcagagccacctcctctcctctcccacctgcagattaagcttttctaaaaagcctaggcatcttcttatattcagataccctatcgtcgtcagtcatggctagcatcattgcacgtgtcggtaacagccggcggctgaatgcacccttgccgccttgggcccattccatgctgaggtccctggggagaagtctcggtcctataatggccagcatggcagacagaaacatgaagttgttctcggggagggtggtgccagcccaaggggaagaaacctttgaaaactggctgacccaagtcaatggcgtcctgccagattggaatatgtctgaggaggaaaagctcaagcgcttgatgaaaacccttaggggccctgcccgcgaggtcatgcgtgtgcttcaggcgaccaaccctaacctaagtgtggcagatttcttgcgagccatgaaattggtgtttggggagtctgaaagcagtgtgactgcccatggtaaattttttaacaccctacaagctcaaggggagaaagcctccctttatgtgatccgtttagaggtgcagctccagaacgctattcaggcaggcattatagctgagaaagatgcaaaccggactcgcttgcagcagctccttttaggcggtgagctgagtagggacctccgactcagacttaaggattttctcaggatgtatgcaaatgagcaggagcggcttcccaactttctggagttaatcagaatggtaagggaggaagaggattgggatgatgcttttattaaacggaagcgtccaaaaaggtctgagtcaatggtggagagggcagtcagccctgtggcatttcagggctccccaccgatagtgatcggcagtgctgactgcaatgtgatagagatagatgataccctcgacgactccgatgaggatgtgatcctggtggagtctcaggaccctccacttccatcctggggtgcccctcccctcagagacagggccagacctcaggatgaagtgctggtcattgattccccccacaattccagggctcagtttccttccaccagtggtggttctggctataagaataacggtcctggggagatgcgtagagccaggaagcgaaaacacacaatccgctgttcgtattgtggtgaggaaggccactcaaaagaaacctgtgacaacgagagtgacaaggcccaggtttttgagaatttgatcatcactctccaggagctgacccatactgagatggagaggtcaagagtggcccctggcgaatacaatgacttctctgagccactgtaagggaccacccccaggtttcagtgaacccttacctatattcagcatccagtagtgggaaaactggggtgggggtgggggtgggacttctaactgcatgaattaatccacaaagcggctatcttttggggtggagtagaaagggtcttggataccagcacattggagggagatagcctgacctctgtccttgctccttctccctgcagcctacgggtctgttttctgtgtgtgcccatttccttgacagctttattctttgtgaaagtggtataatttattgttaaatatttgaacaataaaaaaggtacaaaaagtgaagtacaaattacccaaatctctccacccttatataatcattgtcaaccctttgatgagtgatatttccctatacctatgtacccagatagatatatgcatagataaaagtgatgaaatataagtgctgttctatctgtattttttcaccaaacaatatatgttgtgagcttctatgtcaataaatatatatatcagca

SEQ ID NO: 204328 - DNA, 842 bp, Homo sapiens
  Payload ID: 20297
  Gene Name: zinc finger, CCHC domain containing 13
  Uniprot ID: Q8WW36
  ENST ID: ENST00000339534
  CDS Start-End: 78-578
aagccgcccaaagcggggttgcgccggggcctccggggccgaggtgggcctgctcattggaagatcgcatcgcagccatgagcagtaaggatttcttcgcgtgtggacactctggccattgggctcggggatgccctagaggaggagctggagggcgaagaggtggaggccatggcagaggttctcaatgtggttccaccaccctatcttacacctgttactgctgtggtgagtccggtcgtaatgctaagaactgtgtccttctcggaaacatctgctacaactgtgggagaagcggccacatcgccaaagactgtaaggatcctaaacgagagagacgccaacactgttatacctgcggcagactaggacatctggctcgtgactgtgatcgtcagaaagagcagaaatgctactcttgcggcaaacttgggcacattcagaaagactgcgcccaggtcaagtgttaccgatgcggcgagattggccacgtggccatcaattgcagcaaggcgaggccaggtcaactgctaccgctgcggcaaatcccgacatctagccaaggaatgtcccagtgaggttaccacttaaatcttcccccccaccccccacccttttgctgattgataattgtattattttctccgaaaacttcactcaccgaaaggtcgatagattgaggctactctcaggcaagtgagctttaattaccatgttaaaggaggaaagagctagaaaaaaaaacctcaaaaaagttaatcattggtagatgccccacaattaacgtgttgcttctgccccacgggcaaatctagttattaaatagtcattctgagcaccaa

SEQ ID NO: 204329 - DNA, 7102 bp, Homo sapiens
  Payload ID: 20298
  Gene Name: zinc finger, CCHC domain containing 14
  Uniprot ID: Q8WYQ9
  ENST ID: ENST00000268616
  CDS Start-End: 219-3068
aggccaacaacccggccgacctgggcagcctcaccaacctgacggacgaggtggtgcgcagcaagctgctggtgtcgctggcgctgctgggctcggagcagcgcgaggcggcgggcgtgctctaccgcacgctcacgcacatcgactccatcatccacaactacgggctgcagcttaacgagggccgcacgggcgatgagttcctgctgctgttcaccatggcctccaaccacccggccttcagcttccaccagaagcaggtgctgcgccaggagctcacgcagatccagagcagcctgaacggcggcgggggccacggcggcaagggcgcgcccgggccgggcggcgcgctgcccacttgcccagcctgccacaagatcactccaagaactgaggcccctgtcagcagtgtcagtaatagtttggagaatgccctgcacacatcagcacattccacggaggagtcgctgcccaagaggcccttaggaaaacacagcaaagtgagtgttgaaaagatagacctgaagggattatcacacacaaaaaatgacagaaatgttgaatgttcctttgaggtcttgtggtctgattcttcaataacatcagtaaccaaatcttcctctgaagtgacggaatttatttcaaagctatgtcagctctatcctgaagagaacttggagaaactcattccttgcttagctggtccggacgcattttatgtggagcgaaaccacgtggatctggactcaggcctgaggtacctggcctcattaccttctcacgtgttgaaaaatgaccatgtcaggaggtttctcagcacttcctctcccccacagcagcttcagagtccaagtcctggcaatccctccctttctaaagtaggtaccgtgatgggcgtgtctggaaggcctgtgtgtggagtggctggtatcccgtcctcgcagagcggagcccagcaccacgggcagcacccggccggctccgccgcccccttgcctcactgctcccatgcgggcagcgcgggctcagccctggcctaccggacccagatggacacatcacctgccatcctcatgccttccagtctgcagacccctcagacccaggagcagaatgggattctagactggcttaggaaactgcgtttgcacaagtattaccccgtctttaagcagctctccatggagaagtttttgagccttactgaagaagatctgaataaatttgagtctcttaccatgggggcaaagaagaagctcaagacccagctggagctggaaaaggagaagtcagagagacggtgcctgaacccctcggccccgccgctggtcaccagcagtggtgtggctcgagtgccccccaccagccacgtcgggcccgtgcagtcggggcggggcagccatgcagcagagctgcgggtggaagtggagcagccccatcaccagctgccccgggaaggcagttcctcggagtactccagctcctcctccagccccatgggggtacaggcccgggaagagagctccgacagcgctgaggagaatgacagacgtgtggagattcacttggagagctctgacaaggagaagccggtgatgctgctgaatcacttcacttccagttccgccagacccacggcccaggttctccctgtgcagaatgaggccagctccaatccatcaggccaccaccccctgcccccgcagatgctgagcgcagcctcacacatcacacccatccgcatgctgaattccgtgcacaagccggaaagagggagcgcggacatgaagctcctctcgtcttctgtgcactcacttttgtctctagaagaaaggaataaaggatctggaccaagaagcagcatgaaagtggacaagagctttggcagcgccatgatggacgtgctgcccgcgtccgcaccccaccagcctgtgcaggtcctctctgggctttcggagagcagctccatgtcacccacagtctcctttggtccccggaccaaagtcgtgcatgcatccacgctggacagggtgctgaagacagcacagcaaccggccctggtcgtggagaccagcacggccgccacggggacgcccagcacagtcctccacgccgcccgtccgcccatcaaactgctgctgtcgtcatctgttcctgctgattctgccatttctgggcaaacttcctgtcctaataatgtgcaaataagtgtgccccctgcaataataaacccccggactgctctgtacacagccaacaccaaagttgccttttctgcaatgagcagtatgccagtgggccccctgcagggtggcttctgtgcaaacagcaacactgcctctcccagcagccacccctccacgtcctttgccaacatggccacgttgcccagctgcccagcccccagctccagcccggcgctgtcctccgtccctgaaagcagtttctatagcagcagtggcggtggcggctccacaggaaacattcctgcctcgaatccgaaccaccaccaccaccaccaccatcagcagcccccggcacccccgcagcccgccccacccccgccaggctgcattgtgtgcacgtcctgtggctgcagcggcagctgcggctcgagtggcctgactgtcagctacgccaactacttccagcacccgttctccggtccgtccgtgttcaccttccccttcttgcccttcagtcccatgtgcagcagcggctacgtcagcgcccagcagtacggcggcggctccaccttccccgtcgtgcacgccccttacagcagcagcgggaccccagaccctgtcctgagtgggcagtccacgtttgccgtgccacccatgcagaacttcatggcagggacagcaggggtgtaccagacccaaggactggtgggcagtagcaatggttccagtcacaaaaagagcgggaacctatcttgttacaactgcggggccactggtcaccgcgcccaggactgcaaacagccgtccatggacttcaaccggccaggtacttttaggttgaaatacgcccctccagcagaaagtctggactccacagattgatatttttctctggcaacagaacgttattaagccatggagacataaggaaaattaaatacaaaactgagaagtctagttgctgttgagcttaatctttttaatccaaaggtgctttacttttcctagactggatagaaaatctagcgtagaagtgcatcaaactcgatttattgccaaaaccctagattggagcttggtgtcagaactcgcctagtgggcatctctgtggctggtgagatcggccacctccacttttggttgcagtgcagagacgccatgtctcccgaagagcattgccatcactggccctcctaggctcacacgtcaattccagggcagctacacgtggtctgaatcgagaaccgagcttggagttctccaagtggagttccacccgccggactcctgacacccctgggctagggaaaatgtcgactttgttttgttctgttcctaaagtgattagcactaatctctgggatttttaaggattgcactacagaagaatgtaccctgatgtaaatctctgcggttctgggagccaaactcctctgagaacagtcagtgcaagagactccaataatccatattgaaagagtcagcaccagcagaggctactcgacttaggacgcaacagaggttttagtatttccttccctcctccaagcacttgtagcagtttcaggtttttaatttttttctgcaaataaatctaaactacgttattaaatagaaatagtttactcgcaacaacttaatttctaagggtccaagtcccagagaatccatagtcgtcaaagctttgagagtatctttcttcccagccagtcagtggctttgagccctatcttccactacaaatgacctctcgaggggggacggcgacagcgcggctctgtgagtggctgtgaggatgctgcacgtcctcagcagagtttgcaagttgctttatctcccacgggctccccaagaacctccaaccccgaggcttatcgctagcggattcacacctgagacagacatttcaacaatgatacagtcctgtcatttatcagcaaaagattgggaattttctcctgtcaacttcttttgtattaggctgtgtattgatagttaattccgttaaaaattacttggaaaacagtgggaagtggtaggactctggaagaggccacacacccgagagctgcgagatctgtgcaagtctggttttggttaggtagtaataaaagtcctcactgtagatctctaaatttcaacccacggaaatgaaagccttttgtctgaaatttacggacttaaatcttcaaggttaaagggaattttctgctcaaataatactcttatcgaaaatgctaaagtcttcaatgttaaaatactgattggtaaaatcttgcagttgggattttgcagttggatatttattttaaaaaaaattataatattcagactattcttaaaatgggacaatcagcctcatgaaaaattgatgtaaatcagaagaataccctagaatgaggccttgtgatgtgagcgttcaatttgaagagcagttcctaacttcatagaaactaaagcagaaagttgttacattttttttatgacaggcttttagtagaattttttagttttattttagttgaattttatttctatgcaatgcagaattaacagacctcttctcctcatggtacacagtattacagtgttgaagtaatggtgatgcttattacaacagctatttaggggaatgttacgttgatctcttaaattgtaaacactacaaaatgtcaaaataatgagaactgacacaactttgccttaaagagtactagactggaccttctcatattacgtttaaggaagacttagagtgttcattgatgtttacgattttaatatttctgaaggccattacagtggcctggatatgtgctgaaagccaaacttttaaattttttggtttttttaagcaaagaaatattttaaataaatcctatttcaacactgaaattgttgaaaaccgtctcataacaaaaggaaaaaacattggaatttttgttttagtggtcagtataggggaatgaaagcgtctgttgttacccacgtaactattttgataagtattagaggttaaccttaaatccagcaaaacattaaaacagaaacttttcaacttggagcctgccattcagcgttgaggtagatgagttccgacactgtcacggctgtgttcccagcagcgaaggcctctgcggagctgccagtcgtcttgaacgtgcatgggcggcgtgtgacatctccagggaggccgtccgaagtcgagaatcgtcagctgtaagtaggagctacacagcgcagagaaaatggaaccacccatccgtgaggcctctttccggagggagccgcacacttggacttgagagtttgccagcagcgagctcggatgcatctctccaaaagccaccaaggtcggcgcgtctgaagagcgttttgcggtcatcagacttcctcatctgaaaacacagaacatactgaccctttcaagtacttagtcattttcctgaaagtgtggtctgtttcagaatgctgtggcaaccaggtaggtgtggcactggccatgtgccacgtctttgccctttgtagtctgtcagatattaaagtttctaaccctgtttttttaatctccaagaatggggaaagtggaatgtagagatggaagcagaacgtgatgtttggatacaacagctatttaatccttttttattttttaagcaaaacactcagttttctaccttattttctaatgttgatttcatggtaatactgacagttggaagtgtttaacataaaaactcattgctaaagagcactgaggaaatgggagctagcgcacttgtaataaaaataaagacaaaatattttcttgaatgcatatatgtgattgggtattttaaaaaccagtatcatctgtcatctccaaaagattacaggagtcagcttgttaatacagtagtgttagtaggttctgtatttttaattcagtacttagaattctaggtcctttattgcccaaagtcagcacagttagtttataccacagactctgtcttggggcacagtagtggggcggggtagtgactttgcctaaacatcacccagctggaacagaggctgagcggggctttaggcacttgccagatgggaactgggttgcaccctccttgctccctgtcattttcttgtcactcttcctgcttcccagtgttttattttatgccttgctcgttgtacatcatgatgactgatggtcttcaaggttgtgaggaaagccgtctccctgcttgactcgactgctgtcccagaggagagtcctgtgcgacctgagcgggggtggctgccatttccagcatgcaggtgacttccaaagaatgagtcaggtggcactgaaagccatgggttctgaagaggcgaatttgttgaaaagtcccaagggtctgaatgaaagcatctttaatcaacactcaacactcgcaatattctagaaaaccatatactgtgctggttgaggccaaaggttaacattgctccactgttcaccaaggaagggggcagtggccatccgccgcggcctcacgtgcgttgtaacaagccctcatcacatgtgtgagtcttacgtgcacaaaaagagaaggctttggtactgaaactggacaccttgtgtactcgataccttcacagcttctattggacatattttctttttaggaatgaaggaaaattctcccatttttgagccattcttttgtcaattctacaaaattgcatgtaactttataaatatttttaaaagatatagttttgtaaatatttaatattccgctaatttgattttgaattgtaaatgtcaagtattctgtttttggggtttttatgttttattatactttgttaaaaaggacaaattgtacatttttagaatgtttttatgagtaaatttaatgtactgaaaataaaaattttaaaaaaggctg

SEQ ID NO: 204330 - DNA, 6242 bp, Homo sapiens
  Payload ID: 20298
  Gene Name: zinc finger, CCHC domain containing 14
  Uniprot ID: Q8WYQ9
  ENST ID: ENST00000568020
  CDS Start-End: 33-2882
gcacgggcgatgagttcctgctgctgttcaccatggcctccaaccacccggccttcagcttccaccagaagcaggtgctgcgccaggagctcacgcagatccagagcagcctgaacggcggcgggggccacggcggcaagggcgcgcccgggccgggcggcgcgctgcccacttgcccagcctgccacaagatcactccaagaactgaggcccctgtcagcagtgtcagtaatagtttggagaatgccctgcacacatcagcacattccacggaggagtcgctgcccaagaggcccttaggaaaacacagcaaagtgagtgttgaaaagatagacctgaagggattatcacacacaaaaaatgacagaaatgttgaatgttcctttgaggtcttgtggtctgattcttcaataacatcagtaaccaaatcttcctctgaagtgacggaatttatttcaaagctatgtcagctctatcctgaagagaacttggagaaactcattccttgcttagctggtccggacgcattttatgtggagcgaaaccacgtggatctggactcaggcctgaggtacctggcctcattaccttctcacgtgttgaaaaatgaccatgtcaggaggtttctcagcacttcctctcccccacagcagcttcagagtccaagtcctggcaatccctccctttctaaagtaggtaccgtgatgggcgtgtctggaaggcctgtgtgtggagtggctggtatcccgtcctcgcagagcggagcccagcaccacgggcagcacccggccggctccgccgcccccttgcctcactgctcccatgcgggcagcgcgggctcagccctggcctaccggacccagatggacacatcacctgccatcctcatgccttccagtctgcagacccctcagacccaggagcagaatgggattctagactggcttaggaaactgcgtttgcacaagtattaccccgtctttaagcagctctccatggagaagtttttgagccttactgaagaagatctgaataaatttgagtctcttaccatgggggcaaagaagaagctcaagacccagctggagctggaaaaggagaagtcagagagacggtgcctgaacccctcggccccgccgctggtcaccagcagtggtgtggctcgagtgccccccaccagccacgtcgggcccgtgcagtcggggcggggcagccatgcagcagagctgcgggtggaagtggagcagccccatcaccagctgccccgggaaggcagttcctcggagtactccagctcctcctccagccccatgggggtacaggcccgggaagagagctccgacagcgctgaggagaatgacagacgtgtggagattcacttggagagctctgacaaggagaagccggtgatgctgctgaatcacttcacttccagttccgccagacccacggcccaggttctccctgtgcagaatgaggccagctccaatccatcaggccaccaccccctgcccccgcagatgctgagcgcagcctcacacatcacacccatccgcatgctgaattccgtgcacaagccggaaagagggagcgcggacatgaagctcctctcgtcttctgtgcactcacttttgtctctagaagaaaggaataaaggatctggaccaagaagcagcatgaaagtggacaagagctttggcagcgccatgatggacgtgctgcccgcgtccgcaccccaccagcctgtgcaggtcctctctgggctttcggagagcagctccatgtcacccacagtctcctttggtccccggaccaaagtcgtgcatgcatccacgctggacagggtgctgaagacagcacagcaaccggccctggtcgtggagaccagcacggccgccacggggacgcccagcacagtcctccacgccgcccgtccgcccatcaaactgctgctgtcgtcatctgttcctgctgattctgccatttctgggcaaacttcctgtcctaataatgtgcaaataagtgtgccccctgcaataataaacccccggactgctctgtacacagccaacaccaaagttgccttttctgcaatgagcagtatgccagtgggccccctgcagggtggcttctgtgcaaacagcaacactgcctctcccagcagccacccctccacgtcctttgccaacatggccacgttgcccagctgcccagcccccagctccagcccggcgctgtcctccgtccctgaaagcagtttctatagcagcagtggcggtggcggctccacaggaaacattcctgcctcgaatccgaaccaccaccaccaccaccaccatcagcagcccccggcacccccgcagcccgccccacccccgccaggctgcattgtgtgcacgtcctgtggctgcagcggcagctgcggctcgagtggcctgactgtcagctacgccaactacttccagcacccgttctccggtccgtccgtgttcaccttccccttcttgcccttcagtcccatgtgcagcagcggctacgtcagcgcccagcagtacggcggcggctccaccttccccgtcgtgcacgccccttacagcagcagcgggaccccagaccctgtcctgagtgggcagtccacgtttgccgtgccacccatgcagaacttcatggcagggacagcaggggtgtaccagacccaaggactggtgggcagtagcaatggttccagtcacaaaaagagcgggaacctatcttgttacaactgcggggccactggtcaccgcgcccaggactgcaaacagccgtccatggacttcaaccggccaggtacttttaggttgaaatacgcccctccagcagaaagtctggactccacagattgatatttttctctggcaacagaacgttattaagccatggagacataaggaaaattaaatacaaaactgagaagtctagttgctgttgagcttaatctttttaatccaaaggtgctttacttttcctagactggatagaaaatctagcgtagaagtgcatcaaactcgatttattgccaaaaccctagattggagcttggtgtcagaactcgcctagtgggcatctctgtggctggtgagatcggccacctccacttttggttgcagtgcagagacgccatgtctcccgaagagcattgccatcactggccctcctaggctcacacgtcaattccagggcagctacacgtggtctgaatcgagaaccgagcttggagttctccaagtggagttccacccgccggactcctgacacccctgggctagggaaaatgtcgactttgttttgttctgttcctaaagtgattagcactaatctctgggatttttaaggattgcactacagaagaatgtaccctgatgtaaatctctgcggttctgggagccaaactcctctgagaacagtcagtgcaagagactccaataatccatattgaaagagtcagcaccagcagaggctactcgacttaggacgcaacagaggttttagtatttccttccctcctccaagcacttgtagcagtttcaggtttttaatttttttctgcaaataaatctaaactacgttattaaatagaaatagtttactcgcaacaacttaatttctaagggtccaagtcccagagaatccatagtcgtcaaagctttgagagtatctttcttcccagccagtcagtggctttgagccctatcttccactacaaatgacctctcgaggggggacggcgacagcgcggctctgtgagtggctgtgaggatgctgcacgtcctcagcagagtttgcaagttgctttatctcccacgggctccccaagaacctccaaccccgaggcttatcgctagcggattcacacctgagacagacatttcaacaatgatacagtcctgtcatttatcagcaaaagattgggaattttctcctgtcaacttcttttgtattaggctgtgtattgatagttaattccgttaaaaattacttggaaaacagtgggaagtggtaggactctggaagaggccacacacccgagagctgcgagatctgtgcaagtctggttttggttaggtagtaataaaagtcctcactgtagatctctaaatttcaacccacggaaatgaaagccttttgtctgaaatttacggacttaaatcttcaaggttaaagggaattttctgctcaaataatactcttatcgaaaatgctaaagtcttcaatgttaaaatactgattggtaaaatcttgcagttgggattttgcagttggatatttattttaaaaaaaattataatattcagactattcttaaaatgggacaatcagcctcatgaaaaattgatgtaaatcagaagaataccctagaatgaggccttgtgatgtgagcgttcaatttgaagagcagttcctaacttcatagaaactaaagcagaaagttgttacattttttttatgacaggcttttagtagaattttttagttttattttagttgaattttatttctatgcaatgcagaattaacagacctcttctcctcatggtacacagtattacagtgttgaagtaatggtgatgcttattacaacagctatttaggggaatgttacgttgatctcttaaattgtaaacactacaaaatgtcaaaataatgagaactgacacaactttgccttaaagagtactagactggaccttctcatattacgtttaaggaagacttagagtgttcattgatgtttacgattttaatatttctgaaggccattacagtggcctggatatgtgctgaaagccaaacttttaaattttttggtttttttaagcaaagaaatattttaaataaatcctatttcaacactgaaattgttgaaaaccgtctcataacaaaaggaaaaaacattggaatttttgttttagtggtcagtataggggaatgaaagcgtctgttgttacccacgtaactattttgataagtattagaggttaaccttaaatccagcaaaacattaaaacagaaacttttcaacttggagcctgccattcagcgttgaggtagatgagttccgacactgtcacggctgtgttcccagcagcgaaggcctctgcggagctgccagtcgtcttgaacgtgcatgggcggcgtgtgacatctccagggaggccgtccgaagtcgagaatcgtcagctgtaagtaggagctacacagcgcagagaaaatggaaccacccatccgtgaggcctctttccggagggagccgcacacttggacttgagagtttgccagcagcgagctcggatgcatctctccaaaagccaccaaggtcggcgcgtctgaagagcgttttgcggtcatcagacttcctcatctgaaaacacagaacatactgaccctttcaagtacttagtcattttcctgaaagtgtggtctgtttcagaatgctgtggcaaccagtgttttattttatgccttgctcgttgtacatcatgatgactgatggtcttcaaggttgtgaggaaagccgtctccctgcttgactcgactgctgtcccagaggagagtcctgtgcgacctgagcgggggtggctgccatttccagcatgcaggtgacttccaaagaatgagtcaggtggcactgaaagccatgggttctgaagaggcgaatttgttgaaaagtcccaagggtctgaatgaaagcatctttaatcaacactcaacactcgcaatattctagaaaaccatatactgtgctggttgaggccaaaggttaacattgctccactgttcaccaaggaagggggcagtggccatccgccgcggcctcacgtgcgttgtaacaagccctcatcacatgtgtgagtcttacgtgcacaaaaagagaaggctttggtactgaaactggacaccttgtgtactcgataccttcacagcttctattggacatattttctttttaggaatgaaggaaaattctcccatttttgagccattcttttgtcaattctacaaaattgcatgtaactttataaatatttttaaaagatatagttttgtaaatatttaatattccgctaatttgattttgaattgtaaatgtcaagtattctgtttttggggtttttatgttttattatactttgttaaaaaggacaaattgtacatttttagaatgtttttatgagtaaatttaatgtactgaaaataaaaatttt

SEQ ID NO: 204331 - DNA, 2548 bp, Homo sapiens
  Payload ID: 20298
  Gene Name: zinc finger, CCHC domain containing 14
  ENST ID: ENST00000561928
  CDS Start-End: 1-2539
ctttgaggtcttgtggtctgattcttcaataacatcagtaaccaaatcttcctctgaagtgacggaatttatttcaaagctatgtcagctctatcctgaagagaacttggagaaactcattccttgcttagctggtccggacgcattttatgtggagcgaaaccacgtggatctggactcaggcctgaggtacctggcctcattaccttctcacgtgttgaaaaatgaccatgtcaggaggtttctcagcacttcctctcccccacagcagcttcagagtccaagtcctggcaatccctccctttctaaagtaggtaccgtgatgggcgtgtctggaaggcctgtgtgtggagtggctggtatcccgtcctcgcagagcggagcccagcaccacgggcagcacccggccggctccgccgcccccttgcctcactgctcccatgcgggcagcgcgggctcagccctggcctaccggacccagatggacacatcacctgccatcctcatgccttccagtctgcagacccctcagacccaggagcagaatgggattctagactggcttaggaaactgcgtttgcacaagtattaccccgtctttaagcagctctccatggagaagtttttgagccttactgaagaagatctgaataaatttgagtctcttaccatgggggcaaagaagaagctcaagacccagctggagctggaaaaggagaagtcagagagacggtgcctgaacccctcggccccgccgctggtcaccagcagtggtgtggctcgagtgccccccaccagccacgtcgggcccgtgcagtcggggcggggcagccatgcagcagagctgcgggtggaagtggagcagccccatcaccagctgccccgggaaggcagttcctcggagtactccagctcctcctccagccccatgggggtacaggcccgggaagagagctccgacagcgctgaggagaatgacagacgtgtggagattcacttggagagctctgacaaggagaagccggtgatgctgctgaatcacttcacttccagttccgccagacccacggcccaggttctccctgtgcagaatgaggccagctccaatccatcaggccaccaccccctgcccccgcagatgctgagcgcagcctcacacatcacacccatccgcatgctgaattccgtgcacaagccggaaagagggagcgcggacatgaagctcctctcgtcttctgtgcactcacttttgtctctagaagaaaggaataaaggatctggaccaagaagcagcatgaaagtggacaagagctttggcagcgccatgatggacgtgctgcccgcgtccgcaccccaccagcctgtgcaggtcctctctgggctttcggagagcagctccatgtcacccacagtctcctttggtccccggaccaaagtcgtgcatgcatccacgctggacagggtgctgaagacagcacagcaaccggccctggtcgtggagaccagcacggccgccacggggacgcccagcacagtcctccacgccgcccgtccgcccatcaaactgctgctgtcgtcatctgttcctgctgattctgccatttctgggcaaacttcctgtcctaataatgtgcaaataagtgtgccccctgcaataataaacccccggactgctctgtacacagccaacaccaaagttgccttttctgcaatgagcagtatgccagtgggccccctgcagggtggcttctgtgcaaacagcaacactgcctctcccagcagccacccctccacgtcctttgccaacatggccacgttgcccagctgcccagcccccagctccagcccggcgctgtcctccgtccctgaaagcagtttctatagcagcagtggcggtggcggctccacaggaaacattcctgcctcgaatccgaaccaccaccaccaccaccaccatcagcagcccccggcacccccgcagcccgccccacccccgccaggctgcattgtgtgcacgtcctgtggctgcagcggcagctgcggctcgagtggcctgactgtcagctacgccaactacttccagcacccgttctccggtccgtccgtgttcaccttccccttcttgcccttcagtcccatgtgcagcagcggctacgtcagcgcccagcagtacggcggcggctccaccttccccgtcgtgcacgccccttacagcagcagcgggaccccagaccctgtcctgagtgggcagtccacgtttgccgtgccacccatgcagaacttcatggcagggacagcaggggtgtaccagacccaaggactggtgggcagtagcaatggttccagtcacaaaaagagcgggaacctatcttgttacaactgcggggccactggtcaccgcgcccaggactgcaaacagccgtccatggacttcaaccggccaggtaagcgcgcgccatggccgcgcccaccaggctcccgcaggaccagtgcacacaaatgcttggtttttatgaagagtaaacttctttctttgtaaagcaaataa

SEQ ID NO: 204332 - DNA, 2613 bp, Homo sapiens
  Payload ID: 20299
  Gene Name: zinc finger, CCHC domain containing 16
  Uniprot ID: Q6ZR62
  ENST ID: ENST00000340433
  CDS Start-End: 230-1162
accattggccttttccatgaagaagaggcaacattgagtggcggacaacactttttggcatctctccaattcagctgttagcatctcctagtgtcttcttcacagctaacagctttggctacttgctcatgacactccgtctctgatcacagagcaaatccactgtctccattggtttccagtactagtactcaattctactcaatcccacctgattccaggagacataatggagaagtgcacgaaatcatcatctaccatgcaggtagagccttcctttcttcaggcagagaatctgattctgcggcttcaaatgcagcatccaaccacggagaacactgctaaaaggggccaagtcatgcctgccctggccaccacagtgatgcctgtaccatactcacttgagcatctcacccagtttcatggtgaccctgccaattgctcagagttcctcactcaggtgactacctacttgacagctctccaaatctctaatcctgcaaatgatgcccagatcaaactcttttttgattacctatctcagcagttagaaagttgtgggatcatatctgggcctgacaagagtaccttactgaagcaatatgagaatcttattcttgagttccagcagtcatttggtaaacccacaaaacaggaaatcaatcctctgatgaatgctaagtttgacaaaggagacaactcctctcagcaggaccctgctactttccacctcctcgctcaaaatctgatctgtaatgaaaccaatcagagtggtcagttcgaaaaggcactagctgatcccaaccaggatgaagagagtgtcactgatatgatggacaatcttccagacctgatcactcagtgcattcagttggacaagaaacatagtgacaggccagagctcctacagtcagagacccagctcccattgttggcttccttgatccaacaccaagccctctttagccccacagatccaccacccaagaaagggcctatacagctgcgagaaggccagctgcctctcaccccagccaaacgagcccgccagcaagaaactcagttgtgcctctactgcagccaatctggtcacttcacaagagattgccttgccaaacgttctcgagctccggcaacgacaaataacacagctcaccagtaagaggagaccaggaaagtcactttttaaacttacatcccagccttactgatttataacctgcattaacttttaaaatacagatggggaactgtgacaccactttataggcagttatgaactgacacgctttgggggaatttaaacaatcagatcttgttcattggcaaattacccctcacgaaacctaacccgagaatgatgaaaacaattcacaggcactttctgcagttgggattaattctccaagagcaccaaaaacctgcaggcaaaactttgcccagtctgagccaatgaaaataaccgtggaagcacattgggaaccttatcctgaccaatgggtgacatctgggttgagtttgtgtcccaaatcctgaatcttgtgtgcctagaaatgagcccaagacttttaccttcacctttattggtctgtatcctagtttcctgttggcttaggacctttggctgaagtccaaatgacattcctataatctgcttatattctcctcctagagtttggaccatgcttcacctattgactacgatctaccttcagcataaatcaaccttcctggaaccacagctctgccacccttccatagagctatatgttttgtttccatctaaagactcatgctttcccaacaaacagaacctcctggctatttacaaaccagattgaatgggcatttgaatactgcttggaactgttggtccctttttctttgcaggctagcccatcaggcaggtgtatgcttttagccaagcccaccaattccaacttattcctctcttctccaacaaccctacttgaggttccagcatgtcttatagccaagtcaatatgctctaggataaggatttctgaaaggtatttagtgagagttggggatggtgtgtcataattactgtatctgtagcatgtccttgctgccttggacaagggacctggccaaataaatctccactgaagactgacagccagaccctgcagtagtttctaactctagaagcctcaatgtagtcaccatctaggattactactcattgctattgagctctacctttatggaccacctctgaagtccttcatctaattgaggatcttaaaaaacaatgaatggcaaaaaacttcctacactatctcatctgaaaaatcctggggcacatacattaaaaccatttgtgcacaaaactcaggaagtcgggattttattgcttatgttttactcttggtacacaccagctttgtgtagattcctgatgcttctgaacaaaagtagtgttatgctagaaaggcaaaactccctaaaatgttaaaactgttcagcaatgatcactgctggtaattaccagccctctgttccctgcttcttgtttctgatgtatgtccccaaaatggatatcctggagaaatatcagtaatcacatattccctagcaaccatcaaggcc

SEQ ID NO: 204333 - DNA, 1605 bp, Homo sapiens
  Payload ID: 20300
  Gene Name: zinc finger, CCHC domain containing 17
  Uniprot ID: Q9NP64
  ENST ID: ENST00000344147
  CDS Start-End: 137-862
cttgtgggtggaaacgcgctggctgactggggtcggcgtttagttcagcgcagcgactcggggacctggagctgacgcctagacacttgtattagctttaatagaagagaaatggaggagccatagaatattaaggatgaattcaggaaggcctgagaccatggaaaacttgcctgctctctacactattttccaaggagaggttgctatggtgacagactatggggcctttatcaaaatcccaggctgtcggaagcaaggtctggtccatcgaactcatatgtcatcctgtcgggtggataagccctctgagatagtagatgttggagataaagtgtgggtgaagcttattggccgagagatgaaaaatgatagaataaaagtatccctctccatgaaggttgtcaatcaagggactgggaaagaccttgatcccaacaatgttatcattgagcaagaagagaggcggaggcgatccttccaggattacactgggcagaagatcacccttgaggctgtcttgaacactacctgcaagaagtgtggctgtaaaggccactttgcaaaagattgtttcatgcaaccaggtgggactaaatactctctgatacctgatgaggaagaggaaaaggaagaggcaaagtcagcagagtttgagaagcctgaccctacaaggaatccttctagaaaaagaaagaaggagaagaagaaaaagaaacatagagataggaagtcatctgactctgacagctcagactctgagagtgatacaggcaagagggcaaggcacacatcaaaagacagcaaggcagcaaagaagaagaaaaagaagaagaagcacaagaagaagcacaaggagtgagagtataaagagtgtagggggtggttgagagtaagaaaccaggagccttgtgccttgagactcctggaaagactcaatagtgagaatatagcctcccaccccattaacttcgctcccatgggagatggcttcccctcatgcaacaggcaggtttgggagttagaggtcaaaagcagctgcctgaatgagttgttgtttccttatcactcctggtccctttgcaagtgaaccctgcagctcacccattcattcacccaacttccttcattcagcaggaggtcctattaccctctccagctgccactgccagagctggattcctgtaaaggagtccaggctagagccacagagactgttgtggaggtgagttcggctgtagttagagtgattggacccttcctattggtctgtcctgggccaactggtgggtgatctctgctgcatccaacatgggagcagagactggcagcaggaggggggaacatggtgagaagtggtgctcacttttcccattcctcctaacatagttctactatgctagaagtggcatccagcggccacagctagaaaacagtctgcagtgtgacttaacttgtgtattgcattccagcagaccactgaaccagacagcgaagccaagatcattgttctactttgtatttactactgtgtgaatcagttgattctacttcaggtccttgcttaaattcctgtcactaaatggaaatgtgtttggttttaaa

SEQ ID NO: 204334 - DNA, 1730 bp, Homo sapiens
  Payload ID: 20300
  Gene Name: zinc finger, CCHC domain containing 17
  Uniprot ID: Q9NP64
  ENST ID: ENST00000373714
  CDS Start-End: 262-987
acgcgctggctgactggggtcggcgtttagttcagcgcagcgactcggggacctggagctgacgcctagtacgtatgaggaagaacggggtgggtggctgcctgagtctggaggcgacgcctcggttgtgcagtctgaacctgcccttctcagctgagggtgctgacagcaaggggtgggaggcgggccccgagtccccagctgtggacacttgtattagctttaatagaagagaaatggaggagccatagaatattaaggatgaattcaggaaggcctgagaccatggaaaacttgcctgctctctacactattttccaaggagaggttgctatggtgacagactatggggcctttatcaaaatcccaggctgtcggaagcaaggtctggtccatcgaactcatatgtcatcctgtcgggtggataagccctctgagatagtagatgttggagataaagtgtgggtgaagcttattggccgagagatgaaaaatgatagaataaaagtatccctctccatgaaggttgtcaatcaagggactgggaaagaccttgatcccaacaatgttatcattgagcaagaagagaggcggaggcgatccttccaggattacactgggcagaagatcacccttgaggctgtcttgaacactacctgcaagaagtgtggctgtaaaggccactttgcaaaagattgtttcatgcaaccaggtgggactaaatactctctgatacctgatgaggaagaggaaaaggaagaggcaaagtcagcagagtttgagaagcctgaccctacaaggaatccttctagaaaaagaaagaaggagaagaagaaaaagaaacatagagataggaagtcatctgactctgacagctcagactctgagagtgatacaggcaagagggcaaggcacacatcaaaagacagcaaggcagcaaagaagaagaaaaagaagaagaagcacaagaagaagcacaaggagtgagagtataaagagtgtagggggtggttgagagtaagaaaccaggagccttgtgccttgagactcctggaaagactcaatagtgagaatatagcctcccaccccattaacttcgctcccatgggagatggcttcccctcatgcaacaggcaggtttgggagttagaggtcaaaagcagctgcctgaatgagttgttgtttccttatcactcctggtccctttgcaagtgaaccctgcagctcacccattcattcacccaacttccttcattcagcaggaggtcctattaccctctccagctgccactgccagagctggattcctgtaaaggagtccaggctagagccacagagactgttgtggaggtgagttcggctgtagttagagtgattggacccttcctattggtctgtcctgggccaactggtgggtgatctctgctgcatccaacatgggagcagagactggcagcaggaggggggaacatggtgagaagtggtgctcacttttcccattcctcctaacatagttctactatgctagaagtggcatccagcggccacagctagaaaacagtctgcagtgtgacttaacttgtgtattgcattccagcagaccactgaaccagacagcgaagccaagatcattgttctactttgtatttactactgtgtgaatcagttgattctacttcaggtccttgcttaaattcctgtcactaaatggaaatgtgtttggttttaaa

SEQ ID NO: 204335 - DNA, 1140 bp, Homo sapiens
  Payload ID: 20300
  Gene Name: zinc finger, CCHC domain containing 17
  ENST ID: ENST00000422613
  CDS Start-End: 193-831
gggtcggcgtttagttcagcgcagcgactcggggacctggagctgacgcctagacacttgtattagctttaatagaagagaaatggaggagccatagaatattaaggatgaattcaggaaggcctgagaccatggaaaacttgcctgctctctacactattttccaaggagaggttgctatggtgacagactatggggcctttatcaaaatcccaggctgtcggaagcaaggtctggtccatcgaactcatgtcatcctgtcgggtggataagccctctgagatagtagatgttggagataaagtgtgggtgaagcttattggccgagagatgaaaaatgatagaataaaagtatccctctccatgaaggttgtcaatcaagggactgggaaagaccttgatcccaacaatgttatcattgagcaagaagagaggcggaggcgatccttccaggattacactgggcagaagatcacccttgaggctgtcttgaacactacctgcaagaagtgtggctgtaaaggccactttgcaaaagattgtttcatgcaaccaggtgggactaaatactctctgatacctgatgaggaagaggaaaaggaagaggcaaagtcagcagagtttgagaagcctgaccctacaaggaatccttctagaaaaagaaagaaggagaagaagaaaaagaaacatagagataggaagtcatctgactctgacagctcagactctgagagtgatacaggcaagagggcaaggcacacatcaaaagacagcaaggcagcaaagaagaagaaaaagaagaagaagcacaagaagaagcacaaggagtgagagtataaagagtgtagggggtggttgagagtaagaaaccaggagccttgtgccttgagactcctggaaagactcaatagtgagaatatagcctcccaccccattaacttcgctcccatgggagatggcttcccctcatgcaacaggcaggtttgggagttagaggtcaaaagcagctgcctgaatgagttgttgtttccttatcactcctggtccctttgcaagtgaaccctgcagctcacccattcattcacccaacttccttcattcagcaggaggtcctattaccctctccagctgccactgcca

SEQ ID NO: 204336 - DNA, 1705 bp, Homo sapiens
  Payload ID: 20300
  Gene Name: zinc finger, CCHC domain containing 17
  Uniprot ID: Q9NP64
  ENST ID: ENST00000546109
  CDS Start-End: 244-945
aggcgcgctgggtcttgtgggtggaaacgcgctggctgactggggtcggcgtttagttcagcgcagcgactcggggacctggagctgacgcctagacacttgtattagctttaatagaagagaaatggaggagccatagaatattaaggatgaattcaggaaggcctgagaccatggaaaacttgcctgctctctacactattttccaaggagagttatggtgaagctgaaacagtgctcaagatgaagcagctaattgaagacactgaaaagaataaagtttatgttgctatggtgacagactatggggcctttatcaaaatcccaggctgtcggaagcaaggtctggtccatcgaactcatatgtcatcctgtcgggtggataagccctctgagatagtagatgttggagataaagtgtgggtgaagcttattggccgagagatgaaaaatgatagaataaaagtatccctctccatgaaggttgtcaatcaagggactgggaaagaccttgatcccaacaatgttatcattgagcaagaagagaggcggaggcgatccttccaggattacactgggcagaagatcacccttgaggctgtcttgaacactacctgcaagaagtgtggctgtaaaggccactttgcaaaagattgtttcatgcaaccaggtgggactaaatactctctgatacctgatgaggaagaggaaaaggaagaggcaaagtcagcagagtttgagaagcctgaccctacaaggaatccttctagaaaaagaaagaaggagaagaagaaaaagaaacatagagataggaagtcatctgactctgacagctcagactctgagagtgatacaggcaagagggcaaggcacacatcaaaagacagcaaggcagcaaagaagaagaaaaagaagaagaagcacaagaagaagcacaaggagtgagagtataaagagtgtagggggtggttgagagtaagaaaccaggagccttgtgccttgagactcctggaaagactcaatagtgagaatatagcctcccaccccattaacttcgctcccatgggagatggcttcccctcatgcaacaggcaggtttgggagttagaggtcaaaagcagctgcctgaatgagttgttgtttccttatcactcctggtccctttgcaagtgaaccctgcagctcacccattcattcacccaacttccttcattcagcaggaggtcctattaccctctccagctgccactgccagagctggattcctgtaaaggagtccaggctagagccacagagactgttgtggaggtgagttcggctgtagttagagtgattggacccttcctattggtctgtcctgggccaactggtgggtgatctctgctgcatccaacatgggagcagagactggcagcaggaggggggaacatggtgagaagtggtgctcacttttcccattcctcctaacatagttctactatgctagaagtggcatccagcggccacagctagaaaacagtctgcagtgtgacttaacttgtgtattgcattccagcagaccactgaaccagacagcgaagccaagatcattgttctactttgtatttactactgtgtgaatcagttgattctacttcaggtccttgcttaaattcctgtcactaaatggaaatgtgtttggttttaaacttactgagttattttt

SEQ ID NO: 204337 - DNA, 1652 bp, Homo sapiens
  Payload ID: 20300
  Gene Name: zinc finger, CCHC domain containing 17
  ENST ID: ENST00000615916
  CDS Start-End: 101-892
aggcgcgctgggtcttgtgggtggaaacgcgctggctgactggggtcggcgtttagttcagcgcagcgactcggggacctggagctgacgcctagtacgtatgaggaagaacggggtgggtggctgcctgagtctggaggcgacgcctcggttgtgcagtctgaacctgcccttctcagctgagggtgctgacagcaaggggtgggaggcgggccccgagtccccagctgtggttgctatggtgacagactatggggcctttatcaaaatcccaggctgtcggaagcaaggtctggtccatcgaactcatatgtcatcctgtcgggtggataagccctctgagatagtagatgttggagataaagtgtgggtgaagcttattggccgagagatgaaaaatgatagaataaaagtatccctctccatgaaggttgtcaatcaagggactgggaaagaccttgatcccaacaatgttatcattgagcaagaagagaggcggaggcgatccttccaggattacactgggcagaagatcacccttgaggctgtcttgaacactacctgcaagaagtgtggctgtaaaggccactttgcaaaagattgtttcatgcaaccaggtgggactaaatactctctgatacctgatgaggaagaggaaaaggaagaggcaaagtcagcagagtttgagaagcctgaccctacaaggaatccttctagaaaaagaaagaaggagaagaagaaaaagaaacatagagataggaagtcatctgactctgacagctcagactctgagagtgatacaggcaagagggcaaggcacacatcaaaagacagcaaggcagcaaagaagaagaaaaagaagaagaagcacaagaagaagcacaaggagtgagagtataaagagtgtagggggtggttgagagtaagaaaccaggagccttgtgccttgagactcctggaaagactcaatagtgagaatatagcctcccaccccattaacttcgctcccatgggagatggcttcccctcatgcaacaggcaggtttgggagttagaggtcaaaagcagctgcctgaatgagttgttgtttccttatcactcctggtccctttgcaagtgaaccctgcagctcacccattcattcacccaacttccttcattcagcaggaggtcctattaccctctccagctgccactgccagagctggattcctgtaaaggagtccaggctagagccacagagactgttgtggaggtgagttcggctgtagttagagtgattggacccttcctattggtctgtcctgggccaactggtgggtgatctctgctgcatccaacatgggagcagagactggcagcaggaggggggaacatggtgagaagtggtgctcacttttcccattcctcctaacatagttctactatgctagaagtggcatccagcggccacagctagaaaacagtctgcagtgtgacttaacttgtgtattgcattccagcagaccactgaaccagacagcgaagccaagatcattgttctactttgtatttactactgtgtgaatcagttgattctacttcaggtccttgcttaaattcctgtcactaaatggaaatgtgtttggttttaaacttactgagttattttt

SEQ ID NO: 204338 - DNA, 1489 bp, Homo sapiens
  Payload ID: 20300
  Gene Name: zinc finger, CCHC domain containing 17
  ENST ID: ENST00000618216
  CDS Start-End: 150-590
aggcgcgctgggtcttgtgggtggaaacgcgctggctgactggggtcggcgtttagttcagcgcagcgactcggggacctggagctgacgcctagacacttgtattagctttaatagaagagaaatggaggagccatagaatattaaggatgaattcaggaaggcctgagaccatggaaaacttgcctgctctctacactattttccaaggagaggttgctatggtgacagactatggggcctttatcaaaatcccaggctgtcggaagcaaggtctggtccatcgaactcatatgtcatcctgtcgggtggataagccctctgagatagtagatgttggagataaagtgtgggtgaagcttattggccgagagatgaaaaatgatagaataaaagtatccctctccatgaaggttgtcaatcaagggactgggaaagaccttgatcccaacaatgttatcattgagcaagaagagaggcggaggcgatccttccaggattacactgggcagaagatcacccttgaggctgtcttgaacactacctgcaagaagtgtggctgtaaaggagaagaagaaaaagaaacatagagataggaagtcatctgactctgacagctcagactctgagagtgatacaggcaagagggcaaggcacacatcaaaagacagcaaggcagcaaagaagaagaaaaagaagaagaagcacaagaagaagcacaaggagtgagagtataaagagtgtagggggtggttgagagtaagaaaccaggagccttgtgccttgagactcctggaaagactcaatagtgagaatatagcctcccaccccattaacttcgctcccatgggagatggcttcccctcatgcaacaggcaggtttgggagttagaggtcaaaagcagctgcctgaatgagttgttgtttccttatcactcctggtccctttgcaagtgaaccctgcagctcacccattcattcacccaacttccttcattcagcaggaggtcctattaccctctccagctgccactgccagagctggattcctgtaaaggagtccaggctagagccacagagactgttgtggaggtgagttcggctgtagttagagtgattggacccttcctattggtctgtcctgggccaactggtgggtgatctctgctgcatccaacatgggagcagagactggcagcaggaggggggaacatggtgagaagtggtgctcacttttcccattcctcctaacatagttctactatgctagaagtggcatccagcggccacagctagaaaacagtctgcagtgtgacttaacttgtgtattgcattccagcagaccactgaaccagacagcgaagccaagatcattgttctactttgtatttactactgtgtgaatcagttgattctacttcaggtccttgcttaaattcctgtcactaaatggaaatgtgtttggttttaaacttactgagttattttt

SEQ ID NO: 204339 - DNA, 1458 bp, Homo sapiens
  Payload ID: 20300
  Gene Name: zinc finger, CCHC domain containing 17
  ENST ID: ENST00000616859
  CDS Start-End: 244-726
aggcgcgctgggtcttgtgggtggaaacgcgctggctgactggggtcggcgtttagttcagcgcagcgactcggggacctggagctgacgcctagacacttgtattagctttaatagaagagaaatggaggagccatagaatattaaggatgaattcaggaaggcctgagaccatggaaaacttgcctgctctctacactattttccaaggagagttatggtgaagctgaaacagtgctcaagatgaagcagctaattgaagacactgaaaagaataaagtttatgttgctatggtgacagactatggggcctttatcaaaatcccaggctgtcggaagcaaggtctggtccatcgaactcatatgtcatcctgtcgggtggataagccctctgagatagtagatgttggagataaagtgtgggtgaagcttattggccgagagatgaaaaatgatagaataaaagtatccctctccatgaaggttgtcaatcaagggactgggaaagaccttgatcccaacaatgttatcattgagagaagaagaaaaagaaacatagagataggaagtcatctgactctgacagctcagactctgagagtgatacaggcaagagggcaaggcacacatcaaaagacagcaaggcagcaaagaagaagaaaaagaagaagaagcacaagaagaagcacaaggagtgagagtataaagagtgtagggggtggttgagagtaagaaaccaggagccttgtgccttgagactcctggaaagactcaatagtgagaatatagcctcccaccccattaacttcgctcccatgggagatggcttcccctcatgcaacaggcaggtttgggagttagaggtcaaaagcagctgcctgaatgagttgttgtttccttatcactcctggtccctttgcaagtgaaccctgcagctcacccattcattcacccaacttccttcattcagcaggaggtcctattaccctctccagctgccactgccagagctggattcctgtaaaggagtccaggctagagccacagagactgttgtggaggtgagttcggctgtagttagagtgattggacccttcctattggtctgtcctgggccaactggtgggtgatctctgctgcatccaacatgggagcagagactggcagcaggaggggggaacatggtgagaagtggtgctcacttttcccattcctcctaacatagttctactatgctagaagtggcatccagcggccacagctagaaaacagtctgcagtgtgacttaacttgtgtattgcattccagcagaccactgaaccagacagcgaagccaagatcattgttctactttgtatttactactgtgtgaatcagttgattctacttcaggtccttgcttaaattcctgtcactaaatggaaatgtgtttggttttaaacttactgagttattttt

SEQ ID NO: 204340 - DNA, 1534 bp, Homo sapiens
  Payload ID: 20300
  Gene Name: zinc finger, CCHC domain containing 17
  ENST ID: ENST00000616393
  CDS Start-End: 235-774
aggcgcgctgggtcttgtgggtggaaacgcgctggctgactggggtcggcgtttagttcagcgcagcgactcggggacctggagctgacgcctagacacttgtattagctttaatagaagagaaatggaggagccatagaatattaaggatgaattcaggaaggcctgagaccatggaaaacttgcctgctctctacactattttccaaggagaggttgctatggtgacagactatggggcctttatcaaaatcccaggctgtcggaagcaagatgaaaaatgatagaataaaagtatccctctccatgaaggttgtcaatcaagggactgggaaagaccttgatcccaacaatgttatcattgagcaagaagagaggcggaggcgatccttccaggattacactgggcagaagatcacccttgaggctgtcttgaacactacctgcaagaagtgtggctgtaaaggccactttgcaaaagattgtttcatgcaaccaggtgggactaaatactctctgatacctgatgaggaagaggaaaaggaagaggcaaagtcagcagagtttgagaagcctgaccctacaaggaatccttctagaaaaagaaagaaggagaagaagaaaaagaaacatagagataggaagtcatctgactctgacagctcagactctgagagtgatacaggcaagagggcaaggcacacatcaaaagacagcaaggcagcaaagaagaagaaaaagaagaagaagcacaagaagaagcacaaggagtgagagtataaagagtgtagggggtggttgagagtaagaaaccaggagccttgtgccttgagactcctggaaagactcaatagtgagaatatagcctcccaccccattaacttcgctcccatgggagatggcttcccctcatgcaacaggcaggtttgggagttagaggtcaaaagcagctgcctgaatgagttgttgtttccttatcactcctggtccctttgcaagtgaaccctgcagctcacccattcattcacccaacttccttcattcagcaggaggtcctattaccctctccagctgccactgccagagctggattcctgtaaaggagtccaggctagagccacagagactgttgtggaggtgagttcggctgtagttagagtgattggacccttcctattggtctgtcctgggccaactggtgggtgatctctgctgcatccaacatgggagcagagactggcagcaggaggggggaacatggtgagaagtggtgctcacttttcccattcctcctaacatagttctactatgctagaagtggcatccagcggccacagctagaaaacagtctgcagtgtgacttaacttgtgtattgcattccagcagaccactgaaccagacagcgaagccaagatcattgttctactttgtatttactactgtgtgaatcagttgattctacttcaggtccttgcttaaattcctgtcactaaatggaaatgtgtttggttttaaacttactgagttattttt

SEQ ID NO: 204341 - DNA, 1158 bp, Homo sapiens
  Payload ID: 20300
  Gene Name: zinc finger, CCHC domain containing 17
  ENST ID: ENST00000627541
  CDS Start-End: 68-799
agttcagcgcagcgactcggggacctggagctgacgcctagtacgtatgaggaagaacggggttgctatggtgacagactatggggcctttatcaaaatcccaggctgtcggaagcaaggtctggtccatcgaactcatatgtcatcctgtcgggtggataagccctctgagatagtagatgttggagataaagtgtgggtgaagcttattggccgagagatgaaaaatgatagaataaaagtatccctctccatgaaggttgtcaatcaagggactgggaaagaccttgatcccaacaatgttatcattgagcaagaagagaggcggaggcgatccttccaggattacactgggcagaagatcacccttgaggctgtcttgaacactacctgcaagaagtgtggctgtaaaggtagggtgaagcctctgccctttccacgtttctctccttgtggatggacccttttctggaagaaggaggcagcccagtgccactttgcaaaagattgtttcatgcaaccaggtgggactaaatactctctgatacctgatgaggaagaggaaaaggaagaggcaaagtcagcagagtttgagaagcctgaccctacaaggaatccttctagaaaaagaaagaaggagaagaagaaaaagaaacatagagataggaagtcatctgactctgacagctcagactctgagagtgatacaggcaagagggcaaggcacacatcaaaagacagcaaggcagcaaagaagaagaaaaagaagaagaagcacaagaagaagcacaaggagtgagagtataaagagtgtagggggtggttgagagtaagaaaccaggagccttgtgccttgagactcctggaaagactcaatagtgagaatatagcctcccaccccattaacttcgctcccatgggagatggcttcccctcatgcaacaggcaggtttgggagttagaggtcaaaagcagctgcctgaatgagttgttgtttccttatcactcctggtccctttgcaagtgaaccctgcagctcacccattcattcacccaacttccttcattcagcaggaggtcctattaccctctccagctgccactgccagagctggattcctgtaaaggagtccaggctagagccacagagactgttgt

SEQ ID NO: 204342 - DNA, 2907 bp, Homo sapiens
  Payload ID: 20301
  Gene Name: zinc finger, CCHC domain containing 18
  Uniprot ID: P0CG32
  ENST ID: ENST00000537356
  CDS Start-End: 1415-2626
ccggcccgtcacgctcttttgtctcagtcgccagagactgaaagcaaccgcggctgcccggagggccgaactggagggtgggcgcagccttggctgccttgggaaccgtgctgcctcgactcggctacccctcgctgggcggtcgtgcgcactcgctaggtcgggcagccccgggtcgcttagcggccgaggaggcggcagagatcccgttcccctgcagagctacggggaccggaaggcgaaacagagctgtggacgcgggagcacatgctgcccaccagtggagcacaagtaaagaaagaacgcgcgattgcccggcgcggagaggggtgggggaagccccgccaggactgggcggcgcccggcttggagaatcagtaactgcgaggcaggggatggagcactcccttggcctggttgcgctgaggaaggagttgtggttcatctggatgctgccgactggataggatttaggatttgcctggattaaggtgggtgggggtgttgtcgtaggtcgggggtgttgttgggtgtcgggggcggggtgtgttcggggaggtggcaaggggcgggaggagacgatcgcaagctgtcttgaaccccttttgcatctcctcatctcttcctgggaaggaatatgagggtgggaggttatccaacttctagtctctttctccctggcaggtcatcaaagccgaatccgaacttgaattctgtgcggcggattgcagagctgtcttgaggccctgaggactgggatctgcgacacccagtggacaaaagtcggccgtaccccagaggctaattttctcacggcaggcacctgttgcagaggctgcacgtaaaataaaggcgaacgctagtttccgagctcatgtaagaatctgagaaataacgggggaaacgttgacaagggggtgtgattgagacctgaggccatgaggttaatggtttcttattatcataaatctgtgacacacaaccattgagttccgttttgagggcccagtatcagctcccaacactatgtcatctagaattagaagcaacagttgtcgcccctcctggagtacaggcaggaggggatggatgtggctctgaaaaactacctactagcccagggacacctgctagctctggaatgttgtaattgccagtctcctgcagggtattgttaaggcactgggcagatataaaatgcactgcaaggctattcaggaagatagagaatgctactgcagactgcttccccacagcccactatcttattaaccttttttactttccttagaatccctactgaaatataaggcaggcacagcccaggaacgttgctttggagaatcctgcagataaggcttttccaaaaagcgcgagcatcttgttgtattcagataccctatcgtcgtcagtcatggctagcatcactgcgtgtgtgggtaacagcaggcagcagaatgcacctttgccgccttgggcccattccatgttgaggtctctggggaggagtctctgtcctttagtggtcaaaatggcagagagaaacatgaagttgttctcaggaagagtggtgccagcccaggggaaagaaacctttgaaaactggctgatccaagtcaatgaggtcctgccagattggagtatgtctgaggaggaaaaactcaagcgcttgatgaaaacacttaggggccctgcccgggaggtcatgcgtttgcttcaggcggccaaccccaacctaagtgtagcagatttcttgcgggcaatgaaattggtgtttggggagtctgaaagcagtgtgactgcccatggtaaattttttaacaccctgcaggcacaaggggagaaagcctccctttatgtgatccgtttagaggtgcagctccagaatgctattcaggcaggcatcctagctgagaaagatgcaaaccagactcgcttgcaacagcttcttttaggcgctgagctgaatagggacctgcgcttcaggcttaagcatcttctcaggatgtatgcaaataagcaggagcggcttcccaatttcctggagttaatcaagatgataagggaggaagaggattgggatgatgcttttattaaacggaagcggccgaaaaggtctgagccaataatggagagggcagccagccctgtggcatttcagggcgcccagccaatagcaatcagcagtgctgactgtaactgcaacgtgatagaaatagatgatacccttgatgactctgatgaggatgtgatcctggtggtgtctctgtacccttcactgacacctacaggtgcccctcccttcagaggaagagccagacctctggatcaagtgctggttattgattcccccaacaattctggggctcagtctctttctaccagtggtggttctgggtataagaatgatggtcctgggaatattcgtagagccaggaagcgaaaatacacaacccgctgctcatattgtggggaggagggccactcaaaagaaacctgtgacaatgagagcaacaaggcccaggtttttgagaatctgatcatcaccctgcaggagctgacacatacagaggagaggtcaaaagaggtccctggagaacacagtgatgcttctgagccacagtaaggatctagtccagccctaaatgagtccttgactgtattcagagtctggtaatgggaataacaggagaggggggtgggtttctaactgcatgaattaatccacaaagcagttttcctttgggaaggagaagaggtcttgcataccagcacagtggatggggaatggtgtgacctctgtccctgctctcttctctgctggcttaagggtctattctccatgtgtctatttctttgatgactttatactttttatgaaaggagcatcttttcattaaaccttca

SEQ ID NO: 204343 - DNA, 2941 bp, Homo sapiens
  Payload ID: 20301
  Gene Name: zinc finger, CCHC domain containing 18
  Uniprot ID: P0CG32
  ENST ID: ENST00000611638
  CDS Start-End: 1207-2418
cttttgtctcagtcgccagagactgaaagcaaccgcggctgcccggagggccgaactggagggtgggcgcagccttggctgccttgggaaccgtgctgcctcgactcggctacccctcgctgggcggtcgtgcgcactcgctaggtcgggcagccccgggtcgcttagcggccgaggaggcggcagagatcccgttcccctgcagagctacggggaccggaaggcgaaacagagctgtggacgcgggagcacatgctgcccaccagtggagcacaagtaaagaaagaacgcgcgattgcccggcgcggagaggggtgggggaagccccgccaggactgggcggcgcccggcttggagaatcagtaactgcgaggcaggggatggagcactcccttggcctggttgcgctgaggaaggagttgtggttcatctggatgctgccgactggataggatttaggatttgcctggattaaggtcatcaaagccgaatccgaacttgaattctgtgcggcggattgcagagctgtcttgaggccctgaggactgggatctgcgacacccagtggacaaaagtcggccgtaccccagaggctaattttctcacggcaggcacctgttgcagaggctgcacgtaaaataaaggcgaacgctagtttccgagctcatgtaagaatctgagaaataacgggggaaacgttgacaagggggtgtgattgagacctgaggccatgaggttaatggtttcttattatcataaatctgtgacacacaaccattgagttccgttttgagggcccagtatcagctcccaacactatgtcatctagaattagaagcaacagttgtcgcccctcctggagtacaggcaggaggggatggatgtggctctgaaaaactacctactagcccagggacacctgctagctctggaatgttgtaattgccagtctcctgcagggtattgttaaggcactgggcagatataaaatgcactgcaaggctattcaggaagatagagaatgctactgcagactgcttccccacagcccactatcttattaaccttttttactttccttagaatccctactgaaatataaggcaggcacagcccaggaacgttgctttggagaatcctgcagataaggcttttccaaaaagcgcgagcatcttgttgtattcagataccctatcgtcgtcagtcatggctagcatcactgcgtgtgtgggtaacagcaggcagcagaatgcacctttgccgccttgggcccattccatgttgaggtctctggggaggagtctctgtcctttagtggtcaaaatggcagagagaaacatgaagttgttctcaggaagagtggtgccagcccaggggaaagaaacctttgaaaactggctgatccaagtcaatgaggtcctgccagattggagtatgtctgaggaggaaaaactcaagcgcttgatgaaaacacttaggggccctgcccgggaggtcatgcgtttgcttcaggcggccaaccccaacctaagtgtagcagatttcttgcgggcaatgaaattggtgtttggggagtctgaaagcagtgtgactgcccatggtaaattttttaacaccctgcaggcacaaggggagaaagcctccctttatgtgatccgtttagaggtgcagctccagaatgctattcaggcaggcatcctagctgagaaagatgcaaaccagactcgcttgcaacagcttcttttaggcgctgagctgaatagggacctgcgcttcaggcttaagcatcttctcaggatgtatgcaaataagcaggagcggcttcccaatttcctggagttaatcaagatgataagggaggaagaggattgggatgatgcttttattaaacggaagcggccgaaaaggtctgagccaataatggagagggcagccagccctgtggcatttcagggcgcccagccaatagcaatcagcagtgctgactgtaactgcaacgtgatagaaatagatgatacccttgatgactctgatgaggatgtgatcctggtggtgtctctgtacccttcactgacacctacaggtgcccctcccttcagaggaagagccagacctctggatcaagtgctggttattgattcccccaacaattctggggctcagtctctttctaccagtggtggttctgggtataagaatgatggtcctgggaatattcgtagagccaggaagcgaaaatacacaacccgctgctcatattgtggggaggagggccactcaaaagaaacctgtgacaatgagagcaacaaggcccaggtttttgagaatctgatcatcaccctgcaggagctgacacatacagaggagaggtcaaaagaggtccctggagaacacagtgatgcttctgagccacagtaaggatctagtccagccctaaatgagtccttgactgtattcagagtctggtaatgggaataacaggagaggggggtgggtttctaactgcatgaattaatccacaaagcagttttcctttgggaaggagaagaggtcttgcataccagcacagtggatggggaatggtgtgacctctgtccctgctctcttctctgctggcttaagggtctattctccatgtgtctatttctttgatgactttatactttttatgaaaggagcatcttttcattaaaccttcaaaaataaaggaagatacaaaaactaaagtacaaattacctgaaactcagcacccttttgtaaccattgtcagccctttggtgaatgtccttccagatatctccctgtacctgtgtacccagatagatatatgtatagataagagtgaccaaatataagtgctgttctatactgtgtatttttcaccaaataatgtatctcgtggacttctatgtcgatgaatatatataaatatctaacttc

SEQ ID NO: 204344 - DNA, 5959 bp, Homo sapiens
  Payload ID: 20302
  Gene Name: zinc finger, CCHC domain containing 2
  Uniprot ID: Q9C0B9
  ENST ID: ENST00000269499
  CDS Start-End: 419-3955
gcccggcccggctgctccacctcctcacccagccgctccgtcctcaccggctcgcgagggaacagctcaggcaccgccgccccggctcagcgcggacggcggagagagggaggcggaaggaggacaccctcgctcgcttgctcccacccgcacccgggctcccagaaccggcgaggagcccagggggaggagccgtcgcgggcacgccccgcccccagcccgggaagacgacgccagcgaccccgccggccggccaccgcccccctcgccggccgagacccgcccccggccccggccctcccccggcggcatggaggggccccgctcctgacggccgcgccgccgcctcggcccgtgctccacctcgcggcccctcccgcccgcccccgctcgcatgtctgcgccgccctagccgaggatgctgaggatgaagctgccgctgaagccaacgcaccccgcggagccgccgcccgaggcggaggagcccgaggcggacgcgcggccgggcgcgaaggcgccttcgcgccgccgccgcgactgccgccccccgccgccgccgccgccgcccgcgggcccgtcgcggggccctctgccgccgccgccgccgccccggggactcgggccgcctgttgctggtggagcggcggcgggggcgggtatgccgggcggcggcggggggccctcggcggcgctgcgcgagcaggagcgggtatacgagtggttcgggctggtgctgggctcggcgcagcgcctggagttcatgtgcgggctgctggacctgtgcaacccgctggagctgcgcttccttggctcgtgcctggaggacctggcgcgcaaggactaccactacctgcgcgactcggaggccaaggccaacggcctctcggacccggggccgctggccgacttccgagagcccgcggtgcgctcgcgcctcatcgtctacctggcgctgctgggctcggagaaccgggaggccgctggccgtctgcaccgcctgctaccccaggtggactcggtgctcaaaagcctgcgcgcggcccggggcgagggctcgcggggcggcgcggaggacgagcgcggcgaggacggcgacggcgagcaggacgccgagaaggacggctcaggcccggaaggcggcattgtggagccccgggtcggcggcgggcttggctccagggcccaggaggaactgctgctgctcttcaccatggcctcgctgcacccggctttctccttccaccagcgggtcaccctgagggaacacttggagaggctccgcgccgcgctccgcgggggccccgaggacgcggaggtggaggtagagccgtgcaagtttgccggccccagggcccagaacaactctgctcatggtgattacatgcaaaataacgagagcagcttaatagagcaagctccaatacctcaggacggacttaccgtggcacctcacagagctcagcgagaagctgtacacattgagaagataatgttgaaaggagtccagagaaaaagagctgacaaatactgggagtacactttcaaagtaaattggtctgatctttcagtcacaacagtaacaaaaacccaccaagaactacaggaatttctactgaagcttccaaaggaactgtcttcagagacttttgacaagaccatcttaagagccctgaatcagggttccttgaaaagggaggaacggcgacatcctgacctagagcccatcctaaggcagctattttcaagttcatcacaagcttttctacaaagtcagaaagtacacagcttctttcagtccatatcatcagactccctacacagtatcaataacttacaatcctctctgaagacttctaagatattagaacacttaaaagaagacagctctgaagcttcaagtcaagaagaagatgtgttgcagcatgccataatccacaagaagcatactgggaaaagtcccattgtgaacaatattggtacaagttgttctccattggatgggcttaccatgcaatattctgaacagaatggaattgtggattggaggaagcaaagctgtaccaccattcaacacccagagcactgtgtgacctcggctgaccagcattctgctgaaaaacggagtttatcttcaataaataagaagaaaggaaagccacaaacagaaaaggagaaaattaagaaaactgacaacagattgaatagtagaataaatggtattagactctccactcctcagcatgcccatggtggtactgtgaaagatgtgaatttggacattggctctggacatgacacatgtggagaaacatcttcagagagttacagttctccatctagtccccgacatgatggaagagaaagttttgaaagtgaagaagagaaagacagagacacagacagcaattctgaggattctgggaatccatcaacaactaggtttacaggttacggttctgtcaaccagactgtcactgtcaagccacctgttcaaattgcttcactaggaaatgagaatggaaaccttttagaagatcccttaaactcacccaagtatcagcatatttcttttatgccaacgttacactgtgtcatgcacaatggtgcccagaagtctgaagttgtcgttcctgcacccaaacccgctgatggcaaaaccatagggatgcttgttcctagtcctgttgctatttctgcaataagggagtctgcaaattcaacccctgttggaatactagggccaacagcttgcactggagaatcggaaaagcaccttgagttactggcttcccctttacctattccatcaaccttccttccacacagtagtactcccgctttgcatcttacagttcagaggctaaagttgccaccaccacagggatcttctgagagctgcacagttaacatcccacaacaaccacccggaagcctgagcatcgcatcaccaaacactgcctttattcctatccataacccaggtagtttcccaggctctcctgttgctaccacggaccccatcacaaaatctgcatcccaagtggtaggactcaatcaaatggtgcctcaaattgagggaaacacagggacagtccctcagcctaccaatgtgaaggtagttcttccagcagctggcctctcagctgctcagccaccagcttcctaccccttaccaggctctccccttgctgccggcgtgttacccagccagaactccagtgtgctcagcacagcagcaacttctccccagccagcgagcgcaggtatcagccaggcccaggcaactgttcctcctgcagttcctacccacaccccaggccctgccccgagcccaagccctgccttgacacacagtaccgcgcagagtgacagcacctcttacatcagtgctgtggggaacacgaacgctaatgggacagtagtgccaccgcagcagatgggctcaggtccttgtggttcttgtgggcgaaggtgcagctgtgggaccaatggaaaccttcagctaaatagttactattatcctaatccaatgcctggaccaatgtaccgagtcccttcattctttactctgccatccatttgcaatggcagctacctcaaccaagcacatcagagcaatggaaaccaacttcctttttttctgcctcagactccatatgcaaatggactggtacatgacccagtcatggggagccaagccaactatggcatgcagcagatggcaggatttgggagattctatcctgtatatccagcacctaacgtagttgccaacaccagtggttcggggcccaagaagaatgggaatgtctcatgttacaattgtggtgtaagcggacactatgcacaggactgtaagcagtcgtccatggaggccaatcaacaaggcacttacagactgagatacgcacctcccctccccccttctaatgatacgttggattctgcagactgaaacgagtaaagcttgcctacttaatacactcaagtgtggggagtcatggggtgtggaggggaggaaaggaaaggtattttgtttctttgtctatacatttcctagatttctatgcagttgggatttttcatttctcttgtaccaatgtccaaaacaagaaagaatgcaatgcttttgagcctctggtctcctggttcaacaacaggcttatatgtatgatacatgtaatttaaaccttcagacaaacttaaatgttggtgcgtgcttttttttttttttttacactgaatacttgctgtgtgcaatgtttactgaatctttaaaactgtgtatttgaccttttttttacaacactggtgacagtcatatggttttgaaaaaaaaaagaaattttgcttcttcccagcttttctcactttcaccctaaacgacacttcctccccagccagcctcactctgtctccggcccgcagcaggagcagccagcagtgcattcaccccacttttgtaaactgctctgcatataaaccaagggcagaatgtttcaccctgatcttatgggaggaatcaaactcccaaaatagtgtgtatatatgtaataaacagcgtcacgtaaatacatatatgcagtgcttgttgtccaaatagaaatgaaaataagtggaagagagaggaagaagtcaaaccatatgaaactgaaaaaatatgacgtacgaaatggacaaaaagctttttctgaaaccaactttttacttccatcatccttttttagcctgttgcttcagagagacacaaagtgaacacactggtgtgaatgtcgctctctgtgtgcttgtgtttgtaatgaaagtctacagccaattttacttgtctaccaccgtgttgtgctcaaagagacactacttgagtgaagatttcttctttccctgtaccagctgttacagtgttacgttgtgtttaaaatgtgtatggtttattgcaatctgaacagagctatgggtttctaccataagtcaggttgtttgttccctaacctgtctctcatagcaaagtcacttttataacagtttaccactatgcttgattataatgtgaaaggcggaattctgagtgtgttaagatggtattaatcatgtcggtgtcatgtcactaagtttaatgctgctgtttttaaaaaaaaaaaaaagtttttttaaaaagccaatctatgtactaaattgcttccaggtaatttttgatttcctaaagtgcactgaggttatctggaagattgggtgtattttttggtgactgctgcattcatcagcaatgaacagtttccactgtatagtcctaggggtcagggggtgggggtttcattttccattcctcagcacagagcagaaatgatagatttttattgtttggagtaacgttggtatgcagcagaggaacgtaaacatttggtcttggttcagaagcctaacagattgctagacaagagaaaaaacttgaagaaaaaagaagcttaatttcatgcttcataagtagcatttatatttatagcaccaatgtacattttgaaactttctttcaggggtgggagttatggggaaggggtgggtgtgaaggggtagatgaaagctttaatttagaaagaaagttcaagtaaaggaaattattttgattaaatatattttatttgatctgggtatttttggaccacattattaaattaattgttaagctgcagttgagttgttcaagtgagagttttgataagccacttatgggccgcgttgtgaatcacttgccagttgtactttatggagcttattttatgatttaaaatactgtactgtacataggaggtatgttaccttctccttatttgtatgtttaccatatactttgatatttgaaatgttatgtactggaaaggccacttatatttctagaacagattggattttatgcaaccttttttccttgaattaacagcaataaaaaaatgaaaaacagctt

SEQ ID NO: 204345 - DNA, 4765 bp, Homo sapiens
  Payload ID: 20302
  Gene Name: zinc finger, CCHC domain containing 2
  Uniprot ID: Q9C0B9
  ENST ID: ENST00000586834
  CDS Start-End: 192-2765
gcttgcggctctcacactgtgcctttgtgcccatagtgtgcagtcacctattggacctctaaaaattgccactaaaatggttgttagtaaaatgagaagacctaaatctgtgattattactcttagtccatggtttaagttaacgtatctccctctttctcatctagaacaactctgctcatggtgattacatgcaaaataacgagagcagcttaatagagcaagctccaatacctcaggacggacttaccgtggcacctcacagagctcagcgagaagctgtacacattgagaagataatgttgaaaggagtccagagaaaaagagctgacaaatactgggagtacactttcaaagtaaattggtctgatctttcagtcacaacagtaacaaaaacccaccaagaactacaggaatttctactgaagcttccaaaggaactgtcttcagagacttttgacaagaccatcttaagagccctgaatcagggttccttgaaaagggaggaacggcgacatcctgacctagagcccatcctaaggcagctattttcaagttcatcacaagcttttctacaaagtcagaaagtacacagcttctttcagtccatatcatcagactccctacacagtatcaataacttacaatcctctctgaagacttctaagatattagaacacttaaaagaagacagctctgaagcttcaagtcaagaagaagatgtgttgcagcatgccataatccacaagaagcatactgggaaaagtcccattgtgaacaatattggtacaagttgttctccattggatgggcttaccatgcaatattctgaacagaatggaattgtggattggaggaagcaaagctgtaccaccattcaacacccagagcactgtgtgacctcggctgaccagcattctgctgaaaaacggagtttatcttcaataaataagaagaaaggaaagccacaaacagaaaaggagaaaattaagaaaactgacaacagattgaatagtagaataaatggtattagactctccactcctcagcatgcccatggtggtactgtgaaagatgtgaatttggacattggctctggacatgacacatgtggagaaacatcttcagagagttacagttctccatctagtccccgacatgatggaagagaaagttttgaaagtgaagaagagaaagacagagacacagacagcaattctgaggattctgggaatccatcaacaactaggtttacaggttacggttctgtcaaccagactgtcactgtcaagccacctgttcaaattgcttcactaggaaatgagaatggaaaccttttagaagatcccttaaactcacccaagtatcagcatatttcttttatgccaacgttacactgtgtcatgcacaatggtgcccagaagtctgaagttgtcgttcctgcacccaaacccgctgatggcaaaaccatagggatgcttgttcctagtcctgttgctatttctgcaataagggagtctgcaaattcaacccctgttggaatactagggccaacagcttgcactggagaatcggaaaagcaccttgagttactggcttcccctttacctattccatcaaccttccttccacacagtagtactcccgctttgcatcttacagttcagaggctaaagttgccaccaccacagggatcttctgagagctgcacagttaacatcccacaacaaccacccggaagcctgagcatcgcatcaccaaacactgcctttattcctatccataacccaggtagtttcccaggctctcctgttgctaccacggaccccatcacaaaatctgcatcccaagtggtaggactcaatcaaatggtgcctcaaattgagggaaacacagggacagtccctcagcctaccaatgtgaaggtagttcttccagcagctggcctctcagctgctcagccaccagcttcctaccccttaccaggctctccccttgctgccggcgtgttacccagccagaactccagtgtgctcagcacagcagcaacttctccccagccagcgagcgcaggtatcagccaggcccaggcaactgttcctcctgcagttcctacccacaccccaggccctgccccgagcccaagccctgccttgacacacagtaccgcgcagagtgacagcacctcttacatcagtgctgtggggaacacgaacgctaatgggacagtagtgccaccgcagcagatgggctcaggtccttgtggttcttgtgggcgaaggtgcagctgtgggaccaatggaaaccttcagctaaatagttactattatcctaatccaatgcctggaccaatgtaccgagtcccttcattctttactctgccatccatttgcaatggcagctacctcaaccaagcacatcagagcaatggaaaccaacttcctttttttctgcctcagactccatatgcaaatggactggtacatgacccagtcatggggagccaagccaactatggcatgcagcagatggcaggatttgggagattctatcctgtatatccagcacctaacgtagttgccaacaccagtggttcggggcccaagaagaatgggaatgtctcatgttacaattgtggtgtaagcggacactatgcacaggactgtaagcagtcgtccatggaggccaatcaacaaggcacttacagactgagatacgcacctcccctccccccttctaatgatacgttggattctgcagactgaaacgagtaaagcttgcctacttaatacactcaagtgtggggagtcatggggtgtggaggggaggaaaggaaaggtattttgtttctttgtctatacatttcctagatttctatgcagttgggatttttcatttctcttgtaccaatgtccaaaacaagaaagaatgcaatgcttttgagcctctggtctcctggttcaacaacaggcttatatgtatgatacatgtaatttaaaccttcagacaaacttaaatgttggtgcgtgcttttttttttttttttacactgaatacttgctgtgtgcaatgtttactgaatctttaaaactgtgtatttgaccttttttttacaacactggtgacagtcatatggttttgaaaaaaaaaagaaattttgcttcttcccagcttttctcactttcaccctaaacgacacttcctccccagccagcctcactctgtctccggcccgcagcaggagcagccagcagtgcattcaccccacttttgtaaactgctctgcatataaaccaagggcagaatgtttcaccctgatcttatgggaggaatcaaactcccaaaatagtgtgtatatatgtaataaacagcgtcacgtaaatacatatatgcagtgcttgttgtccaaatagaaatgaaaataagtggaagagagaggaagaagtcaaaccatatgaaactgaaaaaatatgacgtacgaaatggacaaaaagctttttctgaaaccaactttttacttccatcatccttttttagcctgttgcttcagagagacacaaagtgaacacactggtgtgaatgtcgctctctgtgtgcttgtgtttgtaatgaaagtctacagccaattttacttgtctaccaccgtgttgtgctcaaagagacactacttgagtgaagatttcttctttccctgtaccagctgttacagtgttacgttgtgtttaaaatgtgtatggtttattgcaatctgaacagagctatgggtttctaccataagtcaggttgtttgttccctaacctgtctctcatagcaaagtcacttttataacagtttaccactatgcttgattataatgtgaaaggcggaattctgagtgtgttaagatggtattaatcatgtcggtgtcatgtcactaagtttaatgctgctgtttttaaaaaaaaaaaaaagtttttttaaaaagccaatctatgtactaaattgcttccaggtaatttttgatttcctaaagtgcactgaggttatctggaagattgggtgtattttttggtgactgctgcattcatcagcaatgaacagtttccactgtatagtcctaggggtcagggggtgggggtttcattttccattcctcagcacagagcagaaatgatagatttttattgtttggagtaacgttggtatgcagcagaggaacgtaaacatttggtcttggttcagaagcctaacagattgctagacaagagaaaaaacttgaagaaaaaagaagcttaatttcatgcttcataagtagcatttatatttatagcaccaatgtacattttgaaactttctttcaggggtgggagttatggggaaggggtgggtgtgaaggggtagatgaaagctttaatttagaaagaaagttcaagtaaaggaaattattttgattaaatatattttatttgatctgggtatttttggaccacattattaaattaattgttaagctgcagttgagttgttcaagtgagagttttgataagccacttatgggccgcgttgtgaatcacttgccagttgtactttatggagcttattttatgatttaaaatactgtactgtacataggaggtatgttaccttctccttatttgtatgtttaccatatactttgatatttgaaatgttatgtactggaaaggccacttatatttctagaacagattggattttatgcaaccttttttccttgaattaacagcaataaaaaaatgaaaaaca

SEQ ID NO: 204346 - DNA, 1877 bp, Homo sapiens
  Payload ID: 20302
  Gene Name: zinc finger, CCHC domain containing 2
  ENST ID: ENST00000588676
  CDS Start-End: 1-1135
gggactcgggccgcctgttgctggtggagcggcggcgggggcgggtatgccgggcggcggcggggggccctcggcggcgctgcgcgagcaggagcgggtatacgagtggttcgggctggtgctgggctcggcgcagcgcctggagttcatgtgcgggctgctggacctgtgcaacccgctggagctgcgcttccttggctcgtgcctggaggacctggcgcgcaaggactaccactacctgcgcgactcggaggccaaggccaacggcctctcggacccggggccgctggccgacttccgagagcccgcggtgcgctcgcgcctcatcgtctacctggcgctgctgggctcggagaaccgggaggccgctggccgtctgcaccgcctgctaccccaggtggactcggtgctcaaaagcctgcgcgcggcccggggcgagggctcgcggggcggcgcggaggacgagcgcggcgaggacggcgacggcgagcaggacgccgagaaggacggctcaggcccggaaggcggcattgtggagccccgggtcggcggcgggcttggctccagggcccaggaggaactgctgctgctcttcaccatggcctcgctgcacccggctttctccttccaccagcgggtcaccctgagggaacacttggagaggctccgcgccgcgctccgcgggggccccgaggacgcggaggtggaggtagagccgtgcaagtttgccggccccagggcccaggtaaggcgcacggagcctccctggactcgcggtgcgatcgctgccccggcggcctccccggcctcgctctcggacgccccttgcccgagccccagcccggcgcaggtggctcggaatccccacccggcagctcccagcgccagagggctgagcttcgtctcgctgggccgctccgttccactcccccaccccaccccacaccccggcagacacagccacccgccatcacagaatgctctagaagtcccttccgtgccacggtgttgccacggaagacgtggagctccccgcccggggcccctctcggaggaaaagtgtcgggacgtttttggctctgagcatctcagcgctcggtgcgggagccgccgggcgctggaggaacctgtgtgagagccagccgcagtgagccccaggcagcgccgtccttccccgcctgcctggccggggctccgcctcccgtctccgggctctgccgggccctcggcggggtgtcctgaaggtgcgctcccggcgagctgcccttgtctttggcacagagggactttttttgcccagtgtgtgcctgagttaaaaggggtcgtacgggtccttgtggcttctgctctgagggcttgtgttcccagcagacatctgacgtagagacctgcgaatggatctgagatgagtagtaacgcaggttgtccggggagagaaaccttttctagcgcggcctgggatgctttttccctccggcacacgcgctttctcacgggcttgattcctgcctacagattggggttccgggatatttgttgagcgtttacgataggcgttaatgttgcccaaaagaatcacttaaacaccaaaatgtagtagacgagaatccagatgagacacttgtcgcaaacattaaagatgaattttttttacagccatgaaagcaatttaatgataattagggtccagtgagtctttgaggaggacttttccatgggaaggtggggagtaggtttcagtaagagtgagaactgtaaagtgagattatttgtggggtcacaggcttttgaaaggtgttgatttggatgccatgtttttcagcttaggtgatctctaggagataatggaaaaggggattttctcctctccttgcttg

SEQ ID NO: 204347 - DNA, 673 bp, Homo sapiens
  Payload ID: 20302
  Gene Name: zinc finger, CCHC domain containing 2
  ENST ID: ENST00000591145
  CDS Start-End: 1-321
ttttttctgcctcagactccatatgcaaatggactggtacatgacccagtcatggggagccaagccaactatggcatgcagcagatggcaggatttgggagattctatcctgtatatccagcacctaacgtagttgccaacaccagtggttcggggcccaagaagaatgggaatgtctcatgttacaattgtggtgtaagcggacactatgcacaggactgtaagcagtcgtccatggaggccaatcaacaaggcacttacagactgagatacgcacctcccctccccccttctaatgatacgttggattctgcagactgaaacgagtaaagcttgcctacttaatacactcaagtgtggggagtcatggggtgtggaggggaggaaaggaaagttccaatttgagccgctgtgaaaaaggcctccaccagcctctcaccagaagagattgctcattggaacgcaatgccacctggtgggggacgaggacagtgcgagcaagcagatgttatttcctactgacctaatttagagaacattaaacagtggaagtttccagagaaaacagccatcaaagaaggttgagagtgagaattaagagacactggagaagatcaagagaatgtgccctgaagacaacaacaaaaatcaataaaagatttcaagaatgaaa

SEQ ID NO: 204348 - DNA, 5652 bp, Homo sapiens
  Payload ID: 20302
  Gene Name: zinc finger, CCHC domain containing 2
  ENST ID: ENST00000585873
  CDS Start-End: 1-3295
gccgggcggcggcggggggccctcggcggcgctgcgcgagcaggagcgggtatacgagtggttcgggctggtgctgggctcggcgcagcgcctggagttcatgtgcgggctgctggacctgtgcaacccgctggagctgcgcttccttggctcgtgcctggaggacctggcgcgcaaggactaccactacctgcgcgactcggaggccaaggccaacggcctctcggacccggggccgctggccgacttccgagagcccgcggtgcgctcgcgcctcatcgtctacctggcgctgctgggctcggagaaccgggaggccgctggccgtctgcaccgcctgctaccccaggtggactcggtgctcaaaagcctgcgcgcggcccggggcgagggctcgcggggcggcgcggaggacgagcgcggcgaggacggcgacggcgagcaggacgccgagaaggacggctcaggcccggaaggcggcattgtggagccccgggtcggcggcgggcttggctccagggcccaggaggaactgctgctgctcttcaccatggcctcgctgcacccggctttctccttccaccagcgggtcaccctgagggaacacttggagaggctccgcgccgcgctccgcgggggccccgaggacgcggaggtggaggtagagccgtgcaagtttgccggccccagggcccagaacaactctgctcatggtgattacatgcaaaataacgagagcagcttaatagagcaagctccaatacctcaggacggacttaccgtggcacctcacagagctcagcgagaagctgtacacattgagaagataatgttgaaaggagtccagagaaaaagagctgacaaatactgggagtacactttcaaagtaaattggtctgatctttcagtcacaacagtaacaaaaacccaccaagaactacaggaatttctactgaagcttccaaaggaactgtcttcagagacttttgacaagaccatcttaagagccctgaatcagggttccttgaaaagggaggaacggcgacatcctgacctagagcccatcctaaggcagctattttcaagttcatcacaagcttttctacaaagtcagaaagtacacagcttctttcagtccatatcatcagactccctacacagtatcaataacttacaatcctctctgaagacttctaagatattagaacacttaaaagaagacagctctgaagcttcaagtcaagaagaagatgtgttgcagcatgccataatccacaagaagcatactgggaaaagtcccattgtgaacaatattggtacaagttgttctccattggatgggcttaccatgcaatattctgaacagaatggaattgtggattggaggaagcaaagctgtaccaccattcaacacccagagcactgtgtgacctcggctgaccagcattctgctgaaaaacggagtttatcttcaataaataagaagaaaggaaagccacaaacagaaaaggagaaaattaagaaaactgacaacagattgaatagtagaataaatggtattagactctccactcctcagcatgcccatggtggtactgtgaaagatgtgaatttggacattggctctggacatgacacatgtggagaaacatcttcagagagttacagttctccatctagtccccgacatgatggaagagaaagttttgaaagtgaagaagagaaagacagagacacagacagcaattctgaggattctgggaatccatcaacaactaggtttacaggttacggttctgtcaaccagactgtcactgtcaagccacctgttcaaattgcttcactaggaaatgagaatggaaaccttttagaagatcccttaaactcacccaagtatcagcatatttcttttatgccaacgttacactgtgtcatgcacaatggtgcccagaagtctgaagttgtcgttcctgcacccaaacccgctgatggcaaaaccatagggatgcttgttcctagtcctgttgctatttctgcaataagggagtctgcaaattcaacccctgttggaatactagggccaacagcttgcactggagaatcggaaaagcaccttgagttactggcttcccctttacctattccatcaaccttccttccacacagtagtactcccgctttgcatcttacagttcagaggctaaagttgccaccaccacagggatcttctgagagctgcacagttaacatcccacaacaaccacccggaagcctgagcatcgcatcaccaaacactgcctttattcctatccataacccaggtagtttcccaggctctcctgttgctaccacggaccccatcacaaaatctgcatcccaagtggtaggactcaatcaaatggtgcctcaaattgagggaaacacagggacagtccctcagcctaccaatgtgaaggtagttcttccagcagctggcctctcagctgctcagccaccagcttcctaccccttaccaggctctccccttgctgccggcgtgttacccagccagaactccagtgtgctcagcacagcagcaacttctccccagccagcgagcgcaggtatcagccaggcccaggcaactgttcctcctgcagttcctacccacaccccaggccctgccccgagcccaagccctgccttgacacacagtaccgcgcagagtgacagcacctcttacatcagtgctgtggggaacacgaacgctaatgggacagtagtgccaccgcagcagatgggctcaggtccttgtggttcttgtgggcgaaggtgcagctgtgggaccaatggaaaccttcagctaaatagttactattatcctaatccaatgcctggaccaatgtaccgagtcccttcattctttactctgccatccatttgcaatggcagctacctcaaccaagcacatcagagcaatggaaaccaacttcctttttttctgcctcagactccatatgcaaatggactggtacatgacccagtcatggggagccaagccaactatggcatgcagcagatggcaggatttgggagattctatcctgtatatccagcacctaacgtagttgccaacaccagtggttcggggcccaagaagaatgggaatgtctcatgttacaattgtggtgtaagcggacactatgcacaggactgtaagcagtcgtccatggaggccaatcaacaaggcacttacagactgagatacgcacctcccctccccccttctaatgatacgttggattctgcagactgaaacgagtaaagcttgcctacttaatacactcaagtgtggggagtcatggggtgtggaggggaggaaaggaaagttccaatttgagccgctgtgaaaaaggcctccaccagcctctcaccagaagagattgctcattggaacgcaatgccacctggtgggggacgaggacagtgcgagcaagcagatgttatttcctactgacctaatttagagaacattaaacgtaagagagggaacatttggggttggaagcctgtgcccaaaaccttaaagagtgcaggcagctggccataaaagcagcttgagcaaacccctcattcagccgttgaaatgtgtgtgtgaacactttaaaggtttcctctgtgcttttcctgcgtgcatttggtcatcacagctgtgaagtggggtgggaatgtttcccctcgttttctaggagagaaattttgggttcagtgagacgaagtgctgcagacaggcccatggtgatgctcaggcctctgcttgaagttggtgctcacttcctggcaccacttcctgcccccaccagtgcttctggcagagcccagggcagtggctttatggaactgtgtaaggtgataggaacccacaggtggaatggccgtgtggcctctggactgaggagggctggaccaggttgtgggcacgcctggaacacacgccacatcctatcccatagcgaggcctcttccttgtggctctcgaaggatttgaggacgcgggagggtgaaatgtttccagagaaatatccaggacttttagaactaggctttcaaaagcatttacctgtcagataaattcaagtggcatcaatgcagattttaaatgtgtacagatatctccactcgcacgctgagttgtgcttcacacaagttttgcgcacggagtattccattaaatctactgaagcagtggggcaaggagaaaggagaggtgactgctgatgtttttaaagctctgacagtcacatatagattgtcccaggtacccctgctgcccccaagacactccaaaggcaaagatggatggtgacaaagtaaccttcatgcagaaacaagaacagtcacccccaacaacaagccctgctgaaggtgaagaatgccaccaggctgcctggcagttactgagtgcttattcctgctagcctattggagtcacgtcatatttgttacatggtaacttaattgtgccttccacgccttcacaaaatcagttgtacaagagaaggcacccaccacagtccatgtgacctttctcggtctgatttacatagtggggatgatgacactcgcgttgtagagtagttgcacgattaaacctggcacacagacataaagcactcaatgtctgacacatagtggactctcaagaagtttgtcatgcaggggacacttgaatgcccagtatgggccagacagcatcagctcatttcagtcccacagccctgtgagggaggaactctgccctgttttacagttagggaaattgaggcacaaaggctaagaagtcgatatccaagggcacagaatgattgggtgacggtgagcccaggcagtgtgacaacaaggttgctgccccacgccacctctgtctttcgtgggtatgtcggtgtgaggtgtaggcagccctgcactggcattcagcaggcgggactcccgggcaggctcttctgcgaacactcatgggccaccagccctttctggaacttgccttttttttttttttttacctgaaagctacgtgaatcgttggtaaattggtgtaaaaatggaactgagtcatctcaaaagttcctttcagttctaaaattctgtgaattgaagcctactttttcactttaaatgatttattgggtttacagttctttacgctttctgattgaactgatttgaagttcttatttcgtgtgttggggaacacacccccaacccgtcacagcgtggccgtgggtgggagatggacgttaggctggccagtcactagggggcagcatcagcacgggtctggctgtccctggccttagggagcagtttctgcccctcctgccccgtcagaaagtctcggactcctctctgcttgcatgtgtaaagttttcattttcaggggccttttagtcaaaaaaaataaagctgtatgacttagtgctgaaggatatgaattaggcgtagctcttgggttggcagcataaaccaaggggcatcaacccaccaccgacaagctaagaatggtttttacatctttaaatggttgaaaaaggaaaaagaatgtttagtgacacgtgaaaaatacatgaaattcaaacttcagtgtctacaaataaagtgcattagcacacggtc

SEQ ID NO: 204349 - DNA, 704 bp, Homo sapiens
  Payload ID: 20302
  Gene Name: zinc finger, CCHC domain containing 2
  ENST ID: ENST00000621048
  CDS Start-End: 118-704
ccaggctttgggctagcgccggagacttccaggcggactcgagaaccacgtggatgctgcgctgggccgtactgggccgtggcgataaccctgaacaactctgctcatggtgattacatgcaaaataacgagagcagcttaatagagcaagctccaatacctcaggacggacttaccgtggcacctcacagagctcagcgagaagctgtacacattgagaagataatgttgaaaggagtccagagaaaaagagctgacaaatactgggagtacactttcaaagtaaattggtctgatctttcagtcacaacagtaacaaaaacccaccaagaactacaggaatttctactgaagcttccaaaggaactgtcttcagagacttttgacaagaccatcttaagagccctgaatcagggttccttgaaaagggaggaacggcgacatcctgacctagagcccatcctaaggcagctattttcaagttcatcacaagcttttctacaaagtcagaaagtacacagcttctttcagtccatatcatcagactccctacacagtatcaataacttacaatcctctctgaagacttctaagatattagaacacttaaaagaagacagctctgaagcttcaagtcaagaagaagatgtgttgcagcatgccataatccacaagaagcatactgggaaaagtcccattgtgaa

SEQ ID NO: 204350 - DNA, 906 bp, Homo sapiens
  Payload ID: 20303
  Gene Name: zinc finger, CCHC domain containing 24
  ENST ID: ENST00000372333
  CDS Start-End: 52-738
acccatctgtggccttcacttcctccccttgtgggggttttctctgcaaagatgcaagaggtgtgttcgggggaggacacacatgggggtcactttccttccagacctgggcacaccggcgctgagcaacagtgtgtacaagggcgcctcaccctatggctccctcaacaacatcgccgatggcctcagctccctcaccgagcacttctcagacctgaccctcacctccgaggctcgcaagcccagcaagcggcccccacccaactacctgtgccacctgtgcttcaacaaaggacactacatcaaggactgcccccaggcacgccccaaaggcgagggcctgactccataccagggcaaaaagcgctgcttcggcgagtacaagtgtcccaagtgcaagagaaaatggatgagcgggaactcctgggccaacatggggcaggagtgcatcaagtgccacatcaacgtgtatccacacaagcagagacccctggagaagcccgacggcctggacgtgtccgaccagagcaaggagcacccgcagcacctctgcgagaagtgcaaggtcctgggctactactgccgtcgcgtgcagtgacgggctgcccgcccgcacccagagccaccccccgccagcccgaggagacgctgcttccctgtgctactccgaggggctgcgtgtcgccctgtgcatggggtgccctcgcaggcctgcggggctgggccgggggctcttagcgtccttgtcttgtgtgtgttgacaaacagtgttactgacattgctgccccccacaggccagggaaagcagggagtctggggctttttgcaggcgggcctggggtctcagtggaggggacaaaggcaagcaaaagcccatgtccaggagccctgggtgtccccacagg

SEQ ID NO: 204351 - DNA, 4933 bp, Homo sapiens
  Payload ID: 20303
  Gene Name: zinc finger, CCHC domain containing 24
  Uniprot ID: Q8N2G6
  ENST ID: ENST00000372336
  CDS Start-End: 188-913
cgcagtcggggggaggcggcggcagcggcagcggctgcgggcagcgcgcggggcgcagggcgcggggcgatcaccgtcggggctcgggaggcgggcagtgggcacaggctccccggtgcccgcccctccgctgcggaggggggccgcgagcgggcggccggggaggggccggcaccgccgccacaaaatgagcctgctgtcggccatcgacacgagcgccgcctcggtgtaccagcccgcccagctgctcaactgggtctacctgtcgctgcaggacacgcaccaggctagcgccttcgatgccttccggcccgagccgaccgccggcgccgcacccccggagctggccttcggcaagggccgccccgagcagctgggctcgcccctgcactccagctatctcaacagcttcttccagctgcagcgcggagaggcgctgagcaacagtgtgtacaagggcgcctcaccctatggctccctcaacaacatcgccgatggcctcagctccctcaccgagcacttctcagacctgaccctcacctccgaggctcgcaagcccagcaagcggcccccacccaactacctgtgccacctgtgcttcaacaaaggacactacatcaaggactgcccccaggcacgccccaaaggcgagggcctgactccataccagggcaaaaagcgctgcttcggcgagtacaagtgtcccaagtgcaagagaaaatggatgagcgggaactcctgggccaacatggggcaggagtgcatcaagtgccacatcaacgtgtatccacacaagcagagacccctggagaagcccgacggcctggacgtgtccgaccagagcaaggagcacccgcagcacctctgcgagaagtgcaaggtcctgggctactactgccgtcgcgtgcagtgacgggctgcccgcccgcacccagagccaccccccgccagcccgaggagacgctgcttccctgtgctactccgaggggctgcgtgtcgccctgtgcatggggtgccctcgcaggcctgcggggctgggccgggggctcttagcgtccttgtcttgtgtgtgttgacaaacagtgttactgacattgctgccccccacaggccagggaaagcagggagtctggggctttttgcaggcgggcctggggtctcagtggaggggacaaaggcaagcaaaagcccatgtccaggagccctgggtgtccccacaggctcgcctctgagagcctctttggggtgagcagccttgtattggccacaggtgcactaaattgactgtgaatcccaaacctccccagaccagccaggccgcctgcccccacccagaaccttccggtttgccctgtatggaaagccactctcagaaatccctctttcctgagtcagcaatcgtggcaaggggacatgtgttccaacagcggctggggagtggacctctctgtcccttgcccaccttaagccccaaatccagaccccctctgacatcactggcattgcacctgggtgtgcccccctccccacgctatggacccagataggaggggttaggcatgggggaggcacagaatgctggagagatgcgtcctggtgaacgtggggcagcccctcccacgacccccaccagactgccttaggttttgtcagccccactccctttccttcccctctgcctcccacccactctgggggtccacatcaagatagctgggcccagtgtggaagcccagcgtgtctgttccagcagaaaggacacaagcctggtgttctggagacctcggctcaagtctttgccctgctgccgacgcattgtgtcaccttgggcaaggacttcgcatctccaggcctcagtttccccattagttaaatgacagcataacactagagagcagagggcccatttcagctctgttgttctgggattcaggctggccggtgctgtgtcctggagctttatttggggagtttcacccagaatggtgggagaaacctcccaggtgccaggtaccccgcatcgtgacccttcacttggtgtcttaggaagtcaagctgagggatgctgagtcctcccctgctggcccctgcagccccagccctgcttttcatcccccacccctgcaaacatggaggagccccctccttctcacctcggtctcctagcccctgacatggagaaccctgagacaagccacagaacccctcttttctaaaatggagacaataatttcctacctcccaagggagcagagaggcctcgtggcacgtccgtggccagggagcccactgtcctggctggcggcgggatcgtgcgctcctctgtctcccggatgagaagccccgtttccatggtcttgacccttcctttctcccggctgtcagaactgggtctcttgattttgcccctacattatgcctctgtgggaaaaaaaaaaaatcagaccaagaaatgagcctgaaattcagtgtttaccatggctcaaggatgcccatctggtgtccagttgccttttgtattcaaatgaaaatgctttgtacaactgaggagttacagtgaagtgttaaccaggggtccagggagcgagttgaaaagatggagtgagtgtatttgcagccagggagctgcagggtggatttgaggggccataccctctgagcacttaaaaaaggtatttgctccaggccaggcagcaggctgtggacacccttgccaccactggggactgccactgaggactccccgagcacgttgttccccgtcttctccaaggtgttgaggtgagctggggttggccccggcccaggcttctgtcccaaggagaagctgccactgacagtcatcctaccgcactgctaaagagaatgttcgcagtggtgggcggcgtgcctgtgccaacccttccagggacccggccatgggggaccttggcccaaggatgcctggggcctgccagctgtgctgcaaaggtggggggcccacaccctaaaactaacccaggccccagaccactggaggccagggcttccctgcacgggctaaggggagttgggatatcaccccaaagtgaccttgccagtgagctgttcagcaggtagccactgccctgccatctgtgcagagccagccaccttgggggctggggttcccgctttgaggcccaccttccatactccccttgactcggctctggctgaactggggaactctcttgtggtcagcaaagcccctgccatgcaggccaggtgccattgagaattaagtgctcagagggccaggagcccaggggatgggaaagtgtgtggttttagtacgttcaaaagggacaatcgcttgcagttggtagatctagcgatctagttgggagataatggtgtttaccccatatgaagtattcaatagttctacttgtgaatttgtatttattttgagttatacttgacacagaattccttttttaaaaaaatatgtgtgtattttggaaaaaaaattcatagatgttaaaatttctgcatggttaccagtttttctcacaacactgaatttggtagcttttcccgaaaaaatcttcacagtaattttttgtctgtatatatttgagggcctttttttaaaaaaaaaaaaagaaaagaaaaatataattgtttgatttttgagattaaaacaaacaaaaagagaggcattttcaaaatttcagaactttcaggagggcaagagaatatcaaacaaagatttctggaagtattttgccaaccttctggttgagctgcaagaaaatatttatggtgagaacttttctgtttcccgttattgggtttttggttggtttttgtttgttttttactatgctttggtctgtaaaaatatgcaactgaactacattcagaaggaaatattgtctacatagaatattatatgaagttggtacataattctgatgaggaaaaaaaatctttgcaattctttaagccatattgttgtttttctgtgttgttttccctggatgaaaatatcagtattaagtagacagcatattattcaagtgtttagacttattaatatgttcttgtcctgtatttatacatatgtgtattttggaaagtattgccttttttaagggaagctataattcgatacatagtgaaaaagggaatggtgacccctttgtgcctcttccactgaggataacaaacagcattgtaatccattctcttgcaccttcttcttcttatcttgttattacggttttattaattttgtagagggacagggagtgggcaaggggaagaagcagcttatttgactaaccagcccctctgtggtccaccagcgtcttggcttggtgggagggctctcaatcagcagggccccaggagggaagaagaagtggggcaaagcctggcctcgccgctcgggagctttgccatctgagccacgcctcctccaggccatgctccttgaacttggaaatgtcaaccggagcccttacaccagccctccagcatctaatagacttgaatctactctaaacgaatatttaatccaacctcactacattgtagctcagtccaacgactaaccctgaaatgggggtgttccagccttcagcgagatggccaagcggtcccctgggggctgtggcagcgggcttatccttctctgttgccaaccttgccgtccgacctcctccgcccccatgcggtgaccccgtccgtgtctgtgtctgtccatacgtgtgagtccagctaaaaagacaaaacagaacccgtgggcccagctcggaaggtgcgtggagaaggctccgacgtctccgaagtgcagcccttgggatggcattccgttgtgtgccttattcctggagaatctgtatacggctcgcctatagaaatatagcctcttcatgctgtattaaaaggacttttaaaagcaaaa

SEQ ID NO: 204352 - DNA, 3354 bp, Homo sapiens
  Payload ID: 20304
  Gene Name: zinc finger, CCHC domain containing 3
  Uniprot ID: Q9NUD5
  ENST ID: ENST00000500893
  CDS Start-End: 620-1831
tagtgtgacagagtaaaattttaatgataaaaagttaatggtaaaatgttcactgtaaaactttcaacttttcttcttgaaaacgtgcataatccgacgtgggaaaaaaaataacgcattgcagtcagttctggggaaacggaaagctaagttttaattttgctattgcttttgcttttttaacagaaaaggtacaaaaaagaaaaaatgggagagatgttgccgaactccgtcccgcctgtgggctgtgggccgttagcaaagctgctagcatgaaatcgtcgagcaccgcttgcgaaacgccaaatcctcgagagcgaggccggaggctgccaaacccgcgctggggaaagggccgcctccgggcgccccatcccgctgcggacggaggtgaggttggagcgagcgctggcggaagagaggctcagcgcagggggcgcagagccggcgctggccaatatgcgccgcatgtgatacctttgagggcgcggcgggggagggtagcgtcaaatttcaaaaaaaaaaaaaaaccaaacccacacagccccggcgggcgggcgcgcgcgatgggcgccctttggctgcgggagcgagtggaggatgctgggaaggaggtaaaatggccaccggcggcggcgcggaggaagagaggaaacgggggcggccgcagcttctgccccccgcgcggcccgcggcccggggcgaggaggccgacggcggccgcgagaagatgggctgggcccaggtggtgaagaatctagccgagaagaagggcgaattccgcgagccgcggccgccgcggcgggaggaggaaagcggcggcggtggagggagcgccgggctcggcggccccgcgggcctggcggcgccggacctcggcgacttcccaccggctggccgcggggatccgaagggccgtcggagagatccggccggcgaggcggtggacccccgcaaaaagaagggcgctgcggaggcgggcaggaggaagaaggccgaggcggcggcggccgccatggcgaccccggccaggcccggcgaggccgaggacgcggccgagcggcccctccaggatgagccggcggcggcggcaggcccgggcaagggtcgcttcctcgtccgcatctgtttccagggagacgagggcgcctgcccgacccgggacttcgtggtaggagcgcttatcctgcgctccatcggcatggacccgagcgacatctacgcggtcatccagatcccgggcagccgcgaattcgacgtgagcttccgctcagcggagaagctggccctgttcctacgcgtctacgaggagaagcgggagcaggaggactgctgggagaactttgtggtgctggggcggagcaagtccagcttgaagacgctcttcatcctcttccggaacgagacggtggacgtggaggacattgtgacttggctcaagcgccactgcgacgtgctggccgtgccggtgaaagtgaccgacaggtttgggatctggaccggggagtacaaatgcgagatcgagctgcgccagggggagggcggggtcaggcacttgccaggggccttcttcctgggggccgagaggggctacagctggtacaaggggcagcccaagacatgctttaaatgtggttcccggacccacatgagcggcagctgcacgcaggacaggtgcttcaggtgcggggaggaggggcacctgagcccttactgccggaagggcatcgtgtgcaacctctgtggcaagcgaggacacgcctttgcccagtgtcccaaagcagtgcacaattccgtggcagctcagctaaccggcgtggccgggcactaaacacccgcctgcctgccagggtgaacacacagccagcttatccctcttaagtgccaaaacttttttttaaaccattttttatcgtttttgaaggagatctttttaaaacctacaagagacatctctctatgccttcttaaaccgagtttactccatttcagcctgttctgaattggtgactctgtcaccaataacgactgcggagaactgtagcgtgcagatgtgttgcccctcccttttaaaattttattttcgtttttctattgggtatttgttttgtttcttgtactttttctctctctccttgcccccctcccgccctccccgccccataccttttcttcccctggattttcaccctttgggctgccttgctcatctttatgccccagcactaggtacggggcccaacacgtggtaggcactccatcagtgtttgctgaattgaaaacattgttgactgtggcttctatcagagtgtctaccttttgcagctcttcccctccctcatttaatttgctgcttttaatctacgtggtctgagaatttgtgaaaccagtgttgttagaagtgtatataatctgaatcaataagctctgaatggtggccaagggcctctcttatggcacaaagatgcatggacttcatgacagctcttttggtggctcagaagccattttttatagaatcatggaatctagaatattcctgctggaaagaacctgagagttggtttggaccaattccctggttttccagcagatgaaacaggcccaaagaggttaaatgactgggtgaaaatcacatagctgtctggtgccagagccagcctatagtagagtcccctgaccccaagcccggtgctcattccactacctctcacacttcacaacaatttcctcaacacttgagggcccagaaagtctgatctctccagaatgatcagcccagaggaatgctgagaaatcacctggaggagggagcagaaagagaaggtttttaaggaggggcttctgaatacttgggagatacggaacggaccaaggaccacactccagggtgcattcgttgctccctggggcaccacttctggattacagtgtgccaggtcctttggaggccctaccccttccccattcattgccaccagtgagaaatgggggtgcccctgtgtaaagaaacctaccaaaggtttacatttgcaccttagcctcaatagctacgaaccctagagaagcagctagctggagctcatgtgcaactcctgattctcaggagaaagatggattttaacccaaaattatgagtgagctgttaactctaaaatgtacttgggagataggccaagcgagaggtcatgggccaactaagtgttatccagtagaaaagacagtacactgcttttcttttagtgtttgcttttcctttgctatatgttttgctatttccttgtggcttagaatgtaaaattgattgttaaaagttttgttctgaataaatatttatcttttgtattgctaaaa

SEQ ID NO: 204353 - DNA, 2785 bp, Homo sapiens
  Payload ID: 20305
  Gene Name: zinc finger, CCHC domain containing 4
  Uniprot ID: Q9H5U6
  ENST ID: ENST00000302874
  CDS Start-End: 25-1566
ggctttcgggacggcggcgggaagatggcggcctccaggaatgggtttgaagccgtggaggcagagggcagcgcagggtgccggggaagctcgggaatggaggtggtgcttcctttggatcctgccgtccccgccccgctgtgccctcacggacccactcttctgtttgtaaaggtgacccaagggaaagaagaaactcggaggttttatgcctgttcagcctgtagagatagaaaagactgtaatttttttcagtgggaagatgaaaagttgtcaggagctagacttgctgcccgagaagctcataaccgaagatgtcagcctcccctgtcccgaacgcagtgtgtggaaaggtacttgaagtttattgagttgcccttgactcagagaaagttttgtcaaacatgtcagcagttgttgttaccagatgactgggggcaacatagtgagcatcaggttctgggtaatgtgtccattacccagttaagaaggcccagtcaactcctttatccactggaaaacaagaagacaaatgcccagtatctgtttgctgatcggagctgtcagttcttggtagacttactttctgccctcggattcagaagagtactgtgtgttggaacaccaaggttgcatgagctgatcaagttgacagcatcaggtgacaagaagtctaacattaaaagccttttattggatattgattttcggtattcacagttttatatggaagatagcttttgccattataatatgtttaaccatcatttctttgatggaaagactgcccttgaagtatgcagagcatttttacaggaagataaaggcgaaggaatcattatggtgacggatcctccgtttggtggcttggttgaacctctggctattacattcaagaagttaattgctatgtggaaagaaggtcaaagccaagatgacagtcacaaagaactacccattttctggattttcccctatttttttgaatcccgaatttgtcagttttttccaagcttccagatgctggattaccaggtagattatgataatcatgcactttataaacacggaaagacaggtcgaaaacagtctcccgtgcgtattttcaccaacattccgcccaacaaaataatccttcctactgaagaagggtacagattttgctctccgtgtcaacggtatgtttctctagagaatcaacactgtgagctctgtaattcttgcacatccaaggatggcaggaaatggaaccattgctttctctgtaaaaagtgtgtaaagccttcctggatccactgtagcatctgcaatcactgtgctgttccagatcattcttgtgagggccccaaacatggctgctttatttgtggtgaactggatcataaacgcagtacttgtcctaacattgctacatctaagagagctaacaaagctgtcagaaagcagaagcaaagaaaaagtaataagatgaaaatggagaccacgaaaggacaatccatgaatcatacatctgctacaaggagaaagaaaaggagggaaagagcccatcaatatcttggctcttaaatgtccagtgactggagaataagaaagatttatggtccaacctttgatgccattttctgaaagtgccacactggacttaaattcagctgcttccagaggtgtgcacctttctgagctagataacaggcaggtggcatttgctggtttacagtcccttatctgcctctctggagacatggggagttgttccatcttcagccagtttactagttctttcagcattcatttttcctcactttaagtctctcccagtcacattgttctatttttatgttttcattttttttgagatggagtcttgctctgtctcccaggctagagtgcaatggcacaacctcagctcactgcaacctctgcctcccgggttcaagcaattctcctgccttagcctcctgagtagctggaattataggcacatgccaccacgactggctaatttttgtatttttagtagagacggggtttcaccatgttggccaggctggtctcgaactcctggcctcaagtgatttgcctgccttggcctcccaaagtgctgggattacaggcatgagccacctcacccagctccggtcacattattctagcctttttatccaaaaaatgggcagaccattcttttgcagaagatgtcagaagaaaatgaaagtgaaaacctatgcagtttgtttaccgtgaacataaaagtatgttaatttaaataggaaaatattttatgttaaatatgaaacaatagtttaaaccccacttgaaaagtatagcgtacaattatttttagactgaatttgaagatgatggaaagggtttttacaaaggcactgtttagatatacagattataattataattacattattattaaatatttattcttcaagtactttttgcagttgtcctctgacggtctagaatcacttaaatgcttgttgaatgagtgagatgtttagaactacgacttgctctgtcattccagtgtcgtttaacctatgcagtaagattctgtctttgtaaaagtagttcgtagcagaagccaggatagtttggtaattaaacgcccaaactaaactcctcattcctacccttaatatttcctggctgtatgatcttggccaggtcactctctaaaagccccggtttcttcattattatcattattataatggggagaataacagctatacctgaggtttgttttgtgattaaattaaatgagacccaa

SEQ ID NO: 204354 - DNA, 2045 bp, Homo sapiens
  Payload ID: 20305
  Gene Name: zinc finger, CCHC domain containing 4
  Uniprot ID: Q9H5U6
  ENST ID: ENST00000507760
  CDS Start-End: 16-705
gacggcggcgggaagatggcggcctccaggaatgggtttgaagccgtggaggcagagggcagcgcagggtgccggggaagctcgggaatggaggtggtgcttcctttggatcctgccgtccccgccccgctgtgccctcacggacccactcttctgtttgtaaaggtgacccaagggaaagaagaaactcggaggttttatgcctgttcagcctgtagagatagaaaagactgtaatttttttcagtgggaagatgaaaagttgtcaggagctagacttgctgcccgagaagctcataaccgaagatgtcagcctcccctgtcccgaacgcagtgtgtggaaaggtacttgaagtttattgagttgcccttgactcagagaaagttttgtcaaacatgtcagcagttgttgttaccagatgactgggggcaacatagtgagcatcaggttctgggtaatgtgtccattacccagttaagaaggcccagtcaactcctttatccactggaaaacaagaagacaaatgcccagtatctgtttgctgatcggagctgtcagttcttggtagacttactttctgccctcggattcagaagagtactgtgtgttggaacaccaaggttgcatgagctgatcaagttgacagcatcaggtgacaagaagtctaacattaaaagccttttattggatattgattttcggtagattatgataatcatgcactttataaacacggaaagacaggtcgaaaacagtctcccgtgcgtattttcaccaacattccgcccaacaaaataatccttcctactgaagaagggtacagattttgctctccgtgtcaacggtatgtttctctagagaatcaacactgtgagctctgtaattcttgcacatccaaggatggcaggaaatggaaccattgctttctctgtaaaaagtgtgtaaagccttcctggatccactgtagcatctgcaatcactgtgctgttccagatcattcttgtgagggccccaaacatggctgctttatttgtggtgaactggatcataaacgcagtacttgtcctaacattgctacatctaagagagctaacaagtcagtcgaatactttactagaaaaatgtattccatctgtgttttatacaggataatccacaaaagcatgcaacattcagaggatcttgaagtgccaagttaattgtcactttcactattaagtactggctgcatagatggatggagggaggagaggaagatgattcaaagagcttgctttcaaagagcttacagttctacagcttagagatgaaaataaccaaaatatgaggtagaaagtggttaattttacctctccttggctttacgtctcatgtgtaaagttatagggggtgacagttcatgctttattgaaggacatgatatttacgtcaggctttgagggacagatcagatatagacacatgatggcaggaaaggctggagaaggcatttcagattgaatagcaagtaattccacagtaggaaaattgtgagaaagctatttctttgtatcaaattttaagaaaaatatttagacatgcttaatgcttaaatatttgaaatttttattactttttttcctgtgattattttcacatctctcaccaatatttgattggagctatggattacaactcagagtatggggatacctatgacaatagcttatttagaagaggcactgcttctggaatagttatccccaaaacaaaacaaaaagagaaaaacattgctattttaaccgagctaatttgaatgattatacttttttcctaactaaaagggatgatagtgattaagtcctcttcctttattgctaagaaaactaatgttacacagttattaattggagattaccagacagctaaatttgacattatatgaaattatatgacattatatgaaaattcagattgggctaccatgtgactatgacttgtaatttaaaaaaattgatttgtgttagaaatatctgatagtttaataattatttatggtaatatta

SEQ ID NO: 204355 - DNA, 1903 bp, Homo sapiens
  Payload ID: 20305
  Gene Name: zinc finger, CCHC domain containing 4
  ENST ID: ENST00000505412
  CDS Start-End: 1-907
ctgggggcaacatagtgagcatcaggttctgggtaatgtgtccattacccagttaagaaggcccagtcaactcctttatccactggaaaacaagaagacaaatgcccagtatctgtttgctgatcggagctgtcagttcttggtagacttactttctgccctcggattcagaagagtactgtgtgttggaacaccaaggttgcatgagctgatcaagttgacagcatcaggtgacaagaagtctaacattaaaagccttttattggatattgattttcggtattcacagttttatatggaagatagcttttgccattataatatgtttaaccatcatttctttgatggaaagactgcccttgaagtatgcagagcatttttacaggaagataaaggcgaaggaatcattatggtgacggatcctccgtttggtggcttggttgaacctctggctattacattcaagaagttaattgctatgtggaaagaaggtcaaagccaagatgacagtcacaaagaactacccattttctggattttcccctatttttttgaatcccgaatttgtcagttttttccaagcttccagatgctggattaccaggtagattatgataatcatgcactttataaacacggaaagacaggtcgaaaacagtctcccgtgcgtattttcaccaacattccgcccaacaaaataatccttcctactgaagaagggtacagattttgctctccgtgtcaacggtatgtttctctagagaatcaacactgtgagctctgtaattcttgcacatccaaggatggcaggaaatggaaccattgctttctctgtaaaaagtgtgtaaagccttcctggatccactgtagcatctgcaatcactgtgctgttccagatcattcttagctgtcagaaagcagaagcaaagaaaaagtaataagatgaaaatggagaccacgaaaggacaatccatgaatcatacatctgctacaaggagaaagaaaaggagggaaagagcccatcaatatcttggctcttaaatgtccagtgactggagaataagaaagatttatggtccaacctttgatgccattttctgaaagtgccacactggacttaaattcagctgcttccagaggtgtgcacctttctgagctagataacaggcaggtggcatttgctggtttacagtcccttatctgcctctctggagacatggggagttgttccatcttcagccagtttactagttctttcagcattcatttttcctcactttaagtctctcccagtcacattgttctatttttatgttttcattttttttgagatggagtcttgctctgtctcccaggctagagtgcaatggcacaacctcagctcactgcaacctctgcctcccgggttcaagcaattctcctgccttagcctcctgagtagctggaattataggcacatgccaccacgactggctaatttttgtatttttagtagagacggggtttcaccatgttggccaggctggtctcgaactcctggcctcaagtgatttgcctgccttggcctcccaaagtgctgggattacaggcatgagccacctcacccagctccggtcacattattctagcctttttatccaaaaaatgggcagaccattcttttgcagaagatgtcagaagaaaatgaaagtgaaaacctatgcagtttgtttaccgtgaacataaaagtatgttaatttaaataggaaaatattttatgttaaatatgaaacaatagtttaaaccccacttgaaaagtatagcgtacaattatttttagactgaatttgaagatgatggaaagggtttttacaaaggcactgtttagatatacagattataattataattacattattattaa

SEQ ID NO: 204356 - DNA, 938 bp, Homo sapiens
  Payload ID: 20305
  Gene Name: zinc finger, CCHC domain containing 4
  ENST ID: ENST00000612982
  CDS Start-End: 65-448
ctccaggaatgggtttgaagccgtggaggcagagggcagcgcagggtgccggggaagctcgggaatggaggtggtgcttcctttggatcctgccgtccccgccccgctgtgccctcacggacccactcttctgtttgtaaaggtgacccaagggaaagaagaaactcggaggttttatgcctgttcagcctgtagagatagaaaagactgtaatttttttcagtgggaagatgaaaagttgtcaggagctagacttgctgcccgagaagctcataaccgaagatgtcagcctcccctgtcccgaacgcagtgtggaaggtacttgaagtttattgagttgcccttgactcagagaaagttttgtcaaacatgtcagcagttgttgttaccagatgactgggggcaacatagtgagcatcagttctgggtatgtgtcattaccagttaagaaggcccagtcaactcctttatccactggaaaacaagaagacaaatgcccagtatctgtttgctgatcggagctgtcagttcttggtagacttactttctgccctcggattcagaagagtactgtgtgttggaacaccaaggttgcatgagctgatcaagttgacagcatcaggtgacaagaagtctaacattaaaagccttttattggatattgattttcggtattcacagttttatatggaagatagcttttgccattataatatgtttaaccatcatttctttgatggaaagactgcccttgaagtatgcagagcatttttacaggaagataaaggcgaaggaatcattatggtgacggatcctccgtttggtggcttggttgaacctctggctattacattcaagaagttaattgctatgtggaaagaaggtcaaagccaaggtgtataatttattactgcaaaataaatacatatctatatatc

SEQ ID NO: 204357 - DNA, 2648 bp, Homo sapiens
  Payload ID: 20306
  Gene Name: zinc finger, CCHC domain containing 5
  Uniprot ID: Q8N8U3
  ENST ID: ENST00000321110
  CDS Start-End: 297-1724
atttacacatttccctcctcagcaatgggtacacagacagccaagctcctggactaagtctctgaatgtgtatctgacacttccccttactgagctccggaggctccttcttgccgagctccggaggctcccagtgacctcttgataatcagccttggcggggcccaaataccaccccttggaaaactcactgagcctgacatctgcctgtaagcagctttcaggaaggatctcacaaacacccacccaatctctcttggtagcaaattgtcaaatcatacccatttcctcaaaagatggtggaggacttagcagcctcctatattgttctgaaattggagaatgaaattcggcaggctcaagtgcagtggctgatggaagaaaatgctgctctccaggcccagatcccagagcttcagaagtcccaagcagccaaggagtatgatctactccgaaagtcctcagaggccaaggagccccagaagctcccagagcacatgaatcccccagcagcctgggaggcccaaaagaccccagagttcaaggaaccccagaagccaccagagccacaggatcttctaccctgggaacccccagcagcctgggaactccaggaggccccagcagccccagagtccctggcgcctccagcaacccgggagtcccagaaacctccaatggcccatgagatcccaacagtcttggagggccaggggcctgcaaacacccaggatgccacaatagcccaagagcccaagaattcagaaccccaggatcccccaaatattgagaagccccaggaggcaccagaataccaggaaactgcagcacagctagagttccttgagcttccacctccccaggagcctctggagccttcaaatgcccaggaattcctagaactctcagcagcccaggagtccctggagggtctaatagttgtggagacatcagcagcttcagagtttccacaggcccctattgggttagaggctacagatttccccctgcaatacactttaaccttcagtggagattcccagaagcttcctgagttcctggttcagctgtatagttacatgagagtcagagggcacctgtatcccactgaagcagccctggtgagctttgttggcaattgcttctcaggtagggcaggatggtggttccagctcttactggatatccaaagccccttactggagcaatgtgaaagtttcatacctgtgctccaggatacttttgataatccagaaaacatgaaagatgccaaccagtgcatccatcaactctgccaaggggagggtcatgtagcaacccacttccacctcattgctcaagagctgaactgggatgaaagcactctctggatccaatttcaagaaggtcttgccagttctatacaagatgaactgtctcacacaagcccagccaccaacctatctgatctcatcactcagtgcatcagcctggaagagaagcctgatcccaatccattagggaaaagttcctctgcagagggagatggacccgagagtccaccagctgaaaaccaacctatgcaggctgcaatcaactgcccacacatcagtgaagctgaatgggtccgttggcacaaaggccgcttatgcctctactgtggttatcctggtcattttgccagagattgccctgtcaagcctcatcaggccctgcaggcgggaaacatccaggcctgccagtaagggggaccccacgtgggccaatctacaaatatgcgtccccctctcttccaatatccatgtctcatacactatggcttactgttgaaatccaactgggaagaagataattctttgagcaagcaatggtagattcaggctcctacagaaacagcattgatcatactgtggttcttcgagagaagctgcccatccgcagtaatatcttccctctgatgctggaaactgtcgacggccatccacttattaatggacccataactaaggaaacatcacctgtccaagttcaaattggaaaccatgttgaagagctccagtttgacattattcatgcaccacgataccctctgattattggaatccattggcttgagacacatgacccaaacatagaatggagtacccgcactgtgtcctttctatcacgttattgtcactacaattgcttcaggcacaggtggaatagaagaaatcgtgatgaaataatttctgggtagatcctgtgtcctagtgactgttcctggcaacctgtcttctgttacctcagctgtcatcagcatttgctgctccctgaatcttctactgaacatcttgctatgtactaaggctacctgtacaacgactctgcctcttagatgatagactgaacctgatgactttgagctgcttttttttttttcactaactctgcatgcctctatctcagaactctgcatcctgcggaactgttttaattacaattatactaacaatacacatgagaatagatattagaaactaataatgaaaaagcatagctgttaaactgacttgatttttttcttatcaatattttctatatcacaaaaatggcaacatcttttacataaagaaaataagtttgtaagtgatatttcttaaaagaatcaataaatattagcaatttct

SEQ ID NO: 204358 - DNA, 5724 bp, Homo sapiens
  Payload ID: 20307
  Gene Name: zinc finger, CCHC domain containing 6
  ENST ID: ENST00000277141
  CDS Start-End: 2426-4780
aggaagaggctggggaccgcggcgaaggtggtgagtgctcttgggcgccttctcccaacgtccctgccagactcgcctccgggctgattctccagttggtttcctggactccagagtagctgtccggcctggccccggaggtgcaaagtaagaaaattgaagtcaaagaccatgggagatacagcaaaaccttatttcgtgaagcgcactaaagaccgggggactatggatgatgatgacttcagaaggggtcacccccaacaagattatttaataatagatgaccatgctaaaggccatggcagtaaaatggaaaagggccttcaaaaaaagaagataacaccagggaactatgggaatacccccagaaaaggaccatgtgctgtttccagcaatccatatgcatttaaaaacccaatctacagtcaacccgcttggatgaatgacagccacaaagatcagagtaagagatggctgtctgatgaacatactggtaattcagacaactggagagaattcaaacctggacctagaattcctgttataaaccgacaaagaaaagactcctttcaagaaaatgaagatggttataggtggcaagacacaagaggctgcagaactgtaagacgactgtttcataaagacctaacaagcctagaaaccacgtcagaaatggaagcaggaagtcctgaaaacaagaagcagaggtccagacctaggaagccacggaagactagaaatgaggaaaatgagcaggatggagacttggaaggccctgtgatcgatgagtctgtactttcaacgaaggagctgctaggcttacagcaggctgaggagagactgaagagagactgcattgacaggctaaaaaggcgaccacgaaactaccctacagcaaagtacacctgcagactctgtgatgttttaattgaatccattgcatttgcccataagcatatcaaggaaaagaggcacaagaaaaacattaaggagaagcaagaggaagagttgctcactacgttacccccaccaacaccctcccagataaatgcagttggcattgccattgacaaagtggtacaggaatttggcttacacaatgagaacttggaacagaggctggaaattaaacgtatcatggaaaatgtgttccaacacaagttaccagattgttccctaagattatatgggtcatcctgtagcagattgggtttcaaaaattcggatgtaaacattgacatccagtttccagccattatgtctcagccagatgtcctcttacttgttcaagaatgtttaaagaacagtgactcctttattgatgttgatgcagacttccatgctagggtgccagtggtggtgtgcagagaaaagcaaagtggtcttctgtgtaaagtgagcgcaggaaatgaaaatgcttgtctgacaacaaagcatttaactgcccttggaaaactagaaccaaagctggttcctttggtgattgcatttaggtactgggcaaagctttgcagtatagatcgccctgaagaaggaggtctgccaccttatgtgtttgccctgatggccattttctttcttcagcagaggaaagaaccccttttgcctgtatatctaggatcatggattgaaggattctcattaagcaaactagggaatttcaaccttcaagacattgaaaaagatgttgtgatctgggaacatactgacagtgctgcaggggacacaggcataacaaaagaagaggcaccaagagaaacgccgattaaaaggggacaggtggtatcatccctactctgcagataatgatagcgaccattttttgaacactgtgtgccaggcactgtgctaagcactttacagacactatctcactcagtcctcccaacaaccctatgaggtgtcattaatattggatgtgaaacaccagccttcagtaccagttgggcagctctgggtggaattgctgcggttctatgctttagaatttaatttggctgatttagtgataagtattcgtgtcaaagaattggtatctcgggaattgaaggattggcccaaaaagcgcattgccattgaagatccctactctgttaaaagaaatgtggcaagaaccctaaatagtcaacctgtgtttgaatatatacttcattgtttaaggacaacatacaagtattttgctcttccacacaaaattacaaaatccagccttctaaagcctctgaatgcaattacatgtatttcagaacattctaaagaagtaataaatcatcatccagatgtacaaacaaaagatgataagctcaaaaactcagttttggcccaaggtcctggtgctaccagttcagctgcaaatacctgtaaggtacagccacttactcttaaagagactgctgaaagttttggaagcccaccaaaagaagaaatgggaaatgaacacatcagtgtccaccctgaaaactcagactgtatccaagcagatgttaactctgatgattacaagggtgataaagtataccatccagaaacaggaaggaaaaacgagaaagagaaagttggaaggaagggcaagcatctgttgactgttgatcagaaacgtggagagcatgttgtctgtggcagcacacgtaataatgagtcagagagcactttggatttagaaggcttccaaaatcccacagctaaagagtgtgagggacttgccactttagataacaaggctgatcttgatggagaaagtacagaaggtactgaggaactagaagactctctaaaccactttacccactcagtacagggccagacatcagaaatgattccctctgatgaagaggaggaggacgacgaagaagaggaggaggaagaagaacctaggctcaccattaaccaaagggaagatgaagatggcatggctaatgaagatgagttagacaacacctacactgggtcaggggatgaggacgccctatctgaagaggatgatgagttaggcgaagctgctaagtatgaagacgtgaaagaatgtggaaaacatgtagaaagagctctcctagtggaacttaataaaataagtctcaaggaagaaaatgtatgtgaagaaaaaaattcacctgtggatcagtctgattttttttatgaattcagtaaacttatcttcaccaaaggcaagtctcctacggtagtgtgcagcttatgcaaacgagagggtcatctaaagaaggactgtcctgaagacttcaaaagaatccagctagaacctctgccaccattaacacccaagtttttaaatatcttagatcaagtctgtatccagtgttataaggatttttctccaacaattatagaagatcaggctcgtgaacatattcggcaaaacctagaaagtttcataagacaggactttccaggaactaaattgagcctgtttggctcctccaaaaatggatttgggttcaaacagagtgaccttgacgtctgtatgacaattaatggacttgaaactgctgagggattggactgtgtcagaactattgaagaattagcaagagtcctcagaaaacattcaggtctgagaaacatcttacctattacaacagcaaaggtgccaattgtgaagttcttccatttgagaagtggtctggaagtagatatcagtttgtataacacattggcccttcataacacaaggcttttatctgcttattccgccattgatcccagagtgaagtatttgtgctataccatgaaagtatttacaaagatgtgtgatattggtgatgcatctagaggcagcttatcatcgtatgcatatactcttatggtgctatattttctccagcagaggaatccaccagtcattcctgtccttcaagagatatacaaaggtgaaaagaaacctgaaatatttgttgatggctggaatatttatttttttgatcaaatagatgaactgcctacctattggtcagaatgtggaaaaaatacagaatctgttgggcagttatggttgggccttcttcgtttctacacagaggaatttgattttaaagaacatgttattagcatcaggagaaaaagtctgcttacaacttttaagaaacagtggacctcaaaatacattgttattgaagatccctttgatttgaatcataatcttggagctggattatcaaggaaaatgacaaattttataatgaaggcttttatcaatggtagaagagtatttggtattcctgtcaagggatttccaaaggactacccctcaaaaatggaatacttttttgatccagatgtgttaactgaaggagagctggccccaaatgatagatgttgtcgaatttgtggaaaaatcggacacttcatgaaggactgtcctatgaggagaaaagtaagacggcggcgagatcaggaagatgccctgaaccaaagataccctgagaacaaggaaaaaagaagcaaagaggacaaagaaattcacaacaagtacacagaaagggaggtgtcaacaaaagaagataagcccatacagtgcacacctcagaaagccaagccaatgcgggcagctgctgacctggggagggagaagatcctcaggccaccagtagaaaaatggaagagacaggatgacaaagacttaagagaaaaacgttgttttatttgtggaagagaagggcacattaaaaaggaatgcccacagtttaaaggctcttcaggtagcctttccagtaaatatatgactcagggaaaagcctcagcgaagaggacccagcaggaatcatgagggaaggaaaatgcagcactctaaatggccactcaggcgttcctattcactcggaaaattaggttcatttcacaggacacagcagtgtagatcaggcttcaacttaacatttaagggaaatgtcagatttttttttaatttaatgaaattgttaatgaggaaaaatttttaatatagtcttatctaccacacatccccatagatttaaggattttaatagaaagacatgatgtatgtatttaagccacgttaaaagaaaaaatataactatggaccggtattcagtgaatacagtttcatggtttttaattctttcaaagcacattaaaaatggtgtgctgataaaccccaagtaaattaaccctttttccgtataaatccattttttgttttgaagaggggaaattatatttattgttgtttactgaatcctggtgtgaaagcatatcagatatgtatgaactgctactgctgtacttccgatttacggacatcattttattgctatttgtagacgtgataacatgaacatgagtacctatttatgtgggccttcagtggatgggcagtgccactcaggtctctggggtttccctctctaattttaagtaaattgacatataactactatgcttataaaaatgaagtaaggaaaacaagtagtcctgtttgccactaaaaacattttcaaaggaaaaataaaatgaaagtactttttactttttatgatactcagaaattaggatgaagaacttttaaaattgctgaagatcaaagaggttatctctgccagtcacaagtgtggctggtgtcattctgggtctgactggagccctcctggactgtttctttaatttcaaaagccctgcagacatagtacctggtcagaactatgcctcggtttatttatcattttgaaataaaatcagaatttcaacctgtaa

SEQ ID NO: 204359 - DNA, 611 bp, Homo sapiens
  Payload ID: 20307
  Gene Name: zinc finger, CCHC domain containing 6
  ENST ID: ENST00000375947
  CDS Start-End: 9-515
cgtcagaaatggaagcaggaagtcctgaaaacaagaagcagaggtccagacctaggaagccacggaagactagaaatgaggaaaatgagcaggatggagacttggaaggccctgtgatcgatgagtctgtactttcaacgaaggagctgctaggcttacagcaggctgaggagagactgaagagagactgcattgacaggctaaaaaggcgaccacgaaactaccctacagcaaagtacacctgcagactctgtgatgttttaattgaatccattgcatttgcccataagcatatcaaggaaaagaggcacaagaaaaacattaaggagaagcaagaggaagagttgctcactacgttacccccaccaacaccctcccagataaatgcagttggcattgccattgacaaagtggtacaggaatttggcttacacaatgagaacttggaacagaggctggaaattaaacgtatcatggaaaatgtgttccaacacaagttaccaggtattttctagatttgtttttctatttaactacctaaaagtacctcattcatttctcctaccaatagtaattttcatcaaataaaaatttatttaccatgtcatgaa

SEQ ID NO: 204360 - DNA, 958 bp, Homo sapiens
  Payload ID: 20307
  Gene Name: zinc finger, CCHC domain containing 6
  ENST ID: ENST00000375948
  CDS Start-End: 50-424
gggtttcaaaaattcggatgtaaacattgacatccagtttccagccattatgtctcagccagatgtcctcttacttgttcaagaatgtttaaagaacagtgactcctttattgatgttgatgcagacttccatgctagggtgccagtggtggtgtgcagagaaaagcaaagtggtcttctgtgtaaagtgagcgcaggaaatgaaaatgcttgtctgacaacaaagcatttaactgcccttggaaaactagaaccaaagctggttcctttggtgattgcatttaggtactgggcaaagctttgcagtatagatcgccctgaagaaggaggtctgccaccttatgtgtttgccctgatggccattttctttcttcagcagaggaaagaaccccttttgcctgtatatctaggatcatgggtataaaacattttttttgcttatatatctgaacagattttattacaggtccacaattaaattttgcataatttcaaaatctagacacctaaccagaactgacatggatttatttattctactcatgtgaatattcatacctttcactgctgaaatactaatgtgtttgatttcagtatgttgccctataacctgcttagggatattattacctttctagactgcaaaatctcttaatttttgaaatatgtatggtcctgagacgaacaagagactgaccctgtaaatttaccatttggtacattctttctttgggtacagttttctaaattgatacttgaatttacatatcacctccagacagacagactgtgggaagcatttggttcactgtaacttactttctgtttctaatctatttctccccataacctgtaaaacaaaaaaatatataaacattgaaattgctacctgtaccacaagatgcagaacctagtagtcatctcttgaataatattttgacattattttaaagatgaa

SEQ ID NO: 204361 - DNA, 2262 bp, Homo sapiens
  Payload ID: 20307
  Gene Name: zinc finger, CCHC domain containing 6
  ENST ID: ENST00000375957
  CDS Start-End: 133-1320
gatcaggctcgtgaacatattcggcaaaacctagaaagtttcataagacaggactttccaggaactaaattgagcctgtttggctcctccaaaaatggatttgggttcaaacagagtgaccttgacgtctgtatgacaattaatggacttgaaactgctgagggattggactgtgtcagaactattgaagaattagcaagagtcctcagaaaacattcaggtctgagaaacatcttacctattacaacagcaaaggtgccaattgtgaagttcttccatttgagaagtggtctggaagtagatatcagtttgtataacacattggcccttcataacacaaggcttttatctgcttattccgccattgatcccagagtgaagtatttgtgctataccatgaaagtatttacaaagatatacaaaggtgaaaagaaacctgaaatatttgttgatggctggaatatttatttttttgatcaaatagatgaactgcctacctattggtcagaatgtggaaaaaatacagaatctgttgggcagttatggttgggccttcttcgtttctacacagaggaatttgattttaaagaacatgttattagcatcaggagaaaaagtctgcttacaacttttaagaaacagtggacctcaaaatacattgttattgaagatccctttgatttgaatcataatcttggagctggattatcaaggaaaatgacaaattttataatgaaggcttttatcaatggtagaagagtatttggtattcctgtcaagggatttccaaaggactacccctcaaaaatggaatacttttttgatccagatgtgttaactgaaggagagctggccccaaatgatagatgttgtcgaatttgtggaaaaatcggacacttcatgaaggactgtcctatgaggagaaaagtaagacggcggcgagatcaggaagatgccctgaaccaaagataccctgagaacaaggaaaaaagaagcaaagaggacaaagaaattcacaacaagtacacagaaagggaggtgtcaacaaaagaagataagcccatacagtgcacacctcagaaagccaagccaatgcgggcagctgctgacctggggagggagaagatcctcaggccaccagtagaaaaatggaagagacaggatgacaaagacttaagagaaaaacgttgttttatttgtggaagagaagggcacattaaaaaggaatgcccacagtttaaaggctcttcaggtagcctttccagtaaatatatgactcagggaaaagcctcagcgaagaggacccagcaggaatcatgagggaaggaaaatgcagcactctaaatggccactcaggcgttcctattcactcggaaaattaggttcatttcacaggacacagcagtgtagatcaggcttcaacttaacatttaagggaaatgtcagatttttttttaatttaatgaaattgttaatgaggaaaaatttttaatatagtcttatctaccacacatccccatagatttaaggattttaatagaaagacatgatgtatgtatttaagccacgttaaaagaaaaaatataactatggaccggtattcagtgaatacagtttcatggtttttaattctttcaaagcacattaaaaatggtgtgctgataaaccccaagtaaattaaccctttttccgtataaatccattttttgttttgaagaggggaaattatatttattgttgtttactgaatcctggtgtgaaagcatatcagatatgtatgaactgctactgctgtacttccgatttacggacatcattttattgctatttgtagacgtgataacatgaacatgagtacctatttatgtgggccttcagtggatgggcagtgccactcaggtctctggggtttccctctctaattttaagtaaattgacatataactactatgcttataaaaatgaagtaaggaaaacaagtagtcctgtttgccactaaaaacattttcaaaggaaaaataaaatgaaagtactttttactttttatgatactcagaaattaggatgaagaacttttaaaattgctgaagatcaaagaggttatctctgccagtcacaagtgtggctggtgtcattctgggtctgactggagccctcctggactgtttctttaatttcaaaagccctgcagacatagtacctggtcagaactatgcctcggtttatttatcattttgaaataaaatcagaatttcaacctgt

SEQ ID NO: 204362 - DNA, 4939 bp, Homo sapiens
  Payload ID: 20307
  Gene Name: zinc finger, CCHC domain containing 6
  Uniprot ID: Q5VYS8
  ENST ID: ENST00000375960
  CDS Start-End: 216-3995
aagtggggccgaaggaaaacacggagagggagcccggccgggacaggaagaggctggggaccgcggcgaaggtggtgagtgctcttgggcgccttctcccaacgtccctgccagactcgcctccgggctgattctccagttggtttcctggactccagagtagctgtccggcctggccccggaggtgcaaagtaagaaaattgaagtcaaagaccatgggagatacagcaaaaccttatttcgtgaagcgcactaaagaccgggggactatggatgatgatgacttcagaaggggtcacccccaacaagattatttaataatagatgaccatgctaaaggccatggcagtaaaatggaaaagggccttcaaaaaaagaagataacaccagggaactatgggaatacccccagaaaaggaccatgtgctgtttccagcaatccatatgcatttaaaaacccaatctacagtcaacccgcttggatgaatgacagccacaaagatcagagtaagagatggctgtctgatgaacatactggtaattcagacaactggagagaattcaaacctggacctagaattcctgttataaaccgacaaagaaaagactcctttcaagaaaatgaagatggttataggtggcaagacacaagaggctgcagaactgtaagacgactgtttcataaagacctaacaagcctagaaaccacgtcagaaatggaagcaggaagtcctgaaaacaagaagcagaggtccagacctaggaagccacggaagactagaaatgaggaaaatgagcaggatggagacttggaaggccctgtgatcgatgagtctgtactttcaacgaaggagctgctaggcttacagcaggctgaggagagactgaagagagactgcattgacaggctaaaaaggcgaccacgaaactaccctacagcaaagtacacctgcagactctgtgatgttttaattgaatccattgcatttgcccataagcatatcaaggaaaagaggcacaagaaaaacattaaggagaagcaagaggaagagttgctcactacgttacccccaccaacaccctcccagataaatgcagttggcattgccattgacaaagtggtacaggaatttggcttacacaatgagaacttggaacagaggctggaaattaaacgtatcatggaaaatgtgttccaacacaagttaccagattgttccctaagattatatgggtcatcctgtagcagattgggtttcaaaaattcggatgtaaacattgacatccagtttccagccattattgaaggattctcattaagcaaactagggaatttcaaccttcaagacattgaaaaagatgttgtgatctgggaacatactgacagtgctgcaggggacacaggcataacaaaagaagaggcaccaagagaaacgccgattaaaaggggacaggtgtcattaatattggatgtgaaacaccagccttcagtaccagttgggcagctctgggtggaattgctgcggttctatgctttagaatttaatttggctgatttagtgataagtattcgtgtcaaagaattggtatctcgggaattgaaggattggcccaaaaagcgcattgccattgaagatccctactctgttaaaagaaatgtggcaagaaccctaaatagtcaacctgtgtttgaatatatacttcattgtttaaggacaacatacaagtattttgctcttccacacaaaattacaaaatccagccttctaaagcctctgaatgcaattacatgtatttcagaacattctaaagaagtaataaatcatcatccagatgtacaaacaaaagatgataagctcaaaaactcagttttggcccaaggtcctggtgctaccagttcagctgcaaatacctgtaaggtacagccacttactcttaaagagactgctgaaagttttggaagcccaccaaaagaagaaatgggaaatgaacacatcagtgtccaccctgaaaactcagactgtatccaagcagatgttaactctgatgattacaagggtgataaagtataccatccagaaacaggaaggaaaaacgagaaagagaaagttggaaggaagggcaagcatctgttgactgttgatcagaaacgtggagagcatgttgtctgtggcagcacacgtaataatgagtcagagagcactttggatttagaaggcttccaaaatcccacagctaaagagtgtgagggacttgccactttagataacaaggctgatcttgatggagaaagtacagaaggtactgaggaactagaagactctctaaaccactttacccactcagtacagggccagacatcagaaatgattccctctgatgaagaggaggaggacgacgaagaagaggaggaggaagaagaacctaggctcaccattaaccaaagggaagatgaagatggcatggctaatgaagatgagttagacaacacctacactgggtcaggggatgaggacgccctatctgaagaggatgatgagttaggcgaagctgctaagtatgaagacgtgaaagaatgtggaaaacatgtagaaagagctctcctagtggaacttaataaaataagtctcaaggaagaaaatgtatgtgaagaaaaaaattcacctgtggatcagtctgattttttttatgaattcagtaaacttatcttcaccaaaggcaagggattggactgtgtcagaactattgaagaattagcaagagtcctcagaaaacattcaggtctgagaaacatcttacctattacaacagcaaaggtgccaattgtgaagttcttccatttgagaagtggtctggaagtagatatcagtttgtataacacattggcccttcataacacaaggcttttatctgcttattccgccattgatcccagagtgaagtatttgtgctataccatgaaagtatttacaaagatgtgtgatattggtgatgcatctagaggcagcttatcatcgtatgcatatactcttatggtgctatattttctccagcagaggaatccaccagtcattcctgtccttcaagagatatacaaaggtgaaaagaaacctgaaatatttgttgatggctggaatatttatttttttgatcaaatagatgaactgcctacctattggtcagaatgtggaaaaaatacagaatctgttgggcagttatggttgggccttcttcgtttctacacagaggaatttgattttaaagaacatgttattagcatcaggagaaaaagtctgcttacaacttttaagaaacagtggacctcaaaatacattgttattgaagatccctttgatttgaatcataatcttggagctggattatcaaggaaaatgacaaattttataatgaaggcttttatcaatggtagaagagtatttggtattcctgtcaagggatttccaaaggactacccctcaaaaatggaatacttttttgatccagatgtgttaactgaaggagagctggccccaaatgatagatgttgtcgaatttgtggaaaaatcggacacttcatgaaggactgtcctatgaggagaaaagtaagacggcggcgagatcaggaagatgccctgaaccaaagataccctgagaacaaggaaaaaagaagcaaagaggacaaagaaattcacaacaagtacacagaaagggaggtgtcaacaaaagaagataagcccatacagtgcacacctcagaaagccaagccaatgcgggcagctgctgacctggggagggagaagatcctcaggccaccagtagaaaaatggaagagacaggatgacaaagacttaagagaaaaacgttgttttatttgtggaagagaagggcacattaaaaaggaatgcccacagtttaaaggctcttcaggtagcctttccagtaaatatatgactcagggaaaagcctcagcgaagaggacccagcaggaatcatgagggaaggaaaatgcagcactctaaatggccactcaggcgttcctattcactcggaaaattaggttcatttcacaggacacagcagtgtagatcaggcttcaacttaacatttaagggaaatgtcagatttttttttaatttaatgaaattgttaatgaggaaaaatttttaatatagtcttatctaccacacatccccatagatttaaggattttaatagaaagacatgatgtatgtatttaagccacgttaaaagaaaaaatataactatggaccggtattcagtgaatacagtttcatggtttttaattctttcaaagcacattaaaaatggtgtgctgataaaccccaagtaaattaaccctttttccgtataaatccattttttgttttgaagaggggaaattatatttattgttgtttactgaatcctggtgtgaaagcatatcagatatgtatgaactgctactgctgtacttccgatttacggacatcattttattgctatttgtagacgtgataacatgaacatgagtacctatttatgtgggccttcagtggatgggcagtgccactcaggtctctggggtttccctctctaattttaagtaaattgacatataactactatgcttataaaaatgaagtaaggaaaacaagtagtcctgtttgccactaaaaacattttcaaaggaaaaataaaatgaaagtactttttactttttatgatactcagaaattaggatgaagaacttttaaaattgctgaagatcaaagaggttatctctgccagtcacaagtgtggctggtgtcattctgggtctgactggagccctcctggactgtttctttaatttcaaaagccctgcagacatagtacctggtcagaactatgcctcggtttatttatcattttgaaataaaatcagaatttcaacctgtaa

SEQ ID NO: 204363 - DNA, 5379 bp, Homo sapiens
  Payload ID: 20307
  Gene Name: zinc finger, CCHC domain containing 6
  Uniprot ID: Q5VYS8
  ENST ID: ENST00000375963
  CDS Start-End: 174-4661
acaggaagaggctggggaccgcggcgaaggtggtgagtgctcttgggcgccttctcccaacgtccctgccagactcgcctccgggctgattctccagttggtttcctggactccagagtagctgtccggcctggccccggaggtgcaaagtaagaaaattgaagtcaaagaccatgggagatacagcaaaaccttatttcgtgaagcgcactaaagaccgggggactatggatgatgatgacttcagaaggggtcacccccaacaagattatttaataatagatgaccatgctaaaggccatggcagtaaaatggaaaagggccttcaaaaaaagaagataacaccagggaactatgggaatacccccagaaaaggaccatgtgctgtttccagcaatccatatgcatttaaaaacccaatctacagtcaacccgcttggatgaatgacagccacaaagatcagagtaagagatggctgtctgatgaacatactggtaattcagacaactggagagaattcaaacctggacctagaattcctgttataaaccgacaaagaaaagactcctttcaagaaaatgaagatggttataggtggcaagacacaagaggctgcagaactgtaagacgactgtttcataaagacctaacaagcctagaaaccacgtcagaaatggaagcaggaagtcctgaaaacaagaagcagaggtccagacctaggaagccacggaagactagaaatgaggaaaatgagcaggatggagacttggaaggccctgtgatcgatgagtctgtactttcaacgaaggagctgctaggcttacagcaggctgaggagagactgaagagagactgcattgacaggctaaaaaggcgaccacgaaactaccctacagcaaagtacacctgcagactctgtgatgttttaattgaatccattgcatttgcccataagcatatcaaggaaaagaggcacaagaaaaacattaaggagaagcaagaggaagagttgctcactacgttacccccaccaacaccctcccagataaatgcagttggcattgccattgacaaagtggtacaggaatttggcttacacaatgagaacttggaacagaggctggaaattaaacgtatcatggaaaatgtgttccaacacaagttaccagattgttccctaagattatatgggtcatcctgtagcagattgggtttcaaaaattcggatgtaaacattgacatccagtttccagccattatgtctcagccagatgtcctcttacttgttcaagaatgtttaaagaacagtgactcctttattgatgttgatgcagacttccatgctagggtgccagtggtggtgtgcagagaaaagcaaagtggtcttctgtgtaaagtgagcgcaggaaatgaaaatgcttgtctgacaacaaagcatttaactgcccttggaaaactagaaccaaagctggttcctttggtgattgcatttaggtactgggcaaagctttgcagtatagatcgccctgaagaaggaggtctgccaccttatgtgtttgccctgatggccattttctttcttcagcagaggaaagaaccccttttgcctgtatatctaggatcatggattgaaggattctcattaagcaaactagggaatttcaaccttcaagacattgaaaaagatgttgtgatctgggaacatactgacagtgctgcaggggacacaggcataacaaaagaagaggcaccaagagaaacgccgattaaaaggggacaggtgtcattaatattggatgtgaaacaccagccttcagtaccagttgggcagctctgggtggaattgctgcggttctatgctttagaatttaatttggctgatttagtgataagtattcgtgtcaaagaattggtatctcgggaattgaaggattggcccaaaaagcgcattgccattgaagatccctactctgttaaaagaaatgtggcaagaaccctaaatagtcaacctgtgtttgaatatatacttcattgtttaaggacaacatacaagtattttgctcttccacacaaaattacaaaatccagccttctaaagcctctgaatgcaattacatgtatttcagaacattctaaagaagtaataaatcatcatccagatgtacaaacaaaagatgataagctcaaaaactcagttttggcccaaggtcctggtgctaccagttcagctgcaaatacctgtaaggtacagccacttactcttaaagagactgctgaaagttttggaagcccaccaaaagaagaaatgggaaatgaacacatcagtgtccaccctgaaaactcagactgtatccaagcagatgttaactctgatgattacaagggtgataaagtataccatccagaaacaggaaggaaaaacgagaaagagaaagttggaaggaagggcaagcatctgttgactgttgatcagaaacgtggagagcatgttgtctgtggcagcacacgtaataatgagtcagagagcactttggatttagaaggcttccaaaatcccacagctaaagagtgtgagggacttgccactttagataacaaggctgatcttgatggagaaagtacagaaggtactgaggaactagaagactctctaaaccactttacccactcagtacagggccagacatcagaaatgattccctctgatgaagaggaggaggacgacgaagaagaggaggaggaagaagaacctaggctcaccattaaccaaagggaagatgaagatggcatggctaatgaagatgagttagacaacacctacactgggtcaggggatgaggacgccctatctgaagaggatgatgagttaggcgaagctgctaagtatgaagacgtgaaagaatgtggaaaacatgtagaaagagctctcctagtggaacttaataaaataagtctcaaggaagaaaatgtatgtgaagaaaaaaattcacctgtggatcagtctgattttttttatgaattcagtaaacttatcttcaccaaaggcaagtctcctacggtagtgtgcagcttatgcaaacgagagggtcatctaaagaaggactgtcctgaagacttcaaaagaatccagctagaacctctgccaccattaacacccaagtttttaaatatcttagatcaagtctgtatccagtgttataaggatttttctccaacaattatagaagatcaggctcgtgaacatattcggcaaaacctagaaagtttcataagacaggactttccaggaactaaattgagcctgtttggctcctccaaaaatggatttgggttcaaacagagtgaccttgacgtctgtatgacaattaatggacttgaaactgctgagggattggactgtgtcagaactattgaagaattagcaagagtcctcagaaaacattcaggtctgagaaacatcttacctattacaacagcaaaggtgccaattgtgaagttcttccatttgagaagtggtctggaagtagatatcagtttgtataacacattggcccttcataacacaaggcttttatctgcttattccgccattgatcccagagtgaagtatttgtgctataccatgaaagtatttacaaagatgtgtgatattggtgatgcatctagaggcagcttatcatcgtatgcatatactcttatggtgctatattttctccagcagaggaatccaccagtcattcctgtccttcaagagatatacaaaggtgaaaagaaacctgaaatatttgttgatggctggaatatttatttttttgatcaaatagatgaactgcctacctattggtcagaatgtggaaaaaatacagaatctgttgggcagttatggttgggccttcttcgtttctacacagaggaatttgattttaaagaacatgttattagcatcaggagaaaaagtctgcttacaacttttaagaaacagtggacctcaaaatacattgttattgaagatccctttgatttgaatcataatcttggagctggattatcaaggaaaatgacaaattttataatgaaggcttttatcaatggtagaagagtatttggtattcctgtcaagggatttccaaaggactacccctcaaaaatggaatacttttttgatccagatgtgttaactgaaggagagctggccccaaatgatagatgttgtcgaatttgtggaaaaatcggacacttcatgaaggactgtcctatgaggagaaaagtaagacggcggcgagatcaggaagatgccctgaaccaaagataccctgagaacaaggaaaaaagaagcaaagaggacaaagaaattcacaacaagtacacagaaagggaggtgtcaacaaaagaagataagcccatacagtgcacacctcagaaagccaagccaatgcgggcagctgctgacctggggagggagaagatcctcaggccaccagtagaaaaatggaagagacaggatgacaaagacttaagagaaaaacgttgttttatttgtggaagagaagggcacattaaaaaggaatgcccacagtttaaaggctcttcaggtagcctttccagtaaatatatgactcagggaaaagcctcagcgaagaggacccagcaggaatcatgagggaaggaaaatgcagcactctaaatggccactcaggcgttcctattcactcggaaaattaggttcatttcacaggacacagcagtgtagatcaggcttcaacttaacatttaagggaaatgtcagatttttttttaatttaatgaaattgttaatgaggaaaaatttttaatatagtcttatctaccacacatccccatagatttaaggattttaatagaaagacatgatgtatgtatttaagccacgttaaaagaaaaaatataactatggaccggtattcagtgaatacagtttcatggtttttaattctttcaaagcacattaaaaatggtgtgctgataaaccccaagtaaattaaccctttttccgtataaatccattttttgttttgaagaggggaaattatatttattgttgtttactgaatcctggtgtgaaagcatatcagatatgtatgaactgctactgctgtacttccgatttacggacatcattttattgctatttgtagacgtgataacatgaacatgagtacctatttatgtgggccttcagtggatgggcagtgccactcaggtctctggggtttccctctctaattttaagtaaattgacatataactactatgcttataaaaatgaagtaaggaaaacaagtagtcctgtttgccactaaaaacattttcaaaggaaaaataaaatgaaagtacttttt

SEQ ID NO: 204364 - DNA, 1219 bp, Homo sapiens
  Payload ID: 20308
  Gene Name: zinc finger, CCHC domain containing 7
  ENST ID: ENST00000322831
  CDS Start-End: 270-887
cctgttcgcagctgcggcagtgagtatgtgtgtgacggacccccgccgcccgcggctcgggacccctgcctaccctccttcttgcccgccgggctgtggaactagcgcgtgccccctcgccggcctcgacgtctcccgtccgcccctcactcgtggcagggcgcagctcctggagaatctgagcatggggaataaagtcaggaaggatcgcaagtgaggattatattaatatgataattagcacgcttcaaggttactgactttttatgatgtttggtggctatgagactatagaagcatacgaagatgatctttatcgagatgagtcatctagtgaactgagtgttgatagtgaggtggaatttcaactctatagccaaattcattatgcccaagatcttgatgatgtcatcagggaggaagagcatgaagaaaagaactctgggaattcggaatcttcgagtagtaaaccaaatcagaagaagctaatcgtcctttcagatagtgaggtcatccagctgtcagatgggtcagaggtcatcactttgtctgatgaagacagtatttatagatgtaaaggaaagaatgttagagttcaagcacaagaaaatgcccatggtctttcttcttctcttcaatctaatgagctggttgataagaaatgcaagagtgatattgagaagcctaaatctgaagagagatcaggtgtaatccgagaggtcatgattatagaggtcagttcaagtgaagaggaagagagcaccatttcagaaggtgataatgtggaaagctggatgctactgggatgtgaagtagatgataaagatgatgatatccttctcaaccttgtgggatgtgaaaactctgttactgaaggccaagaataaaatctttatgaactaacaagatgaattaaagatggaatgattcatttctatggttaggttttaattaatacatgggggatgattttggcactttttcaaagaatttgtttctgtgtatctgaatttgcacctactctgtaacctaactgcgatttataaaatgaaacaatctcttctaatttggcacttgataggtgctttgactttaaaaggcaagtgtatttttctgtcacgaatatcttgtcattctaaaataagtaaaaacaatggattgatgaaacttcttcactgcttttttctttgtgtataacaaatacattgatattttactg

SEQ ID NO: 204365 - DNA, 2619 bp, Homo sapiens
  Payload ID: 20308
  Gene Name: zinc finger, CCHC domain containing 7
  Uniprot ID: Q8N3Z6
  ENST ID: ENST00000336755
  CDS Start-End: 107-1738
ctccttacctcatttgtcctcgcccctccccgtccctctacgcgttttggttcccggttggtgcttcctgttcgcagctgcggcacttcaaggttactgactttttatgatgtttggtggctatgagactatagaagcatacgaagatgatctttatcgagatgagtcatctagtgaactgagtgttgatagtgaggtggaatttcaactctatagccaaattcattatgcccaagatcttgatgatgtcatcagggaggaagagcatgaagaaaagaactctgggaattcggaatcttcgagtagtaaaccaaatcagaagaagctaatcgtcctttcagatagtgaggtcatccagctgtcagatgggtcagaggtcatcactttgtctgatgaagacagtatttatagatgtaaaggaaagaatgttagagttcaagcacaagaaaatgcccatggtctttcttcttctcttcaatctaatgagctggttgataagaaatgcaagagtgatattgagaagcctaaatctgaagagagatcaggtgtaatccgagaggtcatgattatagaggtcagttcaagtgaagaggaagagagcaccatttcagaaggtgataatgtggaaagctggatgctactgggatgtgaagtagatgataaagatgatgatatccttctcaaccttgtgggatgtgaaaactctgttactgaaggagaagatggtataaactggtccatcagtgacaaagacattgaggcccagatagctaataaccgaacacctggaagatggacccagcggtactattcagccaacaaaaacattatctgtagaaattgtgacaaacgtggtcatttatcaaaaaactgccccttaccacgaaaagttcgtcgctgcttcctgtgctccaggagaggacatctcctgtattcctgtccagcccccctttgcgaatactgtcctgtgcctaagatgttggaccactcatgtcttttcagacattcctgggataaacagtgtgaccgatgtcatatgctaggccactatacagatgcttgcacagaaatctggaggcagtatcacctaacgaccaaacctggaccacccaaaaagccgaagaccccttcaagaccatcagccttagcatattgctatcactgcgcgcaaaaaggccattatggacacgaatgtccagaaagagaagtgtatgacccgtctccagtatctccattcatctgctactatgatgacaaatatgaaattcaggagagagaaaagagactaaaacaaaaaataaaagtactcaagaaaaatggggttatcccagagccatccaagctaccttatataaaagcagcaaatgagaacccccaccatgatataaggaagggccgtgcctcatggaaaagcaacaggtggcctcaagaaaataaagaaacacaaaaagaaatgaagaacaagaatagaaactgggagaagcacaggaaggctgacagacatcgtgaagtggatgaggattttcccaggggccccaaaacctactcttctcctggcagttttaaaacccagaagccttctaagccctttcaccgttcatcacattaccacacgtcaagagaagacaagtctcccaaggaaggcaagaggggcaagcagaagaaaaaggagaggtgctgggaagatgatgacaatgataacttatttcttattaagcagagaaaaaaaaagtcttaagccgtcaggcagcctctgatgtggcttttcattgttcatttggcctttgtgtctataaccttctggcactgtgtttattatctatgattaaataaagtgagtttttggttttgtttttttaatttcagccattcctagagttactgaatatccatggagatctcaattctctgtgtccaacaggatattaggtaagaaagtacaaagataaacctggacttctcctattccaatatgtcatctttactcagaatcctagggataggtagaagaattcatcttttcaagaaagtgttttaaaaatactttgggaaaaaaactgcatcaaaggtaatttatcctcaaattaaatccttgcaggaagagaaattaacactaagaaaaagtcatcaatatttttcaactttttttttttttttttttactttggaaaggacaataactataaacctatatccagattttctttctgctgaagctgttgtcagaatcttcctttggacaaaacatcactagctgactataaaaacaaaagtgtcatcattgaagccctgaagaggcagggaattgagcttcagcaaaatacaggaaaagaactatccagtataaatgtcagaagacagatttcctaaacaagtaaaagagacatcaaaaattttaacataatcacaatgaaatcattttttaccacttttacagcggtgtttcaagcggactgtcactcagatctgcagagatgaatattactcaaaaaatttttttgttctcttgcatttttttcaactaccgcaaagctatacagatttttttgtacttgtggatcttttgtacttctcataacctaatgtcagactaagaaaaataaaatatctgagagtaaa

SEQ ID NO: 204366 - DNA, 2828 bp, Homo sapiens
  Payload ID: 20308
  Gene Name: zinc finger, CCHC domain containing 7
  Uniprot ID: Q8N3Z6
  ENST ID: ENST00000534928
  CDS Start-End: 319-1950
ggtgcttcctgttcgcagctgcggcagtgagtatgtgtgtgacggacccccgccgcccgcggctcgggacccctgcctaccctccttcttgcccgccgggctgtggaactagcgcgtgccccctcgccggcctcgacgtctcccgtccgcccctcactcgtggcagggcgcagctcctggtccgtcacctgcgcgccgccccacgcggccgggctgcgggtctagggggtccgcgtctccctggctttccaagggctaatgccgtgattctagagcggctgggcgtctagggcctcgcttcaaggttactgactttttatgatgtttggtggctatgagactatagaagcatacgaagatgatctttatcgagatgagtcatctagtgaactgagtgttgatagtgaggtggaatttcaactctatagccaaattcattatgcccaagatcttgatgatgtcatcagggaggaagagcatgaagaaaagaactctgggaattcggaatcttcgagtagtaaaccaaatcagaagaagctaatcgtcctttcagatagtgaggtcatccagctgtcagatgggtcagaggtcatcactttgtctgatgaagacagtatttatagatgtaaaggaaagaatgttagagttcaagcacaagaaaatgcccatggtctttcttcttctcttcaatctaatgagctggttgataagaaatgcaagagtgatattgagaagcctaaatctgaagagagatcaggtgtaatccgagaggtcatgattatagaggtcagttcaagtgaagaggaagagagcaccatttcagaaggtgataatgtggaaagctggatgctactgggatgtgaagtagatgataaagatgatgatatccttctcaaccttgtgggatgtgaaaactctgttactgaaggagaagatggtataaactggtccatcagtgacaaagacattgaggcccagatagctaataaccgaacacctggaagatggacccagcggtactattcagccaacaaaaacattatctgtagaaattgtgacaaacgtggtcatttatcaaaaaactgccccttaccacgaaaagttcgtcgctgcttcctgtgctccaggagaggacatctcctgtattcctgtccagcccccctttgcgaatactgtcctgtgcctaagatgttggaccactcatgtcttttcagacattcctgggataaacagtgtgaccgatgtcatatgctaggccactatacagatgcttgcacagaaatctggaggcagtatcacctaacgaccaaacctggaccacccaaaaagccgaagaccccttcaagaccatcagccttagcatattgctatcactgcgcgcaaaaaggccattatggacacgaatgtccagaaagagaagtgtatgacccgtctccagtatctccattcatctgctactatgatgacaaatatgaaattcaggagagagaaaagagactaaaacaaaaaataaaagtactcaagaaaaatggggttatcccagagccatccaagctaccttatataaaagcagcaaatgagaacccccaccatgatataaggaagggccgtgcctcatggaaaagcaacaggtggcctcaagaaaataaagaaacacaaaaagaaatgaagaacaagaatagaaactgggagaagcacaggaaggctgacagacatcgtgaagtggatgaggattttcccaggggccccaaaacctactcttctcctggcagttttaaaacccagaagccttctaagccctttcaccgttcatcacattaccacacgtcaagagaagacaagtctcccaaggaaggcaagaggggcaagcagaagaaaaaggagaggtgctgggaagatgatgacaatgataacttatttcttattaagcagagaaaaaaaaagtcttaagccgtcaggcagcctctgatgtggcttttcattgttcatttggcctttgtgtctataaccttctggcactgtgtttattatctatgattaaataaagtgagtttttggttttgtttttttaatttcagccattcctagagttactgaatatccatggagatctcaattctctgtgtccaacaggatattaggtaagaaagtacaaagataaacctggacttctcctattccaatatgtcatctttactcagaatcctagggataggtagaagaattcatcttttcaagaaagtgttttaaaaatactttgggaaaaaaactgcatcaaaggtaatttatcctcaaattaaatccttgcaggaagagaaattaacactaagaaaaagtcatcaatatttttcaactttttttttttttttttttactttggaaaggacaataactataaacctatatccagattttctttctgctgaagctgttgtcagaatcttcctttggacaaaacatcactagctgactataaaaacaaaagtgtcatcattgaagccctgaagaggcagggaattgagcttcagcaaaatacaggaaaagaactatccagtataaatgtcagaagacagatttcctaaacaagtaaaagagacatcaaaaattttaacataatcacaatgaaatcattttttaccacttttacagcggtgtttcaagcggactgtcactcagatctgcagagatgaatattactcaaaaaatttttttgttctcttgcatttttttcaactaccgcaaagctatacagatttttttgtacttgtggatcttttgtacttctcataacctaatgtcagactaagaaaaataaaatatctgagagt

SEQ ID NO: 204367 - DNA, 1252 bp, Homo sapiens
  Payload ID: 20309
  Gene Name: zinc finger, CCHC domain containing 8
  ENST ID: ENST00000536663
  CDS Start-End: 698-1252
aggtgatgaaataccggctgcttagacgcgggatcggtttttataccggggcaaacgctagtggtcccagaatgcagagttgggggcctcaaggaatccgggtgtgctgagataattggttaattgcttgattaaaattggggattaattttagagttcttccactcggagctcgcttctgtgctgaagatgctttgcaacgccttgaggaaaacgcgccaaagaagtttctgttagacttgagttacaagattgcagatttttcttgatttgctatggaatattggtgaacgatactaagttagatggacctatattacagattctattcatgaacaatgctatttcaaatttcatatttatattggtgtttccttatgtacgtattaagaatctctgggaggaggatgtggaagacctgaatatatggactatctttgtgttgcagaaatagatggccaagagacagggcaatatcatcaagaaatagaggaatttgtatcaaatttagtaaaaagatttgaggaacagcagaaaaatgatgtggaaaagacttcctttaatcttttgccccagccatccagtattgtgctagaggaggaccacaaagtggaagagtcctgtgccattaaaaacaacaaggaagctttcagtgccaaagcctcactgtttcaattgtggttctgaagaacaccaaatgaaagattgcccaatgcctcggaatgctgctcgaataagtgaaaagagaaaagagtatatggatgcctgtggagaagcaaacaatcagaatttccagcagcgataccacgcagaagaagtagaagaaagatttggaagattcaagccaggagttattagtgaggaacttcaagatgcactaggtgtgacagacaagagtcttccaccttttatctatcggatgcgccagctagggtacccaccagggtggctcaaagaggctgaattggagaattcggggcttgcactctatgatggaaaagatggcactgatggggaaacagaagttggagaaatacaacagaataaaagtgtcacttacgatctctcaaaattggtcaactatcctggttttaatatatctactcccagaggaattccagacgaatggaggatctttggttccataccaatgcaggcatgtcagcagaaggatgtgtttgccaattaccttacttctaacttccaagcgccaggtgtgaagtctggcaacaagaggtcttcatctcactct

SEQ ID NO: 204368 - DNA, 5663 bp, Homo sapiens
  Payload ID: 20309
  Gene Name: zinc finger, CCHC domain containing 8
  Uniprot ID: Q6NZY4
  ENST ID: ENST00000543897
  CDS Start-End: 2357-3766
ggcagcgccaggcgtggggccggggcagcgccgggcgagggcgagggcgcgggcggaagttccaggagggccagaattccaagtgctttctgtcacccgccggcggaccgagagtctagggttcggggcgcgcaggctgcctcggcgcagacctcttcccctcagggaggccgtctcctgaccagacccactcctgcctcccacccgggtgccgtgtttagggttattttaggctgctcacctgacagattgtacacaagcccttaattgcccccctctgtttgaggtcgtggtgaggtttcatatttcgcagccacgctcaaattgtgccgtcatgttacagttgtaggtgatgaaataccggctgcttagacgcgggatcggtttttataccggggcaaacgctagtggtcccagaatgcagagttgggggcctcaaggaatccgggtgtgctgagataattggttaattgcttgattaaaattggggattaattttagagttcttccactcggagctcgcttctgtgctgaagatgctttgcaacgccttgaggaaaacgcgccaaagaagtttctgttagacttgagttacaagattgcagatttttcttgatttgctagtatgtttttttttacgttcgtagagttttataggtagatagataactttggttcgggtagttttccttttaaaatttgtagagaactgaaagtggctgatatgttagcttttttagggggacggggtcggggaatggagtctcagtctgttgcccaggctggagtgcagtggcgcgatctcggctcactgcaacctccgcctcccgggttcaagcgattctcctgcctcagcctcccgaatagctgggattacaggcgcccgccacggcgcccagtcagtatatcagtttttaaggtttgtgaagcgcgatttattttttcagaatgtcgtcttcctccacattgtgaggaaaattttcagaatacaaaaagttgaggccgggcgctgtggctcaagcctgtaatcccagcactttgggaggccgaggcgggtggatcatgaggtcaggaggatcatgaggatcaggtggatcatgaggatcaggaggtcagcctggccaacatggtgaaaccccgtctctactaaaaatacaaaattagccgggcgtggtggcgcgtgcttgtaatcccagctactcaggaggctgaggcaggagaatcccttgaacctgggaggcggaggttgcagtgagccaagatcacaccattgcactccagcctgggcgacagggtgagactgtgtctcaaaaaaaaaaaaaaaaagttgaaaggattctacagtggacatccatagatttattccaaattctaaagttgttaacagctcgttatactgcattctctttatcacatagtggttgttgaaaggtttgacaggaacactgatgcttcaataatggttttggttcagtttgttagtctgttgaacttcaggatcgtgtcttagaatatatgttcgaaaggataaaaaccgtactttaattttgggtttcaaaagcctacccctgcaacaaaatagaagctcaataagtgtgtcatcctcaaaatatccgtgggtcttttgtctttataatattctgacaccaaaagtgagagaagtagtagttgaattttatgatttgcattgttaaatgagggcttatcttccttaacaaataataacatcaagaacttaaacgaaaattgaacattctgactcgaccgagtggaatattggtgaacgatactaagttagatggacctatattacagattctattcatgaacaatgctatttcaaagcaatatcatcaagaaatagaggaatttgtatcaaatttagtaaaaagatttgaggaacagcagaaaaatgatgtggaaaagacttcctttaatcttttgccccagccatccagtattgtgctagaggaggaccacaaagtggaagagtcctgtgccattaaaaacaacaaggaagctttcagtgttgtaggaagtgtcctgtattttactaatttttgccttgataaattggggcaaccgcttctaaatgaaaaccctcagctttccgaaggatgggaaatacccaagtatcctacatagtgaatgaagatcttttatgcatcttgccactaagttcacctttaaaacaatttccaaattttgcagaccatgataactattccttaataaaattcactaaaggtaccatcaagtcttcagccacattgtttctctagaagggcaagaaatacaagtaaaggcaaaaaggccaaagcctcactgtttcaattgtggttctgaagaacaccaaatgaaagattgcccaatgcctcggaatgctgctcgaataagtgaaaagagaaaagagtatatggatgcctgtggagaagcaaacaatcagaatttccagcagcgataccacgcagaagaagtagaagaaagatttggaagattcaagccaggagttattagtgaggaacttcaagatgcactaggtgtgacagacaagagtcttccaccttttatctatcggatgcgccagctagggtacccaccagggtggctcaaagaggctgaattggagaattcggggcttgcactctatgatggaaaagatggcactgatggggaaacagaagttggagaaatacaacagaataaaagtgtcacttacgatctctcaaaattggtcaactatcctggttttaatatatctactcccagaggaattccagacgaatggaggatctttggttccataccaatgcaggcatgtcagcagaaggatgtgtttgccaattaccttacttctaacttccaagcgccaggtgtgaagtctggcaacaagaggtcttcatctcactctagcccaggtagtccaaagaagcagaagaatgaaagcaactcagcgggatctcccgccgacatggagctcgattcagatatggaggtaccacatggttctcagagcagcgaaagttttcagtttcaaccaccattacctcctgacactcctccactcccccggggaactcctccacccgtcttcacccctccactcccaaagggcaccccgccgctgactcccagtgactcaccccagaccagaacagcatctggagctgtggatgaggacgcactgactctagaagaacttgaagaacagcagaggcggatctgggcagctcttgagcaggccgagagcgtaaacagcgactccgacgttcctgtggacacacctttaactggcaattccgttgcctcatcaccttgtccaaatgagctagacctccctgtcccggagggaaaaacatctgaaaagcagacgctggatgagcctgaggtaccagagatttttacaaagaaatcagaagctggacatgcctccagtccagactctgaggtgacatcactttgtcagaaggaaaaagcagagttggctccggtaaacactgaaggtgcccttcttgataatggcagtgtcgtaccaaactgtgacatcagcaatgggggcagccagaagctctttcctgcagacaccagtccttcaacggccactaaaattcatagccctatacctgacatgagcaaatttgcaactggaatcacgccatttgaatttgagaatatggcagaatctactggaatgtacctcaggataagaagcttgttaaagaactcaccccgaaaccagcagaaaaacaaaaaggcctctgaataatggcttgacttagcactgagagctatttaataactttgttccgttaattagtactaattaagtggatagatagaatggttttcctgtttgtccctcccatgtttaaaaatctatccaaggttcatgttccaaagtcaagcctattttaaagaaagactgagctcactagttcagtatattttattctcactgacaaaacttggggggagatgtgaatatgacctggtttagagagggtttgttaaggtttatactatttttggattgtgactatccgtcgagagtgatggtttttatctgtcttttgtacattgttttccctttctacattttgctaattatcctgtatataagtttaatatatcactttttaaaagaaaaaattctaccattttaaattcatgtttcaactcctacaaccaaatgagaaaaatcagggatgagcagctttatcccatttggggtatttttgtaagtgatttacatgtgtcaattttagtaatacttttacttttttgtaacttcatccttcatatatgcttgctatacaggtatgttcatctttgtgtacagaggtttaataaattagttttcatatacataatctaagactttgaatacaaaaaagtgattcacaggtaaaatcagtgtatataaccttttttttttttgagacaagggtttcactcttgttgcccaggctggagtgcaatggcacaatctcggctcaccgcaacctccgcctcccgagtttaagcgattctcctgcctcagcctccggagtagctgggattacaggcatgtgccaccacgcccagctaacttcgtatttttagtagagatggggtttctccacgtcgggtcaggctggtcttgacctcctgacttcaggtgatctgcccgcccagcctcccaaagtgctgggattacaggcgtaagccacctcacctggccggtgcatataacttttaagtttaaaagtaaattgttggccaggcgtggtggctcatgcttataatcctagcactttgggaggccaaggaggaaggatcacctgaggtcaggagttcgagaccagcctggccaacatggcaaaaccccatctctacataaatacaaaaattagccaggtgtggtggtacatgcctgtaatcccagctactcgggaggctgaggcaggagaatcacttgaacctgggagtgggaggttgcagtgagccgaggtcgcgccattgcactccagcctgggcaacaagagcaaaactccatctcaaaaaaaaaaaaaaaaaaaggtaaattgtaaaaatcagtggtagcaaaacaaaaataatgataggaattgcaagtttgggtgttttcagtggatttcagccttaaatatagaaacagcagaatttttgaaaagtaattattttgaaaaatgaatggcatgcagctagcctttgtataaaaataattttctagatttgaaccctaatagttaaaaattaaaaattaaacataaacatactgcttttaattgtcaggtatatatataagatagagctgaaactgtggtttaggtctttctgtggaatgccattacatctttatattagtcaagtccatgaaaataaatgtttagatcgtcttgaattgttagtctcaggcagtgttatcctgctctcaggccaacagggggagcaaaatagaaacattccagatatagctttcatttttgagaacttgagtaatcagaatttactgttctgtaaagaataaaggaaaggaaaattataaagagagaaatttctttttaaagccctcacagaatgtgctagaaatagaataaaatttaaaatacttttggcttcttttcctcagcttaagttcaaaataaaagcaatcctttacagtt

SEQ ID NO: 204369 - DNA, 1250 bp, Homo sapiens
  Payload ID: 20309
  Gene Name: zinc finger, CCHC domain containing 8
  ENST ID: ENST00000540586
  CDS Start-End: 1136-1250
attccaagtgctttctgtcacccgccggcggaccgagagtctagggttcggggcgcgcaggctgcctcggcgcagacctcttcccctcagggaggccgtctcctgaccagacccactcctgcctcccacccgggtgccgtgtttagggttattttaggctgctcacctgacagattgtacacaagcccttaattgcccccctctgtttgaggtcgtggtgaggtttcatatttcgcagccacgctcaaattgtgccgtcatgttacagttgtaggtgatgaaataccggctgcttagacgcgggatcggtttttataccggggcaaacgctagtggtcccagaatgcagagttgggggcctcaaggaatccgggtgtgctgagataattggttaattgcttgattaaaattggggattaattttagagttcttccactcggagctcgcttctgtgctgaagatgctttgcaacgccttgaggaaaacgcgccaaagaagtttctgttagacttgagttacaagattgcagatttttcttgatttgctatggaatattggtgaacgatactaagttagatggacctatattacagattctattcatgaacaatgctatttcaaagcaatatcatcaagaaatagaggaatttgtatcaaatttagtaaaaagatttgaggaacagcagaaaaatgatgtggaaaagacttcctttaatcttttgccccagccatccagtattgtgctagaggaggaccacaaagtggaagagtcctgtgccattaaaaacaacaaggaagctttcagtgttgtaggaagtgtcctgtattttactaatttttgccttgataaattggggcaaccgcttctaaatgaaaaccctcagctttccgaaggatgggaaatacccaagtatcctacatagtgaatgaagatcttttatgcatcttgccactaagttcacctttaaaacaatttccaaattttgcagaccatgataactattccttaataaaattcactaaaggtaccatcaagtcttcagccacattgtttctctagaagggcaagaaatacaagtaaaggcaaaaaggccaaagcctcactgtttcaattgtggttctgaagaacaccaaatgaaagattgcccaatgcctcggaatgctgctcgaataagtgaaaagagaaaagagtatatggatgcctgtggagaagcaaacaatcagaatttccagcagcgataccacgcag

SEQ ID NO: 204370 - DNA, 1561 bp, Homo sapiens
  Payload ID: 20309
  Gene Name: zinc finger, CCHC domain containing 8
  ENST ID: ENST00000544054
  CDS Start-End: 928-1561
caagattgcaccactgtactccagcctgggcaacagagaccctatctcaaaacaaacaaaaaagtgtatgtgtgtgtgttcggtgtatgtgtaaagagagagagaggcagacaaaaatgttaaactattaacagttgtttaggtgaaggatacattgggtattcattgtaccacttttccaacttgtctgtatggaattttttcaaaaagaactggagggataagaaaagagtaaatgggaagaaaggaaatggaaacaataactaaagggtctgcatgtcttgcaaagagaagcaatgaaatggggcattggagggaaatatgagagtcaaggttttcattttttgtttgaattctgtagagaatgcagctgatagtcatgatccaatacagaggaaaaactgatctagcagagagagggaactgacgatgtagtttctacttacacatcaaagtctggctccttaataacaaggaagttattatttctaataattccatccaaaaataaattgttaaaacagttaatcataatcttacattatttaatgtctttttttctgcttaaatagcaatattttttgacttgttttctgcaggttgtaggaagtgtcctgtattttactaatttttgccttgataaattggggcaaccgcttctaaatgaaaaccctcagctttccgaaggatgggaaatacccaagtatcctacatagtgaatgaagatcttttatgcatcttgccactaagttcacctttaaaacaatttccaaattttgcagaccatgataactattccttaataaaattcactaaaggtaccatcaagtcttcagccacattgtttctctagaagggcaagaaatacaagtaaaggcaaaaaggccaaagcctcactgtttcaattgtggttctgaagaacaccaaatgaaagattgcccaatgcctcggaatgctgctcgaataagtgaaaagagaaaagagtatatggatgcctgtggagaagcaaacaatcagaatttccagcagcgataccacgcagaagaagtagaagaaagatttggaagattcaagccaggagttattagtgaggaacttcaagatgcactaggtgtgacagacaagagtcttccaccttttatctatcggatgcgccagctagggtacccaccagggtggctcaaagaggctgaattggagaattcggggcttgcactctatgatggaaaagatggcactgatggggaaacagaagttggagaaatacaacagaataaaagtgtcacttacgatctctcaaaattggtcaactatcctggttttaatatatctactcccagaggaattccagacgaatggaggatctttggttccataccaatgcaggcatgtcagcagaaggatgtgtttgccaattaccttacttctaacttccaagcgccaggtgtgaagtctggcaacaagaggtcttcatctcactctagcccaggtagtccaaagaagcagaagaatgaaagcaactcagcgggatctcccgccgacatggagctcgattcaggta

SEQ ID NO: 204371 - DNA, 2904 bp, Homo sapiens
  Payload ID: 20309
  Gene Name: zinc finger, CCHC domain containing 8
  Uniprot ID: Q6NZY4
  ENST ID: ENST00000536306
  CDS Start-End: 868-2277
ttgcactccagcctgggcgacagggtgagactgtgtctcaaaaaaaaaaaaaaaaagttgaaaggattctacagtggacatccatagatttattccaaattctaaagttgttaacagctcgttatactgcattctctttatcacatagtggttgttgaaaggtttgacaggaacactgatgcttcaataatggttttggttcagtttgttagtctgttgaacttcaggatcgtgtcttagaatatatgttcgaaaggataaaaaccgtactttaattttgggtttcaaaagcctacccctgcaacaaaatagaagctcaataagtgtgtcatcctcaaaatatccgtgggtcttttgtctttataatattctgacaccaaaagtgagagaagtagtagttgaattttatgatttgcattgttaaatgagggcttatcttccttaacaaataataacatcaagaacttaaacgaaaattgaacattctgactcgaccgagtggaatattggtgaacgatactaagttagatggacctatattacagattctattcatgaacaatgctatttcaaagcaatatcatcaagaaatagaggaatttgtatcaaatttagtaaaaagatttgaggaacagcagaaaaatgatgtggaaaagacttcctttaatcttttgccccagccatccagtattgtgctagaggaggaccacaaagtggaagagtcctgtgccattaaaaacaacaaggaagctttcagtgtaccatcaagtcttcagccacattgtttctctagaagggcaagaaatacaagtaaaggcaaaaaggccaaagcctcactgtttcaattgtggttctgaagaacaccaaatgaaagattgcccaatgcctcggaatgctgctcgaataagtgaaaagagaaaagagtatatggatgcctgtggagaagcaaacaatcagaatttccagcagcgataccacgcagaagaagtagaagaaagatttggaagattcaagccaggagttattagtgaggaacttcaagatgcactaggtgtgacagacaagagtcttccaccttttatctatcggatgcgccagctagggtacccaccagggtggctcaaagaggctgaattggagaattcggggcttgcactctatgatggaaaagatggcactgatggggaaacagaagttggagaaatacaacagaataaaagtgtcacttacgatctctcaaaattggtcaactatcctggttttaatatatctactcccagaggaattccagacgaatggaggatctttggttccataccaatgcaggcatgtcagcagaaggatgtgtttgccaattaccttacttctaacttccaagcgccaggtgtgaagtctggcaacaagaggtcttcatctcactctagcccaggtagtccaaagaagcagaagaatgaaagcaactcagcgggatctcccgccgacatggagctcgattcagatatggaggtaccacatggttctcagagcagcgaaagttttcagtttcaaccaccattacctcctgacactcctccactcccccggggaactcctccacccgtcttcacccctccactcccaaagggcaccccgccgctgactcccagtgactcaccccagaccagaacagcatctggagctgtggatgaggacgcactgactctagaagaacttgaagaacagcagaggcggatctgggcagctcttgagcaggccgagagcgtaaacagcgactccgacgttcctgtggacacacctttaactggcaattccgttgcctcatcaccttgtccaaatgagctagacctccctgtcccggagggaaaaacatctgaaaagcagacgctggatgagcctgaggtaccagagatttttacaaagaaatcagaagctggacatgcctccagtccagactctgaggtgacatcactttgtcagaaggaaaaagcagagttggctccggtaaacactgaaggtgcccttcttgataatggcagtgtcgtaccaaactgtgacatcagcaatgggggcagccagaagctctttcctgcagacaccagtccttcaacggccactaaaattcatagccctatacctgacatgagcaaatttgcaactggaatcacgccatttgaatttgagaatatggcagaatctactggaatgtacctcaggataagaagcttgttaaagaactcaccccgaaaccagcagaaaaacaaaaaggcctctgaataatggcttgacttagcactgagagctatttaataactttgttccgttaattagtactaattaagtggatagatagaatggttttcctgtttgtccctcccatgtttaaaaatctatccaaggttcatgttccaaagtcaagcctattttaaagaaagactgagctcactagttcagtatattttattctcactgacaaaacttggggggagatgtgaatatgacctggtttagagagggtttgttaaggtttatactatttttggattgtgactatccgtcgagagtgatggtttttatctgtcttttgtacattgttttccctttctacattttgctaattatcctgtatataagtttaatatatcactttttaaaagaaaaaattctaccattttaaattcatgtttcaactcctacaaccaaatgagaaaaatcagggatgagcagctttatcccatttggggtatttttgtaagtgatttacatgtgtcaattttagtaatacttttacttttttgtaacttcatccttcatatatgcttgctatacaggtatgttcatctttgtgtacagaggtttaataaattagttttcatatacataatctaagactttgaatacaaaaaa

SEQ ID NO: 204372 - DNA, 2955 bp, Homo sapiens
  Payload ID: 20309
  Gene Name: zinc finger, CCHC domain containing 8
  Uniprot ID: Q6NZY4
  ENST ID: ENST00000633063
  CDS Start-End: 234-2357
atgccgtcctccgggcaatcgcaagcccgataggccccgctgcattccgggagttgtagtctctagcgactggccccgccccgtgtgcagctttcgcggcctgcgtctggagaaaaccctagcgggtggctccgtgcggccagagctctagagagtggtgccgccttccaaccttcttccccaagccctggtggccggctccgcctcttctcgaatcttttccacagcccaaaatggccgcagaggtgtattttggcgatctagagctcttcgagccgttcgaccacccagaggagtcgattccgaagcccgttcacactcgcttcaaggacgacgacggcgacgaggaggacgaaaatggggtcggcgacgcggagctacgggagcggcttcggcagtgcgaggagaccatcgagcagctccgcgccgagaatcaagaacttaaacgaaaattgaacattctgactcgaccgagtggaatattggtgaacgatactaagttagatggacctatattacagattctattcatgaacaatgctatttcaaagcaatatcatcaagaaatagaggaatttgtatcaaatttagtaaaaagatttgaggaacagcagaaaaatgatgtggaaaagacttcctttaatcttttgccccagccatccagtattgtgctagaggaggaccacaaagtggaagagtcctgtgccattaaaaacaacaaggaagctttcagtgttgtaggaagtgtcctgtattttactaatttttgccttgataaattggggcaaccgcttctaaatgaaaaccctcagctttccgaaggatgggaaatacccaagtaccatcaagtcttcagccacattgtttctctagaagggcaagaaatacaagtaaaggcaaaaaggccaaagcctcactgtttcaattgtggttctgaagaacaccaaatgaaagattgcccaatgcctcggaatgctgctcgaataagtgaaaagagaaaagagtatatggatgcctgtggagaagcaaacaatcagaatttccagcagcgataccacgcagaagaagtagaagaaagatttggaagattcaagccaggagttattagtgaggaacttcaagatgcactaggtgtgacagacaagagtcttccaccttttatctatcggatgcgccagctagggtacccaccagggtggctcaaagaggctgaattggagaattcggggcttgcactctatgatggaaaagatggcactgatggggaaacagaagttggagaaatacaacagaataaaagtgtcacttacgatctctcaaaattggtcaactatcctggttttaatatatctactcccagaggaattccagacgaatggaggatctttggttccataccaatgcaggcatgtcagcagaaggatgtgtttgccaattaccttacttctaacttccaagcgccaggtgtgaagtctggcaacaagaggtcttcatctcactctagcccaggtagtccaaagaagcagaagaatgaaagcaactcagcgggatctcccgccgacatggagctcgattcagatatggaggtaccacatggttctcagagcagcgaaagttttcagtttcaaccaccattacctcctgacactcctccactcccccggggaactcctccacccgtcttcacccctccactcccaaagggcaccccgccgctgactcccagtgactcaccccagaccagaacagcatctggagctgtggatgaggacgcactgactctagaagaacttgaagaacagcagaggcggatctgggcagctcttgagcaggccgagagcgtaaacagcgactccgacgttcctgtggacacacctttaactggcaattccgttgcctcatcaccttgtccaaatgagctagacctccctgtcccggagggaaaaacatctgaaaagcagacgctggatgagcctgaggtaccagagatttttacaaagaaatcagaagctggacatgcctccagtccagactctgaggtgacatcactttgtcagaaggaaaaagcagagttggctccggtaaacactgaaggtgcccttcttgataatggcagtgtcgtaccaaactgtgacatcagcaatgggggcagccagaagctctttcctgcagacaccagtccttcaacggccactaaaattcatagccctatacctgacatgagcaaatttgcaactggaatcacgccatttgaatttgagaatatggcagaatctactggaatgtacctcaggataagaagcttgttaaagaactcaccccgaaaccagcagaaaaacaaaaaggcctctgaataatggcttgacttagcactgagagctatttaataactttgttccgttaattagtactaattaagtggatagatagaatggttttcctgtttgtccctcccatgtttaaaaatctatccaaggttcatgttccaaagtcaagcctattttaaagaaagactgagctcactagttcagtatattttattctcactgacaaaacttggggggagatgtgaatatgacctggtttagagagggtttgttaaggtttatactatttttggattgtgactatccgtcgagagtgatggtttttatctgtcttttgtacattgttttccctttctacattttgctaattatcctgtatataagtttaatatatcactttttaaaagaaaaaattctaccattttaaattcatgtttcaactcctacaaccaaatgagaaaaatcagggatgagcagctttatcccatttggggtatttttgtaagtgatttacatgtgtcaattttagtaatacttttacttttttgtaacttcatccttcatatatgcttgctatacaggtatgttcatctttgtgtacagaggtttaataaattagttttcatat

SEQ ID NO: 204373 - DNA, 4606 bp, Homo sapiens
  Payload ID: 20310
  Gene Name: zinc finger, CCHC domain containing 9
  Uniprot ID: Q8N567
  ENST ID: ENST00000254037
  CDS Start-End: 3156-3971
ctccaataccgcaggagggcggtcttccccggctcgccaactcggctgctctgggggattcgtgcgcggtaagaagctgcgcggtagcgcggtgaggtgaggttctcagccaccaaagctgcagggtctcgtcgttcgttccctctggcctggcggaacttgcgtgggaagctgggaggacagaaggcttagccgctgggtccctgagctggctggagcgcgggctgtctaggggcggcgacctcagctgttgggctccggctgctgggggctgtgcgtccagccgccctggaatccgcctgtgggtgggccgcttggctctcccacttcaccctcttgataacccagagcctcccccttcccacgtacgtaggggaaggataatctacttccttttgaacagcttcggtccccactatgacagtcgcataaacttcagcgaagagtgcgctggtaaagtggcatggagtttctcacaccaattcattgggtccacccttcagcttctgtggaaggggtctttctgttactaggagctgagacttggggggttgccagggatgctggtcttaaaaggtgataatttaggccgggcgcggtggctcacgcctgtaatcccagcactttgggaggtcgaggcgggcagatctcctgagctcaggagttcgagaccaccctgggcaacatggtgaaaccccttctctactaaaatacaaaaaattagctgggcgtggtggcacgcgcctgtaatcccagctattcgggaggctgaggcccgagaatcgcttgagccctggcggcagaggttgcagtgagccaagatcgcccactgcactccaggttgggctacagagtgagactccgtctcaacaacgaccacaacaacaacaaaaaaggtggtggcttaatacagccatgctccccttaagaactggtatagttatgagaaatggttgggccgtttcgtggttgtgtgaacatcatagtgtacttgcacaaacctacacagctgggccgtatgggatagcctgttactcctagtctacagacctgtacagtataactactaaatactgtaggcagttgtaaaaggatggtgtgtatctaaacacagaaaagatactgtaaaaatatagtgtaaaagaaaacatggtacagctgaatagggcacttacgcatggagcttgcagggctgtcggtagctattaagtgagtcagtgagtggtatgtgagtgtgaaggcctacgatattatttagggtattactgtacactactgtagactttataaatgcggtatgcttagtctaagtttattaaaaataaggtaataaccttagcttactgtgcttttttaactttataaacttttaaattaattttaactccttgaccttttttttttttttttgagacggagtttattctctctgtctctcatttttgagacagagttttgctcttgtcacccaggctggagtgcagtggcgcaatctcagctcactgcaacgtccacctcttgagttcaagcgattctcctgcctcagcttcccaggtggtgcgcgcctgtagctgggactacaagagtgcgccaccacgcccagctaatttttgtatttttagtagagatggggtttgaccatgttggccaggatggtctcgatatcctgaccttgtgatccacctggccttggcctcccaaagtgctgggattacaggcgtgagccaccatacccggcccactcttttgtaataacacttagcttaaaatgctaatgtgttgtatagctatataaaaatattttctttattcccttacattattctatagctttttcctgtaaaaattttttttgttgttataaactaagacacacacattgtgcctacaccgggtcaggagcatcaatatcactcttttcttcctccacatcttgtcctactggaaggttttcaggggcagtaacatgaatggagctgtcatctcctataataactgcttttttctggaatacttataattgtctagtattatgtacagtacatcattgtaagcattatgcttgtatatgactggcatcccaggtttgtttacaccagcattaccacagacatgagtaatgtgttacactacaagttatgagggctacaaagtcaataggaatttttcagctccattataatcatctgagaccagtatcatgtgtgcagtcgctgttgacctaaatgttatgtagcatgtgactagctgatgaatctttgattatggctgaatgttctcattcattgcaggaaaaaaatatcctccaaatcactaggtagtatgtaagtgaccaaaacttttttccattttatgttggagccaaatcattagtgttaggataaattacttctttatgtatgtgctctaaaatgaaaagttatttctgaatattaaagcatatgtattaagagtataaaaacaagatacagattttggtgtgaaatatatcttatgattcaagtcataatttaaatagaattgaagatgatgtgaaatcactgggctggaagtagcttataccttgattagtaagaggaagcccgggatcatcctgtgatggtaaacacttttatatgttttacttataactttgccaggaaatttcaacaaacttcatattaaaggacatgatttctgtatacttagtaatctgctatgcaaattgttgcattgaaatggcagacgaagcaagaagattgggagaaagtagctgtgggacttggagataggaaaataaacagccgggaaaactgcagaatgtgggaggaataattgcattcattgtattactatctgatttatattttatgaaataatttggtttcttaagatagtttttcaattttaagcacaccttttttaactggtgtggcagcttttctggtaagtggtagatttatgttagaagcatgtctatgcagcatattatagcattaaatatgtatacagatatctaactgaaataaaaagtgttttaataattaaaagtttaacatatgggcatatgtgacatatagtgatatagcatgtctctttagttttgttgtttttgttgttgatggctaaccacccatgcttgtcttaaaaattgataaggtaccactgatgaaattatgaccaggtgggcccgagttagtaccacatataacaagagacccttgcctgcaacatcatgggaggacatgaagaagggatcctttgagggaacaagccaaaacctaccaaagcgtaaacaacttgaagccaataggctatccctcaaaaatgatgcaccccaagcaaaacataaaaagaacaaaaagaaaaaagagtacttaaatgaagatgtgaatggattcatggaatacctaagacagaattcacagatggttcacaatgggcaaattatagcaacagacagtgaggaagtaagggaagaaattgcagttgctttaaagaaagacagtcgacgggaaggaagaagattaaaaagacaagcggcaaagaaaaatgcaatggtgtgtttccattgtagaaaacctggtcatggaattgcagattgccccgccgcccttgaaaatcaagacatgggcactgggatatgttacaggtgtgggtccacagagcacgaaataaccaagtgtaaggctaaagtagacccggctcttggcgaatttccttttgcaaaatgttttgtttgtggagaaatggggcacctgtctagatcttgtcctgataatcccaaaggactctatgctgatggtggcggttgcaaactttgtggctctgtggaacatttaaagaaagattgccctgaaagtcagaattcagagcgaatggtcacagttggtcgctgggcaaagggaatgagtgcagactatgaagaaattttggatgtacctaaaccgcaaaaacccaaaacaaaaatacctaaagttgttaatttttgataacagctagcactatcatgagttactacctcattgttactttctaaaccaggcccgcttcacgagttagagttgagctcccctgtagccaggactatgctgtagatatcagtatgatctgggtgtggccaaaaacaattttctttattctgtctatcaaatagtacttctaccactgtttggagaaaattgaagaaaagaataagatgattaaatgaattctctaaaagaacatattttaagagacagaacttagacataaccaagtagttgtatacctgattgtaacaatcatcttttataaaagcaaaattatgcataaatgtaaaacacccctaaacaaagggaacaaatgaatttttggttatattgttttcttggctcaaagtatcaatttattattataatagaaatttataagttgctagaaagtctatatttttaaagtacggaataaaaatatgttttctattaagcaatagaaatatttttgtgtataatttttctgaatacttgattctcgattgaaatatccattgttcgttaatatccatgtaacaatcccattggaaacaagattttttttgaatcctagatgagaataaacagggatttggtttttgttttagttttga

SEQ ID NO: 204374 - DNA, 1372 bp, Homo sapiens
  Payload ID: 20310
  Gene Name: zinc finger, CCHC domain containing 9
  Uniprot ID: Q8N567
  ENST ID: ENST00000380199
  CDS Start-End: 65-880
gtcttccccggctcgccaactcggctgctctgggggattcgtgcgcggtaccactgatgaaattatgaccaggtgggcccgagttagtaccacatataacaagagacccttgcctgcaacatcatgggaggacatgaagaagggatcctttgagggaacaagccaaaacctaccaaagcgtaaacaacttgaagccaataggctatccctcaaaaatgatgcaccccaagcaaaacataaaaagaacaaaaagaaaaaagagtacttaaatgaagatgtgaatggattcatggaatacctaagacagaattcacagatggttcacaatgggcaaattatagcaacagacagtgaggaagtaagggaagaaattgcagttgctttaaagaaagacagtcgacgggaaggaagaagattaaaaagacaagcggcaaagaaaaatgcaatggtgtgtttccattgtagaaaacctggtcatggaattgcagattgccccgccgcccttgaaaatcaagacatgggcactgggatatgttacaggtgtgggtccacagagcacgaaataaccaagtgtaaggctaaagtagacccggctcttggcgaatttccttttgcaaaatgttttgtttgtggagaaatggggcacctgtctagatcttgtcctgataatcccaaaggactctatgctgatggtggcggttgcaaactttgtggctctgtggaacatttaaagaaagattgccctgaaagtcagaattcagagcgaatggtcacagttggtcgctgggcaaagggaatgagtgcagactatgaagaaattttggatgtacctaaaccgcaaaaacccaaaacaaaaatacctaaagttgttaatttttgataacagctagcactatcatgagttactacctcattgttactttctaaaccaggcccgcttcacgagttagagttgagctcccctgtagccaggactatgctgtagatatcagtatgatctgggtgtggccaaaaacaattttctttattctgtctatcaaatagtacttctaccactgtttggagaaaattgaagaaaagaataagatgattaaatgaattctctaaaagaacatattttaagagacagaacttagacataaccaagtagttgtatacctgattgtaacaatcatcttttataaaagcaaaattatgcataaatgtaaaacacccctaaacaaagggaacaaatgaatttttggttatattgttttcttggctcaaagtatcaatttattattataatagaaatttataagttgctagaaagtctatatttttaaagtacggaataaaaatatgttttctattaagcaatagaaatattttt

SEQ ID NO: 204375 - DNA, 1555 bp, Homo sapiens
  Payload ID: 20310
  Gene Name: zinc finger, CCHC domain containing 9
  Uniprot ID: Q8N567
  ENST ID: ENST00000407610
  CDS Start-End: 105-920
cgcaggagggcggtcttccccggctcgccaactcggctgctctgggggattcgtgcgcggtaagaagctgcgcggtagcgcggtgaggtaccactgatgaaattatgaccaggtgggcccgagttagtaccacatataacaagagacccttgcctgcaacatcatgggaggacatgaagaagggatcctttgagggaacaagccaaaacctaccaaagcgtaaacaacttgaagccaataggctatccctcaaaaatgatgcaccccaagcaaaacataaaaagaacaaaaagaaaaaagagtacttaaatgaagatgtgaatggattcatggaatacctaagacagaattcacagatggttcacaatgggcaaattatagcaacagacagtgaggaagtaagggaagaaattgcagttgctttaaagaaagacagtcgacgggaaggaagaagattaaaaagacaagcggcaaagaaaaatgcaatggtgtgtttccattgtagaaaacctggtcatggaattgcagattgccccgccgcccttgaaaatcaagacatgggcactgggatatgttacaggtgtgggtccacagagcacgaaataaccaagtgtaaggctaaagtagacccggctcttggcgaatttccttttgcaaaatgttttgtttgtggagaaatggggcacctgtctagatcttgtcctgataatcccaaaggactctatgctgatggtggcggttgcaaactttgtggctctgtggaacatttaaagaaagattgccctgaaagtcagaattcagagcgaatggtcacagttggtcgctgggcaaagggaatgagtgcagactatgaagaaattttggatgtacctaaaccgcaaaaacccaaaacaaaaatacctaaagttgttaatttttgataacagctagcactatcatgagttactacctcattgttactttctaaaccaggcccgcttcacgagttagagttgagctcccctgtagccaggactatgctgtagatatcagtatgatctgggtgtggccaaaaacaattttctttattctgtctatcaaatagtacttctaccactgtttggagaaaattgaagaaaagaataagatgattaaatgaattctctaaaagaacatattttaagagacagaacttagacataaccaagtagttgtatacctgattgtaacaatcatcttttataaaagcaaaattatgcataaatgtaaaacacccctaaacaaagggaacaaatgaatttttggttatattgttttcttggctcaaagtatcaatttattattataatagaaatttataagttgctagaaagtctatatttttaaagtacggaataaaaatatgttttctattaagcaatagaaatatttttgtgtataatttttctgaatacttgattctcgattgaaatatccattgttcgttaatatccatgtaacaatcccattggaaacaagattttttttgaatcctagatgagaataaacagggatttggtttttgttttagttttga

SEQ ID NO: 204376 - DNA, 1248 bp, Homo sapiens
  Payload ID: 20310
  Gene Name: zinc finger, CCHC domain containing 9
  Uniprot ID: Q8N567
  ENST ID: ENST00000438268
  CDS Start-End: 433-1248
aactcggctgctctgggggattcgtgcgcggtaagaagctgcgcggtagcgcggtgaggtgaggttctcagccaccaaagctgcagggtctcgtcgttcgttccctctggcctggcggaacttgcgtgggaagctgggaggacagaaggcttagccgctgggtccctgagctggctggagcgcgggctgtctaggggcggcgacctcagctgttgggctccggctgctgggggctgtgcgtccagccgccctggaatccgcctgtgggtgggccgcttggctctcccacttcaccctcttgataacccagagcctcccccttcccacgtacgtaggggaaggataatctacttccttttgaacagcttcggtccccactatgacagtcgcataaacttcagcgaagagtgcgctggtaccactgatgaaattatgaccaggtgggcccgagttagtaccacatataacaagagacccttgcctgcaacatcatgggaggacatgaagaagggatcctttgagggaacaagccaaaacctaccaaagcgtaaacaacttgaagccaataggctatccctcaaaaatgatgcaccccaagcaaaacataaaaagaacaaaaagaaaaaagagtacttaaatgaagatgtgaatggattcatggaatacctaagacagaattcacagatggttcacaatgggcaaattatagcaacagacagtgaggaagtaagggaagaaattgcagttgctttaaagaaagacagtcgacgggaaggaagaagattaaaaagacaagcggcaaagaaaaatgcaatggtgtgtttccattgtagaaaacctggtcatggaattgcagattgccccgccgcccttgaaaatcaagacatgggcactgggatatgttacaggtgtgggtccacagagcacgaaataaccaagtgtaaggctaaagtagacccggctcttggcgaatttccttttgcaaaatgttttgtttgtggagaaatggggcacctgtctagatcttgtcctgataatcccaaaggactctatgctgatggtggcggttgcaaactttgtggctctgtggaacatttaaagaaagattgccctgaaagtcagaattcagagcgaatggtcacagttggtcgctgggcaaagggaatgagtgcagactatgaagaaattttggatgtacctaaaccgcaaaaacccaaaacaaaaatacctaaagttgttaatttttga

SEQ ID NO: 204377 - DNA, 2110 bp, Homo sapiens
  Payload ID: 20311
  Gene Name: zinc finger, CW type with PWWP domain 1
  Uniprot ID: Q9H0M4
  ENST ID: ENST00000360951
  CDS Start-End: 234-1808
gagatgcgccgcccggtctccctgccagcggagtgctgggccgaggacagggcggcaggggtgacagtggggtccaggagagtctcaaaatcctaagctttcagtatttgttattgtgaaagaagttaattcacctgaaacagaggaggggcaacctgagttatcagaaagtgacttcctggccttcccttctttactgatcagaggcacacaaagcgtagtttctaagctgaatgatgacaacgttgcagaataaagaagaatgtggaaagggaccaaagagaatctttgccccacctgcacaaaaatcttacagcctgttaccttgtagccctaactcccctaaggaggagaccccggggatcagttccccagagacagaggccaggataagcctgccaaaggccagtttaaagaagaaagaggaaaaagcaaccatgaagaatgttccaagcagggaacaggagaaaaaaagaaaggcacaaatcaacaagcaagcagagaagaaagaaaaggaaaaatcaagtcttaccaatgcagaatttgaggagattgtccagattgttctgcagaagtcccttcaggagtgcttggggatgggatctggccttgattttgcagagacttcttgtgcccagcccgtagtatctacccaatcagacaaggagccaggaattactgcttctgctactgatactgataatgctaatggagaggaggtaccacatactcaagagatttcagtgtcttgggaaggtgaagctgcccctgagataaggacatctaagttaggccagccagatcctgcaccctctaagaagaaatccaatagactcaccttaagcaaaagaaagaaggaagctcaagatgagaaggtggagaaaactcaaggtggacatgagcacagacaggaagaccgactaaagaaaacagttcaggatcattctcagatcagggaccagcaaaaaggagagataagtggttttggtcaatgtctggtctgggtccagtgttccttcccaaactgtgggaaatggaggcggctgtgtgggaacattgacccctcagttctcccagataattggtcctgtgatcagaacacagatgtgcagtataatcgctgtgatattcctgaggagacctggacagggcttgagagtgatgtggcctatgcctcctacatcccaggatccatcatctgggccaagcaatacggttacccctggtggccaggcatgatagaatctgatcctgacttaggggaatattttctttttacttcccatcttgattccctgccgtctaagtaccatgtgacgttttttggagaaacagtttctcgtgcatggatcccagtcaacatgctaaagaacttccaggagctgtccctggagctatcagtcatgaaaaagcgcagaaatgactgcagccagaaactgggggtggccctgatgatggctcaagaggcagaacagatcagcattcaggaacgggttaacttgtttggtttctggagccgattcaacggatctaacagtaatggggaaagaaaagacttacagctctctggtttgaacagcccaggatcctgcttagagaaaaaggagaaagaggaagagttggaaaaggaggaaggagagaaaacagccctaagaaaaaatttaaagctccccagagcaaggccttggcagccagcttttcagagggaaaagaagttagaacagtgccaaagaacctgggcctatcagcgtgtaagggggcctgcccctcatctgcgaaagaagagcccagacaccgggaacccctgacccaggaggctggaagtgtcccccttgaggacgaagcctccagtgacctggacctggagcaactcatggaagatgttgggagagagctggggcagagcggggagctgcagcacagcaacagtgatggcgaggacttccccgtggcgctgtttgggaagtagctggtgctcctctgctccctctttttctcccttctctggggcgcaggagggagaagttgctaagtgctgggtctgttcattggctatgaggttcaaatgtgtgtggtgcagtttctgtgttaataaagcaggttacagtcg

SEQ ID NO: 204378 - DNA, 2356 bp, Homo sapiens
  Payload ID: 20311
  Gene Name: zinc finger, CW type with PWWP domain 1
  Uniprot ID: Q9H0M4
  ENST ID: ENST00000398027
  CDS Start-End: 249-2195
cgccgttttcccggggagatgcgccgcccggtctccctgccagcggagtgctgggccgaggacagggcggcaggggtgacagtggggtccaggagagtctcaaaatcctaagctttcagtatttgttattgtgaaagaagttaattcacctgaaacagaggaggggcaacctgagttatcagaaagtgacttcctggccttcccttctttactgatcagaggcacacaaagcgtagtttctaagctgaatgatgacaacgttgcagaataaagaagaatgtggaaagggaccaaagagaatctttgccccacctgcacaaaaatcttacagcctgttaccttgtagccctaactcccctaaggaggagaccccggggatcagttccccagagacagaggccaggataagcctgccaaaggccagtttaaagaagaaagaggaaaaagcaaccatgaagaatgttccaagcagggaacaggagaaaaaaagaaaggcacaaatcaacaagcaagcagagaagaaagaaaaggaaaaatcaagtcttaccaatgcagaatttgaggagattgtccagattgttctgcagaagtcccttcaggagtgcttggggatgggatctggccttgattttgcagagacttcttgtgcccagcccgtagtatctacccaatcagacaaggagccaggaattactgcttctgctactgatactgataatgctaatggagaggaggtaccacatactcaagagatttcagtgtcttgggaaggtgaagctgcccctgagataaggacatctaagttaggccagccagatcctgcaccctctaagaagaaatccaatagactcaccttaagcaaaagaaagaaggaagctcatgagaaggtggagaaaactcaaggtggacatgagcacagacaggaagaccgactaaagaaaacagttcaggatcattctcagatcagggaccagcaaaaaggagagataagtggttttggtcaatgtctggtctgggtccagtgttccttcccaaactgtgggaaatggaggcggctgtgtgggaacattgacccctcagttctcccagataattggtcctgtgatcagaacacagatgtgcagtataatcgctgtgatattcctgaggagacctggacagggcttgagagtgatgtggcctatgcctcctacatcccaggatccatcatctgggccaagcaatacggttacccctggtggccaggcatgatagaatctgatcctgacttaggggaatattttctttttacttcccatcttgattccctgccgtctaagtaccatgtgacgttttttggagaaacagtttctcgtgcatggatcccagtcaacatgctaaagaacttccaggagctgtccctggagctatcagtcatgaaaaagcgcagaaatgactgcagccagaaactgggggtggccctgatgatggctcaagaggcagaacagatcagcattcaggaacgggttaacttgtttggtttctggagccgattcaacggatctaacagtaatggggaaagaaaagacttacagctctctggtttgaacagcccaggatcctgcttagagaaaaaggagaaagaggaagagttggaaaaggaggaaggagagaaaacagacccaattttgcccattcgtaagcgagtcaaaatacagacccaaaaaaccaagccaagagggcttgggggtgatgcaggcacagcagatggccgaggcaggacactgcagaggaagataatgaagagatctctaggcaggaaatccacagctcctcctgcacccagaatgggaaggaaagaaggccaagggaattcagattctgaccagccaggccctaagaaaaaatttaaagctccccagagcaaggccttggcagccagcttttcagagggaaaagaagttagaacagtgccaaagaacctgggcctatcagcgtgtaagggggcctgcccctcatctgcgaaagaagagcccagacaccgggaacccctgacccaggaggctggaagtgtcccccttgaggacgaagcctccagtgacctggacctggagcaactcatggaagatgttgggagagagctggggcagagcggggagctgcagcacagcaacagtgatggcgaggacttccccgtggcgctgtttgggaagtagctggtgctcctctgctccctctttttctcccttctctggggcgcaggagggagaagttgctaagtgctgggtctgttcattggctatgaggttcaaatgtgtgtggtgcagtttctgtgttaataaagcaggttacagtcgactgggttggctggtctcta

SEQ ID NO: 204379 - DNA, 822 bp, Homo sapiens
  Payload ID: 20311
  Gene Name: zinc finger, CW type with PWWP domain 1
  ENST ID: ENST00000471336
  CDS Start-End: 1-741
ggtcaatgtctggtctgggtccagtgttccttcccaaactgtgggaaatggaggcggctgtgtgggaacattgacccctcagttctcccagataattggtcctgtgatcagaacacagatgtgcagtataatcgctgtgatattcctgaggagacctggacagggcttgagagtgatgtggcctatgcctcctacatcccaggatccatcatctgggccaagcaatacggttacccctggtggccaggcatgatagaatctgatcctgacttaggggaatattttctttttacttcccatcttgattccctgccgtctaagtaccatgtgacgttttttggagaaacagtttctcgtgcatggatcccagtcaacatgctaaagaacttccaggagctgtccctggagctatcagtcatggaacgggttaacttgtttggtttctggagccgattcaacggatctaacagtaatggggaaagaaaagacttacagctctctggtttgaacagcccaggatcctgcttagagaaaaaggagaaagaggaagagttggaaaaggaggaaggagagaaaacagccctaagaaaaaatttaaagctccccagagcaaggccttggcagccagcttttcagagggaaaagaagttagaacagtgccaaagaacctgggcctatcagcgtgtaagggggcctgcccctcatctgcgaaagaagagcccagacaccgggaacccctgacccaggaggctggaagtgtcccccttgaggacgaagcctccagtgacctggacctggagcaactcatggaagatgttggga

SEQ ID NO: 204380 - DNA, 2031 bp, Homo sapiens
  Payload ID: 20311
  Gene Name: zinc finger, CW type with PWWP domain 1
  Uniprot ID: Q9H0M4
  ENST ID: ENST00000490721
  CDS Start-End: 439-1872
gaaagggaccaaagagaatctttgccccacctgcacaaaaatcttacagcctgttaccttgtagccctaactcccctaaggaggagaccccggggatcagttccccagagacagaggccaggataagcctgccaaaggccagtttaaagaagaaagaggaaaaagcaaccatgaagaatgttccaagcagggaacaggagaaaaaaagaaaggcacaaatcaacaagcaagcagagaagaaagaaaaggaaaaatcaagtcttaccaatgcagaatttgaggagattgtccagattgttctgcagaagtcccttcaggagtgcttgggtatggcatgtagtaagagaaaaagggtttcagttaagcagtgactgttacctgagagggagagttaagtctgacagcttctctctttctctcccatcttctaaataagggatgggatctggccttgattttgcagagacttcttgtgcccagcccgtagtatctacccaatcagacaaggagccaggaattactgcttctgctactgatactgataatgctaatggagaggaggtaccacatactcaagagatttcagtgtcttgggaaggtgaagctgcccctgagataaggacatctaagttaggccagccagatcctgcaccctctaagaagaaatccaatagactcaccttaagcaaaagaaagaaggaagctcaagatgagaaggtggagaaaactcaaggtggacatgagcacagacaggaagaccgactaaagaaaacagttcaggatcattctcagatcagggaccagcaaaaaggagagataagtggttttggtcaatgtctggtctgggtccagtgttccttcccaaactgtgggaaatggaggcggctgtgtgggaacattgacccctcagttctcccagataattggtcctgtgatcagaacacagatgtgcagtataatcgctgtgatattcctgaggagacctggacagggcttgagagtgatgtggcctatgcctcctacatcccaggatccatcatctgggccaagcaatacggttacccctggtggccaggcatgatagaatctgatcctgacttaggggaatattttctttttacttcccatcttgattccctgccgtctaagtaccatgtgacgttttttggagaaacagtttctcgtgcatggatcccagtcaacatgctaaagaacttccaggagctgtccctggagctatcagtcatgaaaaagcgcagaaatgactgcagccagaaactgggggtggccctgatgatggctcaagaggcagaacagatcagcattcaggaacgggttaacttgtttggtttctggagccgattcaacggatctaacagtaatggggaaagaaaagacttacagctctctggtttgaacagcccaggatcctgcttagagaaaaaggagaaagaggaagagttggaaaaggaggaaggagagaaaacagacccaattttgcccattcgtaagcgagtcaaaatacagacccaaaaaaccaagccaagaggccctaagaaaaaatttaaagctccccagagcaaggccttggcagccagcttttcagagggaaaagaagttagaacagtgccaaagaacctgggcctatcagcgtgtaagggggcctgcccctcatctgcgaaagaagagcccagacaccgggaacccctgacccaggaggctggaagtgtcccccttgaggacgaagcctccagtgacctggacctggagcaactcatggaagatgttgggagagagctggggcagagcggggagctgcagcacagcaacagtgatggcgaggacttccccgtggcgctgtttgggaagtagctggtgctcctctgctccctctttttctcccttctctggggcgcaggagggagaagttgctaagtgctgggtctgttcattggctatgaggttcaaatgtgtgtggtgcagtttctgtgttaataaagcaggttacagtcgactgggttggctggtctc

SEQ ID NO: 204381 - DNA, 617 bp, Homo sapiens
  Payload ID: 20311
  Gene Name: zinc finger, CW type with PWWP domain 1
  ENST ID: ENST00000472716
  CDS Start-End: 503-617
aacacccaccgcggcgccacgccgacttatataccagcgagtgtgggcggggacgggggttcggtccgcgctgggcccccccagcttctgccaatgaggaagaagcgagtctacgccgttttcccggggagatgcgccgcccggtctccctgccagcggagtgctgggccgaggacagggcggcaggggtgacagtggggtccaggagagtctcaaaatcctaagctttcagtatttgttattgtgaaagaagttaattcacctgaaacagaggaggggcaacctgagttatcagaaagtgacttcctggccttcccttctttactgatcagaggcacacaaagcgtagtttctaagctgaatgatgacaacgttgcagaataaagaagccctaactcccctaaggaggagaccccggggatcagttccccagagacagaggccaggataagcctgccaaaggccagtttaaagaagaaagaggaaaaagcaaccatgaagaatgttccaagcagggaacaggagaaaaaaagaaaggcacaaatcaacaagcaagcagagaagaaagaaaaggaaaaatcaagtcttaccaatgcagaatttgaggagattgtcca

SEQ ID NO: 204382 - DNA, 1716 bp, Homo sapiens
  Payload ID: 20312
  Gene Name: zinc finger, CW type with PWWP domain 2
  Uniprot ID: Q504Y3
  ENST ID: ENST00000383768
  CDS Start-End: 189-1259
ggcgggacggggcggggccgcgggacgccaggaggcggaggcggagtggagttagattcatcccagtagaacgcctgcctctttagtgactacagacctcacttcccttctctggagttttggagtctattttcttcatggaattttgctaggaacaaaagaaaagtctaactccattaaatgccttaatggataaagaaaaattggatgttaagattgaatattgtaactatgcaatggattcctcagtggaaaacatgtatgtaaacaaagtgtgggttcaatgtgagaatgaaaattgtttgaaatggagattgttatcaagtgaggattcagccaaggttgatcatgatgaaccatggtactgcttcatgaacactgattcaagatataataactgctcaatttctgaagaagacttccctgaagagtctcagcttcatcagtgtggatttaagattgtctattcacagctccctcttggaagcctggttttggtaaaattacagaattggccaagttggccaggaatactttgccctgaccgttttaaagggaaatatgtaacttatgacccggatggaaatgttgaagagtatcacatagaattcctgggcgatccccattcaagatcatggataaaggcaacattcgttggacattatagtatcacattaaagccagaaaagtgtaagaataaaaagaagtggtataaaagtgcactacaagaagcatgtctactctatggatattctcatgagcaaagactggaaatgtgctgcctatcaaaactacaagataaatccgaaacacatgacaaagttgctgcactggtcaagaaaaggaagcagacttctaaaaataatattgaaaagaagaagcccaaatttagaaaaaggaaaaggaaagcaattttaaaatgctcttttgaaaatgtttattctgatgatgccttatcaaaggagaacagggttgtctgtgagacggaagttttactaaaagagctggagcaaatgctgcagcaagcactgcaacccacagccacacctgatgaatcagaagaaggacatggagaggaaataaatatgggagaaaagttatctaaatgcagcccagaagctcctgcaggcagtctgtttgaaaaccactatgaagaggactatcttgtaattgatgggataaaattaaaagctggagaatgtattgaggatataactaataaatttaaagaaatagatgctttgatgtctgagttttagaacattatacatttttcaaattaattataaaaatattggcatctttatatttatccaaagttaaaactttaaaaatgtttagtgaaataggtataaattataccaaagtttatatttgcggtaactttctacttcatattttgagaatggccatgatttttagagccagtcaaatggtatttaagttagtgttaaaaatttagaattaaaaaaccctgatatttgtatttatatatttcttgtttgccttaatttttaaatggtttgtgaaatttgcctaacaaacatatgttttacaatgattgtttaggccctttgttcaaaaatggataacttaaaatggctggccaagctattataattctcagaggtaattcaaatctaataaacttagagaatgtatatttgcagtggaatcaaactattacaaaataaaaggaaataattttttaaataa

SEQ ID NO: 204383 - DNA, 767 bp, Homo sapiens
  Payload ID: 20312
  Gene Name: zinc finger, CW type with PWWP domain 2
  ENST ID: ENST00000428875
  CDS Start-End: 1-496
ggattcctcagtggaaaacatgtatgtaaacaaagtgtgggttcaatgtgagaatgaaaattgtttgaaatggagattgttatcaagtgaggattcagccaaggttgatcatgatgaaccatggtactgcttcatgaacactgattcaagatataataactgctcaatttctgaagaagacttccctgaagagtctcagcttcatcagtgtggatttaagattgtctattcacagctccctcttggaagcctggttttggtaaaattacagaattggccaagttggccaggaatactttgccctgaccgttttaaagggaaatatgtaacttatgacccggatggaaatgttgaagagtatcacatagaattcctgggcgatccccattcaagatcatggataaaggcaacattcgttggacattatagtatcacattaaagattatgagatctatgacttatatccacatgttgctacagacatataagaaataatttaaagtaatgatcaatatttgaaatcataccaatgaatttttgaagctctataaagaagattaggctaatcacataattcaggattaaaaaatgtagcagcctttcattttcatctccagtttcctgactgggttgtttttcatgccaccttgaacgaaatatatctatttatactactcaataaatatttactcaactcctattatttgaaattcttctaggttccaaagtgaacaaaatagaccaaattgaatgccctcataaaatt

SEQ ID NO: 204384 - DNA, 759 bp, Homo sapiens
  Payload ID: 20312
  Gene Name: zinc finger, CW type with PWWP domain 2
  ENST ID: ENST00000457897
  CDS Start-End: 1-575
tagccttttcagctatcaagatgagagtcaacgctaagaatctaccccagatgtcaagaaagaccctgggcataatcaatgctgaagtgaaaaggatcaacactggagagagaagaggggaagagaagcagacttctaaaaataatattgaaaagaagaagcccaaatttagaaaaaggaaaaggaaagcaattttaaaatgctcttttgaaaatgtttattctgatgatgccttatcaaaggagaacagggttgtctgtgagacggaagttttactaaaagagctggagcaaatgctgcagcaagcactgcaacccacagccacacctgatgaatcagaagaaggacatggagaggaaataaatatgggagaaaagacaatttttttttttggagatagagtctcactttgtcaccaaggctggagtgaagtaatgcaatctttgctcactgcaatctctgcctcccaagttcaagtgattctcctgcctcagcctcctgagtatctgggattacagaataataaccaaaggaggtttatggtggaggatgaagaaaagctctgtctgagttagtgagtttgttaaagcaatttttcaagcaaaagaaaatttgtgattgaggccaaagagaatttgagagcctcaattactcagattttaaaaaacaacacttaatgtttacacttagtgtttgacgcttcattttccttcatatggataatagctaacatttattaaacacttcttatatgcccga

SEQ ID NO: 204385 - DNA, 1181 bp, Homo sapiens
  Payload ID: 20312
  Gene Name: zinc finger, CW type with PWWP domain 2
  ENST ID: ENST00000419130
  CDS Start-End: 1-724
atggataaaggcaacattcgttggacattatagtatcacattaaagactggagtgcagtggcacaatctcgcatcactgcagcatctgcctcccaggttcaagcagttctcctacctcagcctcccaagtagctgggaattacagccagaaaagtgtaagaataaaaagaagtggtataaaagtgcactacaagaagcatgtctactctatggatattctcatgagcaaagactggaaatgtgctgcctatcaaaactacaagataaatccgaaacacatgacaaagttgctgcactggtcaagaaaaggaagcagacttctaaaaataatattgaaaagaagaagcccaaatttagaaaaaggaaaaggaaagcaattttaaaatgctcttttgaaaatgtttattctgatgatgccttatcaaaggagaacagggttgtctgtgagacggaagttttactaaaagagctggagcaaatgctgcagcaagcactgcaacccacagccacacctgatgaatcagaagaaggacatggagaggaaataaatatgggagaaaagttatctaaatgcagcccagaagctcctgcaggcagtctgtttgaaaaccactatgaagaggactatcttgtaattgatgggataaaattaaaagctggagaatgtattgaggatataactaataaatttaaagaaatagatgctttgatgtctgagttttagaacattatacatttttcaaattaattataaaaatattggcatctttatatttatccaaagttaaaactttaaaaatgtttagtgaaataggtataaattataccaaagtttatatttgcggtaactttctacttcatattttgagaatggccatgatttttagagccagtcaaatggtatttaagttagtgttaaaaatttagaattaaaaaaccctgatatttgtatttatatatttcttgtttgccttaatttttaaatggtttgtgaaatttgcctaacaaacatatgttttacaatgattgtttaggccctttgttcaaaaatggataacttaaaatggctggccaagctattataattctcagaggtaattcaaatctaataaacttagagaatgtatatttgcagtggaatcaaactattacaaaataaaaggaaataattttttaaataa

SEQ ID NO: 204386 - DNA, 816 bp, Homo sapiens
  Payload ID: 20312
  Gene Name: zinc finger, CW type with PWWP domain 2
  ENST ID: ENST00000420223
  CDS Start-End: 437-816
cgcggcgggacggggcggggccgcgggacgccaggaggcggaggcggagtggagttaggactttgtctatatctgagctgtgaagaatatttacagtaaaaagaaacaattcatcccagtagaacgcctgcctctttagtgactacagacctcacttcccttctctggagttttggagtctattttcttcatggaattttgctaggaacaaaagaaaagtctaactccacattgtcagtctggctgctataacaaattaccgtagactgggtggcttcaacaacaaacatgtatttctcacagttctggaggctaaaaagtccaagatcaaggtgacagcaggtcctatatctgatgggggactgcttcctggttttcagatggctatcttctcactgtatcctcacatggtgaagagtcgagattaaatgccttaatggataaagaaaaattggatgttaagattgaatattgtaactatgcaatggattcctcagtggaaaacatgtatgtaaacaaagtgtgggttcaatgtgagaatgaaaattgtttgaaatggagattgttatcaagtgaggattcagccaaggttgatcatgatgaaccatggtactgcttcatgaacactgattcaagatataataactgctcaatttctgaagaagacttccctgaagagtctcagcttcatcagtgtggatttaagattgtctattcacagctccctcttggaagcctggttttggtaaaattacagaattggccaagttggccaggaatactttgccctgaccgttttaaagggaaatatgtaac

SEQ ID NO: 204387 - DNA, 10286 bp, Homo sapiens
  Payload ID: 20313
  Gene Name: zinc finger, DBF-type containing 2
  Uniprot ID: Q9HCK1
  ENST ID: ENST00000374423
  CDS Start-End: 387-7451
aaacctccatcagggttgcaacgccacgttgccttggatgcctgcgtgagtggagtcgcgactcggggcccgcgtcctgagagacgcgctcccgcgccgcttctcgcctccggaccgcaggggccgaagtcgcctatttctggctccgcgggcagcggggccgtggcgctcggacggtctgggattcgggcgccgccgcggaaccggaataagaagggagagcgcccggctcggtcctcggtctccaccgcggcccggaaggaatccgggcagcctccgcggagatacttgccagaactaatacagctgatgaaatacctgaccttttctgctccagcttgagtattcaaagacagtagccatctgacttcagttatttattcaagatgcagaaaagacaaggatattgcagttattgccgtgtgcagtataataacctggaacagcatttgttcagtgctcagcacaggagtttgaccagacagagtagacgtcaaatatgtaccagtagtttgatggaacgtttcttacaggatgtactgcagcaccacccatatcattgtcaagagagcagttcaacacaagatgagacacatgtgaatactgggtcatcgtctgaagtggtgcatttggatgatgctttttctgaagaagaggaagaggatgaggataaggttgaggatgaggatgctaccgaagagagaccatccgaggtttcagaacctattgaagagttacattccagacctcataaatctcaggaaggcacgcaggaggtttcagttcgaccatcagttattcaaaaactggagaagggacagcagcagcccttggagtttgttcataaaattggggccagtgtgagaaaatgtaacctagtagatattggtcaggctacaaataatagaagcaacttggtacgccccccagtgatttgtaatgctcctgctagttgtttacctgaaagctctaacgatagaccagttacagctaatacaactagtttaccaccagcagctcatttggattcagttagcaaatgtgacccaaacaaagttgagaaatatcttgaacagccagatggggcctctagaaatcctgtgccatcatcccatgtagaaactacttcattttcgtatcagaaacataaagaatcaaataggaaatctttacgcatgaattcagataagttggttttgtggaaagatgtaaaatctcagggtaaaactttatcagctggcttgaaattccatgaacgcatgggtactaagggctccttaagagttaaatctccttccaaattagcagtaaacccgaataaaactgacatgccttctaataaaggaatctttgaagatactattgcaaagaaccatgaggaattcttttctaacatggattgtacccaagaagaaaagcatttggtttttaacaagacagccttttgggaacagaagtgctcagtgagttctgaaatgaagtttgattgtatctctcttcagtcagcatctgatcagccccaagagactgcacaagacttaagtctttggaaggaggagcaaattgaccaagaagataactatgagtctagaggttcagaaatgagttttgattgcagttcctcttttcattcactgactgaccaatctaaagtgagtgccaaagaagtaaacctttccaaggaagtacgtactgatgtacagtataagaataataaatcttatgtttctaaaataagttctgattgtgatgacattcttcacttggttaccaaccaatcccaaatgattgttaaagaaataagtcttcagaatgcaaggcatattagcctggttgaccaaagctatgaatctagtagttctgaaacgaattttgattgtgatgcttcacctcagtccactagtgactacccccaacaatctgtaacagaagtaaaccttcctaaggaagtgcacattggtttggttgataagaactatggttccagtagctctgaagtaagtgctgattctgttttcccactgcagtcagtggttgacagacccccagtggctgtcacagaaacaaaacttcggaagaaggctcataccagcttggttgataactatggatcgagttgttctgaaacaagttttgattgtgatgtttctcttgagtcagtagttgatcatccccaactgactgtcaaaggaagaaacctgaaaggtagacaagtccacctaaaacataagaagcgtaaacccagtagtgctaaagcacatcttgattgtgatgtctcacttgggacagttgcagatgaatcccagagggctgttgaaaagataaatcttctgaaggagaagaatgctgaccttatggatatgaactgtgaatcccatggtcctgaaatgggttttcaggctgatgctcaattagctgaccagtctcaagtagccgaaatagagcgtcagaaagtggatgttgaccttgagaataagagtgttcagtctagccgttcttctctgagttctgattctccggcttctctttatcattcagctcatgatgagcctcaagaagctttggatgaagtaaatcttaaagagttaaatattgacatggaagttaggagctatgattgctccagctctgagttgacttttgattctgacccgcctcttctgtcagttactgagcagtctcatctggatgctgaaggaaaagaacggcacattgacctggaagatgagagctgtgagtcagatagttctgaaataacttttgattctgatattcctctttattcagtaattgaccaacctgaagtagctgtttatgaggaagaaactgttgatctggaaagtaaaagtaatgaatcttgtgtctctgaaataacttttgattctgatattcctcttcattcaggaaatgatcaccctgaagtagctgttaaagaagtaattcagaaagaagagtacattcacttagaaaggaagaatgatgaacccagtggttctgaaataagttcggattcccatgcccctcttcattcagtgactaattctcccgaagtagctgttaaaaagctaaatcctcaaaaagaagagcaggtacacttagaaaataaggaaaatgaacctattgattctgaagtaagtttggattataatatcatttttcattcagtgactggacgttctgaagatcccattaaagaaataagccttcacacaaaagagcacatgtacttagaaaataagagtgtttttgaaacaagtttggattctgatgtccctcttcaggcagcgactcacaaacctgaagtaattgtcaaagaaacatggcttcaaagagaaaagcacgctgaattccaaggtagaagtactgaattcagtggttcaaaaacaagtttagattctggtgtccctcattattcagtaactgaacctcaagtagctgttaacaaaataaacagaaagaagcaatatgttctagaaaacaagaatgataaatgtagtggttctgaaataattttggattctaatgttccacctcagtcaatgactgaccaacctcaactagcttttttgaaggaaaaacatgttaatctgaaggacaaaaacagtaaatcaggtgattctaaaataacttttgattctgaacaacttcaggaagcggttaaaaaaatagaccaatggaaggaagaggttattggcctgaaaaataagattaatgaacctagtacttataaattaatacatcatcctgatgtttctgtccaatctgtggctgatcaacccaaagtagctattaaacatgtgaaccttgggaatgaaaaccatatgtacttggaagttaagaacagccaatatagttgttcagaaatgaatttggattctggtttcttgggtcagtcaatagtcaatcgacctcaaataactattttggagcaggagcacattgaactagaaggtaagcacaatcaatgttgtggttctgaagtaagttttgattctgatgaccctcttcagtcagtggctgaccggctgagagaaaccgttaaagaaataagcctttggaaggatgaagaagttgacacggaagataggagaaatgaagctaagggttttgaaattatgtatgattctgatgttcttcagccagtggctggccaacctgaagaagtagttaaggaggtcagtctttggaaagagcatgttgacttggaaaataagattgtcaaacctacagattccagaataaattttgattctcatgaaccccttcagtccgtaactaataaaattccaggggcgaataaagaaataaatcttttgagggaggaacatgtttgtctggatgataagggctatgtgcccagtgattctgaaataatttatgtttcaaatatccctcttcagtcagtgataaaacaaccacacattttggaagaggagcatgccagtctggaagataagagcagtaattcttatagtcctgaagaaagttctgattccaatgactcttttcaggcagcagcagatgagcttcaaaaacctgtcaaagaaataaatctttggaaggaagaccatatttacctggaagataagagctataaattaggtgattttgatgtaagttatgcttctcatattcctgttcagtttgtgactgatcaatcttctgtacctgtcaaagaaataaacttgcaaaagaaggatcataatgatctagaaaataagaactgtgaagtctgtggttctgaaataaaatgtcattcttgtgttcatcttcagtcagaagttgaccaacctcaagtgtcttacaaagaggcagaccttcagaaggaagagcatgttgtcatggaagaaaagaccgatcaacctagtgattcagaaatgatgtatgattctgatgttccttttcaaatagtagttaaccaatttccaggatcagtcaaagaaacccaccttccaaaggtggtacttgtggatctggtgcccggtgatagtgattatgaagtaatttcagatgatattccccttcagttagtgactgacccacctcagttgactgtcaaagatatcagctgtataaatacagaatgtattgatatagaagataagagctgtgacttttttggttctgaagtcagatgtaattgtaaagcctctactccctcaatgacaaaccaatgcaaagagactttcaaaataataaaccggaagaaggactatattattctgggagagccaagttgtcaatcttgtggttctgaaatgaattttaatgttgatgcctctgatcagtccatgacttacgagtcacaaggacctgatgagaaaatggtgaaatatattgattcagaagataagagctgtggatataatggttctaaaggaaaatttaatttggaagacacttctcatcgaacgactcaccgactgcagaaagctcacaaagaagccagtcttcggaaggatccaagaaatgctggcctaaaaggtaagagctgtcagtctagtgcttctgcagtggattttggtgcctcttccaagtcagcgctccatcgaagggctgataaaaaaaaacgttcgaagctaaaacatagagatctagaagtgagctgtgaaccggatggttttgagatgaattttcagtgtgctccccctcttccatctgatactgatcagcctcaagaaactgttaagaaaagacacccttgtaagaaggtatcttctgacttgaaagaaaagaaccatgattcccagtcaagctctgttctcaaggttgattctgtaaggaacctgaaaaaagcaaaggatgtcatagaggataatcctgatgaaccagttcttgaagccttgcctcatgtacctccttcatttgtggggaaaacatggtctcagataatgagagaagatgacataaaaattaatgctctggtgaaggagtttagggaaggtcgtttccactgttactttgatgatgactgtgagaccaaaaaagtttcttcgaaggggaaaaaaaaggttacctgggctgacttgcaaggtaaggaggacactgcaccaactcaagctgtgtcagagagtgatgatattgtctgtggtatttcagatattgatgacttgtcagtggccttagataaaccatgccatcgtcatcctccagcagagaggcctcctaagcaaaaggggcgtgtggcttctcaatgccagacagcgaaaatcagccatagtactcagaccagttgtaagaattacccagtgatgaaaagaaaaataattagacaagaggaagacccaccaaaaagtaagtgttcacgtttacaggatgacagaaaaaccaaaaagaaagtcaaaattgggacagttgaatttcctgcatcatgtactaaagttttgaagcctatgcaacccaaagccttagtctgtgttctttcttctttaaatattaaactgaaagagggtgaaggccttcctttccctaaaatgaggcaccatagttgggataatgatattcggtttatatgcaaatataaacggaatatctttgattattatgagcccttgattaagcaaattgtaattagtcctcccctgagtgtaatagtaccagagtttgagaggcgtaactgggttaaaattcattttaataggagcaaccaaaactccagtgcaggagataatgatgctgatggacaaggctctgcttcagcgcctttaatggcagtgccggcaagatatggatttaattcacatcagggaaccagtgactcttctctgtttctggaagaatcaaaggttctgcatgctcgtgagcttccaaagaaaagaaatttccagctaacatttttaaatcatgatgttgtcaaaatctctccaaaatcagttagaaataagcttttggaaagtcaaagtaaaaagaaaattcatggaaagagggtgacaactagtagtaataagctaggttttcccaaaaaggtttataaaccaattattctccagcaaaaacccagaaaagcttcagagaaacagtcaatttggattcggaccaaaccaagtgatatcattagaaagtatatttcgaaatactctgtctttttacgtcatagatatcagtccaggagcgcttttcttggaaggtatctgaagaagaaaaaatctgttgtcagtaggctaaagaaggcgaagagaacagctaaagtgcttttgaactcttcagttccaccagctggtgccgaagagctgtcaagcgctatggcaaatcctcctccaaagcgacctgtgcgggcttcttgccgcgttgcaagaaggaggaagaagactgatgaaagctaccatggccgacagaaaggtccttctacacctgtgagagcatatgatctgagaagctcatcttgtttacaacaacgtgagagaatgatgactcggctagcaaacaaactgagaggtaatgaggtaaaatagaagttggttttgtgttcaggctagttgaggattcagtacttcagttgaaatatatttggtactttgtgcacacagctttcccagctttggtgagaaaactaatcttgaactattttgctataaatattatttttcagaatttttatattcatttaaaattagtgtttagagtcctttcattttaagattcagaaacagcctttgtccaacattttctgtagaagaacttcatcttaatttatgtcacaaaataatttagcaccgtatatagaattttgttcctcaaatcatatccctcttattttttatgattatctctctcatgccagcaaatttaacattgtgagaatgaatatagcaaacttattaaaaagaaggaattataatgaattatgtcaacttttgaatggggttgacttaaatgaatacaaacaaaatataagttttctttctttttaaagcattccagaaaatgagattccataatctttaatacagtttttaaaaactggtgattttttttatgcatagcacaaactcctcctgcttcatttaaattggatctgcaagtctctaacttttatcatttggacacatgcacacatacagtctctaggttttttgggttagccttattagatcttaaaggggaaaataattttgcccatgtgtttaggcattcccccccttttttttaaccacctttactctcttctacatgaagagttggtggcttaatatgaaaatccaggttattttgtggccttatcccctaaaaatattttaggcattaccatatcagtttttatttttatgtttatttattattattattttttgagacagagtctcactgtcttgcccaggctggagtgcagtggcctgaacttagctcaccgcaacctccacctcccgggttcaagcaattctcctgcctaagcctctcgagtagctgggactacaggcgtgcgccaccatgcccggctaatttttgtatttttagtagagttgggggtttcactatgttggccaggctggtctcaaactcctgaccttgtggtccacccgcctcagcctcccaaagtgctgggattacagtcatgagccaccatgcccagcctaccatatcagtttttaataacttgaactgaaattattggcttggtaatatttgggcaggccattaattctcattagaaaattacttaatatttcaaaaaattgaataaaactggtaatctttgtggaggcccattttgcaagtggaaacctgtatttatacattagtttgtctttaactatttgttaacagattttaacagttcaaatgaaagatgttaacgagatgcagtttgagtctgggatactcagaatagatccagaacctttattcagggacactggttgagttggtacagatgcattcagttgtcattcattcgtgttaagccaagatcctggatcttctatcattaatgttaagaggaaacatgaattacaactatattgtatgactgccatattttattgaaactaaggtcaatgttgaaccatatcttgatttcagaatttaaaatgtgttaccttagaaataatgaaatatagtgtaacagttggtttctaaatgtggttttatttcaggggccattatttaacctgtgtgtatgctatgatggagttcttttgtgatttctttacttctaaatttaaatagtaattatgtttaaaaacaaatgtttttgtctttagttgcaaagcagcatatatctcatttccttcaaccttgcctcctcatacacaaatatattttcatttcttaaaagatcactgggccagtagttcaaaataatcctccaattttaatttaggaacaaagctttgtcctactgactaggaagtaaacaaacagctgatatataagatatttgtgggtattggtgtcttttttccctatggaatagacacatagttcccttaaatattattaatagacattctacagtctttcagtgtaagtttaaaagcaagagatcaaatgaaaatgtgtactatgtacctatgatgtgtcatatcgtgattacatcatgcagagagaacagttcctgtaattcaagtaattaaaatttcaagttgtaaaaatgttaccattttcacattggaagcccttctaagtaccattttcattgggggcagggagaaggtttatatttaaattttatattaccagacataaaagtacagtgcagtactgatgattttgtttaaagtttttgaaatgttttgtttactaagttcttgtaatcattattttagacaagcttgaaaacttgaaattgttgaaacttataatttaaattaaattggaaattactttcagaatttggtagtatacaagatgtgcccctttgtctaaataaatgttggcttaatttgcagaatagataaaacaattgatgtttttgtgtgttcaagaatgcattaaattcttttaatagtaaaaagtcaaattacgaccataatgagtattttaatcttgttcttgttcagtattttgcgtagatttttattgtaattgtcctgagttctacagtatgtgaacaatatcgtgtgaagtgtgtttttgcatttgtgcatttaaattatttatgtaactagggctgtgagtaacactttttttttttttttttggttaaagaaaagctatatttaaatattcaaataattatatatttccatgtaaaactaatgtgaagactaatgtattttttatattgcagtgtaaaagctaaacttgtttttgatgttatcaagataaaatttattaaaccttgaaat

SEQ ID NO: 204388 - DNA, 9890 bp, Homo sapiens
  Payload ID: 20313
  Gene Name: zinc finger, DBF-type containing 2
  ENST ID: ENST00000611847
  CDS Start-End: 1-7059
atgattcccgatggaagctcagagatacaggaagtaatgaagaacagtggaaagcatttgttcagtgctcagcacaggagtttgaccagacagagtagacgtcaaatatgtaccagtagtttgatggaacgtttcttacaggatgtactgcagcaccacccatatcattgtcaagagagcagttcaacacaagatgagacacatgtgaatactgggtcatcgtctgaagtggtgcatttggatgatgctttttctgaagaagaggaagaggatgaggataaggttgaggatgaggatgctaccgaagagagaccatccgaggtttcagaacctattgaagagttacattccagacctcataaatctcaggaaggcacgcaggaggtttcagttcgaccatcagttattcaaaaactggagaagggacagcagcagcccttggagtttgttcataaaattggggccagtgtgagaaaatgtaacctagtagatattggtcaggctacaaataatagaagcaacttggtacgccccccagtgatttgtaatgctcctgctagttgtttacctgaaagctctaacgatagaccagttacagctaatacaactagtttaccaccagcagctcatttggattcagttagcaaatgtgacccaaacaaagttgagaaatatcttgaacagccagatggggcctctagaaatcctgtgccatcatcccatgtagaaactacttcattttcgtatcagaaacataaagaatcaaataggaaatctttacgcatgaattcagataagttggttttgtggaaagatgtaaaatctcagggtaaaactttatcagctggcttgaaattccatgaacgcatgggtactaagggctccttaagagttaaatctccttccaaattagcagtaaacccgaataaaactgacatgccttctaataaaggaatctttgaagatactattgcaaagaaccatgaggaattcttttctaacatggattgtacccaagaagaaaagcatttggtttttaacaagacagccttttgggaacagaagtgctcagtgagttctgaaatgaagtttgattgtatctctcttcagtcagcatctgatcagccccaagagactgcacaagacttaagtctttggaaggaggagcaaattgaccaagaagataactatgagtctagaggttcagaaatgagttttgattgcagttcctcttttcattcactgactgaccaatctaaagtgagtgccaaagaagtaaacctttccaaggaagtacgtactgatgtacagtataagaataataaatcttatgtttctaaaataagttctgattgtgatgacattcttcacttggttaccaaccaatcccaaatgattgttaaagaaataagtcttcagaatgcaaggcatattagcctggttgaccaaagctatgaatctagtagttctgaaacgaattttgattgtgatgcttcacctcagtccactagtgactacccccaacaatctgtaacagaagtaaaccttcctaaggaagtgcacattggtttggttgataagaactatggttccagtagctctgaagtaagtgctgattctgttttcccactgcagtcagtggttgacagacccccagtggctgtcacagaaacaaaacttcggaagaaggctcataccagcttggttgataactatggatcgagttgttctgaaacaagttttgattgtgatgtttctcttgagtcagtagttgatcatccccaactgactgtcaaaggaagaaacctgaaaggtagacaagtccacctaaaacataagaagcgtaaacccagtagtgctaaagcacatcttgattgtgatgtctcacttgggacagttgcagatgaatcccagagggctgttgaaaagataaatcttctgaaggagaagaatgctgaccttatggatatgaactgtgaatcccatggtcctgaaatgggttttcaggctgatgctcaattagctgaccagtctcaagtagccgaaatagagcgtcagaaagtggatgttgaccttgagaataagagtgttcagtctagccgttcttctctgagttctgattctccggcttctctttatcattcagctcatgatgagcctcaagaagctttggatgaagtaaatcttaaagagttaaatattgacatggaagttaggagctatgattgctccagctctgagttgacttttgattctgacccgcctcttctgtcagttactgagcagtctcatctggatgctgaaggaaaagaacggcacattgacctggaagatgagagctgtgagtcagatagttctgaaataacttttgattctgatattcctctttattcagtaattgaccaacctgaagtagctgtttatgaggaagaaactgttgatctggaaagtaaaagtaatgaatcttgtgtctctgaaataacttttgattctgatattcctcttcattcaggaaatgatcaccctgaagtagctgttaaagaagtaattcagaaagaagagtacattcacttagaaaggaagaatgatgaacccagtggttctgaaataagttcggattcccatgcccctcttcattcagtgactaattctcccgaagtagctgttaaaaagctaaatcctcaaaaagaagagcaggtacacttagaaaataaggaaaatgaacctattgattctgaagtaagtttggattataatatcatttttcattcagtgactggacgttctgaagatcccattaaagaaataagccttcacacaaaagagcacatgtacttagaaaataagagtgtttttgaaacaagtttggattctgatgtccctcttcaggcagcgactcacaaacctgaagtaattgtcaaagaaacatggcttcaaagagaaaagcacgctgaattccaaggtagaagtactgaattcagtggttcaaaaacaagtttagattctggtgtccctcattattcagtaactgaacctcaagtagctgttaacaaaataaacagaaagaagcaatatgttctagaaaacaagaatgataaatgtagtggttctgaaataattttggattctaatgttccacctcagtcaatgactgaccaacctcaactagcttttttgaaggaaaaacatgttaatctgaaggacaaaaacagtaaatcaggtgattctaaaataacttttgattctgaacaacttcaggaagcggttaaaaaaatagaccaatggaaggaagaggttattggcctgaaaaataagattaatgaacctagtacttataaattaatacatcatcctgatgtttctgtccaatctgtggctgatcaacccaaagtagctattaaacatgtgaaccttgggaatgaaaaccatatgtacttggaagttaagaacagccaatatagttgttcagaaatgaatttggattctggtttcttgggtcagtcaatagtcaatcgacctcaaataactattttggagcaggagcacattgaactagaaggtaagcacaatcaatgttgtggttctgaagtaagttttgattctgatgaccctcttcagtcagtggctgaccggctgagagaaaccgttaaagaaataagcctttggaaggatgaagaagttgacacggaagataggagaaatgaagctaagggttttgaaattatgtatgattctgatgttcttcagccagtggctggccaacctgaagaagtagttaaggaggtcagtctttggaaagagcatgttgacttggaaaataagattgtcaaacctacagattccagaataaattttgattctcatgaaccccttcagtccgtaactaataaaattccaggggcgaataaagaaataaatcttttgagggaggaacatgtttgtctggatgataagggctatgtgcccagtgattctgaaataatttatgtttcaaatatccctcttcagtcagtgataaaacaaccacacattttggaagaggagcatgccagtctggaagataagagcagtaattcttatagtcctgaagaaagttctgattccaatgactcttttcaggcagcagcagatgagcttcaaaaacctgtcaaagaaataaatctttggaaggaagaccatatttacctggaagataagagctataaattaggtgattttgatgtaagttatgcttctcatattcctgttcagtttgtgactgatcaatcttctgtacctgtcaaagaaataaacttgcaaaagaaggatcataatgatctagaaaataagaactgtgaagtctgtggttctgaaataaaatgtcattcttgtgttcatcttcagtcagaagttgaccaacctcaagtgtcttacaaagaggcagaccttcagaaggaagagcatgttgtcatggaagaaaagaccgatcaacctagtgattcagaaatgatgtatgattctgatgttccttttcaaatagtagttaaccaatttccaggatcagtcaaagaaacccaccttccaaaggtggtacttgtggatctggtgcccggtgatagtgattatgaagtaatttcagatgatattccccttcagttagtgactgacccacctcagttgactgtcaaagatatcagctgtataaatacagaatgtattgatatagaagataagagctgtgacttttttggttctgaagtcagatgtaattgtaaagcctctactccctcaatgacaaaccaatgcaaagagactttcaaaataataaaccggaagaaggactatattattctgggagagccaagttgtcaatcttgtggttctgaaatgaattttaatgttgatgcctctgatcagtccatgacttacgagtcacaaggacctgatgagaaaatggtgaaatatattgattcagaagataagagctgtggatataatggttctaaaggaaaatttaatttggaagacacttctcatcgaacgactcaccgactgcagaaagctcacaaagaagccagtcttcggaaggatccaagaaatgctggcctaaaaggtaagagctgtcagtctagtgcttctgcagtggattttggtgcctcttccaagtcagcgctccatcgaagggctgataaaaaaaaacgttcgaagctaaaacatagagatctagaagtgagctgtgaaccggatggttttgagatgaattttcagtgtgctccccctcttccatctgatactgatcagcctcaagaaactgttaagaaaagacacccttgtaagaaggtatcttctgacttgaaagaaaagaaccatgattcccagtcaagctctgttctcaaggttgattctgtaaggaacctgaaaaaagcaaaggatgtcatagaggataatcctgatgaaccagttcttgaagccttgcctcatgtacctccttcatttgtggggaaaacatggtctcagataatgagagaagatgacataaaaattaatgctctggtgaaggagtttagggaaggtcgtttccactgttactttgatgatgactgtgagaccaaaaaagtttcttcgaaggggaaaaaaaaggttacctgggctgacttgcaaggtaaggaggacactgcaccaactcaagctgtgtcagagagtgatgatattgtctgtggtatttcagatattgatgacttgtcagtggccttagataaaccatgccatcgtcatcctccagcagagaggcctcctaagcaaaaggggcgtgtggcttctcaatgccagacagcgaaaatcagccatagtactcagaccagttgtaagaattacccagtgatgaaaagaaaaataattagacaagaggaagacccaccaaaaagtaagtgttcacgtttacaggatgacagaaaaaccaaaaagaaagtcaaaattgggacagttgaatttcctgcatcatgtactaaagttttgaagcctatgcaacccaaagccttagtctgtgttctttcttctttaaatattaaactgaaagagggtgaaggccttcctttccctaaaatgaggcaccatagttgggataatgatattcggtttatatgcaaatataaacggaatatctttgattattatgagcccttgattaagcaaattgtaattagtcctcccctgagtgtaatagtaccagagtttgagaggcgtaactgggttaaaattcattttaataggagcaaccaaaactccagtgcaggagataatgatgctgatggacaaggctctgcttcagcgcctttaatggcagtgccggcaagatatggatttaattcacatcagggaaccagtgactcttctctgtttctggaagaatcaaaggttctgcatgctcgtgagcttccaaagaaaagaaatttccagctaacatttttaaatcatgatgttgtcaaaatctctccaaaatcagttagaaataagcttttggaaagtcaaagtaaaaagaaaattcatggaaagagggtgacaactagtagtaataagctaggttttcccaaaaaggtttataaaccaattattctccagcaaaaacccagaaaagcttcagagaaacagtcaatttggattcggaccaaaccaagtgatatcattagaaagtatatttcgaaatactctgtctttttacgtcatagatatcagtccaggagcgcttttcttggaaggtatctgaagaagaaaaaatctgttgtcagtaggctaaagaaggcgaagagaacagctaaagtgcttttgaactcttcagttccaccagctggtgccgaagagctgtcaagcgctatggcaaatcctcctccaaagcgacctgtgcgggcttcttgccgcgttgcaagaaggaggaagaagactgatgaaagctaccatggccgacagaaaggtccttctacacctgtgagagcatatgatctgagaagctcatcttgtttacaacaacgtgagagaatgatgactcggctagcaaacaaactgagaggtaatgaggtaaaatagaagttggttttgtgttcaggctagttgaggattcagtacttcagttgaaatatatttggtactttgtgcacacagctttcccagctttggtgagaaaactaatcttgaactattttgctataaatattatttttcagaatttttatattcatttaaaattagtgtttagagtcctttcattttaagattcagaaacagcctttgtccaacattttctgtagaagaacttcatcttaatttatgtcacaaaataatttagcaccgtatatagaattttgttcctcaaatcatatccctcttattttttatgattatctctctcatgccagcaaatttaacattgtgagaatgaatatagcaaacttattaaaaagaaggaattataatgaattatgtcaacttttgaatggggttgacttaaatgaatacaaacaaaatataagttttctttctttttaaagcattccagaaaatgagattccataatctttaatacagtttttaaaaactggtgattttttttatgcatagcacaaactcctcctgcttcatttaaattggatctgcaagtctctaacttttatcatttggacacatgcacacatacagtctctaggttttttgggttagccttattagatcttaaaggggaaaataattttgcccatgtgtttaggcattcccccccttttttttaaccacctttactctcttctacatgaagagttggtggcttaatatgaaaatccaggttattttgtggccttatcccctaaaaatattttaggcattaccatatcagtttttatttttatgtttatttattattattattttttgagacagagtctcactgtcttgcccaggctggagtgcagtggcctgaacttagctcaccgcaacctccacctcccgggttcaagcaattctcctgcctaagcctctcgagtagctgggactacaggcgtgcgccaccatgcccggctaatttttgtatttttagtagagttgggggtttcactatgttggccaggctggtctcaaactcctgaccttgtggtccacccgcctcagcctcccaaagtgctgggattacagtcatgagccaccatgcccagcctaccatatcagtttttaataacttgaactgaaattattggcttggtaatatttgggcaggccattaattctcattagaaaattacttaatatttcaaaaaattgaataaaactggtaatctttgtggaggcccattttgcaagtggaaacctgtatttatacattagtttgtctttaactatttgttaacagattttaacagttcaaatgaaagatgttaacgagatgcagtttgagtctgggatactcagaatagatccagaacctttattcagggacactggttgagttggtacagatgcattcagttgtcattcattcgtgttaagccaagatcctggatcttctatcattaatgttaagaggaaacatgaattacaactatattgtatgactgccatattttattgaaactaaggtcaatgttgaaccatatcttgatttcagaatttaaaatgtgttaccttagaaataatgaaatatagtgtaacagttggtttctaaatgtggttttatttcaggggccattatttaacctgtgtgtatgctatgatggagttcttttgtgatttctttacttctaaatttaaatagtaattatgtttaaaaacaaatgtttttgtctttagttgcaaagcagcatatatctcatttccttcaaccttgcctcctcatacacaaatatattttcatttcttaaaagatcactgggccagtagttcaaaataatcctccaattttaatttaggaacaaagctttgtcctactgactaggaagtaaacaaacagctgatatataagatatttgtgggtattggtgtcttttttccctatggaatagacacatagttcccttaaatattattaatagacattctacagtctttcagtgtaagtttaaaagcaagagatcaaatgaaaatgtgtactatgtacctatgatgtgtcatatcgtgattacatcatgcagagagaacagttcctgtaattcaagtaattaaaatttcaagttgtaaaaatgttaccattttcacattggaagcccttctaagtaccattttcattgggggcagggagaaggtttatatttaaattttatattaccagacataaaagtacagtgcagtactgatgattttgtttaaagtttttgaaatgttttgtttactaagttcttgtaatcattattttagacaagcttgaaaacttgaaattgttgaaacttataatttaaattaaattggaaattactttcagaatttggtagtatacaagatgtgcccctttgtctaaataaatgttggcttaatttgcagaatagataaaacaattgatgtttttgtgtgttcaagaatgcattaaattcttttaatagtaaaaagtcaaattacgaccataatgagtattttaatcttgttcttgttcagtattttgcgtagatttttattgtaattgtcctgagttctacagtatgtgaacaatatcgtgtgaagtgtgtttttgcatttgtgcatttaaattatttatgtaactagggctgtgagtaacactttttttttttttttttggttaaagaaaagctatatttaaatattcaaataattatatatttccatgtaaaactaatgtgaagactaatgtattttttatattgcagtgtaaaagctaaacttgtttttgatgttatcaagataaaatttattaaaccttg

SEQ ID NO: 204389 - DNA, 2047 bp, Homo sapiens
  Payload ID: 20314
  Gene Name: zinc finger, DHHC-type containing 1
  Uniprot ID: Q8WTX9
  ENST ID: ENST00000348579
  CDS Start-End: 343-1800
gccggacgaggcccagccagtctgggtctggcctggccgcccctccagcctgctggagccggagccggagccggagccggagccggagccggagccagagccagagctcgaggactcaccggcccagtctccgtccgggatggggccccgctcccgggcgcgttgccgcccagtcccggggaccgtccctaccgcgagggtctgaggcgcggctgccccggggagggtggaaggccaggcgtggggcccgaacctctggctgactttggcagggcccatctggcacggcctccgcggcgcgcagctgttttcaagtcagcaaacatttactgaggatctactatgtacaagatgaacatctgcaacaagccctccaacaagacggcccctgagaagagtgtgtggacggcaccggcacagcccagcggaccctcccctgagctgcagggccagcgatcccgccggaatgggtggagctggccccctcacccgctccagattgtggcctggctgctgtacctcttctttgctgtgatcggctttgggatccttgttcccctcctgcctcaccactgggtgcccgctggctacgcttgcatgggcgccatctttgctggccaccttgtggtgcacctgaccgccgtctccatcgatccagcagatgccaacgtgcgggacaagagctatgcggggcccctgcccatcttcaaccgaagccagcacgcacatgtcattgaagacctgcactgcaacttgtgcaacgtggatgtgagcgctcgctccaagcactgcagcgcctgcaacaagtgcgtgtgcggtttcgaccaccactgcaagtggctcaacaactgtgtgggcgagcggaactaccggctctttctacacagtgttgcatccgctttactgggcgtcctgctcctggtgctggtggccacatatgtcttcgtggagttctttgtcaaccccatgcgtctgcgcaccaaccgacactttgaagtcctgaagaatcacacggatgtgtggttcgtgttcctgcctgccgcccccgtggagacccaggcccctgccatcctggccctggccgccctgctcatccttctgggcctcctgtccacagccctcctggggcacctgctctgcttccacatttatctcatgtggcacaagctcaccacctatgagtacatcgtgcagcaccgcccaccacaggaggccaagggggttcacagggagctcgagtcatgtcctcccaagatgcggcccattcaggagatggagttctacatgcggaccttcagacatatgcgcccagagccccctggccaggccgggccagcagcagtgaatgccaaacactctcgccctgcctccccggatccgaccccaggtaggagggactgtgctgggcctccggtccaggtggagtgggatagaaagaagcctctaccctggcgctcgcctctgcttcttttggcgatgtggggccctcaggctcccccgtgtctctgcagaaaaagaggaagaggcgcgtgtataaagtgcgaacgtctgagacctcggatccggcgtcggggcctagggcccccagccgccgctccagctcgtcgacggattccgcggacgccagccctgtgcacgccgctggccctgccggcgcctaccactcggcgtcggcagagtccgtggacgagattccagtggcgcagacgcgcctgggcagcgccgctctggccgccccgcggggccggggccgacagcccacgctggcgcggcaggcgcgtgcgcccgccgttttcgtgagcccgagcagcggcgagcccagggcgccgggcggccgggaggctggtctggcttagctgggccgagaggccggagggccgagttagagcggccggcctgactctctatgcaacaccccatccttgccgcaccgagtgcactttaggggcccctacggccggcgggatcggcctccctcccccacgactcagcaatacccgccccaccggctgtgatgctccaataaacttttttatgcttttgcgga

SEQ ID NO: 204390 - DNA, 1145 bp, Homo sapiens
  Payload ID: 20314
  Gene Name: zinc finger, DHHC-type containing 1
  ENST ID: ENST00000565726
  CDS Start-End: 1-1056
gaagacctgcactgcaacttgtgcaacgtggatgtgagcgctcgctccaagcactgcagcgcctgcaacaagtgcgtgtgcggtttcgaccaccactgcaagtggctcaacaactgtgtgggcgagcggaactaccggctctttctacacagtgttgcatccgctttactgggcgtcctgctcctggtgctggtggccacatatgtcttcgtggagttctttgtcaaccccatgcgtctgcgcaccaaccgacactttgaagtcctgaagaatcacacggatgtgtggttcgtgttcctgcctgccgcccccgtggagacccaggcccctgccatcctggccctggccgccctgctcatccttctgggcctcctgtccacagccctcctggggcacctgctctgcttccacatttatctcatgtggcacaagctcaccacctatgagtacatcgtgcagcaccgcccaccacaggaggccaagggggttcacagggagctcgagtcatgtcctcccaagatgcggcccattcaggagatggagttctacatgcggaccttcagacatatgcgcccagagccccctggccaggccgggccagcagcagtgaatgccaatccctcccagtttcttgccacccgtggccaagcggaacctccaccaccctcttccccagacactctcgccctgcctccccggatccgaccccagaaaaagaggaagaggcgcgtgtataaagtgcgaacgtctgagacctcggatccggcgtcggggcctagggcccccagccgccgctccagctcgtcgacggattccgcggacgccagccctgtgcacgccgctggccctgccggcgcctaccactcggcgtcggcagagtccgtggacgagattccagtggcgcagacgcgcctgggcagcgccgctctggccgccccgcggggccggggccgacagcccacgctggcgcggcaggcgcgtgcgcccgccgttttcgtgagcccgagcagcggcgagcccagggcgccgggcggccgggaggctggtctggcttagctgggccgagaggccggagggccgagttagagcggccggcctgactctctatgcaacaccccatccttgccgcaccgagtgcactttag

SEQ ID NO: 204391 - DNA, 2604 bp, Homo sapiens
  Payload ID: 20315
  Gene Name: zinc finger, DHHC-type containing 11
  Uniprot ID: Q9H8X9
  ENST ID: ENST00000283441
  CDS Start-End: 385-1623
gtgaacgggttgtgggacctgtcgctgtgtgggggctgtcgagcactccccagaacgtaacaaatcctcaggggaactgatgggcggtcgcgcgggcactgggtcctccacaccctggagagccgttttccgttgccactcggctctggccggggtcacattctgcagcatgtctgttcattcccctgggcggggccctgcaccgactccagcccagcccctgctccctctgcggggaacgtggccccaggcagtgctgggccattggctgtcagtgctggtcctggcggctgcattcccagtccccttggtctctgtgacagtgggcggggccggccctcccaggatctgacggcgcaggtcctccccttctgtgtcctgcagatggacacccgctccgggagccagtgttccgtcaccccagaagccatactcaataatgaaaagctggtcttgccgccccgcatctccagagtgaacggctggtcgttacccctgcactacttccaggtggtgacctgggctgtcttcgtgggcctttcctcggccaccttcgggatcttcattcccttcctgcctcacgcgtggaaatacattgcctacgtggtgaccggggggatcttctcgttccacctcgtcgtccacctgatcgcgtcctgcatcgacccggccgactccaatgtcagactcatgaagaactattctcagcccatgcccctcttcgacagatcaaaacatgcacacgtgatccagaatcagttctgccacctgtgcaaggtcaccgtgaacaagaaaaccaaacactgcatttcctgcaataagtgtgtgtccggcttcgaccaccactgcaaatggatcaacaactgcgtgggaagccggaattattggttcttcttcagcactgtggcctcggccacagctggcatgctctgcctgatcgccatcctgctgtatgtcctcgtccagtacctcgtgaaccccggggtgctccgcacggaccccaggtatgaagatgtcaagaatatgaacacgtggctgctgttcctccccctgttcccggtgcaggtgcagaccctgatagtcgtgatcatcgggatgctcgtgctcctgctggactttcttggcttggtgcacctgggccagctgctcatcttccacatctacctgaaggccaagaagatgaccacctttgagtatctcattaataaccgcaaagaagagagttcaaaacatcaagcagtgaggaaagatccatacgtgcaaatggacaaaggagttctccagcaaggagctggcgccctgggctcatctgcacagggagtcaaagccaagagctccctgctgattcacaagcacttatgtcacttctgcacttcagtaaaccaggatggggattcgacggcacgggaaggggatgaagacccgtgtccatctgcacttggagccaaggccaggaactcccggctgatttgcaggcgcctgtgtcagttctccactcgtgtacacccagacgggggctcgatggcacaggaagcagatgatgccccgagtatatctacacttgggctgcaacaagaaacaacagagcccatgaaaactgacagtgctgaaagtgaagactgagattcaggagctcaggtgcccctgtgatccaggtcttctaccctgaaaccccaccctccatcaaggtcctgcctgtagagtctaccttgcaaagcctcctgctcctacccatgctacaggccaggaaccagagcccatcatctcagaggcccctggatgtccttcgaaggaaccaggaccctcagagcccagcatccatctctgtcatcatcttcatcacacccaaagaagagccagccttgcaggagggtttacatctccaggaagatgggctgccagcaactgcagaggatgcagccacctgcttaactgtgctgtccagccagccagccagctgcagggcctcttgctgcttaagagctgatgggccgggcatgttggctcacacctgtgagcacagtactgggaaatgggagcacagtactaggaaatgggagcacagtactgggaaatgggagcacagtactgggaaatgggggctcacagcactgcaaaatgggagcacagtattgggaaatgggagcacagtactgggaagtgggagcacagtactgagaagtgggagcacagtactgagaaatgggagtacactactgagaaatgggagcacagtactgggaaatgggcatacagtactgagaaatgggagcacacagtactgggaaatgggagcacagtactgggaaatgggagcccacagtactgggaaaggggagttcacagtactcggaaatgggagcatagtactgggaaatgggagcacagtactgggaaatgggagcatagtactgggaaaccccagacctggattctgagtttttcagcctagcccagacttcttatcttagtagacaaaaagagtcaataccagagaaccagaggcatcctctgtattttaatgaactctgcattttaatctgtttagtagtcattttttaaaagataatcagttttccaaatatatctataagttactacgtg

SEQ ID NO: 204392 - DNA, 943 bp, Homo sapiens
  Payload ID: 20315
  Gene Name: zinc finger, DHHC-type containing 11
  ENST ID: ENST00000424784
  CDS Start-End: 150-791
gagcccatgaaaactgacagtgctgaaagtgaagactgagattcaggagctcaggtgcccctgtgatccaggtcttctaccctgaaaccccaccctccatcaaggtcctgcctgtagagtctaccttgcaaagcctcctgctcctacccatgctacaggccaggaaccagagcccatcatctcagaggcccctggatgtccttcgaaggaaccaggaccctcagagcccagcatccatctctgtcatcatcttcatcacacccaaagaagagccagccttgcaggagggtttacatctccaggaagatgggctgccagcaactgcagaggatgcagccacctgcttaactgtgctgtccagccagccagccagctgcagggcctcttgctgcttaagagctgatgggccgggcatgttggctcaccctgtgagcacagtatgggaaatgggagcacagtacgaaatgggagcacagtactgggaaatgggagcacacagtactgggaagtgggagcacagtactgagaagtgggagcacagtactgagaaatgggagtacactactgagaaatgggagcacagtactgggaaatgggcatacagtactgagaaatgggagcacagtactgggaaatgggagacagtactgggaaatgggagcccacagtactgggaaaggggagttacagtactcggaaatgggagtactgggaaatgggagcacagtactgggaaatgggagcatagtactgggaaaccccagacctggattctgagtttttcagcctagcccagacttcttatcttagtagacaaaaagagtcaataccagagaaccagaggcatcctctgtattttaatgaactctgcattttaatctgtttagtagtcattttttaaaagataatcagttttccaaatatatctataagttactacgtg

SEQ ID NO: 204393 - DNA, 1790 bp, Homo sapiens
  Payload ID: 20315
  Gene Name: zinc finger, DHHC-type containing 11
  ENST ID: ENST00000507800
  CDS Start-End: 1-666
cactgcatttcctgcaataagtgtgtgtccggcttcgaccaccactgcaaatggatcaacaactgcgtgggaagccggaattattggttcttcttcagcactgtggcctcggccacagctggcatgctctgcctgatcgccatcctgctgtatgtcctcgtccagtacctcgtgaaccccggggtgctccgcacggaccccaggtatgaagatgtcaagaatatgaacacgtggctgctgttcctccccctgttcccggtgcaggtgcagaccctgatagtcgtgatcatcgggatgctcgtgctcctgctggactttcttggcttggtgcacctgggccagctgctcatcttccacatctacctgaaggccaagaagatgaccacctttgagtatctcattaataaccgcaaagaagagagttcaaaacatcaagcagtgaggaaagatccatacgtgcaaatggacaaaggagttctccagcaaggagctggcgccctgggctcatctgcacagggagtcaaagccaagagctccctgctgattcacaagcacttatgtcacttctgcacttcagtaaaccaggatggggattcgacggcacggggccacctcaccacacttccccaggatttcagggaacaggctcctgtgacttggaaataaaaagggatcagcccagcctggaggaacagcgacgctggtgtccaagccttgccccttgcctgcacttccagcaaagatttggagacacactcggtggaaatcgattgagcccccagcccaccctggcccagactcagccaccaaagttccctcactgcatgtggcacacgggctcatgggagtttctctgcctgtgtttgtccacgttgacaccttctgcacaggtgcatttgtgagtcccctcagtgtctctgcagcttctatgtgtggatgaatagtgaagccacatgaggcctggtctgaagcagagaagatccgctcagcatcatgttgaatcccaagcccgcgtctccgtgggctccaggacaatcctatgaaagtgacaccgtcgttcattgttcacatcggggaggagaattccatctgaaaatgcacgtgacttcactgacacccgcgtccgtggcacagccctgtgctgagctccacagacctacagtccatcgcctccccttggagtgggcccacagctgcagacagtgttgtccaaagaagatgctctgagtagatgaatggaacaaactggaaactccagaaacaagcccttctttacatttctaatgtttggcttaaatggaaggtgccaaggaaggggatgaagacccgtgtccatctgcacttggagccaaggccaggaactcccggctgatttgcaggcgcctgtgtcagttctccactcgtgtacacccagacgggggctcgatggcacaggaagcagatgatgccccgagtatatctacacttgggctgcaacaagaaacaacagagcccatgaaaactgacagtgctgaaagtgaagactgagattcaggagctcaggtgcccctgtgatccaggtcttctaccctgaaaccccaccctccatcaaggtcctgcctgtagagtctaccttgcaaagcctcctgctcctacccatgctacaggccaggaaccagagcccatcatctcagaggcccctggatgtccttcgaaggaaccaggaccctcagagcccagcatccatctctgtcatcatcttcatcacacccaaagaagagccagccttgcaggagggtttacatctccag

SEQ ID NO: 204394 - DNA, 514 bp, Homo sapiens
  Payload ID: 20315
  Gene Name: zinc finger, DHHC-type containing 11
  ENST ID: ENST00000511193
  CDS Start-End: 361-514
atctgagggcgggagctgacgtcccaggcacggggagcccagcttctcctggctccaggggacaaggatcctctccccagtgcccccgcagccaggctctgagcccagagggcccaagaaagaggcccagggtccctgagaacaagaaaaccaaacactgcatttcctgcaataagtgtgtgtccggcttcgaccaccactgcaaatggatcaacaactgcgtgggaagccggaattattggttcttcttcagcactgtggcctcggccacagctggcatgctctgcctgatcgccatcctgctgtatgtcctcgtccagtacctcgtgaaccccggggtgctccgcacggaccccaggtatgaaggtgcagaccctgatagtcgtgatcatcgggatgctcgtgctcctgctggactttcttggcttggtgcacctgggccagctgctcatcttccacatctacctgaaggccaagaagatgaccacctttgagtatctcattaataaccgca

SEQ ID NO: 204395 - DNA, 1303 bp, Homo sapiens
  Payload ID: 20315
  Gene Name: zinc finger, DHHC-type containing 11
  Uniprot ID: Q9H8X9
  ENST ID: ENST00000511539
  CDS Start-End: 106-534
cggccacagctggcatgctctgcctgatcgccatcctgctgtatgtcctcgtccagtacctcgtgaaccccggggtgctccgcacggaccccagatgtcaagaatatgaacacgtggctgctgttcctccccctgttcccggtgcaggtgcagaccctgatagtcgtgatcatcgggatgctcgtgctcctgctggactttcttggcttggtgcacctgggccagctgctcatcttccacatctacctgagtatgtcccccaccctaagcccccgatccccccaaggctgggtggtcagagctgctcatcttacacctctacttgagtatgtccctaaccctgagccccccacgcctggggccagagtctttgtcccccgtgtgcgcatgtgttcagggtcagcctctcccagaagtgagatcatggacaaaaagggcaaatcacaggaagaaattaaatccatgaggacccagcaggcccagcaagaagctgaactcacgccgagacctgcaggagtggtgccaggtgcttgaagtaacaagtttaaaatgttcagagacaatggaatggaatctattaggcaagaacaggacattatgaaataaggacaggtggacttccaaaaacacaagtagaaattctaacaatgaaatatattacaggcaggtcacccactaaccaaacaactgaagcgagagctggtggtcttgcttggtctcacagtgggcacagcggtaggcggtcagtcatgttgctgaacgacggagggtaaactccccagccccaaggaaacctgtgttggaagtaacaacaacctccctgctcctggcaccagccgttttggtcatggtgggccagctgcaaagcgtcttccattctctgggcagtggtggccccgaggctgtggcctctcagggggtttctgtggacacgggcagcagagtgtgtccaggccagcccccaagaatgccctgctcctgacagcttggccaacccctggtcagggcagagggagttgggtgggtcaggctctgggctcacctccatctccagagcatcccctgcctgcagttgtggcaagaacgcccagctcagaatgaacacaccccaccaagagcctccttgttcataaccacaggttaccctacaaaccactgtccccacacaaccctggggatgttttaaaacacacacctctaacgcatatcttacagtcactgttgtcttgcctgagggttgaattttttttaatgaaagtgcaatgaaaatcactggattaaatcctacggacacagagctgaa

SEQ ID NO: 204396 - DNA, 1631 bp, Homo sapiens
  Payload ID: 20316
  Gene Name: zinc finger, DHHC-type containing 11B
  ENST ID: ENST00000508859
  CDS Start-End: 1-1149
atggcgcaggtcctccccttctgtgtcctgcagatggacacccgctccgggagccagtgttccgtcaccccagaagccatacgcaacaatgaagagctggtcttgccgccccgcatctccagagtgaacggctggtcgttacccctgcactacttccgggtggtgacttgggctgtcttcgttggcctttccttggccaccttcaggatcttcattcccctcctgcctcactcgtggaaatacatcgcctatgtggtgaccggggggatcttctcgttccacctcgtcgtccacctgatcgcgtcctgcatcgacccggccgactccaatgtcagactcatgaagaactattctcagcccatgcccctcttcgacagatcaaaacatgcacacgtgatccagaatcagttctgccacctgtgcaaggtcaccgtgaacaagaaaaccaaacactgcatttcctgcaataagtgtgtgtccggcttcgaccaccactgcaaatggatcaacaactgcgtgggaagccggaattattggttcttcttcagcactgtggcctcggccacagctggcatgctctgcctgatcgccatcctgctgtatgtcctcgtccagtacctcgtgaaccccagggtgctccgcacggaccccaggtatgaagatgtcaagaatatgaacacgtggctgctgttcctccccctgttcccggtgcaggtgcagactctgatagtcgtgatcatcaggatgctcgtgctcctgctggaccttcttggcttggtgcagctgggccagctgctcatcttccacatctacctgaaggccaagaagatgaccacctttgagtatctcattaatacccgcaaagaagagagttcaaaacatcaagcagtgaggaaagatccatacgtgcaaatggacaaaggatttctccagcaaggagctggcgccctgggctcatctgcacagggagtcaaggccaagagctccctgctgatttacaaatgcccatgtcacttctgcacttcagtaaaccaggacggggattcgaaggcacaggaagcagatgatgccccgagtacatctacacttgggctgcaacaagaaacaacagagcccatgaaaactgacagtgctgaaagtgaagactgagattcgggagctcaggtgcccctgtgatccaggtcttctaccctgaaaccccaccctccatcaaggtcctgcctgtagagtctaccttgcaaagcctcctgctcctacccatgctacaggccaggaaccagagcccatcatctcagaggcccctggatgtccttcgaaggaaccaggaccctcagagcccagcatccatctctgtcatcatcttcatcacacccaaagaagagccagccttgcaggagggtttacatctccaggaagatgggctgccagcaactgcagaggatgcagccacctgcttaactgtgctgtccagccagccagccagctgcagggcctcttgctgcttaagagctgatgggccgggcatgttggctcacacctgtgagcacagtactgggaaatgggagcatagtactgggaaatgggagcacagtactgagaaatgggagcacagtactgggaaatggtagcac

SEQ ID NO: 204397 - DNA, 1116 bp, Homo sapiens
  Payload ID: 20316
  Gene Name: zinc finger, DHHC-type containing 11B
  Uniprot ID: P0C7U3
  ENST ID: ENST00000382776
  CDS Start-End: 1-1116
atggacacccgctccgggagccagtgttccgtcaccccagaagccatacgcaacaatgaagagctggtcttgccgccccgcatctccagagtgaacggctggtcgttacccctgcactacttccgggtggtgacttgggctgtcttcgttggcctttccttggccaccttcaggatcttcattcccctcctgcctcactcgtggaaatacatcgcctatgtggtgaccggggggatcttctcgttccacctcgtcgtccacctgatcgcgtcctgcatcgacccggccgactccaatgtcagactcatgaagaactattctcagcccatgcccctcttcgacagatcaaaacatgcacacgtgatccagaatcagttctgccacctgtgcaaggtcaccgtgaacaagaaaaccaaacactgcatttcctgcaataagtgtgtgtccggcttcgaccaccactgcaaatggatcaacaactgcgtgggaagccggaattattggttcttcttcagcactgtggcctcggccacagctggcatgctctgcctgatcgccatcctgctgtatgtcctcgtccagtacctcgtgaaccccagggtgctccgcacggaccccaggtatgaagatgtcaagaatatgaacacgtggctgctgttcctccccctgttcccggtgcaggtgcagactctgatagtcgtgatcatcaggatgctcgtgctcctgctggaccttcttggcttggtgcagctgggccagctgctcatcttccacatctacctgaaggccaagaagatgaccacctttgagtatctcattaatacccgcaaagaagagagttcaaaacatcaagcagtgaggaaagatccatacgtgcaaatggacaaaggatttctccagcaaggagctggcgccctgggctcatctgcacagggagtcaaggccaagagctccctgctgatttacaaatgcccatgtcacttctgcacttcagtaaaccaggacggggattcgaaggcacaggaagcagatgatgccccgagtacatctacacttgggctgcaacaagaaacaacagagcccatgaaaactgacagtgctgaaagtgaagactga

SEQ ID NO: 204398 - DNA, 1301 bp, Homo sapiens
  Payload ID: 20316
  Gene Name: zinc finger, DHHC-type containing 11B
  ENST ID: ENST00000622126
  CDS Start-End: 106-534
cggccacagctggcatgctctgcctgatcgccatcctgctgtatgtcctcgtccagtacctcgtgaaccccagggtgctccgcacggaccccagatgtcaagaatatgaacacgtggctgctgttcctccccctgttcccggtgcaggtgcagactctgatagtcgtgatcatcaggatgctcgtgctcctgctggaccttcttggcttggtgcagctgggccagctgctcatcttccacatctacctgagtatgtcccccaccctaagcccccgatccccccaagcctggttggtcagagctgctcatcttacacctctacttgagtatgtccctaaccctgagccccccacacctggggccagagtctttgtcccccgtgtgcgcatgtgttcagggtcagcctctcccagaagtgagatcatggacaaaaagggcaaatcacaggaagaaattaaatccatgagggcccagcaggcccagcaagaagctgaactcacgctgagacctgcaggagcgctgccgggtgcttgaagtaacaagtttaaaatgttcagagaaaatggaatggaatctattaggcaagaacaggacattatgaaataaggacaggtggacttccaaaagcacaagtagaaattctaacaatgaaaaatattacaggcagatcacccactaaccaaacaactgaagcgagagctggtggtcttgcttggtctcacagtgggcacagcggtaggcggtcagtcatgttgctgaacgacggagggtaaactccccagccccaaggaaacctgtgttggaagtaacaacaacctccctgctcctggcaccagccgttttggtcatggtgggccagctgcaaagcgtcttccattctctgggcagtggtggccccgaggctgtggcctctcagggggtttctgtggacacgggcagcagagtgtgtccaggccagcccccaagaatgccctgctcctgacagcttggccaacgcctagtcagggcagaggggatcgggtgggtcaggctctgggctcacctccatctccagagcatcccctgcctgcagttgtggcaagaacgcccagctcagaatgaacacaccccaccaagagcctccttgttcataaccacaggttaccctacaaaccactgtccccacacaaccctggggatgttttaaaacacacacctctaacgcacatcttacagtcactgttgtcttgcctgagggttgaattttttttaatgaaagtgcaatgaaaatcactggattaaatcctacggacacagagctg

SEQ ID NO: 204399 - DNA, 1129 bp, Homo sapiens
  Payload ID: 20317
  Gene Name: zinc finger, DHHC-type containing 12
  Uniprot ID: Q96GR4
  ENST ID: ENST00000372663
  CDS Start-End: 14-817
ccgggccgaggcgatggcgccctgggcgctcctcagccctggggtcctggtgcggaccgggcacaccgtgctgacctggggaatcacgctggtgctcttcctgcacgataccgagctgcggcaatgggaggagcagggggagctgctcctgcccctcaccttcctgctcctggtgctgggctccctgctgctctacctcgctgtgtcactcatggaccctggctacgtgaatgtgcagccccagcctcaggaggagctcaaagaggagcagacagccatggttcctccagccatccctcttcggcgctgcagatactgcctggtgctgcagcccctgagggctcggcactgccgtgagtgccgccgttgcgtccgccgctacgaccaccactgcccctggatggagaactgtgtgggagagcgcaaccacccactctttgtggtctacctggcgctgcagctggtggtgcttctgtggggcctgtacctggcatggtcaggcctccggttcttccagccctggggtcagtggttgcggtccagcgggctcctgttcgccaccttcctgctgctgtccctcttctcgttggtggccagcctgctcctcgtctcgcacctctacctggtggccagcaacaccaccacctgggaattcatctcctcacaccgcatcgcctatctccgccagcgccccagcaaccccttcgaccgaggcctgacccgcaacctggcccacttcttctgtggatggccctcagggtcctgggagaccctctgggctgaggaggaggaagagggcagcagcccagctgtttagggttgctggaggccgggctaccgtcttgtgcctgaaaaccacggggcctgtccccagctggggtgagcgctcagagggcctggggccctcactcctgcccacgcctcccagaccccagaacggagcttcaagtcagacagatccctgccttggtgggcagttctgccttccaaggaagaaggggaagaaaaggacctgtgggtggctcaggcccaagcagaccccgggctccaccccagccccgcccaggctgctgccagtgcacacttttacaaatttaatataaagcaagtccagtcttaaaaagacaaa

SEQ ID NO: 204400 - DNA, 1187 bp, Homo sapiens
  Payload ID: 20317
  Gene Name: zinc finger, DHHC-type containing 12
  ENST ID: ENST00000372667
  CDS Start-End: 31-876
ttcttccgggtggggccccgggccgaggcgatggcgccctgggcgctcctcagccctggggtcctggtgcggaccgggcacaccgtgctgacctggggaatcacgctggtgctcttcctgcacgataccggtgagccggaccccgagcgaccccggacccacccgatcccgcagctgcggcaatgggaggagcagggggagctgctcctgcccctcaccttcctgctcctggtgctgggctccctgctgctctacctcgctgtgtcactcatggaccctggctacgtgaatgtgcagccccagcctcaggaggagctcaaagaggagcagacagccatggttcctccagccatccctcttcggcgctgcagatactgcctggtgctgcagcccctgagggctcggcactgccgtgagtgccgccgttgcgtccgccgctacgaccaccactgcccctggatggagaactgtgtgggagagcgcaaccacccactctttgtggtctacctggcgctgcagctggtggtgcttctgtggggcctgtacctggcatggtcaggcctccggttcttccagccctggggtcagtggttgcggtccagcgggctcctgttcgccaccttcctgctgctgtccctcttctcgttggtggccagcctgctcctcgtctcgcacctctacctggtggccagcaacaccaccacctgggaattcatctcctcacaccgcatcgcctatctccgccagcgccccagcaaccccttcgaccgaggcctgacccgcaacctggcccacttcttctgtggatggccctcagggtcctgggagaccctctgggctgaggaggaggaagagggcagcagcccagctgtttagggttgctggaggccgggctaccgtcttgtgcctgaaaaccacggggcctgtccccagctggggtgagcgctcagagggcctggggccctcactcctgcccacgcctcccagaccccagaacggagcttcaagtcagacagatccctgccttggtgggcagttctgccttccaaggaagaaggggaagaaaaggacctgtgggtggctcaggcccaagcagaccccgggctccaccccagccccgcccaggctgctgccagtgcacacttttacaaatttaatataaagcaagtccagtcttaaaaagacaa

SEQ ID NO: 204401 - DNA, 646 bp, Homo sapiens
  Payload ID: 20317
  Gene Name: zinc finger, DHHC-type containing 12
  ENST ID: ENST00000406904
  CDS Start-End: 17-646
gccccgggccgaggcgatggcgccctgggcgctcctcagccctggggtcctggtgcggaccgggcacaccgtgctgacctggggaatcacgctggtgctcttcctgcacgataccgataaaagtgcagatgaactgctggccacacacagccactcatggaaccaacatctccaggcctttgctcagccaggaacacacttccccacctccaactgcaccccaaccccacccactcctgttctacccggcccagcctcactgtgctctccggcctctccagagctgcggcaatgggaggagcagggggagctgctcctgcccctcaccttcctgctcctggtgctgggctccctgctgctctacctcgctgtgtcactcatggaccctggctacgtgaatgtgcagccccagcctcaggaggagctcaaagaggagcagacagccatggttcctccagccatccctcttcggcgctgcagatactgcctggtgctgcagcccctgagggctcggcactgccgtgagtgccgccgttgcgtccgccgctacgaccaccactgcccctggatggagaactgtgtgggagagcgcaaccacccactctttgtggtctacctggcgctgcagctggtggtgcttctgtgg

SEQ ID NO: 204402 - DNA, 644 bp, Homo sapiens
  Payload ID: 20317
  Gene Name: zinc finger, DHHC-type containing 12
  ENST ID: ENST00000452105
  CDS Start-End: 29-644
cttccgggtggggccccgggccgaggcgatggcgccctgggcgctcctcagccctggggtcctggtgcggaccgggcacaccgtgctgacctggggaatcacgctggtgctcttcctgcacgataccgagctgcggcaatgggaggagcagggggagctgctcctgcccctcaccttcctgctcctggtgctgggctccctgctgctctacctcgctgtgtcactcatggaccctggctacgtgaatgtgcagccccagcctcaggaggagctcaaagaggagcagacagccatggttcctccagccatccctcttcggcgctgcagatactgcctggtgctgcagcccctgagggctcggcactgccgtgagtgccgccgttgcgtccgccgctacgaccaccactgcccctggatggagaactgtgtgggagagcgcaaccacccactctttgtggtctacctggcgctgcagctggtggtgcttctgtggggcctgtacctggcatgcaccaggcccctgtcccctgcaccgcaggtcaggcctccggttcttccagccctggggtcagtggttgcggtccagcgggctcctgttcgccaccttcctgctgctgtccctcttctcgttggtggccagcctg

SEQ ID NO: 204403 - DNA, 2283 bp, Homo sapiens
  Payload ID: 20318
  Gene Name: zinc finger, DHHC-type containing 13
  Uniprot ID: Q8IUH4
  ENST ID: ENST00000399351
  CDS Start-End: 350-1828
gggcgccagcaggaagtgggagaagaggcgacccaaggcgggctggcgggctggcggcagtcgctacttgcctagtagcctcagccgctgtgggctcctggggagatggaggggccggggctgggctcgcagatacggaatttttgaacgatgtaaagagttggtagaagcaggatatgatgtcaggcaaccagataaagaaaatgtgtcgcttcttcattgggctgctattaacaacagactggatcttgtaaagttttatatttcaaaaggtgctgttgtagatcagttgggtggagatttaaattcaactcctcttcactgggccatccgacaaggacatttacctatggtcatattattactccagcatggtgcagaccccactcttattgatggagagggattcagcagcatccacctggcagtattgtttcaacacatgcctattatagcatatctcatctcaaagggacagagtgtgaatatgacagatgtaaatgggcagacacctctcatgttatcagctcacaaagtaattgggccagaaccaactggatttcttttaaagtttaatccttctctcaatgtggttgataaaatacaccaaaacactccacttcactgggcagttgcagcaggaaatgttaatgcagttgataagcttttggaagctggttctagcctggatatccagaatgttaagggagaaacacctcttgatatggctctacaaaacaaaaatcagctcattattcatatgctaaaaacagaagccaaaatgagagccaaccaaaagttcagactttggaggtggctgcagaaatgcgagctcttcctgctgctgatgctttctgtgattaccatgtgggctattggatacatattggacttcaattcagattcttggcttttaaaaggatgtcttctagtaacactgttttttctgacatctttgtttccaaggttcttggttgggtataagaaccttgtatacttaccaacagcctttctgctaagttctgttttttggatatttatgacttggttcatcttattttttcctgatttagcaggagcccctttctatttcagtttcattttcagcatagtagcctttctatactttttctataagacttgggcaactgatccaggcttcactaaggcttctgaagaagaaaagaaagtgaatatcatcacccttgcagaaactggctctctggacttcagaacattttgtacatcatgtcttataaggaagccattaaggtcactccactgccatgtatgcaactgctgtgtggctcgatatgatcaacactgcctgtggactggacggtgcataggttttggcaaccatcactattacatattcttcttgtttttcctttccatggtatgtggctggattatatatggatctttcatctatttgtccagtcattgtgccacaacattcaaagaagatggattatggacttacctcaatcagattgtggcctgttccccttgggttttatatatcttgatgctagcaactttccatttctcatggtcaacatttttattattaaatcaactctttcagattgcctttctgggcctgacctcccatgagagaatcagcctgcagaagcagagcaagcatatgaaacagacgttgtccctcaggaagacaccatacaatcttggattcatgcagaacctggcagatttctttcagtgtggctgctttggcttggtgaagccctgtgtggtagattggacatcacagtacaccatggtctttcacccagccagggagaaggttcttcgctcagtatgaagaaaagcaacccaaaactctcaatctgatttgtttttgtttatgtcgatgccctgtagtttgaaagtgaagtaaagatttagaattcacctaagtccaaaggaaaacacgtggtttttaaagccattaggtaaaaaaagttctcaataaaggcattacaattttttaggtttagaaagatggacttttctgataaatcttggcagacatctaaaaaaaaaaccatatttttcacaagaaaatgcaagttactttttttggaaataatactcactgattatggataaaatggaatattttcagatactatattggctgtttcaaaatagtactattctttaaacttgtaatttttgctaagttatttgtctttgttgtatctataaatatgtaaaaaatatttaaatagatgtacctgttttgctttcacacttaataaaaaatttttttttgta

SEQ ID NO: 204404 - DNA, 2445 bp, Homo sapiens
  Payload ID: 20318
  Gene Name: zinc finger, DHHC-type containing 13
  Uniprot ID: Q8IUH4
  ENST ID: ENST00000446113
  CDS Start-End: 122-1990
gcagcggcggaggtgagggcgccagcaggaagtgggagaagaggcgacccaaggcgggctggcgggctggcggcagtcgctacttgcctagtagcctcagccgctgtgggctcctggggagatggaggggccggggctgggctcgcagtgcaggaatcacagccatggcccccaccctccaggatttggtcgatatggcatctgtgcacatgaaaacaaagaacttgccaatgcaagagaagctcttcctcttatagaggactctagtaactgtgacattgtcaaagctactcaatacggaatttttgaacgatgtaaagagttggtagaagcaggatatgatgtcaggcaaccagataaagaaaatgtgtcgcttcttcattgggctgctattaacaacagactggatcttgtaaagttttatatttcaaaaggtgctgttgtagatcagttgggtggagatttaaattcaactcctcttcactgggccatccgacaaggacatttacctatggtcatattattactccagcatggtgcagaccccactcttattgatggagagggattcagcagcatccacctggcagtattgtttcaacacatgcctattatagcatatctcatctcaaagggacagagtgtgaatatgacagatgtaaatgggcagacacctctcatgttatcagctcacaaagtaattgggccagaaccaactggatttcttttaaagtttaatccttctctcaatgtggttgataaaatacaccaaaacactccacttcactgggcagttgcagcaggaaatgttaatgcagttgataagcttttggaagctggttctagcctggatatccagaatgttaagggagaaacacctcttgatatggctctacaaaacaaaaatcagctcattattcatatgctaaaaacagaagccaaaatgagagccaaccaaaagttcagactttggaggtggctgcagaaatgcgagctcttcctgctgctgatgctttctgtgattaccatgtgggctattggatacatattggacttcaattcagattcttggcttttaaaaggatgtcttctagtaacactgttttttctgacatctttgtttccaaggttcttggttgggtataagaaccttgtatacttaccaacagcctttctgctaagttctgttttttggatatttatgacttggttcatcttattttttcctgatttagcaggagcccctttctatttcagtttcattttcagcatagtagcctttctatactttttctataagacttgggcaactgatccaggcttcactaaggcttctgaagaagaaaagaaagtgaatatcatcacccttgcagaaactggctctctggacttcagaacattttgtacatcatgtcttataaggaagccattaaggtcactccactgccatgtatgcaactgctgtgtggctcgatatgatcaacactgcctgtggactggacggtgcataggttttggcaaccatcactattacatattcttcttgtttttcctttccatggtatgtggctggattatatatggatctttcatctatttgtccagtcattgtgccacaacattcaaagaagatggattatggacttacctcaatcagattgtggcctgttccccttgggttttatatatcttgatgctagcaactttccatttctcatggtcaacatttttattattaaatcaactctttcagattgcctttctgggcctgacctcccatgagagaatcagcctgcagaagcagagcaagcatatgaaacagacgttgtccctcaggaagacaccatacaatcttggattcatgcagaacctggcagatttctttcagtgtggctgctttggcttggtgaagccctgtgtggtagattggacatcacagtacaccatggtctttcacccagccagggagaaggttcttcgctcagtatgaagaaaagcaacccaaaactctcaatctgatttgtttttgtttatgtcgatgccctgtagtttgaaagtgaagtaaagatttagaattcacctaagtccaaaggaaaacacgtggtttttaaagccattaggtaaaaaaagttctcaataaaggcattacaattttttaggtttagaaagatggacttttctgataaatcttggcagacatctaaaaaaaaaaccatatttttcacaagaaaatgcaagttactttttttggaaataatactcactgattatggataaaatggaatattttcagatactatattggctgtttcaaaatagtactattctttaaacttgtaatttttgctaagttatttgtctttgttgtatctataaatatgtaaaaaatatttaaatagatgtacctgttttgctttcacacttaataaaaaatttttttttgta

SEQ ID NO: 204405 - DNA, 328 bp, Homo sapiens
  Payload ID: 20319
  Gene Name: zinc finger, DHHC-type containing 14
  ENST ID: ENST00000340347
  CDS Start-End: 1-328
caggggggtaccgcccgcctcccagaaccaaagaagtcatcatcaatggccagaccgtgaaacttaaatactgtttcacctgcaagattttccggccccctcgcgcctcccattgcagcctttgtgataactgcgtagtctttatatttgcattcgttatcacccacgtcattcttcgttcacagcaaacaggattcctaaatgcccttaaggacagtcctgcaagcgtcctggaggctgtggtgtgcttcttctctgtctggtccatcgttggcctctcaggattccacacctacttgatcagctccaaccagacaacaaatgagga

SEQ ID NO: 204406 - DNA, 7380 bp, Homo sapiens
  Payload ID: 20319
  Gene Name: zinc finger, DHHC-type containing 14
  Uniprot ID: Q8IZN3
  ENST ID: ENST00000359775
  CDS Start-End: 890-2356
cgcccacccggcccggaggaggcggacccactcggagcgccgcgcgcgcgccgggctgagccttgcaaacaagtgtctgtgctgtgtccccgcggccctcctcgcgccggggccgcttcctccgggtaggagggagcaagggagccctcgccgcgcggcccgcgagccgccgccgccctcggcccgcgcatccccgcgcgggggccgcggattcgactaggctgccaggcgcagcgacaccgggtcgcggtgcgagcggcgccccggctctcgccgagaggctcctgacagaaaaacgtgcgtggttgtccccacccctgggaggggttgccggtgccgcgcgcggccgcccagtcgccagcgctctctcctgggaggatccgctgccggaggaaggagtggacccaacctggccgcgccgcagaagtggctcccgaggaagccggcgccggggccgccgcctcgtgtcccctcggggcgcagtgctcgggggtcggcgggccagagccgaggcgcggccggggagccgggggctgcggggccgagcgggcagccgcgcgagggggcgggcgctcggcgacccgggggccggccgggctgagccccgcgccccgggacgcgggctggaagcgacggaggagtgctgccgcgggctgcggaccagcgccgtcccctcacggagcggggattctgctatgacagttgggctccccggagggttaacctgggtgtcctcggcaaagttgtcgccgagccgggagcccgtgtaggggccgcggcgccgcggctcggggggcggccgggcggccggcggcggtcgtggctcggcggggcccgcgcggccggggggctcctgggggtgtgcgcccccagccggctgccctcgtggatgcctcccggcggcggcgggcccatgaaagactgcgagtacagccagatcagcacccacagctcctcccccatggagtcgccccacaagaagaagaaaatcgcggcccggaggaaatgggaggtgttcccgggaagaaacaagttcttctgtaacgggaggatcatgatggcccggcagacgggcgtcttctacctgacgctcgtcctcatcctggtcactagcggactcttcttcgccttcgactgtccgtacctggcggtgaaaatcacccctgccatccctgcagtcgctggcatcctgttcttctttgtgatggggaccctgctccgcaccagcttcagcgaccccggagtcctcccacgagccacgcctgatgaagccgccgatctggaaaggcaaatagatatcgcaaacggcaccagttcaggggggtaccgcccgcctcccagaaccaaagaagtcatcatcaatggccagaccgtgaaacttaaatactgtttcacctgcaagattttccggccccctcgcgcctcccattgcagcctttgtgataactgcgtagaacggtttgatcaccactgtccctgggtaggcaactgtgtggggaaaagaaactacagatttttttatatgtttattttatctctgtcttttctgacagtctttatatttgcattcgttatcacccacgtcattcttcgttcacagcaaacaggattcctaaatgcccttaaggacagtcctgcaagcgtcctggaggctgtggtgtgcttcttctctgtctggtccatcgttggcctctcaggattccacacctacttgatcagctccaaccagacaacaaatgaggacattaaaggatcctggtcaaataaaagaggtaaagaaaattacaatccctacagctacggaaatatctttaccaactgctgtgttgccctgtgtgggcccatctcaccaagcctgatcgacagaagagggtacatccagcccgacacgccgcagccagcagcaccctccaatggcatcaccatgtacggggccacgcagtcacagagtgacatgtgcgaccaagaccagtgcattcagagcaccaaattcgttttgcaggctgcagccacgcccctgctgcagagcgagcccagcctcaccagcgacgagctgcacctgcccgggaagcctggcctgggcacgccctgcgccagcctcacactgggcccgcccacaccgcccgcctccatgcccaacctcgccgaggccacgctcgcggacgtgatgccccggaaagatgagcacatgggccaccagttcctgacgcccgatgaggcgccctcgccccccaggctactggcggcgggcagccccctggcgcacagccgcaccatgcacgtgctgggcctggccagccaggactccctgcatgaggactctgtgcgcggcctggtgaagctcagctccgtgtgacccacatggccccaggccgggggacaccagaggctcctccatgggcagcaggagtgagcggaggggtgtgtcccacagcgactttcccagccaatgccacggtggagatgacagccccaggtctggggtacagagaccacttaggatggcacagggtggctggccccggatgctgagagcttggtttcatttgaattttcttccccaacctgagtgctttgacaacaatggaaatagagaagtggctgctttcttttggtgaccctccaggggtggaatcggagtgtgtctgcccgcccttgtgacagacacacggaaggcttctgacgcttgtggccagactgcaattgcacttatgtgttatgctactaatatttgaaacagacctgccattccatttgttaattaaaaaaaaaaaaaatcctaaagggaaaaaaccgaccaggtgtggatctgcatgccacgctgccgtctgtgttacagtggtgttgctatttccaaggaagtgctgctttctttttctttttttaattttgtgaattttcaagtgctgttttgttggaagacagtgcaacgaactgagactaatggacagtgtcatcactcagcttactgggctgaggcgtctgtggagaggtggcaccggggctgcagagggcggctggggttccgtcgtgtcgggtgtcacttcaccttctgtttggccgctcgatgaggtctcgtgttgagatattgtgtgccacaacccccacagtcttcacctccgtgtgtgatgaaacttcccgtggacagccaataaaatgacgtcctctgttattttggatctgcgtacggttatccttaatagcataaatgaaaacaaagtcatccagatggggagagtttttcttgaaatgtccctagcgaggaatggtccccagacaaccaaaagtcaaatctttgaactgggagatatttatagaataatttcttagataagaggcaagttttccatcatttattttctttaattatctctttttgacaccatcttagtggaatttgctctacgtttgcagtttgccgtgcaacagttgatcggaagtagggagaggggaggggacgctcagggagaaggttctgtcgggcgtcttctgggcttccttctgtgttaacgtgtcactcaatcccagaagtgcaacttgaggtcctagtaaaggtatcagaaaatgaggaggagaaatcggcttacagtctaagctgagatcatgtaggtcatcatccttcctagacactgatcagaatgaaattaagaaaatgaccactttgttcactttcattggtcacctagaagggaacgaactggctctggacttagggagtgtgtcactatgggggcagccacaggggacacagcaactcctctcctggcttctttccagaccataaatctaacagctaaagctactcaagttcaaagccatggccttgctccttataaccatatgaaagacaagacacattgaccaatgatacaagtaacccaagtgatttgcatttatggaaaaaggctattactcctgagaaagagttgccattttatataaaagaaaagaagataggaaaaagaaaagcacacaagttttatttggaatgaaggcaattcacaggtcacaaaataattcatgctgaaagggcctgcagagttcttgcactgtgatgtcttcgagccatctttattgtcatgctgcatgcacgtatagaaaatggaataggtccattctatgtagccatttttgattttctgaaccacctaactacttgtacccacctgcaatgtgtaattcatggggcagtgccctccttacacaaccgcacacgctcacaggcaccaactcacagggattctccttgtccacgctacctgtgagcccaaagtgacagccccacaaaggagcttccacaacttcccaaaccgtctctgctccttgctttcttccacctgctccccagaggccccaggaaggagttggccctgatgagaacggtgctccatgggtgaccgcgaatccggcttagccctcactccggtcccacgtgtggcccagtccattctcagctcattcccctggaaagcaagatcatggtcttcagaggcctcccgcttctaacatttcctaactcagtggttgccactctcctgtgaccagcccttcttcccacctcactgtgaaaaattcccagaagccaggatcacgactcacttgtcttcacataatggatatttacttaatatttattatcaatttccccacctccaaccctgtccctggcacacacttggcatcatttatccaataggggactgggaattttggtgaagtgaatcaaggctattcagggtcaagagagagattaacttgaatgggccaatttgctagataattaatgtcttaaaaaccaaaaccagagagaagcccacagccctgtcctctgtggcttgaaaaagaaacccagcatcagaggaatgagcgatgatgccccctggggcgcccacttctgtttgtcaggagggatggtcggaggggcagctcacctggcgaggtgatggctctgcatttcccacgaacatatatgtgacatgtacataaatataaatacttatgtttataaatgttgaatggttccttctagctgtggctgagtagacgttggtgtttctaacttctttcagtgtgttagagattgattacatgctagctataaaaagtaaaataaatattttaccatgctattaaagcttggaccattatcaaacacacacaaacacacactcattctgctgtttaaaaattcatctgcgttcgttctcccaggagtgctccagggaaccacaggcttcccggcacttgaaggctgaactgagcgtgagtgccctggtccccaggaagcaggcggatgctgcaggaaggtggcagacagcctgcatccaggagggccccaggaagtggggatgctgcaggaaggcggcacaaagcctgcatccgggagggccccaggaagcagggggatgctgcaggaaggtggcagacagactgcatccaggagggcacagtgacctgtcactccgttctgcagaaattggcccagcagttgcgttatgcccaaccaaaagatgctcgttccagctttcaaatgtgatgatttcagcctgtgaggacaatgccatgtccccaccctaagccagcaaaatgcgaaatctctgttctggcccagaatggcacaagggaggagtctttgcagagttccacgccaccccccagcttactgcggccttcaccggctctgtctaggattgccagctgtggttccaagtgaggagcaaacccattttatgagccatgttcctgcggagacctgatgggccaggccttctgtggctttgaaaacccctaagctcttcacctcctgggcctaggccttcttgtctgactcaacagcaagaaaaatgaacttgccaaaattggcagtaggtgtccttgacacaggggcttctgatggcatcgcccagaaaatgctggaaccagaactggtcagagactttgaagggcacagcctggcgggctactccccaagggtctcaggtctctgcccacctgactaccctgcagcaaacgcttctctgtaacctgacttctcccttcagacctcagcctacaaccatcctcttcatgccaggaaccaactgcttctcagcctcggcttagggtcttaagttcaccagaagggatcggggtttgcgttgatattataaggaatcttcccagaaggagctgcccttcatccatccacaagaatacattgagttcatttagttcttgaccaggtaagaaaagaataaaggagaacaaatattaaatactcttttctaattgatgccttactactgttttgaagctgagccgaaatcaaattgatgtttacattttctatcaagtacacatgagctgtgggagtctagcatattcttgtccaaaagagagagactttcaaatgaattcctattcctcttggtcccctccacctattttggaggtctgcatgtggagttgtatgctattttccaaggtacctcatttaaaaaaaaaaaaaaaaaaaaactgcctctcatttgttcccttaaaacgtctctctctctcataaaactaagttatcattgaaatattaaacgatctgaagcgtctttttttttttcaaataaatgtcaaagatggtaatagtttgtaaatcagtaaatcctctgtccatctgcccattgtccatggtcctgataatagagccaagatggattttcacatgtaaggtgttagtccattaatccagccattaaaagtagttgggagattgaagattagatggtttctggagcaaccgaatttgcagctgccacaaaactagataaatagccacaactggagttattttttgatctcataaaccccaggaattacacacagaatggattgaaaagcagacaagcatcttgtgctattgcagagacttttctacccaggaagtgttgaatttttaaaagaaacttgatattggtgataaaggtatgaatgaacaactctcttacttgccctcgatgtttcaagatgcctggtgaaaccgagaggccacatggcatgtccaaggagacatgctttctgggttctatatgaatagagatggttttagcctgcaattaaaaaaaaaaaaaaaaacggttgaagccttgctaactttttcccagagcattctgggttgatatttcacagtcaaacgttttggcatggaaaaaaaaaaaagcattttaaactcttagtgaattcaaagctctaaatccaaacaatggtgaacacatgtacataacatttcatgttttcagagatacgtatgcttatttaagtgcctttcatgttttaatcaatgtttgcagaatttatcttaaacctgagatgaattaaaaaatttttctccttcaataaaaactgctaatggca

SEQ ID NO: 204407 - DNA, 3134 bp, Homo sapiens
  Payload ID: 20319
  Gene Name: zinc finger, DHHC-type containing 14
  Uniprot ID: Q8IZN3
  ENST ID: ENST00000414563
  CDS Start-End: 890-2311
cgcccacccggcccggaggaggcggacccactcggagcgccgcgcgcgcgccgggctgagccttgcaaacaagtgtctgtgctgtgtccccgcggccctcctcgcgccggggccgcttcctccgggtaggagggagcaagggagccctcgccgcgcggcccgcgagccgccgccgccctcggcccgcgcatccccgcgcgggggccgcggattcgactaggctgccaggcgcagcgacaccgggtcgcggtgcgagcggcgccccggctctcgccgagaggctcctgacagaaaaacgtgcgtggttgtccccacccctgggaggggttgccggtgccgcgcgcggccgcccagtcgccagcgctctctcctgggaggatccgctgccggaggaaggagtggacccaacctggccgcgccgcagaagtggctcccgaggaagccggcgccggggccgccgcctcgtgtcccctcggggcgcagtgctcgggggtcggcgggccagagccgaggcgcggccggggagccgggggctgcggggccgagcgggcagccgcgcgagggggcgggcgctcggcgacccgggggccggccgggctgagccccgcgccccgggacgcgggctggaagcgacggaggagtgctgccgcgggctgcggaccagcgccgtcccctcacggagcggggattctgctatgacagttgggctccccggagggttaacctgggtgtcctcggcaaagttgtcgccgagccgggagcccgtgtaggggccgcggcgccgcggctcggggggcggccgggcggccggcggcggtcgtggctcggcggggcccgcgcggccggggggctcctgggggtgtgcgcccccagccggctgccctcgtggatgcctcccggcggcggcgggcccatgaaagactgcgagtacagccagatcagcacccacagctcctcccccatggagtcgccccacaagaagaagaaaatcgcggcccggaggaaatgggaggtgttcccgggaagaaacaagttcttctgtaacgggaggatcatgatggcccggcagacgggcgtcttctacctgacgctcgtcctcatcctggtcactagcggactcttcttcgccttcgactgtccgtacctggcggtgaaaatcacccctgccatccctgcagtcgctggcatcctgttcttctttgtgatggggaccctgctccgcaccagcttcagcgaccccggagtcctcccacgagccacgcctgatgaagccgccgatctggaaaggcaaatagatatcgcaaacggcaccagttcaggggggtaccgcccgcctcccagaaccaaagaagtcatcatcaatggccagaccgtgaaacttaaatactgtttcacctgcaagattttccggccccctcgcgcctcccattgcagcctttgtgataactgcgtagaacggtttgatcaccactgtccctgggtaggcaactgtgtggggaaaagaaactacagatttttttatatgtttattttatctctgtcttttctgacagtctttatatttgcattcgttatcacccacgtcattcttcgttcacagcaaacaggattcctaaatgcccttaaggacagtcctgcaagcgtcctggaggctgtggtgtgcttcttctctgtctggtccatcgttggcctctcaggattccacacctacttgatcagctccaaccagacaacaaatgaggacattaaaggatcctggtcaaataaaagaggtaaagaaaattacaatccctacagctacggaaatatctttaccaactgctgtgttgccctgtgtgggcccatctcaccaagcctgatcgacagaagagggtacatccagcccgacacgccgcagccagcagcaccctccaatggcatcaccatgtacggggccacgcagtcacagagtgacatggctgcagccacgcccctgctgcagagcgagcccagcctcaccagcgacgagctgcacctgcccgggaagcctggcctgggcacgccctgcgccagcctcacactgggcccgcccacaccgcccgcctccatgcccaacctcgccgaggccacgctcgcggacgtgatgccccggaaagatgagcacatgggccaccagttcctgacgcccgatgaggcgccctcgccccccaggctactggcggcgggcagccccctggcgcacagccgcaccatgcacgtgctgggcctggccagccaggactccctgcatgaggactctgtgcgcggcctggtgaagctcagctccgtgtgacccacatggccccaggccgggggacaccagaggctcctccatgggcagcaggagtgagcggaggggtgtgtcccacagcgactttcccagccaatgccacggtggagatgacagccccaggtctggggtacagagaccacttaggatggcacagggtggctggccccggatgctgagagcttggtttcatttgaattttcttccccaacctgagtgctttgacaacaatggaaatagagaagtggctgctttcttttggtgaccctccaggggtggaatcggagtgtgtctgcccgcccttgtgacagacacacggaaggcttctgacgcttgtggccagactgcaattgcacttatgtgttatgctactaatatttgaaacagacctgccattccatttgttaattaaaaaaaaaaaaaatcctaaagggaaaaaaccgaccaggtgtggatctgcatgccacgctgccgtctgtgttacagtggtgttgctatttccaaggaagtgctgctttctttttctttttttaattttgtgaattttcaagtgctgttttgttggaagacagtgcaacgaactgagactaatggacagtgtcatcactcagcttactgggctgaggcgtctgtggagaggtggcaccggggctgcagagggcggctggggttccgtcgtgtcgggtgtcacttcaccttctgtttggccgctcgatgaggtctcgtgttgagatattgtgtgccacaacccccacagtcttcacctccgtgtgtgatgaaacttcccgtggacagccaataaaatgacgtcctctgttattttgga

SEQ ID NO: 204408 - DNA, 861 bp, Homo sapiens
  Payload ID: 20319
  Gene Name: zinc finger, DHHC-type containing 14
  ENST ID: ENST00000518214
  CDS Start-End: 1-370
ctgtccgtacctggcggtgaaaatcacccctgccatccctgcagtcgctggcatcctgttcttctttgtgatggggaccctgctccgcaccagcttcagcgaccccggagtcctcccacgagccacgcctgatgaagccgccgatctggaaaggcaaatagatatcgcaaacggcaccagttcaggggggtaccgcccgcctcccagaaccaaagaagtcatcatcaatggccagaccgtgaaacttaaatactgtttcacctgcaagattttccggccccctcgcgcctcccattgcagcctttgtgataactgcgtagaacggtttgatcaccactgtccctgggttcacagcaaacaggattcctaaatgcccttaaggacagtcctgcaagcgtcctggaggctgtggtgtgcttcttctctgtctggtccatcgttggcctctcaggattccacacctacttgatcagctccaaccagacaacaaatgaggacattaaaggatcctggtcaaataaaagaggtaaagaaaattacaatccctacagctacggaaatatctttaccaactgctgtgttgccctgtgtgggcccatctcaccaagcctgatcgacagaagagggtacatccagcccgacacgccgcagccagcagcaccctccaatggcatcaccatgtacggggccacgcagtcacagagtgacatgtgcgaccaagaccagtgcattcagagcaccaaattcgttttgcaggctgcagccacgcccctgctgcagagcgagcccagcctcaccagcgacgagctgcacctgcccgggaagcctggcctgggcacgccctgcgccagcctcacactg

SEQ ID NO: 204409 - DNA, 5796 bp, Homo sapiens
  Payload ID: 20320
  Gene Name: zinc finger, DHHC-type containing 15
  Uniprot ID: Q96MV8
  ENST ID: ENST00000373367
  CDS Start-End: 232-1245
cacccttccgctccaacatggctagttcctcaacgccgtgactcaagcctgttgtgccaggcagggcgcactcagcagcgcagccccacaggtggcgaaggctccgcgagagggttcccgccaggctagacagtggagtgccgcacagcgcgccttccagcctcgcagccgccaccctagcggttccgacccggcgccagcaggcctgcttggtcgatcttcgagccaaagatgcggcgaggctggaagatggctctgtctggggggctgcggtgctgccgccgggtactgtcctgggtgccagtgctcgttattgtcctcgtcgtgctctggtcctactatgcctacgtctttgaactctgcctggtgactgttttgagcccagcagaaaaagttatttacctcatactctaccatgccatctttgtgttctttacctggacctactggaagtctatctttacactcccacagcagccaaaccagaagttccacttgtcctacacagacaaggagcgctatgaaaatgaagaaagacctgaggtccagaagcagatgcttgttgatatggccaaaaagctaccggtttacacaagaactggaagtggagctgtacgattctgtgaccggtgtcatctgatcaagccagaccgctgccaccactgctctgtctgtgctatgtgtgtgttaaaaatggatcatcactgcccttgggttaataactgcattggattttccaactacaaattcttccttcaattcttagcttactctgttctctactgcctgtacattgctacgacagtcttcagctatttcatcaaatactggagaggggaattacccagtgttcgctctaagttccatgtcctttttcttctctttgtggcctgcatgttttttgtcagccttgtgattctctttggttaccattgttggcttgtcagcagaaacaaaaccaccttagaggccttctgcactccagtgtttacaagtggcccagagaaaaatgggttcaaccttggcttcatcaagaatatccagcaggtgtttggagataagaagaagttctggttaatacctattggttccagccctggtgatggacactccttccctatgaggtctatgaatgagtcacagaacccactgctagcaaatgaagaaacctgggaagacaacgaggatgacaaccaagattatccagaaggctcatcatctcttgctgtggaaacggaaacatagcagttttcacatttcctgcatctctcagacaggactcaccatctctgcctcccatgaggcttacagagttcaatgttggaaatcattgtaatcttcaaaataagtcaccgtgttggattgaaagcttcaaaatttgaaagaattccatcaaatacttgctgtgtaaatgtttctggactttatgttatttaatttactgactgaaatccaatttggaatttggtagcagttaattcaagccaattttttttgtttcttcatttcccctcccccaatccatgaaagcctaaatgtaaaatatatcttttcattcatcttatcaggtaaaaggaaattcagaaaatttccttagagtctttaattcccccacaaagattattaatcacatatatagggcctttttggtgttgaagggaatcaaactacatttgctgcttgtgtgcgtgtgcatttgtgaacacgtacagcatatctatacaaaattctgctatagtgtgaaaatcagggctaaaaacctgaagcctttgtttaattatgcttttcctctaaatagcaacttaaatatttgctagactttgaatcatcgctatatcaagtatctaaaatttgggagggtgaatcagtacactgtgaccaaggtcctcaaattggaatttgaacaacaatgtaaaacctgttctgtcacaaatgttcctgaaagcaccacagctactcaagaagatcaaattcaggacataaactttattgaacataataaccagtgttttttaaagacttttttgtcagggtgcagtaaaattctccaattacttttattcatttatctgcttcctagttttattttagcctttatgagttattttatgatgaaagaaaatctataagcctaagttatggcccataggttttgttaagggttttcagagtgattttcaggtttaatttcactgcctttcataagggtaaagtttcacagctgacattagcctgaggattagcactaaagagctgtgttttcatagcaggggctattgtacagacagtgataaccaaatagtaatatgccagttctttcttctttttttagcttcagtagtagctaagccattaatacagtttgcatcaatttccccatttatttataatcagcctttcttttagtcctagtgcctgaatcaatgagtgagaatactagtactgattctttacaataataatatcttaagagtattgatatctttcattttttcatccagcagtctagtgcccagctgctgacaataaaagctccaactcttttagagatcagtggaatttagaagcatcttacaggtatcaaggaattgagcttctagagggatggtttggcttactaatttatcttccctgaaatatgtttgagtaaaaaagagttgcctgccacaatttagtgttggggttccagtggagctgagaaagtgaacaatccagctacttaaagcaacaacaaaacctgttcatctggatccctaggtaattttgaccaaggtgagacttttggcataaattaaatggattgtggtcagcattacatttgagagaatactagacatgactacacttattagggctagtgactttctcaaactcagaagctaaaaagcagcctagatgactatgcacacactgggtttcaagatgaaatcttcttatatattcagatggaaaaaaatttccccttacactctttctcaaaatactctcatttcggtttttcctgaaaccttatttggccattcccatggttttatgacagacaagccttgtcttctattcatatagatatgcacctttttctacatgtatggcctttacttactacacagcaagtaggcctcaaagtaatcttcctctttcccatcaatcatcttctgccaagcattcaggcagagcagctgttaactgtgattcaaagtcagaaaaacatcaagaacttctttgatgcatagggtgtatcagcactcagctcccacagaagtcaagtcacaaaatatagtgtcagttaactataaggaagttccggagaggtaaagctcaggaaagatgtaatgcaaagctgattgtttaatgtcttacagatttacactgtctttaaaaggccaaataaggctgggcgcagtggctcacacctgtaatcccaacattttgggagcccaaggcggccggaccacctgaggtcgggagttcaagaccagcctgaccaacatggagaaaccctgtctctactaaaaatacaaaaattagccaggagtgttggtgcatgactgtaatcccagctactcaggaggctgaggcaggagaatcgcttgaacctgggaggtagaggttgtggtgagctgagatcgtgccattgcactccggcctgggcaataagagtgaaactctgtctcaaaaaaaaaaaaaaaaaaaaaaaaagccaaataaatcagggttttaccaggggctcagagataaaaagaaaacctattcctatcttagcattttggtctcattggtttatagactctgataatatccctatccatggatcatttgagtattgactaatgtacataggtacccaactggttgattattaatcaagaatacagaactttatttaataattagcacaccctgatctggcttctttgcttgcttttctttggatccctgtccaataacctctgtggaatctcattccctaattgttgatactcattttctccgtttgcaaaatgaagatactcattgttaggatcctactgctgaagggtgctatgtcactttctagtgctcttatatgtctttaattataggactggaatgaaaagcttaaccatacagtatttctaagcaaaataatgtactccattcttttgtccatgctctcattgctgatttgttcttgcaggacttagagcactttgttaatgttcttccattcactccaacagcgtcctcagaaagagacagaataaaaaaattgttccccatggtacagctggaaaaattaaggggaaaagagattaagtggtccccaatggaacacagctgtcttatgcagggctcacagttaccatgttcagtacattgttaaagtaacttggcttcccaggactggaattatcatggagcagttagaattttgagagtaattacaacaggatcacattctgaaagagtcacattttgtcaaaaatctgaaaagtatgcaatttgtacaactcttactttctatgtgataagaatgcaatatgtgcctctttcccctactagccccatgtgacacatatttttcacactatgtggcatcaaccagtgccattacctcctgtggcaccatagagcccaatctcagggcagacattgccaaggtaaagaatgcactccatgtttataccaaattgcacaaagtatagacattgaggttaatggagatttaagcacaatcctagcaagtaagttttaagaatactgaatattatacattattgtaacatgaacctaaaattaatttaacagggcccaaattcataggaatgtaacagtcattgaaagcctattcttttcacctctcatcacacatatctacatacatgtatgcacatgtacacacacacacacacacacacacacacacatacacattttctccaaagcaggctgcctcttcagcaggagcaaatactttaatttaaaagaatgattatctgttttctccttttagaaaaagagtctaagaaacacagcatgtgaagaacattagatttatacattccagaatctctgctctcagagtagctaagagattcggtacagaagacgttctatggagaagcacagggggcatctaatgagattgtcaggcccttggacaagatccatattcttagaaaattaatgagttccatctcgttaggaattggttgatgaggtatggtacatctgcatttctttaaccatagctgtaatgtaccatattaaattgtagccttttgcatgcgggtattatataataatgaatgggtggctcctagtagcatgcaacccatgactgtttacttccctaaaagggttaggtctgtgtcctgcacagtgttcaaaaccattaaatgtgttctttgtagcaggatggtacacagccatcagcagaatgagttaaaaccaacaatgaattcaatataccaggaaatagattgttagtagggaatggcattaaaggaaaaaaaaattagataagatgcattcaaggaataattactttcactctgctggcttaatcagtgaaggaacataaaaggaaagctggcagtgggtcttggtaatatatgaactatattagagtgccagaaaaggagacctcagaagttaagcataggttgccaatctgctacaattatttttcccaccaatctgctcaaaatgattgtatatagtattcttaaaaccatgtgtcttggtgcagaaatattgacaaatgctggccagctttatcttcctatatccttcattaaaagtatatgcatataa

SEQ ID NO: 204410 - DNA, 6012 bp, Homo sapiens
  Payload ID: 20320
  Gene Name: zinc finger, DHHC-type containing 15
  Uniprot ID: Q96MV8
  ENST ID: ENST00000541184
  CDS Start-End: 479-1465
gtgtgtaactgtgggggggggtagcagggggagagaaagagaacgaagggagacagagagactgagacagaaacaaagagggcggacgcagtgcagtaagagcagatgggcggacccaaatttcttcggcttcacgattttgcggaggtctagccctgcatccagccttgaaacagggtggggaggaggcagaaaggggagggactgcactccctctgagcgtgctagctccgactgcctgacggatcacccttccgctccaacatggctagttcctcaacgccgtgactcaagcctgttgtgccaggcagggcgcactcagcagcgcagccccacaggtggcgaaggctccgcgagagggttcccgccaggctagacagtggagtgccgcacagcgcgccttccagcctcgcagccgccaccctagcggttccgacccggcgccagcaggcctgcttggtcgatcttcgagccaaagatgcggcgaggctggaagatggctctgtctggggggctgcggtgctgccgccgggtactgtcctgggtgccagtgctcgttattgtcctcgtcgtgctctggtcctactatgcctacgtctttgaactctgcctggttatttacctcatactctaccatgccatctttgtgttctttacctggacctactggaagtctatctttacactcccacagcagccaaaccagaagttccacttgtcctacacagacaaggagcgctatgaaaatgaagaaagacctgaggtccagaagcagatgcttgttgatatggccaaaaagctaccggtttacacaagaactggaagtggagctgtacgattctgtgaccggtgtcatctgatcaagccagaccgctgccaccactgctctgtctgtgctatgtgtgtgttaaaaatggatcatcactgcccttgggttaataactgcattggattttccaactacaaattcttccttcaattcttagcttactctgttctctactgcctgtacattgctacgacagtcttcagctatttcatcaaatactggagaggggaattacccagtgttcgctctaagttccatgtcctttttcttctctttgtggcctgcatgttttttgtcagccttgtgattctctttggttaccattgttggcttgtcagcagaaacaaaaccaccttagaggccttctgcactccagtgtttacaagtggcccagagaaaaatgggttcaaccttggcttcatcaagaatatccagcaggtgtttggagataagaagaagttctggttaatacctattggttccagccctggtgatggacactccttccctatgaggtctatgaatgagtcacagaacccactgctagcaaatgaagaaacctgggaagacaacgaggatgacaaccaagattatccagaaggctcatcatctcttgctgtggaaacggaaacatagcagttttcacatttcctgcatctctcagacaggactcaccatctctgcctcccatgaggcttacagagttcaatgttggaaatcattgtaatcttcaaaataagtcaccgtgttggattgaaagcttcaaaatttgaaagaattccatcaaatacttgctgtgtaaatgtttctggactttatgttatttaatttactgactgaaatccaatttggaatttggtagcagttaattcaagccaattttttttgtttcttcatttcccctcccccaatccatgaaagcctaaatgtaaaatatatcttttcattcatcttatcaggtaaaaggaaattcagaaaatttccttagagtctttaattcccccacaaagattattaatcacatatatagggcctttttggtgttgaagggaatcaaactacatttgctgcttgtgtgcgtgtgcatttgtgaacacgtacagcatatctatacaaaattctgctatagtgtgaaaatcagggctaaaaacctgaagcctttgtttaattatgcttttcctctaaatagcaacttaaatatttgctagactttgaatcatcgctatatcaagtatctaaaatttgggagggtgaatcagtacactgtgaccaaggtcctcaaattggaatttgaacaacaatgtaaaacctgttctgtcacaaatgttcctgaaagcaccacagctactcaagaagatcaaattcaggacataaactttattgaacataataaccagtgttttttaaagacttttttgtcagggtgcagtaaaattctccaattacttttattcatttatctgcttcctagttttattttagcctttatgagttattttatgatgaaagaaaatctataagcctaagttatggcccataggttttgttaagggttttcagagtgattttcaggtttaatttcactgcctttcataagggtaaagtttcacagctgacattagcctgaggattagcactaaagagctgtgttttcatagcaggggctattgtacagacagtgataaccaaatagtaatatgccagttctttcttctttttttagcttcagtagtagctaagccattaatacagtttgcatcaatttccccatttatttataatcagcctttcttttagtcctagtgcctgaatcaatgagtgagaatactagtactgattctttacaataataatatcttaagagtattgatatctttcattttttcatccagcagtctagtgcccagctgctgacaataaaagctccaactcttttagagatcagtggaatttagaagcatcttacaggtatcaaggaattgagcttctagagggatggtttggcttactaatttatcttccctgaaatatgtttgagtaaaaaagagttgcctgccacaatttagtgttggggttccagtggagctgagaaagtgaacaatccagctacttaaagcaacaacaaaacctgttcatctggatccctaggtaattttgaccaaggtgagacttttggcataaattaaatggattgtggtcagcattacatttgagagaatactagacatgactacacttattagggctagtgactttctcaaactcagaagctaaaaagcagcctagatgactatgcacacactgggtttcaagatgaaatcttcttatatattcagatggaaaaaaatttccccttacactctttctcaaaatactctcatttcggtttttcctgaaaccttatttggccattcccatggttttatgacagacaagccttgtcttctattcatatagatatgcacctttttctacatgtatggcctttacttactacacagcaagtaggcctcaaagtaatcttcctctttcccatcaatcatcttctgccaagcattcaggcagagcagctgttaactgtgattcaaagtcagaaaaacatcaagaacttctttgatgcatagggtgtatcagcactcagctcccacagaagtcaagtcacaaaatatagtgtcagttaactataaggaagttccggagaggtaaagctcaggaaagatgtaatgcaaagctgattgtttaatgtcttacagatttacactgtctttaaaaggccaaataaggctgggcgcagtggctcacacctgtaatcccaacattttgggagcccaaggcggccggaccacctgaggtcgggagttcaagaccagcctgaccaacatggagaaaccctgtctctactaaaaatacaaaaattagccaggagtgttggtgcatgactgtaatcccagctactcaggaggctgaggcaggagaatcgcttgaacctgggaggtagaggttgtggtgagctgagatcgtgccattgcactccggcctgggcaataagagtgaaactctgtctcaaaaaaaaaaaaaaaaaaaaaaaaagccaaataaatcagggttttaccaggggctcagagataaaaagaaaacctattcctatcttagcattttggtctcattggtttatagactctgataatatccctatccatggatcatttgagtattgactaatgtacataggtacccaactggttgattattaatcaagaatacagaactttatttaataattagcacaccctgatctggcttctttgcttgcttttctttggatccctgtccaataacctctgtggaatctcattccctaattgttgatactcattttctccgtttgcaaaatgaagatactcattgttaggatcctactgctgaagggtgctatgtcactttctagtgctcttatatgtctttaattataggactggaatgaaaagcttaaccatacagtatttctaagcaaaataatgtactccattcttttgtccatgctctcattgctgatttgttcttgcaggacttagagcactttgttaatgttcttccattcactccaacagcgtcctcagaaagagacagaataaaaaaattgttccccatggtacagctggaaaaattaaggggaaaagagattaagtggtccccaatggaacacagctgtcttatgcagggctcacagttaccatgttcagtacattgttaaagtaacttggcttcccaggactggaattatcatggagcagttagaattttgagagtaattacaacaggatcacattctgaaagagtcacattttgtcaaaaatctgaaaagtatgcaatttgtacaactcttactttctatgtgataagaatgcaatatgtgcctctttcccctactagccccatgtgacacatatttttcacactatgtggcatcaaccagtgccattacctcctgtggcaccatagagcccaatctcagggcagacattgccaaggtaaagaatgcactccatgtttataccaaattgcacaaagtatagacattgaggttaatggagatttaagcacaatcctagcaagtaagttttaagaatactgaatattatacattattgtaacatgaacctaaaattaatttaacagggcccaaattcataggaatgtaacagtcattgaaagcctattcttttcacctctcatcacacatatctacatacatgtatgcacatgtacacacacacacacacacacacacacacacatacacattttctccaaagcaggctgcctcttcagcaggagcaaatactttaatttaaaagaatgattatctgttttctccttttagaaaaagagtctaagaaacacagcatgtgaagaacattagatttatacattccagaatctctgctctcagagtagctaagagattcggtacagaagacgttctatggagaagcacagggggcatctaatgagattgtcaggcccttggacaagatccatattcttagaaaattaatgagttccatctcgttaggaattggttgatgaggtatggtacatctgcatttctttaaccatagctgtaatgtaccatattaaattgtagccttttgcatgcgggtattatataataatgaatgggtggctcctagtagcatgcaacccatgactgtttacttccctaaaagggttaggtctgtgtcctgcacagtgttcaaaaccattaaatgtgttctttgtagcaggatggtacacagccatcagcagaatgagttaaaaccaacaatgaattcaatataccaggaaatagattgttagtagggaatggcattaaaggaaaaaaaaattagataagatgcattcaaggaataattactttcactctgctggcttaatcagtgaaggaacataaaaggaaagctggcagtgggtcttggtaatatatgaactatattagagtgccagaaaaggagacctcagaagttaagcataggttgccaatctgctacaattatttttcccaccaatctgctcaaaatgattgtatatagtattcttaaaaccatgtgtcttggtgcagaaatattgacaaatgctggccagctttatcttcctatatccttcattaaaagtatatgcat

SEQ ID NO: 204411 - DNA, 1519 bp, Homo sapiens
  Payload ID: 20321
  Gene Name: zinc finger, DHHC-type containing 16
  Uniprot ID: Q969W1
  ENST ID: ENST00000345745
  CDS Start-End: 150-1040
gctgcctggcgctgcgggcggcgggccatggtggtttggattgagccgggcccggccggggcgccgagtcggagggggtggcagtgagcggcggcagaggctacggggctcggtttggctgactggggagtcggcaggcggcaggaaccatgcgaggccagcggagcctgctgctgggcccggcccgcctctgcctccgcctccttctgctgctgggttacaggcgccgctgtccacctctactccggggtctagtacagcgctggcgctacggcaaggtctgcctgcgctccctgctctacaactcctttgggggcagtgacaccgctgttgatgctgcctttgagcctgtctactggctggtagacaacgtgatccgctggtttggagtgggcaggaatgatatcgccaccgtctccatctgtaagaagtgcatttaccccaagccagcccgaacacaccactgcagcatctgcaacaggtgtgtgctgaagatggatcaccactgcccctggctaaacaattgtgtgggccactataaccatcggtacttcttctctttctgctttttcatgactctgggctgtgtctactgcagctatggaagttgggaccttttccgggaggcttatgctgccattgagacttatcaccagaccccaccacccaccttctcctttcgagaaaggatgactcacaagagtcttgtctacctctggttcctgtgcagttctgtggcacttgccctgggtgccctaactgtatggcatgctgttctcatcagtcgaggtgagactagcatcgaaaggcacatcaacaagaaggagagacgtcggctacaggccaagggcagagtatttaggaatccttacaactacggctgcttggacaactggaaggtattcctgggtgtggatacaggaaggcactggcttactcgggtgctcttaccttctagtcacttgccccatgggaatggaatgagctgggagccccctccctgggtgactgctcactcagcctctgtgatggcagtgtgagctggactgtgtcagccacgactcgagcactcattctgctccctatgttatttcaagggcctccaagggcagcttttctcagaatccttgatcaaaaagagccagtgggcctgccttagggtaccatgcaggacaattcaaggaccagcctttttaccactgcagaagaaagacacaatgtggagaaatcttaggactgacatccctttactcaggcaaacagaagttccaaccccagactaggggtcaggcagctagctacctaccttgcccagtgctgacccggacctcctccaggatacagcactggagttggccaccacctcttctacttgctgtctgaaaaaacacctgactagtacagctgagatcttggcttctcaacagggcaaagataccaggcctgctgctgaggtcactgccacttctcacatgctgcttaagggagcacaaataaaggtattcgatttttaaagata

SEQ ID NO: 204412 - DNA, 1647 bp, Homo sapiens
  Payload ID: 20321
  Gene Name: zinc finger, DHHC-type containing 16
  Uniprot ID: Q969W1
  ENST ID: ENST00000353979
  CDS Start-End: 156-1172
gggtccgctgcctggcgctgcgggcggcgggccatggtggtttggattgagccgggcccggccggggcgccgagtcggagggggtggcagtgagcggcggcagaggctacggggctcggtttggctgactggggagtcggcaggcggcaggaaccatgcgaggccagcggagcctgctgctgggcccggcccgcctctgcctccgcctccttctgctgctgggttacaggcgccgctgtccacctctactccggggtctagtacagcgctggcgctacggcaaggtctgcctgcgctccctgctctacaactcctttgggggcagtgacaccgctgttgatgctgcctttgagcctgtctactggctggtagacaacgtgatccgctggtttggagtggtgttcgtggtcctggtgatcgtgctgacaggctccattgtagctatcgcctacctgtgtgtcctgcctctcatcctccgaacctactcagtgccacgactctgctggcatttcttctatagccactggaatctgatcctgattgtcttccactactaccaggccatcaccactccgcctgggtacccaccccagggcaggaatgatatcgccaccgtctccatctgtaagaagtgcatttaccccaagccagcccgaacacaccactgcagcatctgcaacagctatggaagttgggaccttttccgggaggcttatgctgccattgagaaaatgaaacagctcgacaagaacaaactacaggcggttgccaaccagacttatcaccagaccccaccacccaccttctcctttcgagaaaggatgactcacaagagtcttgtctacctctggttcctgtgcagttctgtggcacttgccctgggtgccctaactgtatggcatgctgttctcatcagtcgaggtgagactagcatcgaaaggcacatcaacaagaaggagagacgtcggctacaggccaagggcagagtatttaggaatccttacaactacggctgcttggacaactggaaggtattcctgggtgtggatacaggaaggcactggcttactcgggtgctcttaccttctagtcacttgccccatgggaatggaatgagctgggagccccctccctgggtgactgctcactcagcctctgtgatggcagtgtgagctggactgtgtcagccacgactcgagcactcattctgctccctatgttatttcaagggcctccaagggcagcttttctcagaatccttgatcaaaaagagccagtgggcctgccttagggtaccatgcaggacaattcaaggaccagcctttttaccactgcagaagaaagacacaatgtggagaaatcttaggactgacatccctttactcaggcaaacagaagttccaaccccagactaggggtcaggcagctagctacctaccttgcccagtgctgacccggacctcctccaggatacagcactggagttggccaccacctcttctacttgctgtctgaaaaaacacctgactagtacagctgagatcttggcttctcaacagggcaaagataccaggcctgctgctgaggtcactgccacttctcacatgctgcttaagggagcacaaataaaggtattcgatttttaaa

SEQ ID NO: 204413 - DNA, 1718 bp, Homo sapiens
  Payload ID: 20321
  Gene Name: zinc finger, DHHC-type containing 16
  Uniprot ID: Q969W1
  ENST ID: ENST00000352634
  CDS Start-End: 158-1243
ccgggtccgctgcctggcgctgcgggcggcgggccatggtggtttggattgagccgggcccggccggggcgccgagtcggagggggtggcagtgagcggcggcagaggctacggggctcggtttggctgactggggagtcggcaggcggcaggaaccatgcgaggccagcggagcctgctgctgggcccggcccgcctctgcctccgcctccttctgctgctgggttacaggcgccgctgtccacctctactccggggtctagtacagcgctggcgctacggcaaggtctgcctgcgctccctgctctacaactcctttgggggcagtgacaccgctgttgatgctgcctttgagcctgtctactggctggtagacaacgtgatccgctggtttggagtggtgttcgtggtcctggtgatcgtgctgacaggctccattgtagctatcgcctacctgtgtgtcctgcctctcatcctccgaacctactcagtgccacgactctgctggcatttcttctatagccactggaatctgatcctgattgtcttccactactaccaggccatcaccactccgcctgggtacccaccccagggcaggaatgatatcgccaccgtctccatctgtaagaagtgcatttaccccaagccagcccgaacacaccactgcagcatctgcaacaggtgtgtgctgaagatggatcaccactgcccctggctaaacaattgtgtgggccactataaccatcggtacttcttctctttctgctttttcatgactctgggctgtgtctactgcagctatggaagttgggaccttttccgggaggcttatgctgccattgagacttatcaccagaccccaccacccaccttctcctttcgagaaaggatgactcacaagagtcttgtctacctctggttcctgtgcagttctgtggcacttgccctgggtgccctaactgtatggcatgctgttctcatcagtcgaggtgagactagcatcgaaaggcacatcaacaagaaggagagacgtcggctacaggccaagggcagagtatttaggaatccttacaactacggctgcttggacaactggaaggtattcctgggtgtggatacaggaaggcactggcttactcgggtgctcttaccttctagtcacttgccccatgggaatggaatgagctgggagccccctccctgggtgactgctcactcagcctctgtgatggcagtgtgagctggactgtgtcagccacgactcgagcactcattctgctccctatgttatttcaagggcctccaagggcagcttttctcagaatccttgatcaaaaagagccagtgggcctgccttagggtaccatgcaggacaattcaaggaccagcctttttaccactgcagaagaaagacacaatgtggagaaatcttaggactgacatccctttactcaggcaaacagaagttccaaccccagactaggggtcaggcagctagctacctaccttgcccagtgctgacccggacctcctccaggatacagcactggagttggccaccacctcttctacttgctgtctgaaaaaacacctgactagtacagctgagatcttggcttctcaacagggcaaagataccaggcctgctgctgaggtcactgccacttctcacatgctgcttaagggagcacaaataaaggtattcgatttttaaa

SEQ ID NO: 204414 - DNA, 1877 bp, Homo sapiens
  Payload ID: 20321
  Gene Name: zinc finger, DHHC-type containing 16
  Uniprot ID: Q969W1
  ENST ID: ENST00000370842
  CDS Start-End: 317-1402
gggtccgctgcctggcgctgcgggcggcgggccatggtggtttggattgagccgggcccggccggggcgccgagtcggagggggtggcagtgagcggcggcagaggctacggggctcggtttggctgactggggagtcggcaggcggcaggaagaatgataacagcagacacttatttagtgttaccacattggcaggagtgtccttgctggtatttgtaggacagatagacatctggccaggctttccacttctgcatccctccaggtcattcattcaacaaatatttattgagtacttccatgagccgggaaccatgcgaggccagcggagcctgctgctgggcccggcccgcctctgcctccgcctccttctgctgctgggttacaggcgccgctgtccacctctactccggggtctagtacagcgctggcgctacggcaaggtctgcctgcgctccctgctctacaactcctttgggggcagtgacaccgctgttgatgctgcctttgagcctgtctactggctggtagacaacgtgatccgctggtttggagtggtgttcgtggtcctggtgatcgtgctgacaggctccattgtagctatcgcctacctgtgtgtcctgcctctcatcctccgaacctactcagtgccacgactctgctggcatttcttctatagccactggaatctgatcctgattgtcttccactactaccaggccatcaccactccgcctgggtacccaccccagggcaggaatgatatcgccaccgtctccatctgtaagaagtgcatttaccccaagccagcccgaacacaccactgcagcatctgcaacaggtgtgtgctgaagatggatcaccactgcccctggctaaacaattgtgtgggccactataaccatcggtacttcttctctttctgctttttcatgactctgggctgtgtctactgcagctatggaagttgggaccttttccgggaggcttatgctgccattgagacttatcaccagaccccaccacccaccttctcctttcgagaaaggatgactcacaagagtcttgtctacctctggttcctgtgcagttctgtggcacttgccctgggtgccctaactgtatggcatgctgttctcatcagtcgaggtgagactagcatcgaaaggcacatcaacaagaaggagagacgtcggctacaggccaagggcagagtatttaggaatccttacaactacggctgcttggacaactggaaggtattcctgggtgtggatacaggaaggcactggcttactcgggtgctcttaccttctagtcacttgccccatgggaatggaatgagctgggagccccctccctgggtgactgctcactcagcctctgtgatggcagtgtgagctggactgtgtcagccacgactcgagcactcattctgctccctatgttatttcaagggcctccaagggcagcttttctcagaatccttgatcaaaaagagccagtgggcctgccttagggtaccatgcaggacaattcaaggaccagcctttttaccactgcagaagaaagacacaatgtggagaaatcttaggactgacatccctttactcaggcaaacagaagttccaaccccagactaggggtcaggcagctagctacctaccttgcccagtgctgacccggacctcctccaggatacagcactggagttggccaccacctcttctacttgctgtctgaaaaaacacctgactagtacagctgagatcttggcttctcaacagggcaaagataccaggcctgctgctgaggtcactgccacttctcacatgctgcttaagggagcacaaataaaggtattcgatttttaaa

SEQ ID NO: 204415 - DNA, 1280 bp, Homo sapiens
  Payload ID: 20321
  Gene Name: zinc finger, DHHC-type containing 16
  ENST ID: ENST00000370846
  CDS Start-End: 163-1086
cgggtccgggtccgctgcctggcgctgcgggcggcgggccatggtggtttggattgagccgggcccggccggggcgccgagtcggagggggtggcagtgagcggcggcagaggctacggggctcggtttggctgactggggagtcggcaggcggcaggaaccatgcgaggccagcggagcctgctgctgggcccggcccgcctctgcctccgcctccttctgctgctgggttacaggcgccgctgtccacctctactccggggtctagtacagcgctggcgctacggcaaggtctgcctgcgctccctgctctacaactcctttgggggcagtgacaccgctgttgatgctgcctttgagcctgtctactggctggtagacaacgtgatccgctggtttggagtggtgttcgtggtcctggtgatcgtgctgacaggctccattgtagctatcgcctacctgtgtgtcctgcctctcatcctccgaacctactcagtgccacgactctgctggcatttcttctatagccactggaatctgatcctgattgtcttccactactaccaggccatcaccactccgcctgggtacccaccccagggcaggaatgatatcgccaccgtctccatctgtaagaagtgcatttaccccaagccagcccgaacacaccactgcagcatctgcaacaggtgtgtgctgaagatggatcaccactgccacatacttcctccagccctctctaaactacccaccagtcttcgcccctcttttcttagttctgtggcacttgccctgggtgccctaactgtatggcatgctgttctcatcagtcgaggtgagactagcatcgaaaggcacatcaacaagaaggagagacgtcggctacaggccaagggcagagtatttaggaatccttacaactacggctgcttggacaactggaaggtattcctgggtgtggatacaggaaggcactggcttactcgggtgctcttaccttctagtcacttgccccatgggaatggaatgagctgggagccccctccctgggtgactgctcactcagcctctgtgatggcagtgtgagctggactgtgtcagccacgactcgagcactcattctgctccctatgttatttcaagggcctccaagggcagcttttctcagaatccttgatcaaaaagagccagtgggcctgccttagggtaccatgcaggacaattcaaggaccagcctttttaccactgcagaagaaagacacaatgtggagaaatcttag

SEQ ID NO: 204416 - DNA, 1798 bp, Homo sapiens
  Payload ID: 20321
  Gene Name: zinc finger, DHHC-type containing 16
  Uniprot ID: Q969W1
  ENST ID: ENST00000370854
  CDS Start-End: 190-1323
cgcgtgtggttgaggatgggctggcggcgggtccgggtccgctgcctggcgctgcgggcggcgggccatggtggtttggattgagccgggcccggccggggcgccgagtcggagggggtggcagtgagcggcggcagaggctacggggctcggtttggctgactggggagtcggcaggcggcaggaaccatgcgaggccagcggagcctgctgctgggcccggcccgcctctgcctccgcctccttctgctgctgggttacaggcgccgctgtccacctctactccggggtctagtacagcgctggcgctacggcaaggtctgcctgcgctccctgctctacaactcctttgggggcagtgacaccgctgttgatgctgcctttgagcctgtctactggctggtagacaacgtgatccgctggtttggagtggtgttcgtggtcctggtgatcgtgctgacaggctccattgtagctatcgcctacctgtgtgtcctgcctctcatcctccgaacctactcagtgccacgactctgctggcatttcttctatagccactggaatctgatcctgattgtcttccactactaccaggccatcaccactccgcctgggtacccaccccagggcaggaatgatatcgccaccgtctccatctgtaagaagtgcatttaccccaagccagcccgaacacaccactgcagcatctgcaacaggtgtgtgctgaagatggatcaccactgcccctggctaaacaattgtgtgggccactataaccatcggtacttcttctctttctgctttttcatgactctgggctgtgtctactgcagctatggaagttgggaccttttccgggaggcttatgctgccattgagaaaatgaaacagctcgacaagaacaaactacaggcggttgccaaccagacttatcaccagaccccaccacccaccttctcctttcgagaaaggatgactcacaagagtcttgtctacctctggttcctgtgcagttctgtggcacttgccctgggtgccctaactgtatggcatgctgttctcatcagtcgaggtgagactagcatcgaaaggcacatcaacaagaaggagagacgtcggctacaggccaagggcagagtatttaggaatccttacaactacggctgcttggacaactggaaggtattcctgggtgtggatacaggaaggcactggcttactcgggtgctcttaccttctagtcacttgccccatgggaatggaatgagctgggagccccctccctgggtgactgctcactcagcctctgtgatggcagtgtgagctggactgtgtcagccacgactcgagcactcattctgctccctatgttatttcaagggcctccaagggcagcttttctcagaatccttgatcaaaaagagccagtgggcctgccttagggtaccatgcaggacaattcaaggaccagcctttttaccactgcagaagaaagacacaatgtggagaaatcttaggactgacatccctttactcaggcaaacagaagttccaaccccagactaggggtcaggcagctagctacctaccttgcccagtgctgacccggacctcctccaggatacagcactggagttggccaccacctcttctacttgctgtctgaaaaaacacctgactagtacagctgagatcttggcttctcaacagggcaaagataccaggcctgctgctgaggtcactgccacttctcacatgctgcttaagggagcacaaataaaggtattcgatttttaaa

SEQ ID NO: 204417 - DNA, 2014 bp, Homo sapiens
  Payload ID: 20321
  Gene Name: zinc finger, DHHC-type containing 16
  Uniprot ID: Q969W1
  ENST ID: ENST00000393760
  CDS Start-End: 409-1542
atccgggggcggaacttcagaggtccacgctggcgcctgcgcgtgtggttgaggatgggctggcggcgggtccgggtccgctgcctggcgctgcgggcggcgggccatggtggtttggattgagccgggcccggccggggcgccgagtcggagggggtggcagtgagcggcggcagaggctacggggctcggtttggctgactggggagtcggcaggcggcaggtcttttgtggggatgagccagggtgcaaggagagtacaatactccagttaccgaattgaaaccatccctgcagtggagcagcctcctccagtttctgttgggttttgagctacctgttaaataagtcagtgggattgtcaaggacaaagccctccctggctgcctcagggcaaaatcaggaaccatgcgaggccagcggagcctgctgctgggcccggcccgcctctgcctccgcctccttctgctgctgggttacaggcgccgctgtccacctctactccggggtctagtacagcgctggcgctacggcaaggtctgcctgcgctccctgctctacaactcctttgggggcagtgacaccgctgttgatgctgcctttgagcctgtctactggctggtagacaacgtgatccgctggtttggagtggtgttcgtggtcctggtgatcgtgctgacaggctccattgtagctatcgcctacctgtgtgtcctgcctctcatcctccgaacctactcagtgccacgactctgctggcatttcttctatagccactggaatctgatcctgattgtcttccactactaccaggccatcaccactccgcctgggtacccaccccagggcaggaatgatatcgccaccgtctccatctgtaagaagtgcatttaccccaagccagcccgaacacaccactgcagcatctgcaacaggtgtgtgctgaagatggatcaccactgcccctggctaaacaattgtgtgggccactataaccatcggtacttcttctctttctgctttttcatgactctgggctgtgtctactgcagctatggaagttgggaccttttccgggaggcttatgctgccattgagaaaatgaaacagctcgacaagaacaaactacaggcggttgccaaccagacttatcaccagaccccaccacccaccttctcctttcgagaaaggatgactcacaagagtcttgtctacctctggttcctgtgcagttctgtggcacttgccctgggtgccctaactgtatggcatgctgttctcatcagtcgaggtgagactagcatcgaaaggcacatcaacaagaaggagagacgtcggctacaggccaagggcagagtatttaggaatccttacaactacggctgcttggacaactggaaggtattcctgggtgtggatacaggaaggcactggcttactcgggtgctcttaccttctagtcacttgccccatgggaatggaatgagctgggagccccctccctgggtgactgctcactcagcctctgtgatggcagtgtgagctggactgtgtcagccacgactcgagcactcattctgctccctatgttatttcaagggcctccaagggcagcttttctcagaatccttgatcaaaaagagccagtgggcctgccttagggtaccatgcaggacaattcaaggaccagcctttttaccactgcagaagaaagacacaatgtggagaaatcttaggactgacatccctttactcaggcaaacagaagttccaaccccagactaggggtcaggcagctagctacctaccttgcccagtgctgacccggacctcctccaggatacagcactggagttggccaccacctcttctacttgctgtctgaaaaaacacctgactagtacagctgagatcttggcttctcaacagggcaaagataccaggcctgctgctgaggtcactgccacttctcacatgctgcttaagggagcacaaataaaggtattcgattttt

SEQ ID NO: 204418 - DNA, 1325 bp, Homo sapiens
  Payload ID: 20321
  Gene Name: zinc finger, DHHC-type containing 16
  ENST ID: ENST00000417044
  CDS Start-End: 1-905
ccgctgttgatgctgcctttgagcctgtctactggctggtagacaacgtgatccgctggtttggagtggtgttcgtggtcctggtgatcgtgctgacaggctccattgtagctatcgcctacctgtgtgtcctgcctctcatcctccgaacctactcagtgccacgactctgctggcatttcttctatagccactggaatctgatcctgattgtcttccactactaccaggccatcaccactccgcctgggtacccaccccagggcaggaatgatatcgccaccgtctccatctgtaagaagtgcatttaccccaagccagcccgaacacaccactgcagcatctgcaacaggtgtgtgctgaagatggatcaccactgcccctggctaaacaattgtgtgggccactataaccatcggtacttcttctctttctgctttttcatgactctgggctgtgtctactgcagctatggaagttgggaccttttccgggaggcttatgctgccattgagaaaatgaaacagctcgacaagaacaaactacaggcggttgccaaccagacttatcaccagaccccaccacccaccttctcctttcgagaaaggatgactcacaagagtcttgtctacctctggttcctgtgcagtcgaggtgagactagcatcgaaaggcacatcaacaagaaggagagacgtcggctacaggccaagggcagagtatttaggaatccttacaactacggctgcttggacaactggaaggtattcctgggtgtggatacaggaaggcactggcttactcgggtgctcttaccttctagtcacttgccccatgggaatggaatgagctgggagccccctccctgggtgactgctcactcagcctctgtgatggcagtgtgagctggactgtgtcagccacgactcgagcactcattctgctccctatgttatttcaagggcctccaagggcagcttttctcagaatccttgatcaaaaagagccagtgggcctgccttagggtaccatgcaggacaattcaaggaccagcctttttaccactgcagaagaaagacacaatgtggagaaatcttaggactgacatccctttactcaggcaaacagaagttccaaccccagactaggggtcaggcagctagctacctaccttgcccagtgctgacccggacctcctccaggatacagcactggagttggccaccacctcttctacttgctgtctgaaaaaacacctgactagtacagctgagatcttggcttctcaacagggcaaagataccaggcctgctgctgaggtcact

SEQ ID NO: 204419 - DNA, 888 bp, Homo sapiens
  Payload ID: 20321
  Gene Name: zinc finger, DHHC-type containing 16
  ENST ID: ENST00000433086
  CDS Start-End: 162-888
tgcaaggagagtacaatactccagttaccgaattgaaaccatccctgcagtggagcagcctcctccagtttctgttgggttttgagctacctgttaaataagtcagtgggattgtcaaggacaaagccctccctggctgcctcagggcaaaatcaggaaccatgcgaggccagcggagcctgctgctgggcccggcccgcctctgcctccgcctccttctgctgctgggttacaggcgccgctgtccacctctactccggggtctagtacagcgctggcgctacggcaaggtctgcctgcgctccctgctctacaactcctttgggggcagtgacaccgctgttgatgctgcctttgagcctgtctactggctggtagacaacgtgatccgctggtttggagtgggcaggaatgatatcgccaccgtctccatctgtaagaagtgcatttaccccaagccagcccgaacacaccactgcagcatctgcaacaggtgtgtgctgaagatggatcaccactgcccctggctaaacaattgtgtgggccactataaccatcggtacttcttctctttctgctttttcatgactctgggctgtgtctactgcagctatggaagttgggaccttttccgggaggcttatgctgccattgagaaaatgaaacagctcgacaagaacaaactacaggcggttgccaaccagacttatcaccagaccccaccacccaccttctcctttcgagaaaggatgactcacaagagtcttgtctacctctggttcctgtgcagttctgtggcacttgccctgggtgccctaactgtatggcatgctgttctcatcagtcgaggtgagactagcatcgaaaggcacatcaacaagaaggaga

SEQ ID NO: 204420 - DNA, 989 bp, Homo sapiens
  Payload ID: 20321
  Gene Name: zinc finger, DHHC-type containing 16
  ENST ID: ENST00000414567
  CDS Start-End: 349-989
tggcggcgggtccgggtccgctgcctggcgctgcgggcggcgggccatggtggtttggattgagccgggcccggccggggcgccgagtcggagggggtggcagtgagcggcggcagaggctacggggctcggtttggctgactggggagtcggcaggcggcaggtcttttgtggggatgagccagggtgcaaggagagtacaatactccagttaccgaattgaaaccatccctgcagtggagcagcctcctccagtttctgttgggttttgagctacctgttaaataagtcagtgggattgtcaaggacaaagccctccctggctgcctcagggcaaaatcaggaaccatgcgaggccagcggagcctgctgctgggcccggcccgcctctgcctccgcctccttctgctgctgggttacaggcgccgctgtccacctctactccggggtctagtacagcgctggcgctacggcaaggtctgcctgcgctccctgctctacaactcctttgggggcagtgacaccgctgttgatgctgcctttgagcctgtctactggctggtagacaacgtgatccgctggtttggagtggtgttcgtggtcctggtgatcgtgctgacaggctccattgtagctatcgcctacctgtgtgtcctgcctctcatcctccgaacctactcagtgccacgactctgctggcatttcttctatagccactggaatctgatcctgattgtcttccactactaccaggccatcaccactccgcctgggtacccaccccagggcaggaatgatatcgccaccgtctccatctgtaagaagtgcatttaccccaagccagcccgaacacaccactgcagcatctgcaacaggtgtgtgctgaagatggatcaccactgcccctggctaaacaattgtgtgggccactataaccatcggtacttcttctctttctgctttttcatgactctgggctgtgtctactg

SEQ ID NO: 204421 - DNA, 1362 bp, Homo sapiens
  Payload ID: 20321
  Gene Name: zinc finger, DHHC-type containing 16
  ENST ID: ENST00000420089
  CDS Start-End: 1-959
ggcgccgctgtccacctctactccggggtctagtacagcgctggcgctacggcaaggtctgcctgcgctccctgctctacaactcctttgggggcagtgacaccgctgttgatgctgcctttgagcctgtctactggctggtagacaacgtgatccgctggtttggagtggtgttcgtggtcctggtgatcgtgctgacaggctccattgtagctatcgcctacctgtgtgtcctgcctctcatcctccgaacctactcagtgccacgactctgctggcatttcttctatagccactggaatctgatcctgattgtcttccactactaccaggccatcaccactccgcctgggtacccaccccagggcaggaatgatatcgccaccgtctccatctgtaagaagtgcatttaccccaagccagcccgaacacaccactgcagcatctgcaacaggtgtgtgctgaagatggatcaccactgcccctggctaaacaattgtgtgggccactataaccatcggtacttcttctctttctgctttttcatgactctgggctgtgtctactgcagctatggaagttgggaccttttccgggaggcttatgctgccattgagacttatcaccagaccccaccacccaccttctcctttcgagaaaggatgactcacaagagtcttgtctacctctggttcctgtgcagtcgaggtgagactagcatcgaaaggcacatcaacaagaaggagagacgtcggctacaggccaagggcagagtatttaggaatccttacaactacggctgcttggacaactggaaggtattcctgggtgtggatacaggaaggcactggcttactcgggtgctcttaccttctagtcacttgccccatgggaatggaatgagctgggagccccctccctgggtgactgctcactcagcctctgtgatggcagtgtgagctggactgtgtcagccacgactcgagcactcattctgctccctatgttatttcaagggcctccaagggcagcttttctcagaatccttgatcaaaaagagccagtgggcctgccttagggtaccatgcaggacaattcaaggaccagcctttttaccactgcagaagaaagacacaatgtggagaaatcttaggactgacatccctttactcaggcaaacagaagttccaaccccagactaggggtcaggcagctagctacctaccttgcccagtgctgacccggacctcctccaggatacagcactggagttggccaccacctcttctacttgctgtctgaaaaaacacctgactagtacagctgagatcttggcttctcaacagggcaaagataccaggc

SEQ ID NO: 204422 - DNA, 5259 bp, Homo sapiens
  Payload ID: 20322
  Gene Name: zinc finger, DHHC-type containing 17
  Uniprot ID: Q8IUH5
  ENST ID: ENST00000426126
  CDS Start-End: 650-2548
ttgtatccatgtttttccgggcgtcccccggagggacaggttgcgggtgaccttttcaagtgtggaggaaagggaagctgcttttgtcttcaggaatgatgcaggtctcgactcaagcctgacgggcccaaacctccctggagctggctgacgactctgcccgagttcctgaagaggggtcccgggggtcccggagcggaagtgggagcgcgtgggcgtgggctcctcggctgcctggggctccagacttgtgctgcgtgcggctccggagctctgttctcgctcctgagcagctgctaggtttcccaagcgactgtctcaaccgcccggccgcctcccccgggcagccagagcttcacatctacctccagccgggacccgcccccgagccgcggggcccacgcccagagccctccgccgtccccagcgcagtgcagcagagcgcgatccagtctggggccgggccgcgcttccgcgcacgcgcggagaaacccgcgccctccgaggggggaggggacagagggggcgtcacgggggcaggagaagaaggaggaggaggcccgcgtcgcctccggcggggctcgcgctcgccccgcgctcgccctccgcctcgcccgagccccgggagggtgaaacgctttctcccagcatgcagcgggaggagggatttaacaccaagatggcggacggcccggatgagtacgataccgaagcgggctgtgtgccccttctccacccagaggaaatcaaaccccaaagccattataaccatggatatggtgaacctcttggacggaaaactcatattgatgattacagcacatgggacatagtcaaggctacacaatatggaatatatgaacgctgtcgagaattggtggaagcaggttatgatgtacggcaaccggacaaagaaaatgttaccctcctccattgggctgccatcaataacagaatagatttagtcaaatactatatttcgaaaggtgctattgtggatcaacttggaggggacctgaattcaactccattgcactgggccacaagacaaggccatctatccatggttgtgcaactaatgaaatatggtgcagatccttcattaattgatggagaaggatgtagctgtattcatctggctgctcagttcggacatacctcaattgttgcttatctcatagcaaaaggacaggatgtagatatgatggatcagaatggaatgacgcctttaatgtgggcagcatatagaacacatagtgtggatccaactagattgcttttaacattcaatgtttcagttaaccttggtgacaagtatcacaaaaacactgctctgcattgggcagtgctagcagggaataccacagtcattagccttcttctggaagctggagctaatgttgatgcccagaatatcaagggcgaatcagcgcttgatttggcaaaacagagaaaaaatgtgtggatgatcaaccacttacaagaggcaaggcaagcaaaaggatatgacaatccgtccttccttagaaagctgaaagctgataaggaatttcggcagaaagtaatgttaggaactcctttcctagttatttggctggttgggtttatagcagacctaaatattgattcttggctcattaaagggctaatgtatggtggtgtttgggctacagtacagtttctttcaaaatcctttttcgatcattcaatgcatagtgcattgccccttgggatatatttggcaaccaaattctggatgtatgtgacgtggttcttctggttttggaatgatctcaactttttatttatccatcttccattccttgccaatagtgttgcacttttctacaattttggaaaatcttggaaatcagatccagggattattaaagcaacagaagagcaaaagaaaaagacaatagttgaacttgcagagacaggaagtctggacctcagtatattctgcagtacctgtttgatacgaaaaccggtgaggtccaaacattgtggtgtgtgcaaccgctgtatagcaaaatttgatcatcattgcccatgggtgggtaactgtgtaggtgcaggcaaccatagatattttatgggctacctattcttcttgctttttatgatctgctggatgatttatggttgtatatcttactggggactccactgtgagaccacttacaccaaggatggattttggacatacattactcagattgccacgtgttcaccttggatgttttggatgttcctgaacagtgttttccacttcatgtgggtggctgtattactcatgtgtcagatgtaccagatatcatgtttaggtattactacaaatgaaagaatgaatgccaggagatacaagcactttaaagtcacaacaacgtctattgaaagcccattcaaccatggatgtgtaagaaatattatagacttctttgaatttcgatgctgtggcctctttcgtcctgttatcgtggactggaccaggcagtatacaatagaatatgaccaaatatcaggatctgggtaccagctggtgtagcgacatcttatcctatgaagcatattgctgagtggtgcctgaaaattgtgtctgtccgtgtctttctcacactcgaatccacatcctttgaacaagagcatgctatgtgtagggctaatggtgaattttacagtctttttttcaacacttttattaacaaaagtaaacatggacagaacacactgccatttctgggaagagtaaagatgataaaaaataattttaatggttcttaatgtggaaattcacaacatactcaacttttgggttttgttctcacagtatttttcacaaaaaaagggtaaacttattctattgacagacatggtgtactgatcagaaatgttcagttttaactaaaactaaatttatgttatttggctaaatgttatgatgcagtctagtacgagtattgcatctaattccaggagcattgttttaagttgattgactagttattatgtacatttcagaatgtacacataaatactgtgatgaaaatcatgtgattgggatctactgtgatgttgtcttcaaaggcaggagaaaataatgttcacaataaaatgtgctaacaatgttttgtttctatcagctgttgcaatgctgatatatttctagttcagtgaaataatttgtagtaaccttactctgaggttttacggtctgataatgaagcacttgcatgagtatagtaagtcatgtttttttgttcaaatttaaaagccctgctaattgcatgacacaccacatagaatgtatactagcagatactatccagtgaagcataaattagaatttaatttgatgttcaaaaacagttccatttttaagggttaaggtggtattttcaagaaaaggcagaacaaataatgcaaaattctcagtaatagtgatacatggatatacttccttttaaattctcagctgcaaaataattgtagacaaaataatggcatttaactaaagatggagcatgatctaagtacatagcacatgtgaataaaagaaaagctgacagtatattctggtttcaataaaatgacctatcagaaagtagaatttcatccccaagagtatttcagtttatccaatattgagtaagttctgaaacagttttagaaaaaattttctttttgttaaatgtgatgcactgatcaatttttgtcacagcattttcataccttcatggtggactactagtcactgcttccataaatattgtttacagggtgagatttggtttattcatcttaagtgctgtagcaaactgtggttcgagcaacctgtgggaaatctgtgagagggaatggggtgggagatgtgggggaatggtggtcagactgatgacagatcctagaccaatgtaaagaatgtgtatctgtatataaataatttatcaaatagttttctctttgtgtctgtgttagtgtttttaaagctgctcatttcattttgtccaaccaaaaagaaaagggagataactaatgagcttctagtgatgttcaaaattgctgttaataggcattataccctgcaagttcactgcatgtctgatgcttggtaaaactagtcttccctgtaaaatgcagattacaggtattaaagcaatctagtggtatacccgccccttgccttagtaagaggagcagtgaaatgtatatagttgatgttcagtatttccaagtaccatttttatatagtagcttatttgaccataagtcacacatcaaaaaaagattacccttagtgtatgtgttttaatattagaaaattggcatatgtactttatttttgaaaagggaagagatgggtgtggggtggcaatagcattgtgccattttgtcatagaatgtaaaaattggttaactttacaaatgtcagctagttttgactactaattgggggaaattttagataatttttaaattcaaagttatttataaaatgctagaatttgttttaattttttgtattttgagccacttcacatgaagactcagttgcatttttatcgaatacatttttatcaacagttaaagactatggtggttttttcagagtttggctaagaatgttgttaccatcttctttgtttgtggtacaatattttcagtgcaaaagagatgtcattcagttaaaaagacaaacctctagatgtgtaattacatggaaaatactagcaatgtgaatgcttttgtagtaaccatcttgtagtacctgtgaaatctataactcagaaatggtcagatggtcaggagccagctatgcagcagtataccatctgtttaattattttgtaggtcctgtgtgtggaaccaactataaacccagttctaaagttgtgtatgatggtgaacctttgggaatagttcttatcaacttaattggatacttttagcaaataggaacttaattctcagcactgaacatgaattacttccttggagttttttttcattcatatttttgttgtttccaggaatttatttgatattaatgggcgtaaaacagcatcattgtacttaagctatggatgtttttattttatattttctttatttataactgtgccaagtattattttgctacttaccgtgttattctgtggaaagaaaaacctgtaaagtgtttaataaattagccctccttacataaattaaatgtcaaaattttgtaaaatattaatcagaataaatactgactcttaa

SEQ ID NO: 204423 - DNA, 567 bp, Homo sapiens
  Payload ID: 20322
  Gene Name: zinc finger, DHHC-type containing 17
  ENST ID: ENST00000547620
  CDS Start-End: 1-134
gatttaacaccaagatggcggacggcccggatgagtacgataccgaagcgggctgtgtgccccttctccacccagagaatggccttgccagatgtgggccccttcaccttggactactcagccttcagaactgaaatcaaaccccaaagccattataaccatggatatggtgaacctcttggacggaaaactcatattgatgattacagcacatgggacatagtcaaggctacacaatatggaatatatgaacgctgtcgagaattggtggaagcaggttatgatgtacggcaaccggacaaagaaaatgttaccctcctccattgggctgccatcaataacagaatagatttagtcaaatactatatttcgaaaggtgctattgtggatcaacttggaggggacctgaattcaactccattgcactgggccacaagacaaggccatctatccatggttgtgcaactaatgaaatatggtgcagatccttcattaattgatggagaaggatgtagctgtattcatctggctgctcagttcggacatacctcaattgttgcttatctc

SEQ ID NO: 204424 - DNA, 1146 bp, Homo sapiens
  Payload ID: 20322
  Gene Name: zinc finger, DHHC-type containing 17
  ENST ID: ENST00000546778
  CDS Start-End: 135-242
gacagagggggcgtcacgggggcaggagaagaaggaggaggaggcccgcgtcgcctccggcggggctcgcgctcgccccgcgctcgccctccgcctcgcccgagccccgggagggtgaaacgctttctcccagcatgcagcgggaggagggatttaacaccaagatggcggacggcccggatgagtacgataccgaagcgggctgtgtgccccttctccacccagagatatggaatatatgaacgctgtcgagaattggtggaagcaggttatgatgtacggcaaccggacaaagaaaatgttaccctcctccattgggctgccatcaataacagaatagatttagtcaaatactatatttcgaaaggtgctattgtggatcaacttggaggggacctgaattcaactccattgcactgggccacaagacaaggccatctatccatggttgtgcaactaatgaaatatggtgcagatccttcattaattgatggagaaggatgtagctgtattcatctggctgctcagttcggacatacctcaattgttgcttatctcatagcaaaaggacaggatgtagatatgatggatcagaatggaatgacgcctttaatgtgggcagcatatagaacacatagtgtggatccaactagattgcttttaacattcaatgtttcagttaaccttggtgacaagtatcacaaaaacactgctctgcattgggcagtgctagcagggaataccacagtcattagccttcttctggaagctggagctaatgttgatgcccagaatatcaaggcaatccttaggtgtcacatggccctctagtggaagggatgctcagctggaccgaggcaactgcaggatattcccggggagttgttacccaagggattgcttttattcagggcgaatcagcgcttgatttggcaaaacagagaaaaaatgtgtggatgatcaaccacttacaagaggcaaggcaagcaaaaggatatgacaatccgtccttccttagaaagctgaaagctgataaggaatttcggcagaaagtaatgttaggaactcctttcctagttatttggctggttgggtttatagcagacctaaatattgattcttggctcattaaagggctaatgtatg

SEQ ID NO: 204425 - DNA, 544 bp, Homo sapiens
  Payload ID: 20322
  Gene Name: zinc finger, DHHC-type containing 17
  ENST ID: ENST00000551407
  CDS Start-End: 1-108
aacaccaagatggcggacggcccggatgagtacgataccgaagcgggctgtgtgccccttctccacccagagtttgagatggagttgcgctcttgttgcccaggctgaagtgcaatgacgtgatctcggcttactgcaacctcagcctcctgcgttcaagcgattctcctgcatcagcctcccgagtagctgggattacaggaaatcaaaccccaaagccattataaccatggatatggtgaacctcttggacggaaaactcatattgatgattacagcacatgggacatagtcaaggctacacaatatggaatatatgaacgctgtcgagaattggtggaagcaggttatgatgtacggcaaccggacaaagaaaatgttaccctcctccattgggctgccatcaataacagaatagatttagtcaaatactatatttcgaaaggtgctattgtggatcaacttggaggggacctgaattcaactccattgcactgggccacaagacaaggccatctatccatggttgtgcaactaatgaaat

SEQ ID NO: 204426 - DNA, 815 bp, Homo sapiens
  Payload ID: 20322
  Gene Name: zinc finger, DHHC-type containing 17
  ENST ID: ENST00000549944
  CDS Start-End: 1-467
acatagtcaaggctacacaatatggaatatatgaacgctgtcgagaattggtggaagcaggttatgatgtacggcaaccggacaaagaaaatgttaccctcctccattgggctgccatcaataacagaatagatttagtcaaatactatatttcgaaaggtgctattgtggatcaacttggaggggacctgaattcaactccattgcactgggccacaagacaaggccatctatccatggttgtgcaactaatgaaatatggtgcagatccttcattaattgatggagaaggatgtagctgtattcatctggctgctcagttcggacatacctcaattgttgcttatctcatagcaaaaggacaggattattttaaaaaatgtacttgcatattggaaatgttgagtgaggttgcagaagatattcctgacaacactattaaagtaaatccagaaatggatttgtaatggataaggcataacattctatgacagtatgcatggatgtagatatgatggatcagaatggaatgacgcctttaatgtgggcagcatatagaacacatagtgtggatccaactagattgcttttaacattcaatgtttcagttaaccttggtgacaagtatcacaaaaacactgctctgcattgggcagtgctagcagggaataccacagtcattagccttcttctggaagctggagctaatgttgatgcccagaatatcaagggcgaatcagcgcttgatttggcaaaacagagaaaaaatgtgtggatgatcaaccacttacaagaggcaaggcaagcaaaaggat

SEQ ID NO: 204427 - DNA, 856 bp, Homo sapiens
  Payload ID: 20322
  Gene Name: zinc finger, DHHC-type containing 17
  ENST ID: ENST00000552453
  CDS Start-End: 1-605
gggaggagggatttaacaccaagatggcggacggcccggatgagtacgataccgaagcgggctgtgtgccccttctccacccagaggaaatcaaaccccaaagccattataaccatggatatggtgaacctcttggacggaaaactcatattgatgattacagcacatgggacatagtcaaggctacacaatatggaatatatgaacgctgtcgagaattggtggaagcaggttatgatgtacggcaaccggacaaagaaaatgttaccctcctccattgggctgccatcaataacagaatagatttagtcaaatactatatttcgaaaggtgctattgtggatcaacttggaggggacctgaattcaactccattgcactgggccacaagacaaggccatctatccatggttgtgcaactaatgaaatatggtgcagatccttcattaattgatggagaaggatgtagctgtattcatctggctgctcagttcggacatacctcaattgttgcttatctcatagcaaaaggacaggatgtagatatgatggatcagaatggaatgacgcctttaatgtgggcagcatatagaacacatagttaaccttggtgacaagtatcacaaaaacactgctctgcattgggcagtgctagcagggaataccacagtcattagccttcttctggaagctggagctaatgttgatgcccagaatatcaagggcgaatcagcgcttgatttggcaaaacagagaaaaaatgtgtggatgatcaaccacttacaagaggcaaggcaagcaaaaggatatgacaatccgtccttccttagaaagctgaaagctgataaggaatttc

SEQ ID NO: 204428 - DNA, 276 bp, Homo sapiens
  Payload ID: 20322
  Gene Name: zinc finger, DHHC-type containing 17
  ENST ID: ENST00000547604
  CDS Start-End: 1-87
aacaccaagatggcggacggcccggatgagtacgataccgaagcgggctgtgtgccccttctccacccagagatatggaatatatgaacgctgtcgagaattggtggaagcaggttatgatgtacggcaaccggacaaagaaaatgttaccctcctccattgggctgccatcaataacagaatagatttagtcaaacaaggccatctatccatggttgtgcaactaatgaaatatggtgcagatccttcattaattgatggagaaggatgtagctg

SEQ ID NO: 204429 - DNA, 564 bp, Homo sapiens
  Payload ID: 20322
  Gene Name: zinc finger, DHHC-type containing 17
  ENST ID: ENST00000550876
  CDS Start-End: 82-564
atttaacaccaagatggcggacggcccggatgagtacgataccgaagcgggctgtgtgccccttctccacccagagcaagaatggccttgccagatgtgggccccttcaccttggactactcagccttcagaactgatgtagatatgatggatcagaatggaatgacgcctttaatgtgggcagcatatagaacacatagtgtggatccaactagattgcttttaacattcaatgtttcagttaaccttggtgacaagtatcacaaaaacactgctctgcattgggcagtgctagcagggaataccacagtcattagccttcttctggaagctggagctaatgttgatgcccagaatatcaagggcgaatcagcgcttgatttggcaaaacagagaaaaaatgtgtggatgatcaaccacttacaagaggcaaggcaagcaaaaggatatgacaatccgtccttccttagaaagctgaaagctgataaggaatttcggcagaaagtaatgttaggaactcctttcctagttatttggctggttgggtttatagcagacctaaat

SEQ ID NO: 204430 - DNA, 730 bp, Homo sapiens
  Payload ID: 20322
  Gene Name: zinc finger, DHHC-type containing 17
  ENST ID: ENST00000550163
  CDS Start-End: 1-145
aagcgggctgtgtgccccttctccacccagagatatggaatatatgaacgctgtcgagaattggtggaagcaggttatgatgtacggcaaccggacaaagaaaatgttaccctcctccattgggctgccatcaataacagaatagatttagtcaaatactatatttcgaaaggtgctattgtggatcaacttggaggggacctgaattcaactccattgcactgggccacaagacaaggccatctatccatggttgtgcaactaatgaaatatggtgcagatccttcattaattgatggagaaggatgtagctgtattcatctggctgctcagttcggacatacctcaattgttgcttatctcatagcaaaaggacaggatgtagatatgatggatcagaatggaatgacgcctttaatgtgggcagcatatagaacacatagtgtggatccaactagattgcttttaacattcaatgtttcagttaaccttggtgacaagtatcacaaaaacactgctctgcattgggcagtgctagcagggaataccacagtcattagccttcttctggaagctggagctaatgttgatgcccagaatatcaagggcgaatcagcgcttgatttggcaaaacagagaaaaaatgtgtggatgatcaaccacttacaagaggcaaggcaagcaaaaggatatgacaatccgtccttccttagaaagctgaaagctgata

SEQ ID NO: 204431 - DNA, 596 bp, Homo sapiens
  Payload ID: 20322
  Gene Name: zinc finger, DHHC-type containing 17
  ENST ID: ENST00000549682
  CDS Start-End: 217-596
ggaggtgttgatggttctgctgtgtcgccgcgctgcgtttgagagcagaggcggaggggcctggtgtggtttttgaaccgcagcttagaccctagtcttgctccaagcctcttggggccaggtggaagcgcgtctggttttgatttctttttccttcgccagggtgaatgacggtatctattgcttccttttagtccactgtgaggggacagtttcatgggcatagtgatgtccttccaggaaatcaaaccccaaagccattataaccatggatatggtgaacctcttggacggaaaactcatattgatgattacagcacatgggacatagtcaaggctacacaatatggaatatatgaacgctgtcgagaattggtggaagcaggttatgatgtacggcaaccggacaaagaaaatgttaccctcctccattgggctgccatcaataacagaatagatttagtcaaatactatatttcgaaaggtgctattgtggatcaacttggaggggacctgaattcaactccattgcactgggccacaagacaaggccatctatccatggttgtgcaactaatgaaatatggtgcagatcc

SEQ ID NO: 204432 - DNA, 1002 bp, Homo sapiens
  Payload ID: 20323
  Gene Name: zinc finger, DHHC-type containing 18
  Uniprot ID: Q9NUE0
  ENST ID: ENST00000374141
  CDS Start-End: 121-882
attattcctgctgcttattgaaggtgttgcctgccacagagaagacctcactgtccctacctggctcgcaagctgacccttgccatccccatcatcgctgccatcctcttcttcttcgtcatgagctgcctgctgcagacaagcttcaccgaccctgggatcctgccccgggccactgtctgtgaagcagccgccctggagaaacagatcgacaacacaggcagttctacataccggccaccccctcggacccgggaggtgctgatcaacgggcagatggtgaagctgaagtactgcttcacctgcaagatgttccggccaccccgaacctcacactgcagtgtctgcgacaactgtgtggaacgatttgaccatcactgcccctgggtgggcaactgtgtggggagacggaactatcgcttcttctacgcgtttattctctccctctcattcctgacggccttcatcttcgcctgtgtggtcacccacctgacgttgcgcgctcagggaagcaacttcctctccactctgaaggagacaccagcaagcgtgctggagttggtgatctgcttcttctccatctggtccattctgggcctctcagggtttcacacgtacctcgtcgcctccaacctgactactaatgaagacatcaaaggctcgtggtccagcaagaggggcggtgaggcctctgtcaacccctacagccataaaagtattatcaccaactgctgtgctgtgctctgtggccccctacctcccagcctaattgaccggaggggatttgtgcagtccgacaccgtgttgccctcacccatcagaagcgatgagccagcctgcagagccaagcctgatgccagcatggtaggaggccacccctgaccacggctcagtacttgccacctgctggcctgtctgaccctccgcactcacctgccgggaccctccctattccatccaagggaagcagaactgccaaagactcaagtcttttcatattta

SEQ ID NO: 204433 - DNA, 5020 bp, Homo sapiens
  Payload ID: 20323
  Gene Name: zinc finger, DHHC-type containing 18
  Uniprot ID: Q9NUE0
  ENST ID: ENST00000374142
  CDS Start-End: 96-1262
gcgcgcgccgccgctgccacctccgctgctcggcccggtcccggagtggcccggccggcccgcggggcgcggagccgaggcccgcggctggctgcatgaaggactgcgagtaccagcagatcagccccggggccgccccgctgcccgcctccccgggggcgcgccgtcccggccccgccgcgtccccgactccgggccccgggcccgcgccgcccgccgcccccgccccgccgcgctggagcagcagcggcagcggcagcggcagcgggagcgggagcctcggccgccgcccacggcgcaagtgggaggtgttcccgggtcgcaatcgcttctactgcggcggccgcctcatgctggccggccacggcggcgtcttcgcgctcacgctgctgctcatcctcaccaccaccggcctcttcttcgtctttgactgtccctacctggctcgcaagctgacccttgccatccccatcatcgctgccatcctcttcttcttcgtcatgagctgcctgctgcagacaagcttcaccgaccctgggatcctgccccgggccactgtctgtgaagcagccgccctggagaaacagatcgacaacacaggcagttctacataccggccaccccctcggacccgggaggtgctgatcaacgggcagatggtgaagctgaagtactgcttcacctgcaagatgttccggccaccccgaacctcacactgcagtgtctgcgacaactgtgtggaacgatttgaccatcactgcccctgggtgggcaactgtgtggggagacggaactatcgcttcttctacgcgtttattctctccctctcattcctgacggccttcatcttcgcctgtgtggtcacccacctgacgttgcgcgctcagggaagcaacttcctctccactctgaaggagacaccagcaagcgtgctggagttggtgatctgcttcttctccatctggtccattctgggcctctcagggtttcacacgtacctcgtcgcctccaacctgactactaatgaagacatcaaaggctcgtggtccagcaagaggggcggtgaggcctctgtcaacccctacagccataaaagtattatcaccaactgctgtgctgtgctctgtggccccctacctcccagcctaattgaccggaggggatttgtgcagtccgacaccgtgttgccctcacccatcagaagcgatgagccagcctgcagagccaagcctgatgccagcatggtaggaggccacccctgaccacggctcagtacttgccacctgctggcctgtctgaccctccgcactcacctgccgggaccctccctattccatccaagggaagcagaactgccaaagactcaagtcttttcatatttatttcccatcctgcgtggctttccctgaactgttccgtggctgtgccctctgctccccaaacccaggttcccacagccttgggccctaggtaccccagctgatcagtgccaggagagaccagagcctctggaggctacccaggggaccacaccaagtccttgcctgtgccgggcgagccctgtgtgagtgaggctgtgaactgagcgtgaggcctcccaggtgggggaactgcttgggccttgctgagccagggtcctcagggtgaagcaggactgaggagtggccagctctggatagctggctgtggagaggaagcctccatgggctgctttggtctgtgggctccttcattcccttggtgataatttccctttattctgtgggatttttggtggggttttccccccttttttatggagttggccaataggattgagttggggctccagtagagaaggcagggttggtggtgggtgggggcagcctgtatcagacaaaggtaaatcagccagccaggcacccacagcctcagctcctgtgcagttcctgggcagcacagtggaagtgggagcctggtccttcccctgcccatggagagctctttaagggatcccagcctgcccctccacttctctcccaagccaggtcccggcatgggtgggttatgctcatgctggcaatacttgaaacgggtttattaatgctgggtattttgcacaattttatagacctcttttctacatagtcttttttaaatggaaggagaaaatgtcagccacattactgtctgtgtagtgccaggtgaagggttatcagaaggctggttggttttaataagtttattccaagagaccttctggctggaatgagtgagagtgtgtgtgcatgtgtgtgtgtgttcatgtgtgccctgtatgaatgtggctggctcccatatcccctgggctgccccctgccccatcccctttgagtgtcagaagcactctgagccaaggggacagggggcacgtgcactggtcacgagaaaaccctgggctcccactggggctcagcccagcctcctatctttccttcttctatggacttcagacagccagtgtctggggactctgccactctacccccagccctacccaccagcccccaggtgaggcttccagctgggacctgcccagacaggctgagcctgggcgtggtgggtggggtgatggctctggggagcggctgccatcctacaagccacaccccctcctctgagctctgaatatgggacccagtgccaggagctggaagacaaggtgtttctgccaaacggggacctccatccagagaaaaggaagaaggtgcagggtgggccaagaggcaagtgaaggttggcctgagtctgggccggaaactcagaggatgtttctcctctgctgggagctgtagtttcttatcaaaatagatattgttccaccatccccctccttggcccttcaagtgggctgaagcccttggaaagtgacataggaagtccccagatcttgcccttctcactccagaggctagtggtcacagacagctgggaatggcagccacagagggtcccctctgggagaaacagcttcaccccagcctcagggccctgggccatcactgcagtggccctgggaggtgaggaagaagctggctagaggagggggctcccacctaccttttatttaagccagtattctttgttcctgcttgtaataaaacttcagtttataagagttgctttgctttggtttggtttttgtttgcttttcctttgctgaggccccaactgggagccctctgttctttcagacaaatttggttctttcctggggagactgtgagaaggcaggcagcccagtgatctggctacattttccctcacctggctggagctctgtccgctggaggaagagcagagagggctgcggctgagcccccatgggcacgtgaaaagaggccatcctgtcccctctttgtcccctccaccttcccctgcctcaggggcttggagacccccaaattcttcttccctactgcctttccactccgatccccaatgagtgcccagctaagaaaatgtttgagacagtagattccagtttgagagccggagcttccctggctaccacctccaacctgggcaccagggcccagccagacaactcataacactggcccacctctctggtatctccctcaggaggacacctgtcaggattttgccatctcctgcacagcctgaggggagctaacaggcctctttgcagagggttagctggtaagaccgtttcttccctgtcggccagcactgcccgctcccctcacacaccatctcatcctcatcgcatgcctcgccaaccccatggagcccgtccatctgtctggtgtgtggtgcggtgtgtgtgctggtggtggtagggtctccagggactccccgctaagcagaaggatcgggatatagggcaaggctaaaagcccagccccattgtggactgaggaagtagcttctcgcagagcagctctccagctggaagaggaggtggagggtgaggctggggagaggatggcgaacctgccctgaggtgcttgggtctgtgctggtggggtcctggtatgcaggggccaccggtcactaacactcttatgtcctggctttctgtccccgctgagctttctctcacccgcccgttttctctcctgcttcattgcctgctgcctaagccttggcccttctctcgggcagaggcaggtgctgtggcagcacctctccccaccaccggggcccctgcaggccgcctccctcctcccaggcctgctaaccctctctcttctccttctttgctgtcctgccggggatctccagtgtgtgcgggggcttaaggacctcctgaggaccgctgctctctgcctctccaggaatggcctggggggagccaggcacccggcacctccacctgcctaacctgtggcccatctgccaccatctgtgcctacagggtctgccccccagcctgcccggcctgtgtgctctctaggacccccatagggggcaggggctggcctctttgccccattcccgctccatgccggccagagtgtagaaagccataacgcagccatcagcacaataatgtgactctacgctgatatgctccctctctcctccactgacttccccttcccggatttgtgaggtgtcaagactaggaatctggccttagagcctgcccctccaccccctcagatcaggcatagccatagtcaagcccagcaggtttcctcaggagctgtctggggtgttgatggtggatgacgctgctgaacaagtttggtgactgttctaagcacaactggcttgatactgttcccacggcctgtccacctcccacccccaaccctccaccagagtaggtaggatgtagggagggtgcgtgcctcctttgctctaggcactgagggaccaagctagccgtgcacagccccatacacttcaggggactaaaggaaagagctgagccaaggaaaatcagctgagcccagggctgggggctgcttgtctgctatcctgtaccttttttttttttaaccaaaataaagattcccctcttcttgccata

SEQ ID NO: 204434 - DNA, 597 bp, Homo sapiens
  Payload ID: 20323
  Gene Name: zinc finger, DHHC-type containing 18
  ENST ID: ENST00000534643
  CDS Start-End: 124-597
attgaaggtgttgcctgccacagagaagacctcagtaaatatttgtggactgactgtccctacctggctcgcaagctgacccttgccatccccatcatcgctgccatcctcttcttcttcgtcatgagctgcctgctgcagacaagcttcaccgaccctgggatcctgccccgggccactgtctgtgaagcagccgccctggagaaacagatcgacaacacaggcagttctacataccggccaccccctcggacccgggaggtgctgatcaacgggcagatggtgaagctgaagtactgcttcacctgcaagatgttccggccaccccgaacctcacactgcagtgtctgcgacaactgtgtggaacgatttgaccatcactgcccctgggtgggcaactgtgtggggagacggaactatcgcttcttctacgcgtttattctctccctctcattcctgacggccttcatcttcgcctgtgtggtcacccacctgacgttgcgcgctcagggaagcaacttcctctccactctgaaggagacaccagcaagcgtgctggagttggtgatctgcttcttctccatctggtccattctg

SEQ ID NO: 204435 - DNA, 1275 bp, Homo sapiens
  Payload ID: 20323
  Gene Name: zinc finger, DHHC-type containing 18
  ENST ID: ENST00000488397
  CDS Start-End: 1-484
cttctacgcgtttattctctccctctcattcctgacggccttcatcttcgcctgtgtggtcacccacctgacgttgcgcgctcagggaagcaacttcctctccactctgaaggagacaccagcaagcgtgctggagttggtgatctgcttcttctccatctggtccattctgggcctctcagggtttcacacgtacctcgtcgcctccaacctgactactaatgaagacatcaaaggctcgtggtccagcaagaggggcggtgaggcctctgtcaacccctacagccataaaagtattatcaccaactgctgtgctgtgctctgtggccccctacctcccagcctaattgaccggaggggatttgtgcagtccgacaccgtgttgccctcacccatcagaagcgatgagccagcctgcagagccaagcctgatgccagcatggaggacacctgtcaggattttgccatctcctgcacagcctgaggggagctaacaggcctctttgcagagggttagctgtgtgtgcgggggcttaaggacctcctgaggaccgctgctctctgcctctccaggaatggcctggggggagccaggcacccggcacctccacctgcctaacctgtggcccatctgccaccatctgtgcctacagggtctgccccccagcctgcccggcctgtgtgctctctaggacccccatagggggcaggggctggcctctttgccccattcccgctccatgccggccagagtgtagaaagccataacgcagccatcagcacaataatgtgactctacgctgatatgctccctctctcctccactgacttccccttcccggatttgtgaggtgtcaagactaggaatctggccttagagcctgcccctccaccccctcagatcaggcatagccatagtcaagcccagcaggtttcctcaggagctgtctggggtgttgatggtggatgacgctgctgaacaagtttggtgactgttctaagcacaactggcttgatactgttcccacggcctgtccacctcccacccccaaccctccaccagagtaggtaggatgtagggagggtgcgtgcctcctttgctctaggcactgagggaccaagctagccgtgcacagccccatacacttcaggggactaaaggaaagagctgagccaaggaaaatcagctgagcccagggctgggggctgcttgtctgctatcctgtaccttttttttttttaaccaaaataaagattcccctcttcttgccatac

SEQ ID NO: 204436 - DNA, 1306 bp, Homo sapiens
  Payload ID: 20324
  Gene Name: zinc finger, DHHC-type containing 19
  Uniprot ID: Q8WVZ1
  ENST ID: ENST00000296326
  CDS Start-End: 81-1010
ggccatggagctctggaagctgggctgggggaggaagcctggtggctctgacctcccctggaggcgaaggaggcccagccatgacactcttaacggatgccacgccgctggtgaaggagccccatcccctgcctctggtcccacgtccctggttcctccctagcctctttgctgccttcaatgtggtgctgctggtctttttcagtggcctcttcttcgcattcccttgcaggtggctggctcagaacggggagtgggcctttcctgttatcacaggctccctctttgtccttaccttcttcagtcttgtttcactcaacttctcagaccctggcatcttacatcaaggctccgctgagcagggccccttgacggtgcacgtggtgtgggtgaaccacggggccttccgcctgcaatggtgtccaaagtgctgcttccaccgcccgccccggacttaccactgcccctggtgcaacatctgtgtggaggactttgaccaccactgcaagtgggtcaataactgcatcggtcaccgcaacttccgcttcttcatgctgcttgtcctgtccctgtgcctctactcgggcgccatgctggtcacctgtctcatcttcctggtgcgcacaacccacctgcccttctccaccgacaaggccatcgccatcgtggtggccgtgtccgccgcgggcctcctggtgccgctgtccctcctgctgctgatccaggcactgtccgtgagctcggccgaccgcacctacaagggcaagtgcagacaccttcagggatacaaccccttcgaccagggctgtgccagcaactggtatttaacaatttgtgcaccactgggacccaagtacatggctgaagctgtccagctgcagagagtggtggggcctgactggacatccatgccgaatctgcaccctccaatgtccccctctgctctcaaccccccagccccaacctctgggtccctacaaagcagggaagggacccccggggcgtggtgaggctgcagctctccaggagttccacacgggcccagtgctgcccctgctgctgcaggagcccccaggcgaggttcggccttcctctcgcccctgtgcacccggagatgcccacagcaccagcacctgagctcacctccgaacccgcctcctgaacccgcctcctgaacctgcctccttacctcccacttcctgagccctgagtggaagcctttctgtgccttgccctttgcccactcccctggtgggactgccaagaccctcaatgcccattaaatactcttgcctgcctcttacaa

SEQ ID NO: 204437 - DNA, 1308 bp, Homo sapiens
  Payload ID: 20324
  Gene Name: zinc finger, DHHC-type containing 19
  ENST ID: ENST00000397544
  CDS Start-End: 123-971
cttctttcctttcaccctgggctgcggctctgaggctgccgtggccatggagctctggaagctgggctgggggaggaagcctggtggctctgacctcccctggaggcgaaggaggcccagccatgacactcttaacggatgccacgccgctggtgaaggagccccatcccctgcctctggtcccacgtccctggttcctccctagcctctttgctgccttcaatgtggtgctgctggtctttttcagtggcctcttcttcgcattcccttgcaggtggctggctcagaacggggagtgggcctttcctgttatcacaggctccctctttgtccttaccttcttcagtcttgtttcactcaacttctcagaccctggcatcttacatcaaggctccgctgagcagggccccttgacggtgcacgtggtgtgggtgaaccacggggccttccgcctgcaatggtgtccaaagtgctgcttccaccgcccgccccggacttaccactgcccctggtgcaacatctgtgtggaggactttgaccaccactgcaagtgggtcaataactgcatcggtcaccgcaacttccgcttcttcatgctgcttgtcctgtccctgtgcctctactcgggcgccatgctggtcacctgtctcatcttcctggtgcgcacaacccacctgcccttctccaccgacaaggccatcgccatcgtggtggccgtgtccgccgcgggcctcctggtgccgctgtccctcctgctgctgatccaggcactgtccgtgagctcggccgaccgcacctacaagggcaagtgcagacaccttcagggatacaaccccttcgaccagggctgtgccagcaactggtatttaacaatttgtgcaccactgggacccaaggctgctgcatcctggatgaggctggcctcagcttcctgcagagctaagccctgggccgtgtgcttcccaagctgaggcgggcaggggagccggaccagggaggacggtggcccctgcatctggcctgctgctccccagttccacacgggcccagtgctgcccctgctgctgcaggagcccccaggcgaggttcggccttcctctcgcccctgtgcacccggagatgcccacagcaccagcacctgagctcacctccgaacccgcctcctgaacccgcctcctgaacctgcctccttacctcccacttcctgagccctgagtggaagcctttctgtgccttgccctttgcccactcccctggtgggactgccaagaccctcaatgcccattaaatactcttgcctgcctctta

SEQ ID NO: 204438 - DNA, 1521 bp, Homo sapiens
  Payload ID: 20324
  Gene Name: zinc finger, DHHC-type containing 19
  Uniprot ID: Q8WVZ1
  ENST ID: ENST00000438232
  CDS Start-End: 123-812
cttctttcctttcaccctgggctgcggctctgaggctgccgtggccatggagctctggaagctgggctgggggaggaagcctggtggctctgacctcccctggaggcgaaggaggcccagccatgacactcttaacggatgccacgccgctggtgaaggagccccatcccctgcctctggtcccacgtccctggttcctccctagcctctttgctgccttcaatgtggtgctgctggtctttttcagtggcctcttcttcgcattcccttgcaggtggctggctcagaacggggagtgggcctttcctgttatcacaggctccctctttgtccttaccttcttcagtcttgtttcactcaacttctcagaccctggcatcttacatcaaggctccgctgagcagggccccttgacggtgcacgtggtgtgggtgaaccacggggccttccgcctgcaatggtgtccaaagtgctgcttccaccgcccgccccggacttaccactgcccctggtgcaacatctgtgtggaggactttgaccaccactgcaagtgggtcaataactgcatcggtcaccgcaacttccgcttcttcatgctgcttgtcctgtccctgtgcctctactcgggcgccatgctggtcacctgtctcatcttcctggtgcgcacaacccacctgcccttctccaccgacaaggccatcgccatcgtggtggccgtgtccgccgcgggcctcctggtgccgctgtccctcctgctgctgatccaggcactgtccgtgagctcggccgaccgcacctacaagggcaagtgagtgccagctgtccttgcatggagtcctggttcctttggtggagaatggtgttgaaaatctcagcctttgcggcggagagcggggacatgggacacaggggagttggtggtgggcagagatgctgctgggccactttcagtgacaaaacatgacagcaaaggctcttgaagtcagtgcagacaccttcagggatacaaccccttcgaccagggctgtgccagcaactggtatttaacaatttgtgcaccactgggacccaagtacatggctgaagctgtccagctgcagagagtggtggggcctgactggacatccatgccgaatctgcaccctccaatgtccccctctgctctcaaccccccagccccaacctctgggtccctacaaagcagggaagggacccccggggcgtggtgaggctgcagctctccaggagttccacacgggcccagtgctgcccctgctgctgcaggagcccccaggcgaggttcggccttcctctcgcccctgtgcacccggagatgcccacagcaccagcacctgagctcacctccgaacccgcctcctgaacccgcctcctgaacctgcctccttacctcccacttcctgagccctgagtggaagcctttctgtgccttgccctttgcccactcccctggtgggactgccaagaccctcaatgcccattaaatactcttgcctgcctctt

SEQ ID NO: 204439 - DNA, 6377 bp, Homo sapiens
  Payload ID: 20325
  Gene Name: zinc finger, DHHC-type containing 2
  Uniprot ID: Q9UIJ5
  ENST ID: ENST00000262096
  CDS Start-End: 696-1799
cgcaagttgaagcgcgagggttccacgcgggctgcggggacgcgggcctcggtgctgcagactttctcagggcgcctgggtcgcggcaggcgcggagtcccgagcgcagcagctgctccgccggcctcgcctccgacccccgccctgcgccaagcgcggaagcgctcgcgacctaactgccccgggtgccgggcgcctagggaggggccgccaccgcccgctccgccccgggggcctgcgcccagcagcccccgcctccccggaatccagaggccgagccggaggcggcggggccacggtgggagcccgcgaggtggcccgagcgagggccccgcatccccgcagagcccgcccgagggcgcagcctgccacgccaggggaggcggccgggcggcggggaacggcgggggcggagcgcagcctcccgacgccgccgcctcaccgcccccctccgcctcctcggcctccgctcgcagccgccgcctccgcctccgccgggctgaggagccgggagtccgccgcgccggctcggggctgcgggatggggagttagcgccacggcggcggcagtggccgcagcgcaccccgccgccgcccaggagcccgtccagccaggggtgccgggcccgcccagcccgccccggagccaggcccgcgggcggcggcggagctgggcaggtggatgcggctggaagatggcgccctcgggcccgggcagcagcgccaggcggcggtgccggcgggtgctgtactggatcccggtggtgttcatcaccctcctgctcggctggtcctactacgcctacgccatccagctgtgcatagtgtccatggaaaacactggcgaacaagttgtgtgcctgatggcctatcatctactttttgcaatgtttgtctggtcatactggaaaactatctttacattaccaatgaatccttcaaaagaattccatctctcttatgcagagaaagatttgttggagagagagccaagaggagaagcccatcaggaagttcttaggcgagcagccaaggatcttcccatctataccaggaccatgtctggagccatccgatactgtgacagatgccaacttataaaaccagatcgctgccatcactgctccgtctgtgataaatgtattttgaagatggatcatcattgtccatgggtgaacaattgtgttggattttcaaattataagttctttctccttttcttggcttattctctgctctactgcctttttattgcggcaacagatttacagtattttatcaaattttggacaaatggcctacctgatactcaagccaagttccatattatgtttttattctttgctgcagctatgttttctgtcagcttgtcttctctgtttggctatcattgttggctagtcagcaaaaataaatctacattagaggcattcagaagtccagtatttcgacatggaacagataagaatggattcagcttgggtttcagtaaaaacatgcgacaagtttttggtgatgagaagaagtactggttgctacccattttttcaagtctaggtgatggctgctcctttccaacttgccttgttaaccaggatcctgaacaagcatctactcctgcagggctgaattccacagctaaaaatctcgaaaaccatcagtttcctgcaaagccattgagagagtcccagagccaccttcttactgattctcagtcttggacggagagcagcataaacccaggaaaatgcaaagctggtatgagcaatcctgcattaaccatggaaaatgagacttaactcttcaagcaagataaattcatactttataaaagtatcaatgctgtagatggatggaagaggcttcccacaggaaggtgccaccagtcagttgtgcctatgtccctttggctggaaatgcagaatatgaattgattagttctctccaagccattgcttaaaatataacatgttttggatccaatacacacattgttacaactaacacaaattcctattaaatattaaaagtagttctggtttattaatcaacggggaaaacatcttctccaaaaaacttggaataaatccaaggaccagtttttacccaaatatatgggtagcacagtttatcacatagaaactccattaatcatctgattttccgaatctgaaaattgagactattaagatattaggatttcagagatttcaagtcacattataatgataagcattattcataaaacttgttacctttaagaaggtggaagtggcaaaccatacttcttttttttcctctgatgtgaatccagcctcagactgagtgaactgtaataattatgaattcattacagagtccaggtggcctgcagttgaagatcatcaaccatttttgcctcacttaattccagccttttgttttctgctggaaaataagtgtggacattgaagcttgagctctcaaagcagttggctggaatacttttgtcagaatacggtacatttctattacatcagaaatatattttcatctcttcttgttaaattgggaggaaatttatgatagcaattatgaagattgttttatgacattcttttgtcagtttggctttctaaaaatctctttttagattatttctcctgttgaacatagtaaaactattgaatttctcttaagaattcctaataggtcaatagatttaccctccagtgatatctatattatttctttctcgtctcatcaaaatgatgacaggtaaactatatttttccttaaacacctattacagttaaattatgcaaatcattaaataaaaatcatacaacttttggaaagttagttcaacatgaactaaaatggcatgctatttggaaatttagtttgagataaactaaagtgtgttgatgccagaatgttcagcttcagtaaatataataagctcttgtgccttgtatgcactatttaaaaaaagttttttttatttgagtccagtataattcatgtaaatgttaacaattagaataatactctgtatgcttttttgatactgattttgagaatttaaagcagattaccttttaaaactggaccaactaagtaattggtatttaatcaaagagaaaatggtaataaacttttcaaaatctttgttaaaccaaacattcaacacaaaataaactagaaggccagaggataatggaataaaagatcattgcaattacttatccttcctaaaaatatagttttatattaattgtgcttatggaagaaacaatgtcagccaagtccattttatagtttgagtgcaattctttgaacaatagaaatatctgcagtctttcacagatttgtattatgctgaagagtttcatctgacaatctgcttcaagaaatctcagaaaatatgataacattttaactttcattttagagcacgttttggtcatttttaaaaatacctaaagtgccagaccggaacctatagctactgctagaagtcttaaaaaaaccaacagcagcacaggatgtattaagaattatatgaagtcaggtttgtttttttttttttttttttttcaaagcacagtactgttagctgtttttgtggacaggattcgattaagtattccctcttgtcaaactggaagctaggggaaaaagagggatttttatcctttactcttctagagtactgttaatgcccctttcccacagtcttttatataattaaatatatgtcaatacacattagaatcagatttgaaaaagttaaaacaatttcattgttgtaattgttccctttctgttttcatatagtgaataacctttaaagggttgttttgttttgttttgaattataggagttataatctttggagatgattgcatatctcattagatatgcaatataaatttatctgagtgaacaaagtgctaaataaatagatctacattttgtacatatttatataaaatttacctttaagtatttactttaaaaaatttaatggcttaactcgaacttgaagacacatacttcaactgtccttattgtccattaaactgataattttgatttttcttgcttttatagattttactatataggaatcaagatttaagaaattttgcattaaaaatagtgtaccaatgcttcatatacgttagttatttgctattatgtagggaagaggattgttatttcaaagatatattaaagaacagttgcatctgaatataatcatgatgcattcaatgaagttcatatccatgaattcactcctaatataccctaataaagtggttgatcacctacattatctgtctataagaaactgcctttgcactgacaatgtaaattattttaagcataaattttcctaatagtttattagagctactaatggcaaaattcatgtcttcaatgtggccataacataggtcttgggaggggtggtgagaaaataaggtatttactttgtagtagttaagtgattctgaggacaattagaaacagactataaaactcaactacactgtaatcaatagacaactattggaaatatggcatatgttgacaaacacttaactagggaaatcaaagatataaatcatgtttataaaaaattaggcacgcaatcatgtgattcatgcttcaagaaaatatatgaaaaaagtgttactccattatgttataaactagcagattttccctattttgaaatgcatgtaaacgggctcggctgattctgaaattgtactgtatcatttggtatttacttatatggtcaaatacttgtttgtaaaagtgatggttctgatacctttgatcaaacatagatacaaacctcagaaaatggtaaatgcaaagcagtttacgttgtaaatcatgatggtgtcctccagcacaaccatcccacccacacacctagactacagattctgatctgtgaatattttcaccaaagtgacatttaaacaagtggatttttcacaaataacacgtgtttaatatctttctgcagaaacgtgttcttctaaagcagaaaaccacgtggcttaatcccaaatgttttacacttcttttccacatacttagccagttcagcaccgatttcctcttatatgtggaaggagactatgttacatacctgaagtattactcttttacaaagataccattagaattttctcactgtcttggtaaaaattcctagattctactttttattgcaagtgttagcaatatgatcttgtaacgccatgaaaagcattaagtagaagccaacattaacctagattttacaactgagcaatctgttccccaccagatttcctttagaatttattaccaaaggatcttattttgttacagaacacaggaaattgttaaaccttataatgttgcaaaccatgcattttccttttctcttttccataagatttttttattgtagtagtgccctggcttgtaaacagtggacatcactgaaaggatgaaatcaagtaggcttgtttcaaagagactcctgtgaatcaactatgaatatgaagtatctcccagaacaatgttgagtgtttcaggagactctgaaacagggcacccattttttttttccttcctcaaaatagtctccttgaaatgtgagcaaagaactatgatgatgcagtccaggtatctaatagctcaatcaccaacaccgctgagaattgttcttataccagcaaaaagttcaaatacaataacctgggcaatgccaacagaagacacttttaatcatttgcagacctttcttgttgcaggaaagtgagggcaaaaacaaactggtgaaaaatgttcaaaaatagatctttttgatgttcatagccagtattcagtatttctgtattgtttacaattgggggaaaatgtctgttaaggctaatcatctgagtgatttgagtagcaattaaaccaaagggaaacttttaataagttattttaagccctggtttatggctagttcccttttgctcaggaaaaatagtactactttatggtttatgaaaacctatgatttatgttgcatcttccggggaaggtttaacagtacaaggagctgaatcctacctgaaattattaatgcttaatatattgcttctgtttgattgataaaggtgcttaatcaattgaaaaaaaaacgcataatgcttcaaggtaaaattccgttgattctgaatttaaaaagatactacagaatgcgtcagttctcctgttgtatttttctcagttatgagagcaaggctattttgtcagtttagattttgtgtctttttctgtcagtatgtatggctccctaattgaaaacatcttaaatgaactaatcaaacactta

SEQ ID NO: 204440 - DNA, 487 bp, Homo sapiens
  Payload ID: 20325
  Gene Name: zinc finger, DHHC-type containing 2
  ENST ID: ENST00000522184
  CDS Start-End: 97-487
aaacgtctcactcctagacatgtgagttggcttcctggccaatggaaaaggataaacaatgaggcaggtaaaaagagcttttggggagcactgtccatggaaaacactggcgaacaagttgtgtgcctgatggcctatcatctactttttgcaatgtttgtctggtcatactggaaaactatctttacattaccaatgaatccttcaaaagaattccatctctcttatgcagagaaagatttgttggagagagagccaagaggagaagcccatcaggaagttcttaggcgagcagccaaggatcttcccatctataccaggaccatgtctggagccatccgatactgtgacagatgccaacttataaaaccagatcgctgccatcactgctccgtctgtgataaatgtattttgaagatggatcatcattgtccatgggtgaacaattgtgttggattttcaaattataagttctttctccttttct

SEQ ID NO: 204441 - DNA, 167 bp, Homo sapiens
  Payload ID: 20325
  Gene Name: zinc finger, DHHC-type containing 2
  ENST ID: ENST00000523132
  CDS Start-End: 146-167
atttttgaggacatgtgcaacacactaaaccataatttaggtgtttgaacagtagggagagaaaaaaagaggtgatcgtctgaggtttttacatccagagagcgaagtggctccagtccgagttcgaggttcctgaattgtgtccatggaaaacactggcgaacaag

SEQ ID NO: 204442 - DNA, 1351 bp, Homo sapiens
  Payload ID: 20326
  Gene Name: zinc finger, DHHC-type containing 20
  Uniprot ID: Q5W0Z9
  ENST ID: ENST00000320220
  CDS Start-End: 78-1040
cgtccgagtcaccgtcgccggggctcccgcgctccccagaacggtgggacgcggggctcggcagccgccagcggaacatggcgccctggacgctgtggcgctgctgccagcgcgtcgtgggctgggtgccggtgctcttcatcaccttcgtggtcgtctggtcctactacgcgtacgtggtggagctctgcgtgtttactatttttggaaatgaagaaaatggaaagaccgttgtttaccttgtggctttccatctgttctttgttatgtttgtatggtcctattggatgacaattttcacatctcccgcttccccctccaaagagttctacttgtccaattctgaaaaggaacgttatgaaaaagaattcagccaagaaagacaacaagaaattttgagaagagcagcaagagctttacctatctataccacatcagcttcaaaaactatcagatattgtgaaaaatgtcagctgattaaacctgatcgggcgcatcactgctcagcctgtgactcatgtattcttaagatggatcatcactgtccttgggtgaataactgtgtgggattttctaattacaaattcttcctgctgtttttattgtattccctattatattgccttttcgtggctgcaacagttttagagtactttataaaattttggacgaatgaactgacagatacacgtgcaaaattccacgtactttttcttttctttgtgtctgcaatgttcttcatcagcgtcctctcacttttcagctaccactgctggctagttggaaaaaatagaacaacaatagaatcattccgcgcacccacgttttcatacggacctgatggaaatggtttctctcttggatgcagtaaaaattggagacaagtctttggtgatgaaaagaaatattggctacttccaatattttcaagcttgggtgatggttgcagttttccaactcgccttgtggggatggatccagaacaagcttctgttacaaaccagaatgagtatgccagaagatctaaactgcagaggtagaaagcagaaaacttggcaaatgacagtagtggctcaaatcaaccttttcctatcaaaccacttagtgaatcaaaaaaccgcttgttggacagtgaatctcagtggctggagaatggagctgaagaaggcatcgtcaaatcaggtgtatgaaaacattatagactggtattttcaattttcatttgcaagaaaatgatcagtggaatgaaataactgaagtataacagaagatatattttttaaaacggaaagcctttgtacagttcctgggattcacagaagcactactccagagcagaatgatgccttaa

SEQ ID NO: 204443 - DNA, 5338 bp, Homo sapiens
  Payload ID: 20326
  Gene Name: zinc finger, DHHC-type containing 20
  Uniprot ID: Q5W0Z9
  ENST ID: ENST00000382466
  CDS Start-End: 199-1263
tggggtgggggcggggcctggctgggcgccgggacgggaggagtcccggcggcgcctcggacttttgctcccacaagtcctgcctcggaggcgggggagctggaccagcagccgcctggagcgtccgagtcaccgtcgccggggctcccgcgctccccagaacggtgggacgcggggctcggcagccgccagcggaacatggcgccctggacgctgtggcgctgctgccagcgcgtcgtgggctgggtgccggtgctcttcatcaccttcgtggtcgtctggtcctactacgcgtacgtggtggagctctgcgtgtttactatttttggaaatgaagaaaatggaaagaccgttgtttaccttgtggctttccatctgttctttgttatgtttgtatggtcctattggatgacaattttcacatctcccgcttccccctccaaagagttctacttgtccaattctgaaaaggaacgttatgaaaaagaattcagccaagaaagacaacaagaaattttgagaagagcagcaagagctttacctatctataccacatcagcttcaaaaactatcagatattgtgaaaaatgtcagctgattaaacctgatcgggcgcatcactgctcagcctgtgactcatgtattcttaagatggatcatcactgtccttgggtgaataactgtgtgggattttctaattacaaattcttcctgctgtttttattgtattccctattatattgccttttcgtggctgcaacagttttagagtactttataaaattttggacgaatgaactgacagatacacgtgcaaaattccacgtactttttcttttctttgtgtctgcaatgttcttcatcagcgtcctctcacttttcagctaccactgctggctagttggaaaaaatagaacaacaatagaatcattccgcgcacccacgttttcatacggacctgatggaaatggtttctctcttggatgcagtaaaaattggagacaagtctttggtgatgaaaagaaatattggctacttccaatattttcaagcttgggtgatggttgcagttttccaactcgccttgtggggatggatccagaacaagcttctgttacaaaccagaatgagtatgccagaagtggctcaaatcaaccttttcctatcaaaccacttagtgaatcaaaaaaccgcttgttggacagtgaatctcagtggctggagaatggagctgaagaaggcatcgtcaaatcaggtgtatgaaaacattatagactggtattttcaattttcatttgcaagaaaatgatcagtggaatgaaataactgaagtataacagaagatatattttttaaaacggaaagcctttgtacagttcctgggattcacagaagcactactccagagcagaatgatgccttaatcttaagtgtccatttgtgcagcattgacttagagctacaaaagtgacttaatgttattctggaaataatacttacctgttatgagttgctataatatgagctgtcatcacattttaacatgcatatgtattttttgatacctgaattacattattagaataagtatccatatacattttcactccaaaaacacaagcttaaaaactttaaagtacatctagggcaaatggtggctgaaagtgaataatattcaaattactgttgcttgtactgtataaggaaaactgcttttttaaattgggtatttgctaatttataattactattttatacttttcaacatttttaataactttttttattgttggctataacagaaggattcagatatctaaatatcatttagaacatagaacacattggtctaattcatcgaaagcttagttatgagcattaatacaaccatgtagtagagcaagtgcccaaggtttaaagggaacttggcagtataagaaatattttgggttctctctgctattttatagctttttttgttgaactttcaggggtatgtacatgggcagagaaacacaaaggtacatgtgctggagaatactggacacagtaggaagaagtataggtgtccagaagaaaatctaagaggaatattgtaatttgttaaaaaaaatagttttgagttttaacagcagttagaataaagcatgctgttgacttcactttcaaatttcagtgtaggtaatgactaaaaattactttgaaactttttacagtaatactgtaatagcttaaacagtgatttaaaatgcaatttaaactaggcaaaaaaaactttagagtaagttttcctcctggctgtcagttggaaattctaacctgagtggtcattttacattcccagtctcttgagaagtggattctactcttagacgcacagtctgaagtctgacttcctaacggcaacccctttatgactagacacatttctcctttttccttttaaaatctaagcgacaggaggtgttgcattaactccaaggaaaagtacagaataaacaatgtagaaatgtcactcctcatttacaccttttagacagacagacacacacacacacacaccccccccaaaataattgattgcttccagtgagtgggtggagatgaatctcagcagcatctgtgagtactacaggttggagcttcctgtctgtaaaatgggactgcaggggagggggtgttgtgaataagttggactggatgacttctaacattctgtgatgcctaattttgcaaaatcacttttcattcacccaataaatttttttcttcttttttccacagagttttgctctgtctcccaggcaggagtgcagtggcgggatcttggctcgctgcaacctctgccttccaggttcaatagagtctcctgcctcagcctcccaagtagctgggattacaggctcatgccaccatgcccggctaattttcacatttttagaagagacgaggtttcaccatgttgaccaggctgatcactaactcctgacctcaaataatccacccacctcagcttcccaaagtgctgggattacaggcgtgagccaccacgccccgccccggtaaattttttggagtaccttctgtatgctaaataataaactaggaatagctctgtcatttcctagtacagcataaattttatggttgctactgtaggtttataatttgtttataatttggcctaatttccatcagccatactaatattggattttaaaaggaggcaactttttttctttttgaaccaaaggaatgagttagctttgaaaacataatttgggatattatagtatggattcttctacctttgtttcaactccttagtaatcttgattctagcaaactagaatgagatttaagagataccaattattgctgggtgtggtggctcatgcctgtaatcccagcactttgggaggccaaggctggcggatcacctgaggtcaggggttcgagattagcctggtcaaaatggcaaaaccctgtctccactaaaaatacaaaaaaaccccaaaactgtccaggcatggtggcacacgcctgtagtcccaactactcgggaggtggaggcaggagaatcacttgaacccaggaggtggaggtcgcagtgagccgagatcgtgccactgcactccagcctgggcgacgagtgaaactccatctcaaaaatatatatatatatcaattaccaactaaaaacataactccagtttggcagtttgcatattataaggagataaatgttaaaacatacttgactactttcagaaatgttctcctggtactttttgcatttctacattcagataaaaagatttgcatgcacctggctaacgccaagggaacttcatttttttcttcactattatgcactttcatggtatagtctttctcagttcttttaatttttgttatttaacatctttaatagcacagcaaacatcttttcagaaattttcagttaaagcctttgaattacttatctttgatttaatttacagccagcattttgccacgttctaaataatatttagctcaactgattcatacgtattaatgaccattctagcaaaggcctacaagtggtgtgggaatcagggaaaggctgcctctttggtatctcaactggtattgattattgctatcaactatttggggagaaaaaatcaaaatgaagccctgtcaaattttagaagtactatctttggtccttcaaacactttgtgatgacaccttaagaaaaataaagttgaagttcaggtcttgccattgccattacagacaaattaggagacttggtttacctgggaacaaatttacttgaatattcagtacctgaaactatgccaaaccaaagagcagctgcagtacattcgttattttaaatgaacaagtttacaaagtttattttcatctatacgtaaggatgatttttttaaaactttttacatattagtggttatgatccaatgtgtcatgagtgaatttaactgtaaggtggtttaaatcaaatatgcaatgtttacttgaattgtatttctattagcagattttgactatgtttacaggacggtttaaattaaggattatcaggcatgtgagatctttcagttatctttaaagtagatgtatattaagggcttagatttaggatctacatattctgggcattgaataggcagtaacttacaaataagttttgcttaccttttgttctagggactagcactgctatcaatggaaagtatttttaactaatctgttattaagaaagtcatatttttgcatttcagccaaaataaagaccgcctgtaataatctgttagaaacagataatacatgtctgaaatccatatgtttcatatgatctaaactgtattttccaatttaaattaaaaatgtaatatagattcagaaaggttcatatttttctaatgacttcattctatattattttgttaggttgcataaagaagcaaggaattgtacttgtattaaaagatgaagaaagctattaggtatatttgtacatgactgcaaatgagtctatgcccgtttaaaagaaaagatggacactattttaaagtgagctttaatatgcttttatataaacaaatttgaagtacagtttagtttggttgtgtttacctaacaagtaccataagccttgtgtttgttcttatttgtataatcctagcctgtgacttaatgttgatgctttgctttgtcttttggctggcctaacctacattgacatgtacacagaacattttaaaactttttttttcaaaagtcataatgaattactttattaataaacaaagtcttgtatttg

SEQ ID NO: 204444 - DNA, 1869 bp, Homo sapiens
  Payload ID: 20326
  Gene Name: zinc finger, DHHC-type containing 20
  Uniprot ID: Q5W0Z9
  ENST ID: ENST00000400590
  CDS Start-End: 200-1297
gtggggtgggggcggggcctggctgggcgccgggacgggaggagtcccggcggcgcctcggacttttgctcccacaagtcctgcctcggaggcgggggagctggaccagcagccgcctggagcgtccgagtcaccgtcgccggggctcccgcgctccccagaacggtgggacgcggggctcggcagccgccagcggaacatggcgccctggacgctgtggcgctgctgccagcgcgtcgtgggctgggtgccggtgctcttcatcaccttcgtggtcgtctggtcctactacgcgtacgtggtggagctctgcgtgtttactatttttggaaatgaagaaaatggaaagaccgttgtttaccttgtggctttccatctgttctttgttatgtttgtatggtcctattggatgacaattttcacatctcccgcttccccctccaaagagttctacttgtccaattctgaaaaggaacgttatgaaaaagaattcagccaagaaagacaacaagaaattttgagaagagcagcaagagctttacctatctataccacatcagcttcaaaaactatcagatattgtgaaaaatgtcagctgattaaacctgatcgggcgcatcactgctcagcctgtgactcatgtattcttaagatggatcatcactgtccttgggtgaataactgtgtgggattttctaattacaaattcttcctgctgtttttattgtattccctattatattgccttttcgtggctgcaacagttttagagtactttataaaattttggacgaatgaactgacagatacacgtgcaaaattccacgtactttttcttttctttgtgtctgcaatgttcttcatcagcgtcctctcacttttcagctaccactgctggctagttggaaaaaatagaacaacaatagaatcattccgcgcacccacgttttcatacggacctgatggaaatggtttctctcttggatgcagtaaaaattggagacaagtctttggtgatgaaaagaaatattggctacttccaatattttcaagcttgggtgatggttgcagttttccaactcgccttgtggggatggatccagaacaagcttctgttacaaaccagaatgagtatgccagaagtagtggctcaaatcaaccttttcctatcaaaccacttagtgaatcaaaaaaccgcttgttggacagtgaatctcagtggctggagaatggagctgaagaaggcatcgtcaaatcagggacaaataaccatgtaacagtggcaatagaaaattgagtaccacttgttcataactaaccatttgaataagagcaaggtgtatgaaaacattatagactggtattttcaattttcatttgcaagaaaatgatcagtggaatgaaataactgaagtataacagaagatatattttttaaaacggaaagcctttgtacagttcctgggattcacagaagcactactccagagcagaatgatgccttaatcttaagtgtccatttgtgcagcattgacttagagctacaaaagtgacttaatgttattctggaaataatacttacctgttatgagttgctataatatgagctgtcatcacattttaacatgcatatgtattttttgatacctgaattacattattagaataagtatccatatacattttcactccaaaaacacaagcttaaaaactttaaagtacatctagggcaaatggtggctgaaagtgaataatattcaaattactgttgcttgtactgtataaggaaaactgcttttttaaattgggtatttgctaatttataattactattttatacttttcaacatttttaataactttttttat

SEQ ID NO: 204445 - DNA, 1296 bp, Homo sapiens
  Payload ID: 20326
  Gene Name: zinc finger, DHHC-type containing 20
  Uniprot ID: Q5W0Z9
  ENST ID: ENST00000415724
  CDS Start-End: 199-1296
tggggtgggggcggggcctggctgggcgccgggacgggaggagtcccggcggcgcctcggacttttgctcccacaagtcctgcctcggaggcgggggagctggaccagcagccgcctggagcgtccgagtcaccgtcgccggggctcccgcgctccccagaacggtgggacgcggggctcggcagccgccagcggaacatggcgccctggacgctgtggcgctgctgccagcgcgtcgtgggctgggtgccggtgctcttcatcaccttcgtggtcgtctggtcctactacgcgtacgtggtggagctctgcgtgtttactatttttggaaatgaagaaaatggaaagaccgttgtttaccttgtggctttccatctgttctttgttatgtttgtatggtcctattggatgacaattttcacatctcccgcttccccctccaaagagttctacttgtccaattctgaaaaggaacgttatgaaaaagaattcagccaagaaagacaacaagaaattttgagaagagcagcaagagctttacctatctataccacatcagcttcaaaaactatcagatattgtgaaaaatgtcagctgattaaacctgatcgggcgcatcactgctcagcctgtgactcatgtattcttaagatggatcatcactgtccttgggtgaataactgtgtgggattttctaattacaaattcttcctgctgtttttattgtattccctattatattgccttttcgtggctgcaacagttttagagtactttataaaattttggacgaatgaactgacagatacacgtgcaaaattccacgtactttttcttttctttgtgtctgcaatgttcttcatcagcgtcctctcacttttcagctaccactgctggctagttggaaaaaatagaacaacaatagaatcattccgcgcacccacgttttcatacggacctgatggaaatggtttctctcttggatgcagtaaaaattggagacaagtctttggtgatgaaaagaaatattggctacttccaatattttcaagcttgggtgatggttgcagttttccaactcgccttgtggggatggatccagaacaagcttctgttacaaaccagaatgagtatgccagaagtagtggctcaaatcaaccttttcctatcaaaccacttagtgaatcaaaaaaccgcttgttggacagtgaatctcagtggctggagaatggagctgaagaaggcatcgtcaaatcagggacaaataaccatgtaacagtggcaatagaaaattga

SEQ ID NO: 204446 - DNA, 5315 bp, Homo sapiens
  Payload ID: 20326
  Gene Name: zinc finger, DHHC-type containing 20
  ENST ID: ENST00000542645
  CDS Start-End: 362-1240
gtggggtgggggcggggcctggctgggcgccgggacgggaggagtcccggcggcgcctcggacttttgctcccacaagtcctgcctcggaggcgggggagctggaccagcagccgcctggagcgtccgagtcaccgtcgccggggctcccgcgctccccagaacggtgggacgcggggctcggcagccgccagcggaacatggcgccctggacgctgtggcgctgctgccagcgcgtcgtgggctgggtgccggtgctcttcatcaccttcgtggtcgtctggtcctactacgcgtacgtggtggagctctgcgtgtgaaagaccgttgtttaccttgtggctttccatctgttctttgttatgtttgtatggtcctattggatgacaattttcacatctcccgcttccccctccaaagagttctacttgtccaattctgaaaaggaacgttatgaaaaagaattcagccaagaaagacaacaagaaattttgagaagagcagcaagagctttacctatctataccacatcagcttcaaaaactatcagatattgtgaaaaatgtcagctgattaaacctgatcgggcgcatcactgctcagcctgtgactcatgtattcttaagatggatcatcactgtccttgggtgaataactgtgtgggattttctaattacaaattcttcctgctgtttttattgtattccctattatattgccttttcgtggctgcaacagttttagagtactttataaaattttggacgaatgaactgacagatacacgtgcaaaattccacgtactttttcttttctttgtgtctgcaatgttcttcatcagcgtcctctcacttttcagctaccactgctggctagttggaaaaaatagaacaacaatagaatcattccgcgcacccacgttttcatacggacctgatggaaatggtttctctcttggatgcagtaaaaattggagacaagtctttggtgatgaaaagaaatattggctacttccaatattttcaagcttgggtgatggttgcagttttccaactcgccttgtggggatggatccagaacaagcttctgttacaaaccagaatgagtatgccagaagtagtggctcaaatcaaccttttcctatcaaaccacttagtgaatcaaaaaaccgcttgttggacagtgaatctcagtggctggagaatggagctgaagaaggcatcgtcaaatcaggtgtatgaaaacattatagactggtattttcaattttcatttgcaagaaaatgatcagtggaatgaaataactgaagtataacagaagatatattttttaaaacggaaagcctttgtacagttcctgggattcacagaagcactactccagagcagaatgatgccttaatcttaagtgtccatttgtgcagcattgacttagagctacaaaagtgacttaatgttattctggaaataatacttacctgttatgagttgctataatatgagctgtcatcacattttaacatgcatatgtattttttgatacctgaattacattattagaataagtatccatatacattttcactccaaaaacacaagcttaaaaactttaaagtacatctagggcaaatggtggctgaaagtgaataatattcaaattactgttgcttgtactgtataaggaaaactgcttttttaaattgggtatttgctaatttataattactattttatacttttcaacatttttaataactttttttattgttggctataacagaaggattcagatatctaaatatcatttagaacatagaacacattggtctaattcatcgaaagcttagttatgagcattaatacaaccatgtagtagagcaagtgcccaaggtttaaagggaacttggcagtataagaaatattttgggttctctctgctattttatagctttttttgttgaactttcaggggtatgtacatgggcagagaaacacaaaggtacatgtgctggagaatactggacacagtaggaagaagtataggtgtccagaagaaaatctaagaggaatattgtaatttgttaaaaaaaatagttttgagttttaacagcagttagaataaagcatgctgttgacttcactttcaaatttcagtgtaggtaatgactaaaaattactttgaaactttttacagtaatactgtaatagcttaaacagtgatttaaaatgcaatttaaactaggcaaaaaaaactttagagtaagttttcctcctggctgtcagttggaaattctaacctgagtggtcattttacattcccagtctcttgagaagtggattctactcttagacgcacagtctgaagtctgacttcctaacggcaacccctttatgactagacacatttctcctttttccttttaaaatctaagcgacaggaggtgttgcattaactccaaggaaaagtacagaataaacaatgtagaaatgtcactcctcatttacaccttttagacagacagacacacacacacacacaccccccccaaaataattgattgcttccagtgagtgggtggagatgaatctcagcagcatctgtgagtactacaggttggagcttcctgtctgtaaaatgggactgcaggggagggggtgttgtgaataagttggactggatgacttctaacattctgtgatgcctaattttgcaaaatcacttttcattcacccaataaatttttttcttcttttttccacagagttttgctctgtctcccaggcaggagtgcagtggcgggatcttggctcgctgcaacctctgccttccaggttcaatagagtctcctgcctcagcctcccaagtagctgggattacaggctcatgccaccatgcccggctaattttcacatttttagaagagacgaggtttcaccatgttgaccaggctgatcactaactcctgacctcaaataatccacccacctcagcttcccaaagtgctgggattacaggcgtgagccaccacgccccgccccggtaaattttttggagtaccttctgtatgctaaataataaactaggaatagctctgtcatttcctagtacagcataaattttatggttgctactgtaggtttataatttgtttataatttggcctaatttccatcagccatactaatattggattttaaaaggaggcaactttttttctttttgaaccaaaggaatgagttagctttgaaaacataatttgggatattatagtatggattcttctacctttgtttcaactccttagtaatcttgattctagcaaactagaatgagatttaagagataccaattattgctgggtgtggtggctcatgcctgtaatcccagcactttgggaggccaaggctggcggatcacctgaggtcaggggttcgagattagcctggtcaaaatggcaaaaccctgtctccactaaaaatacaaaaaaaccccaaaactgtccaggcatggtggcacacgcctgtagtcccaactactcgggaggtggaggcaggagaatcacttgaacccaggaggtggaggtcgcagtgagccgagatcgtgccactgcactccagcctgggcgacgagtgaaactccatctcaaaaatatatatatatatcaattaccaactaaaaacataactccagtttggcagtttgcatattataaggagataaatgttaaaacatacttgactactttcagaaatgttctcctggtactttttgcatttctacattcagataaaaagatttgcatgcacctggctaacgccaagggaacttcatttttttcttcactattatgcactttcatggtatagtctttctcagttcttttaatttttgttatttaacatctttaatagcacagcaaacatcttttcagaaattttcagttaaagcctttgaattacttatctttgatttaatttacagccagcattttgccacgttctaaataatatttagctcaactgattcatacgtattaatgaccattctagcaaaggcctacaagtggtgtgggaatcagggaaaggctgcctctttggtatctcaactggtattgattattgctatcaactatttggggagaaaaaatcaaaatgaagccctgtcaaattttagaagtactatctttggtccttcaaacactttgtgatgacaccttaagaaaaataaagttgaagttcaggtcttgccattgccattacagacaaattaggagacttggtttacctgggaacaaatttacttgaatattcagtacctgaaactatgccaaaccaaagagcagctgcagtacattcgttattttaaatgaacaagtttacaaagtttattttcatctatacgtaaggatgatttttttaaaactttttacatattagtggttatgatccaatgtgtcatgagtgaatttaactgtaaggtggtttaaatcaaatatgcaatgtttacttgaattgtatttctattagcagattttgactatgtttacaggacggtttaaattaaggattatcaggcatgtgagatctttcagttatctttaaagtagatgtatattaagggcttagatttaggatctacatattctgggcattgaataggcagtaacttacaaataagttttgcttaccttttgttctagggactagcactgctatcaatggaaagtatttttaactaatctgttattaagaaagtcatatttttgcatttcagccaaaataaagaccgcctgtaataatctgttagaaacagataatacatgtctgaaatccatatgtttcatatgatctaaactgtattttccaatttaaattaaaaatgtaatatagattcagaaaggttcatatttttctaatgacttcattctatattattttgttaggttgcataaagaagcaaggaattgtacttgtattaaaagatgaagaaagctattaggtatatttgtacatgactgcaaatgagtctatgcccgtttaaaagaaaagatggacactattttaaagtgagctttaatatgcttttatataaacaaatttgaagtacagtttagtttggttgtgtttacctaacaagtaccataagccttgtgtttgttcttatttgtataatcctagcctgtgacttaatgttgatgctttgctttgtcttttggctggcctaacctacattgacatgtacacagaacattttaaaactttttttttcaaaagtcataatgaattactttattaataaacaaagtcttgtatttg

SEQ ID NO: 204447 - DNA, 3343 bp, Homo sapiens
  Payload ID: 20326
  Gene Name: zinc finger, DHHC-type containing 20
  ENST ID: ENST00000626464
  CDS Start-End: 1-60
gaagaaggcatcgtcaaatcagggacaaataaccatgtaacagtggcaatagaaaattgagtaccacttgttcataactaaccatttgaataagagcaaggtgtatgaaaacattatagactggtattttcaattttcatttgcaagaaaatgatcagtggaatgaaataactgaagtataacagaagatatattttttaaaacggaaagcctttgtacagttcctgggattcacagaagcactactccagagcagaatgatgccttaatcttaagtgtccatttgtgcagcattgacttagagctacaaaagtgacttaatgttattctggaaataatacttacctgttatgagttgctataatatgagctgtcatcacattttaacatgcatatgtattttttgatacctgaattacattattagaataagtatccatatacattttcactccaaaaacacaagcttaaaaactttaaagtacatctagggcaaatggtggctgaaagtgaataatattcaaattactgttgcttgtactgtataaggaaaactgcttttttaaattgggtatttgctaatttataattactattttatacttttcaacatttttaataactttttttattgttggctataacagaaggattcagatatctaaatatcatttagaacatagaacacattggtctaattcatcgaaagcttagttatgagcattaatacaaccatgtagtagagcaagtgcccaaggtttaaagggaacttggcagtataagaaatattttgggttctctctgctattttatagctttttttgttgaactttcaggggtatgtacatgggcagagaaacacaaaggtacatgtgctggagaatactggacacagtaggaagaagtataggtgtccagaagaaaatctaagaggaatattgtaatttgttaaaaaaaatagttttgagttttaacagcagttagaataaagcatgctgttgacttcactttcaaatttcagtgtaggtaatgactaaaaattactttgaaactttttacagtaatactgtaatagcttaaacagtgatttaaaatgcaatttaaactaggcaaaaaaaactttagagtaagttttcctcctggctgtcagttggaaattctaacctgagtggtcattttacattcccagtctcttgagaagtggattctactcttagacgcacagtctgaagtctgacttcctaacggcaacccctttatgactagacacatttctcctttttccttttaaaatctaagcgacaggaggtgttgcattaactccaaggaaaagtacagaataaacaatgtagaaatgtcactcctcatttacaccttttagacagacagacacacacacacacacaccccccccaaaataattgattgcttccagtgagtgggtggagatgaatctcagcagcatctgtgagtactacaggttggagcttcctgtctgtaaaatgggactgcaggggagggggtgttgtgaataagttggactggatgacttctaacattctgtgatgcctaattttgcaaaatcacttttcattcacccaataaatttttttcttcttttttccacagagttttgctctgtctcccagcctgggcgacgagtgaaactccatctcaaaaatatatatatatatcaattaccaactaaaaacataactccagtttggcagtttgcatattataaggagataaatgttaaaacatacttgactactttcagaaatgttctcctggtactttttgcatttctacattcagataaaaagatttgcatgcacctggctaacgccaagggaacttcatttttttcttcactattatgcactttcatggtatagtctttctcagttcttttaatttttgttatttaacatctttaatagcacagcaaacatcttttcagaaattttcagttaaagcctttgaattacttatctttgatttaatttacagccagcattttgccacgttctaaataatatttagctcaactgattcatacgtattaatgaccattctagcaaaggcctacaagtggtgtgggaatcagggaaaggctgcctctttggtatctcaactggtattgattattgctatcaactatttggggagaaaaaatcaaaatgaagccctgtcaaattttagaagtactatctttggtccttcaaacactttgtgatgacaccttaagaaaaataaagttgaagttcaggtcttgccattgccattacagacaaattaggagacttggtttacctgggaacaaatttacttgaatattcagtacctgaaactatgccaaaccaaagagcagctgcagtacattcgttattttaaatgaacaagtttacaaagtttattttcatctatacgtaaggatgatttttttaaaactttttacatattagtggttatgatccaatgtgtcatgagtgaatttaactgtaaggtggtttaaatcaaatatgcaatgtttacttgaattgtatttctattagcagattttgactatgtttacaggacggtttaaattaaggattatcaggcatgtgagatctttcagttatctttaaagtagatgtatattaagggcttagatttaggatctacatattctgggcattgaataggcagtaacttacaaataagttttgcttaccttttgttctagggactagcactgctatcaatggaaagtatttttaactaatctgttattaagaaagtcatatttttgcatttcagccaaaataaagaccgcctgtaataatctgttagaaacagataatacatgtctgaaatccatatgtttcatatgatctaaactgtattttccaatttaaattaaaaatgtaatatagattcagaaaggttcatatttttctaatgacttcattctatattattttgttaggttgcataaagaagcaaggaattgtacttgtattaaaagatgaagaaagctattaggtatatttgtacatgactgcaaatgagtctatgcccgtttaaaagaaaagatggacactattttaaagtgagctttaatatgcttttatataaacaaatttgaagtacagtttagtttggttgtgtttacctaacaagtaccataagccttgtgtttgttcttatttgtataatcctagcctgtgacttaatgttgatgctttgctttgtcttttggctggcctaacctacattgacatgtacacagaacattttaaaactttttttttcaaaagtcataatgaattactttattaataaacaaagtcttgta

SEQ ID NO: 204448 - DNA, 9160 bp, Homo sapiens
  Payload ID: 20327
  Gene Name: zinc finger, DHHC-type containing 21
  Uniprot ID: Q8IVQ6
  ENST ID: ENST00000380916
  CDS Start-End: 468-1265
tcgcggctcccgggagctaagcgagacggcgacggcggcagtcgtccctccccacgcgggcgcgcgggcatgcggacacccactcggccggtccaggccctcaggctcccggaagcggaaggggagagcggcccggcctgggcggcggcgccggaggaggcggaggtggcgcggcaggaggaggggaaagagctgctggcggtcgggagagcggcggcagcgagaggcgagccagcggcgacgaatgaagaactttttcacttactgcaggattttcagcttcagcaagcaggttctcatggagaactgttattgaagagagatccatttggtgggatataattaaaaaaaatgaatcaaaagaaaatctctaaatgcagattccagaaaaattacagcacatctcagtgaatttgcaagtggatcatccttccttgtgggttagcaggcagttataagattgcaaaatgggtctccggattcactttgttgttgacccacatggttggtgctgcatgggtttgattgtctttgtttggttatacaatattgttttaattcccaaaattgtcctctttcctcactatgaagaaggacatattccaggcatattaataataatattctatggcatttccatattctgtctggttgccttagtgagggcctccataactgatccaggaagactccctgagaaccccaagatcccacatggagaaagggagttctgggaattatgtaacaagtgtaatttgatgagaccaaagcgttcccatcactgtagccgctgcggccactgtgtgaggagaatggatcatcactgtccatggattaacaattgtgttggtgaagataatcattggctctttctgcagttgtgtttctacactgaacttcttacttgctacgcactgatgttttctttctgccactattactattttcttccactaaaaaagcgtaatttggacctctttgtttttagacatgaattggccataatgagactagcagcctttatgggcattactatgttagttggaataactggactcttttacactcaactaattggcatcatcacagatacaacatctattgaaaagatgtcaaactgttgtgaagatatatcgaggccccgaaagccatggcagcagaccttctcagaagtttttggcactcgttggaagatcctgtggttcattcctttcaggcagaggcaaccactgcgagttccctaccactttgccaatcatgtctaaacagatggatggtgggcacagatgggtcctccatgctggcaatgcgttacaggttttatgataatagaactatgacagtcttcaagtcaattaaaatccacccaccagtcttaggcatcataatgtgccccaggctttattttaatagtgatcttgatcctgttgtgggactaatacaagatctatatttaagttttaaagcatgtttactttcaaattagctttccacagggatttcttgaaatgcttttgttattaaactcaaaaggcagtgattaggatgaaataattgtacataatttattttagtactgacagtgttacagattctaatttatggtaaatttcagatgtttatttaaaattttcacttttaaacagtaaccaaatctaaatttaattattcaggttttacaaaagttgatacaccttcttatagtataggtaaattttctttttcaaatccaatttaaaataacctttccttttaaatgtgctgcaacgtttttaaaaatgcagcagcataggagtgaacaacagcaacacaaaacgggcattggtttcttaggagtggcttgcttacgttttcttcttttttcttcaccaaaaccaacatgaaagtaccactgaagtaaaacaccaactacctaccttactataaaggaaatgttaaaatttttttcacaataattttttcaattttcactattactgttgtaattattgattgtgattaaaatatttgctcccaggagaactcctgaccagtgggcatgtattcctattttatcctaagattttaatgagcaaaaaggggagagaatttgcaataacttcacaattaccttttctagtgcagttatattagaatgcatatgtttttaaaatgctagtataactagatagtatataatgtacagtataaagaggaatattgtgcttttgaaaagagtatactttttacttttatttatgtactagtagatgtaaaatttcacattgaaggtttatatatattggccaactcatatagaaattttatttataggaagctactactaaaaaaagtcactaactttgtgtacctataatccctaaattaaaattaaattttaattggctggctgtaatttgcattgagagaccttttactagtagctagtgttaggaagtgaacctaaaataagaaaatataatgatctgtgtttatcattagccttgtacaaatgtaaattactaatagtgatgttcttttgcaaggcatagaacatttgtatgaaaagacatttagtatgctttgaaaaaaactcagcttttagtttttttccattagaatactgcaaaacccatatatctttttaaaaaatttatgtactcacagtctttcccttgaagagaagattgaaaaagtctactgttcataaaccatgctaacattttccttttagctagttttgaaagtaaggaacaatacctgggaaataattaaacagaaggttaccattgtcagccagttggctatactgtggttagttctttcagaaattgtaaatatcttgtagcatattctgaaataatagagtaagttcttctcagagatgttaatatcatgtttttcatgttctaattagaatactttattacttacaaactcagaaatacgaacagaaatacagcagacgaacatatttattggtactgaaaagagacgtagtaaattaaatagaagaaatatatttataaagcttagtgaaacacaaaattagaatgttcatgtcaggcacaagggtttggattttgtgcaagctaatttggccacatttggcctggtgacagaactgttcataaggaagtaatatatagataaggtaggtagatatcagttgaatgccttatattgtatacattcctttcaaataaagaccttgagaaaacagcagagccaagtgaagatcacctaaagaactttgtggctaatttatacttcatgtagtagcagtgggtactgggcagggtctctttcccactctgatgatttgtgctcttatttttcctagatttacctcatctagggcatattcttttccctcttcctctttacctttcctggtcctgatccctctgtactcagttcccctaaattattggactacaaactaatatactagaaaagcatacacttattttatttgaatgcagaaatgctatctatcagtatatatacataagaatgtatattacagtatatctatatatacttaacactgtaactttcagtattccccagttagcgtacctaactctcctgtgggttttgttaattcttattagactactagagaaaaaccaactggcagtttgctaagcatatctactggtgttgtttctgcgccctcttttggctaattgatgtaattatactggctctaaagatttactgccccataagtaaatagtatagccacattctgaacatatcaaaagtacaaacttaggaggagtgtatgtacaaaaatgtaaaattttatgaaaatgaacatgtttttatgatgttatttctagttcataagaatgtgatgactgctttgcttcatttatgtacgttcccattatattcttgctgtcaatcaatcacaaatttatatcagattaggataaactaagccattttatgtattttattttaaaccttattttggcagagtaattccttagaattggaaaagctgttactttgaaattaccaatttattacaaaacatagaaatgtattgtagctacaaagacaaccaagcattttctgtgttttaatgaatatctaaaaaactacatttagtttattttactcagttttgaaatgatttttttactggctctattgccttaaaataactaagagattaatgattctttgtataattttccttttctttgttcttttttttacatttcgcagagttatatctatagttttagtaacaatttcttatgtattctggataactgaaaacaactaaaggtgttgggcattagaaaataattgtgagcagtaagattactgatgtaatatgtatgttggactgaagtatttctttataaacattctatttgattttaagcaaaatgtatgttaaagcatgtttttacatcagtaaagtcatttgtcgaccttctggaaatgaaaggtttttacctagatactgtaagttacacctccttaacaatcatatttgtcattgttgttttctgcaaacaaaaatgtttatgggcttcatgtaggcttaagattgtaggcaaaaatggactgagttcaggacccttcaagcagtaggcattcagttacagagcagttggtactttgtaacccagacttacagtttaaaaatatcaagttagctgatgtttcattataataaaaatactattttgcttaagagttgtattacaaatatttgtgcttaacattagaaatagctgttttaaattgtagttaacatattaactttttcagaaaaaaagcatggtttatttttaataatgaaatagagaacataatacgtaatgttcagtataacagctgagttaaaacatctgccaggattaacatcagtgcgtttttgccaatgcatagaggcatttttctctaagtatgatggctaatgataactattctttgttacacattcaagtcactcccatacaagtaactagtgggtgatatgtttcactccaaagggtgtattaattctgaatgctaatcatgaagacttaagttaggacaacacttcaaaccaggaagtgtgaactgatttagattatagctacacaattttctgtgtgttagatcatggggtagtttgagtgttttcacatgtattgctataaaatcacaatgtaccaagctctggtttaatatgccattaatactaattaatagagctgctagtctctctctggacttttctctagtctctgcttctcttgcgcttcctgtatcaatagattacttagctcaagtttaccaagtttaataacctatagttactttattgaataagtttctgacatgacctctaatatacatagatatatctagaatttatttgataaaattcacacatacaaacattgagtagtttgctaatagatacaaatattagattttcacacaactctactactgctttaaaaatataagtattggtaagtgtagcaaataagccatgtacatttaatgtgttctacttgctagtattaactgtatgattaatgaatgtgttatttaatgcccaagtttgttaacttttattctagaaatcatcctctgaatttattataaatcacagatttcattgtgctctatatttagtcattctcagttgaattctagaatattccacagtacagtataagaaagtattagaaccaacttgcttgaactattttgaaccagtgttgtaattctatatgttaatcagtatttagcatttctgctccttttgagatgatgatggtttaacttcaggaaagtgacttttctgacttcttttattatcattgtgcaatttttagcaacaaaactcactatatctttgtcagttcttcagatgttacaatactgcctgctaatttgaaacagaaataacaatggtattttaaaaagtcattgatattactgatactttccattatcattatattttttactattattatgttctttttgccttgtccaccctagagaataggtacaaatgagtagtgagtatccacaaacttactaagatggagagaaggctagatggtgcatgaataatcagcatctcagcaacagagttgactggagccagtttctgacatcagagaatctctttgctgtaatcattttagccttatctcttatttataccatttttatgggaagagttgttagtgcatataagcatttagtttgaattatttaacttaaagaatttatattgcggtttctcttcagttggtcagatgccttttataaatattttagttttaaatataattgtgtagagtatgatcatgtgaagtgttaaaaataatgtggaaaactcagctatttaatgcagaggagaaatgaataggttgaccaaagtttgaaaaaactggcaccttttctggaaatctcttattgcaaagaaaagatactgagtgtatagaaaattttgtcaccagaggaaaaataaacaatatataagggtggctttcactttaacatttgggatattttggagttcttgatacctcgaaggtctccatttctattggtattttgaatatctgtaacatgtaatgtcgttcttataacagttcaacactgatttttttggtatcgatagctttatatataaacaaagatgcggacaaaatagcttaacagaagttgtgggcttttttgtggctttgcctgcctgtttgaccaaatacagggtttaattgtttgcaggctgttaactaaagggaaagcttacctgcgtattgcaagctatatattcttgccagtatacattggatgatattttaacctactggtgcctgaagttcgtgttttataacctcaacaactataaaacatcctggtgctattcactttagcattgagtgacatttttaattcctgtaccaaagagttaattttctttttggttgactgagttttcttctcacatcgttgtgtatttataaagtagaatttaatgttactaagaacagtttgattaacagatcttattttttgcatgctgctctggcaatttaatggattttaaatgtttctcatttggatttttttttaggtaggcatgtatggattttaattttgtattttaatatagcttggctactttaaaaggtagtttgataggctgaaattacaaaagataattgaagcacttttcacaagttgttttatttctgcaacaatgaataaaaaggtaagaactctaatttatataaatgaactatatagcttattgggcactttagtgaatactgaaacaaaatactaagatgaagagttaaggttcgttctcattacaaatcgagttcagcgtgtgtgtgtgtgtgtgtgtgtgtgtgtgtgtgtgtgtaatctttagtggctttaaagaataatattgccatttgtctactttgcaaataaagataacagaacacctttaaaatatatgtatgtgtacatatgtgtgtgtagatatatagagagagagatacggagagacagacagacagagagagagacagagagagagatgctttcccaagaggaaatgcatatgtaccttgatttaagcaaaactgataacagaaaattgaacttaatgaaagaaaaaagtctggatatggttactcactttacatagagtaagatttttaaaactaattttgcttagtagttaattttacaaaaatgaagagaaacaccctttaagtgtactcgtaatttaaaacacctttgaaatgtaattgtccaaatgtaatgctgctatgtatattatttgggttccagatttttccctttaaaattctcaaaacactcagtgtccttacaactgcagctaaaatggttaatcattctggcaagaaggtgacagtgtgtatattggaaaggcagacattcacatttgaaaatattttgcattattgttagctaaaatcaacctctccttgaatgtagatacaatatatggttttgcagtcaattctgaatggaaaaaaagaatcaagtctgaaatttatgtgaaatgtggcttcagatcatttgaacgatatgtagaaatctagatgaacatatcattagaggtgaaagcaaaatttgaaagcctaatgagatgaagcaacattatctctctctaatctgccaacaatattccctagattgtgttgccactgtattgattctgagtaatttggcttgtttatgcgtgatttaaatgcatgtggctgaatgcagtaatttttcaagttattgagtagtagagaattcaccactattcactgtctcccagagatgaacatataaaagaaaaaaaattctacttcatatatgtaagaataaagcaactaaatgatacaaaagtaaaaacttccaccagaatcagagatattccgacaagtgaattgtgagtctaacacgggaggacaaagctaggctcttgcaaggacagagcacacgtggatcatgctgtatgagctcactttgtgtccctggaattagtgtttttttgtgtgtgatctaactggcaagtttaatgaatagccaaaatctatgttattcttgaggctcctaaaattatgtgtgaaccccaagttctgtctagtattatatccctaaaatgcttttaatagtggtatgttacaagtggcataagaagatcctgtttttaaatttgtcaggcattttattattcagtacataatatgtatagatctgagtgctgttttccttgcattgtctattatttttaccttgtctttcccctaagagaatttgaagaaaatcttcaccaatatttctagtgttgatggtaattaggaaaatagtagttgagagatgtaagaatagtttgagaagagtgagtaaaatgggtgaaatgacaagtgggaaccatgtagctgagatgtatttgtttagatgaaaagtctacactggttcttaatgtgaaaatcaaaccatgtatctaccttaagaacaatgttgttgtttttaatttattgtagcgatttagtttttttcacgtaatatttctattttctttgcagattgtttttaatttaaattgtggaatttttacttctcaaaatgtattaagtactgtattttttgaaatcttatttttaaataaatattttttaaaaacgta

SEQ ID NO: 204449 - DNA, 3408 bp, Homo sapiens
  Payload ID: 20328
  Gene Name: zinc finger, DHHC-type containing 22
  Uniprot ID: Q8N966
  ENST ID: ENST00000319374
  CDS Start-End: 204-995
ccttactcgctggcgcccaagtgggaagccagcagctgcccgctccctcctccccacatccccgctacttgcccagttcccgaagcgaagcgcaggctgcgagccagccgggccgagtccacaactttgcagcctcgggcagggcgagagccggcgtccggggctcctcttgtcggcgaccagagctcggaatgtaatcgaggatgctggccctgcggctgctcaacgtggtggcccccgcctacttcttgtgcatctccctggtgaccttcgtgctgcagctcttcctcttcctgcccagcatgcgcgaggaccccgcggccgcccggctcttctcgcccgccctgctccacggggcgctcttcctattcctctcggccaacgccctgggcaattacgtccttgtcatccagaactccccagacgacctgggggcctgccagggggcctcggccaggaagactccatgcccctcacctagcacccacttctgccgagtgtgcgccagagtcaccctgaggcacgaccatcactgtttcttcaccggcaactgcatcggcagcaggaacatgcgcaacttcgtcctgttctgcctctacacctccctggcctgcctctactccatggtggccggcgtggcctacatctccgctgtcctttccatctccttcgcccaccccttggccttcctcacgctcctgcccacctccatcagccagttcttctccggagctgtcctgggttctgaaatgttcgtcatcctcatgctctacctctggttcgccatcggcctggcctgcgccggcttctgctgccaccagctgctgttgatcctccgcgggcagacccgccaccaggtgcggaagggggtggcagtgagggcccggccctggcgcaagaacttacaagaggtcttcggaaagaggtggctgctgggcctgctggtccccatgttcaatgtcggaagtgagagctccaagcagcaggataagtagtagacactcccgtcatttatctctctgtctctgtcttgactcctcctgagcataaaaccatggcagccttgtctccacccatgactcactacaaccttgtgctggtaaggtcctagcatcttcccctcaccttccacccatgagaacagcgtgagctggtggatcatgacaaggaggaaaaatgtccccccaggcatttctaggctcctcacgagccagccaggtggctgctagctgttaggctgcctctgctttctttccgtccccttgggatccctgctttccccctcttcctggctcatccattctccaccgtgtctcattcatcactgctgtctgctagagcccttcctctcagcccccatgttgggagaggggagtggattcttgctgctggtatgagactccctgggacctagaggctggcaaatgtttaaaatcaccacgtgtaagaggcagccaagtcagctctgccaactgctaggggagttgggaaagagtgggtgtgtgtccgcatcccctctgtaggaaaaagaacttagtagcttgctgctccctcaccaccccccaccaggttcaagaccctttttctgggagacagcaatcaatggcctgctttttccaaatgttattccctgtccaccctgccccatctggccggcccagcccagtccaggacctggctggatgcttcctgtccctggaactcttccagcctttctacttgatctccagcccccaggtctttgccagatgatgggaaggcaaggaagaagggacagggaaagataattactgataaatgaaggggatattcgactgtataaccatatggaagtgtgtgtgtgtgtgtgtgtgtgtgtgtgagagagagagagagagagatgggtggtggtgagaagtgttgttagaaacatataggaataatgcctaggggaaagggagaagtgagagggacaattgggttcatttatgccctatacaaagggcattccagcagctgaaactcttcaatgtttgaatggctgcctgtgaaggtagtgagtgccccatcactggaggtattccagcagagtctaggcagtcgtctgccaggcatgctgtggaagggatttctgtacagggtcattctaggtgagcttacacattccttccaaccccaaggttctgatgtcctggttgtgattgctggacccagaggcaagatctgcagagatgcctgtgagatatttgctttcctagaggggagtgtgggcatgggaggggtctgaaaatcaggacccaacccagccactgaagagagagtctctgcagagacagggctacctgggtggttgaggggactgacatttgaggacagggagatggagcagtgtcattgtcagtggcagggcatggggggcagtggtgagctaaggctgaggagtggagatgaccagaatataagggtgcaattcccagaccatccctgcgcatctgactgactccggtggaggcactgctgtgtgttttctgaaacctagaggaccagacctctggggcatataagggagtagggacaacacaagtgccccctcctgactgggtcccaaagccaatatgacatccatgcaggcagcagtgctgaatccatgccctgcaatgtccaaccgccaactgcagtgacccgctgatagctgcgcaacagcctgggttcttgagcagagattgggaggactttactgtggttctgccttcacaccccctagagagctaatgtagtattggctccacctgctcacatttctccctcccatactcattccttcactcatccatcctacgtatatttattgagtgccaactacgttcccagcctcttccaggcactggcaatgcagtgatgaacaggatgacaagattcatgccatcaggggcaccttgtcactgccgtctgtgcactgattcacactccctgcaaaatggtcactctgccatcttggtggttggtggggcaggtcatttggaaataaagaatgtgatagagatggctgaagaggggaagcctaggctgcctcaatggaggagtcgctgggggcattttcacccacaattctggccatacttaagcaatgggagggagagggaggaggggaagatctgggcaattttggccttgactctttcctggctccagagctcaagcttagaagccagccctgctatttccagcctcctgaaggctcagcacggtgaggcctgacatcctggggaagggcaacagggagacctacaggatgttggctgcttgcagactggtcaatgggggatgacggtggggaggttgccagatgtgagacttgagtagcatttgtacacatggccctgtattgtccttgaagaacatcaataaaatatatggttttaaattgga

SEQ ID NO: 204450 - DNA, 388 bp, Homo sapiens
  Payload ID: 20328
  Gene Name: zinc finger, DHHC-type containing 22
  ENST ID: ENST00000555327
  CDS Start-End: 267-388
ggggtgaggctcaaagaagaagctccaagttcaagctctgtgtctggataaactcccattgtctttccttctctcaaatcagagctgcccgtgggtcccagggtgatgctgggctgtgtagaggctgagtgcaggagcattaatgctagaaccagatgaggaaactggaatctaagatcacactggaatttacagacgaagaaactggaatctgagatctcacagtagtgaatggtgaatattcaaacccaggaatgtaatcgaggatgctggccctgcggctgctcaacgtggtggcccccgcctacttcttgtgcatctccctggtgaccttcgtgctgcagctcttcctcttcctgcccagcatgcgcgaggaccccgcggccgc

SEQ ID NO: 204451 - DNA, 545 bp, Homo sapiens
  Payload ID: 20328
  Gene Name: zinc finger, DHHC-type containing 22
  ENST ID: ENST00000555389
  CDS Start-End: 217-545
actcgtgcgcccagggcgggcttgtcggcatggaaaggatttcggcgccatgagggttgtttgggtttctctcagcaggagggcgggaggcgggcgcgaaggggggattttaatttcgcctcaaatgaaaacgctcttcgcaaagaaatagcccgggcagccagcgttggagagatgtgctggccaggacccgctgacacaggaatgtaatcgaggatgctggccctgcggctgctcaacgtggtggcccccgcctacttcttgtgcatctccctggtgaccttcgtgctgcagctcttcctcttcctgcccagcatgcgcgaggaccccgcggccgcccggctcttctcgcccgccctgctccacggggcgctcttcctattcctctcggccaacgccctgggcaattacgtccttgtcatccagaactccccagacgacctgggggcctgccagggggcctcggccaggaagactccatgcccctcacctagcacccacttctgccgagtgtgcgccagagtcaccctgaggcacgaccatca

SEQ ID NO: 204452 - DNA, 3778 bp, Homo sapiens
  Payload ID: 20329
  Gene Name: zinc finger, DHHC-type containing 23
  Uniprot ID: Q8IYP9
  ENST ID: ENST00000330212
  CDS Start-End: 300-1529
ggggcacccggaagcgcgcgtggacctggcgcaccgagccgggcgggcggaggggcggttgggacggcgcggggaggcgggcgcgccgcccgggccgcggcgggctgtggtcacaggtgggcggctgcggcgagggagcggccgagcggagcccgggtcccggagactcctgccgtcacgcccggggctccgcgtagcagagatcgggagacgcgtctgtgcctccggggaagccgacccatctcccctccgcctctttggctgcagttgcacctccggccagagggcaggtgcaaatcatgacacagaagggcagtatgaagcctgtgaagaaaaagaaaaccgaagaacctgaattggagcccctgtgctgctgcgagtacatagatcggaatggggaaaagaaccacgtggctacttgtttgtgtgattgtcaagatctggatgaagggtgtgatcgatggattacatgtaaatctttacagccagagacttgtgaaagaatcatggatacaatttctgatcgcctccgaattccttggcttaggggagccaaaaaagtgaacatcagcatcatccctccgcttgtcctgctgcctgtcttccttcatgtggcttcctggcatttcctcctgggggtggtggttttgacctcccttcctgtgctggcactgtggtactactacctcactcacagaaggaaagaacagaccctgtttttcctgagccttggactgttctctctgggctacatgtactatgtgttcctgcaggaagtggtccccaaagggcgtgtgggtcccgttcagctggcggttcttacctgcgggttatttctgatactcttagccttgcacagagccaagaagaatccaggctacctcagcaatccagcaagcggtgacagatctctaagcagcagccagctggagtgcctgagcagaaaagggcaggagaagaccaaagggttccctggggcagacatgtcgggcagtctcaacaatcgcacaacaaaggatgaccccaagggctcttccaagatgccagctggaagccccaccaaagcgaaggaggactggtgtgccaagtgccagctggtgcgaccagcccgggcatggcactgccggatatgtggcatctgtgtgaggagaatggatcatcattgtgtctggataaatagctgcgttggagaatcaaatcatcaagcatttatacttgcccttttgatcttcttgctcacctcggtgtatgggatcacactgaccttggacaccatttgtagagacagaagtgtcttcacagctcttttctattgtcctggagtttatgcaaattacagctcggctctgtccttcacctgcgtgtggtactctgtgatcatcacagcaggcatggcctacatcttcctgatccagctgatcaacatcagctacaatgtgactgagcgggaagtccagcaggccctccgacagaagactgggcgccggctcctctgcgggctcatcgtggacacagggttacttggatgagccaactccgcttccttcccatggataggaagggactctgtgtattattcaggtttattggcacgaagatacttgttttaagttccttgagaacccatgatggacagttgacagaatgcttaaacctgtcaaaagatgagtgatcttgtgtgggaaaagccttcccaggcgtctgtaccgaaaggagcagcaaacaaggggctaatccatgagcagtgttctgtaggctctgtgacatctttggtttataggattttggagccttttatgatctggaactatttgaggggtttcattataggccttggttctctccaggggccagatgagtttattgtggaatctttgaaaggacaaggcctctgtgaatgaatcagtcccagggaagcatttggtggtggcggcagtggaggattgcccggtgaacctataaatcagcagtctcttgggcagaggagcaagcccctcgaacatgatttcaaacaagcaggtcctcttctctcatctcacgtccttagtctctgttaatgaacatactggatgtggagtttaataaattacctactatcatctggccacttagattattatcacaccactgtggactgttcctggggggagaagaacagaccgatttgaaagattcaagggagaaagattaaggatcaggattgcatgaaagaagaaaatccttcaatatttaaaatgtttcttacaatacccacggagcacttttatggttccagccgagcgttcctgaaatgaactgaccattaacagcgcctctttgataggttaccctgatgctgctaaagtaaagccttaagtgtgtttttgggacaacgtgctgcttattccacctcagccacatatgtgtttgtgtttaggatattgtaaatctttgctaagtagtgttttccttggtgaatgaagtcattgttgtcttcaagtgtaccatctgcctagcaaaaaattgctacaaactttctcttatgcaatagtccttggtacttctaatatttttagcaagagacaattttctgtactagaatcttccactgccagaaaacacagtgccagtaaggttctacataccactgaccatctgcttaatagacatgtatttcctttgagtaggacattagcttttgattataaagctcaactagtataagcaaaaatataacatctagaagcacagttttagccaggatgtttaaaaattacagttttgtgagacttaagggtctttttaacctaggtaagtttatatgacctaacttaattgtagccatattctggtaccttccattttgaaaagtagaggttgcttaagcaagcaatggataataagagacttttcctgaggcacctgtttggaatctggttttctcagcggcagcttgacatgtgcacccttttgtattaaacactgcaagggtgatgcaggggagcaggaaagccatcctaaactcactactgagtacgattcagtatgttcctgtggatgtctgctgtgactaatataaatttcttgcagaatcagctacacttaattatgttgctgatagacaagcatccacgcttcagctggcactaagtgttttcattgtaggatcagcagcaggttaaagactgaacggttagtgaagacaaatgtcttaagaggctgcgatgtctaggttgggcttgtgacttcttagtggcctagccttcttgatggcaccttgaaagtgaacttctagaaatctacatttaaaaggcaaagctttaaaagcagagctagtctattctagttactgatgcaactaaaattctgtatttcttaagatggagccactgacgagatgtcacagtatagagcctgcagtctcaactcattgtgatcctaatggtctgggtgattggatggtttgagttgttagggattttgagtttttcattttattgcatatctgggttggatgttagactaaaggaaacccaggaatatttacctggtgttacatttaatatttaatgtaactggtctagcaacattaagggggatttctgaagccaactccggaggctgtgggctgcacattttgcactgtttttatatacttgtattcatatcctcttatcacctcagactcagacacaaggccttttacatggaaattttacaaattacttccatttatgtaaaataacgtcctgtgaccaagttgtttaaatggaaaataaagtgctttctttaaggaaaa

SEQ ID NO: 204453 - DNA, 317 bp, Homo sapiens
  Payload ID: 20329
  Gene Name: zinc finger, DHHC-type containing 23
  ENST ID: ENST00000496083
  CDS Start-End: 1-228
tacaatgtgactgagcgggaagtccagcaggccctccgacagaagactgggcgccggctcctctgcgggctcatcgtggacacagacttgtcttactcaaggaccaagtatctgattgctgatatagctcgtggtaccttccaggtacctggaagtctggaagaatttcaactaccttcctacgaagttgctgtcgcctttcttcttttactctttcctctttcataaattttacaaacttcttccatgtccgaagggtgatccagaggatcctcctttaagaataaagaaggaaaaaagtgaaatgttgagaaaaa

SEQ ID NO: 204454 - DNA, 2055 bp, Homo sapiens
  Payload ID: 20329
  Gene Name: zinc finger, DHHC-type containing 23
  ENST ID: ENST00000498275
  CDS Start-End: 263-1474
aggcgggcgcgccgcccgggccgcggcgggctgtggtcacaggtgggcggctgcggcgagggagcggccgagcggagcccgggtcccggagactcctgccgtcacgcccggggctccgcgtagcagagatcgggagacgcgtctgtgcctccggggaagccgacccatctcccctccgcctctttggctgcagttgcacctccggccagagggcgttggaggttaagcagagagagagaggcgtggacctatttacgagattatgaagcctgtgaagaaaaagaaaaccgaagaacctgaattggagcccctgtgctgctgcgagtacatagatcggaatggggaaaagaaccacgtggctacttgtttgtgtgattgtcaagatctggatgaagggtgtgatcgatggattacatgtaaatctttacagccagagacttgtgaaagaatcatggatacaatttctgatcgcctccgaattccttggcttaggggagccaaaaaagtgaacatcagcatcatccctccgcttgtcctgctgcctgtcttccttcatgtggcttcctggcatttcctcctgggggtggtggttttgacctcccttcctgtgctggcactgtggtactactacctcactcacagaaggaaagaacagaccctgtttttcctgagccttggactgttctctctgggctacatgtactatgtgttcctgcaggaagtggtccccaaagggcgtgtgggtcccgttcagctggcggttcttacctgcgggttatttctgatactcttagccttgcacagagccaagaagaatccaggctacctcagcaatccagcaagcggtgacagatctctaagcagcagccagctggagtgcctgagcagaaaagggcaggagaagaccaaagggttccctggggcagacatgtcgggcagtctcaacaatcgcacaacaaaggatgaccccaagggctcttccaagatgccagctggaagccccaccaaagcgaaggaggactggtgtgccaagtgccagctggtgcgaccagcccgggcatggcactgccggatatgtggcatctgtgtgaggagaatggatcatcattgtgtctggataaatagctgcgttggagaatcaaatcatcaagcatttatacttgcccttttgatcttcttgctcacctcggtgtatgggatcacactgaccttggacaccatttgtagagacagaagtgtcttcacagctcttttctattgtcctggagtttatgcaaattacagctcggctctgtccttcacctgcgtgtggtactctgtgatcatcacagcaggcatggcctacatcttcctgatccagctgatcaacatcagctacaatgtgactgagcgggaagtccagcaggccctccgacagaagactgggcgccggctcctctgcgggctcatcgtggacacagggttacttggatgagccaactccgcttccttcccatggataggaagggactctgtgtattattcaggtttattggcacgaagatacttgttttaagttccttgagaacccatgatggacagttgacagaatgcttaaacctgtcaaaagatgagtgatcttgtgtgggaaaagccttcccaggcgtctgtaccgaaaggagcagcaaacaaggggctaatccatgagcagtgttctgtaggctctgtgacatctttggtttataggattttggagccttttatgatctggaactatttgaggggtttcattataggccttggttctctccaggggccagatgagtttattgtggaatctttgaaaggacaaggcctctgtgaatgaatcagtcccagggaagcatttggtggtggcggcagtggaggattgcccggtgaacctataaatcagcagtctcttgggcagaggagcaagcccctcgaacatgatttcaaacaagcaggtcctcttctctcatctcacgtccttagtctctgttaatgaacatactggatgtggagtttaataaattacctactatcatctggccactt

SEQ ID NO: 204455 - DNA, 3466 bp, Homo sapiens
  Payload ID: 20329
  Gene Name: zinc finger, DHHC-type containing 23
  ENST ID: ENST00000478793
  CDS Start-End: 244-1482
gactcctgccgtcacgcccggggctccgcgtagcagagatcgggagacgcgtctgtgcctccggggaagccgacccatctcccctccgcctctttggctgcagttgcacctccggccagagggcaggcgttggaggttaagcagagagagagaggcgtggacctatttacgagatgtaagttgtgttctttccacctttaccttctgagggcttcttacgcctcatggtgacaggtgcaaatcatgacacagaagggcagtatgaagcctgtgaagaaaaagaaaaccgaagaacctgaattggagcccctgtgctgctgcgagtacatagatcggaatggggaaaagaaccacgtggctacttgtttgtgtgattgtcaagatctggatgaagggtgtgatcgatggattacatgtaaatctttacagccagagacttgtgaaagaatcatggatacaatttctgatcgcctccgaattccttggcttaggggagccaaaaaagtgaacatcagcatcatccctccgcttgtcctgctgcctgtcttccttcatgtggcttcctggcatttcctcctgggggtggtggttttgacctcccttcctgtgctggcactgtggtactactacctcactcacagaaggaaagaacagaccctgtttttcctgagccttggactgttctctctgggctacatgtactatgtgttcctgcaggaagtggtccccaaagggcgtgtgggtcccgttcagctggcggttcttacctgcgggttatttctgatactcttagccttgcacagagccaagaagaatccaggctacctcagcaatccagcaagcggtgacagatctctaagcagcagccagctggagtgcctgagcagaaaagggcaggagaagaccaaagggttccctggggcagacatgtcgggcagtctcaacaatcgcacaacaaaggatgaccccaagggctcttccaagatgccagctggaagccccaccaaagcgaaggaggactggtgtgccaagtgccagctggtgcgaccagcccgggcatggcactgccggatatgtggcatctgtgtgaggagaatggatcatcattgtgtctggataaatagctgcgttggagaatcaaatcatcaagcatttatacttgcccttttgatcttcttgctcacctcggtgtatgggatcacactgaccttggacaccatttgtagagacagaagtgtcttcacagctcttttctattgtcctggagtttatgcaaattacagctcggctctgtccttcacctgcgtgtggtactctgtgatcatcacagcaggcatggcctacatcttcctgatccagctgatcaacatcagctacaatgtgactgagcgggaagtccagcaggccctccgacagaagactgggcgccggctcctctgcgggctcatcgtggacacaggtaaggtgctagcacacttgtgactgtggctggaagaggagaacagacactcctgtggggatgctttactctcttttctggggccagatgagtttattgtggaatctttgaaaggacaaggcctctgtgaatgaatcagtcccagggaagcatttggtggtggcggcagtggaggattgcccggtgaacctataaatcagcagtctcttgggcagaggagcaagcccctcgaacatgatttcaaacaagcaggtcctcttctctcatctcacgtccttagtctctgttaatgaacatactggatgtggagtttaataaattacctactatcatctggccacttagattattatcacaccactgtggactgttcctggggggagaagaacagaccgatttgaaagattcaagggagaaagattaaggatcaggattgcatgaaagaagaaaatccttcaatatttaaaatgtttcttacaatacccacggagcacttttatggttccagccgagcgttcctgaaatgaactgaccattaacagcgcctctttgataggttaccctgatgctgctaaagtaaagccttaagtgtgtttttgggacaacgtgctgcttattccacctcagccacatatgtgtttgtgtttaggatattgtaaatctttgctaagtagtgttttccttggtgaatgaagtcattgttgtcttcaagtgtaccatctgcctagcaaaaaattgctacaaactttctcttatgcaatagtccttggtacttctaatatttttagcaagagacaattttctgtactagaatcttccactgccagaaaacacagtgccagtaaggttctacataccactgaccatctgcttaatagacatgtatttcctttgagtaggacattagcttttgattataaagctcaactagtataagcaaaaatataacatctagaagcacagttttagccaggatgtttaaaaattacagttttgtgagacttaagggtctttttaacctaggtaagtttatatgacctaacttaattgtagccatattctggtaccttccattttgaaaagtagaggttgcttaagcaagcaatggataataagagacttttcctgaggcacctgtttggaatctggttttctcagcggcagcttgacatgtgcacccttttgtattaaacactgcaagggtgatgcaggggagcaggaaagccatcctaaactcactactgagtacgattcagtatgttcctgtggatgtctgctgtgactaatataaatttcttgcagaatcagctacacttaattatgttgctgatagacaagcatccacgcttcagctggcactaagtgttttcattgtaggatcagcagcaggttaaagactgaacggttagtgaagacaaatgtcttaagaggctgcgatgtctaggttgggcttgtgacttcttagtggcctagccttcttgatggcaccttgaaagtgaacttctagaaatctacatttaaaaggcaaagctttaaaagcagagctagtctattctagttactgatgcaactaaaattctgtatttcttaagatggagccactgacgagatgtcacagtatagagcctgcagtctcaactcattgtgatcctaatggtctgggtgattggatggtttgagttgttagggattttgagtttttcattttattgcatatctgggttggatgttagactaaaggaaacccaggaatatttacctggtgttacatttaatatttaatgtaactggtctagcaacattaagggggatttctgaagccaactccggaggctgtgggctgcacattttgcactgtttttatatacttgtattcatatcctcttatcacctcagactcagacacaaggccttttacatggaaattttacaaattacttccatttatgtaaaataacgtcctgtgaccaagttgtttaaatggaaaataaagtgctttctttaagg

SEQ ID NO: 204456 - DNA, 740 bp, Homo sapiens
  Payload ID: 20329
  Gene Name: zinc finger, DHHC-type containing 23
  ENST ID: ENST00000491556
  CDS Start-End: 297-740
ggctgtcgccataggaacggctggtgcccagacggcgcctgcccaggctgggaaggggcggtgaaggcagctcagacctccaagaaccctggagccccctgtgtggccaggcggagccacagaagcctgatgaaaacgggaccccctccccctctctcttctcatttttgattgctcaggcgttggaggttaagcagagagagagaggcgtggacctatttacgagatgtaagttgtgttctttccacctttaccttctgagggcttcttacgcctcatggtgacaggtgcaaatcatgacacagaagggcagtatgaagcctgtgaagaaaaagaaaaccgaagaacctgaattggagcccctgtgctgctgcgagtacatagatcggaatggggaaaagaaccacgtggctacttgtttgtgtgattgtcaagatctggatgaagggtgtgatcgatggattacatgtaaatctttacagccagagacttgtgaaagaatcatggatacaatttctgatcgcctccgaattccttggcttaggggagccaaaaaagtgaacatcagcatcatccctccgcttgtcctgctgcctgtcttccttcatgtggcttcctggcatttcctcctgggggtggtggttttgacctcccttcctgtgctggcactgtggtactactacctcactcacagaaggaaagaacagaccctgtttttcctgagccttggactgttctct

SEQ ID NO: 204457 - DNA, 4721 bp, Homo sapiens
  Payload ID: 20330
  Gene Name: zinc finger, DHHC-type containing 24
  Uniprot ID: Q6UX98
  ENST ID: ENST00000310442
  CDS Start-End: 236-1090
aatcactccgcggcgttatccgggctccagcgccgcgggattccgagcgcctccactgctggtccgttggccagatcaactcgccgcgtgggccggccgttccctgagagtctgagcgctcgccgcacccccttccgagcttctattggccgtagcagacgtccgtctgccgctatctccgccccaatacggaagcggcctagtcctccggctccgacagctgggtgtccaggccatggggcagccctgggcggctgggagcacggacggggcgcccgcgcagctgcctctcgtgctcaccgcgctgtgggccgcggccgtgggcctggagctggcttacgtgctggtgctcggtcccgggccgccgccgctgggacccctggcccgggccttgcagctggcgctggccgccttccagctgctcaacctgctgggcaacgtggggctcttcctgcgctcggatcccagcatccgtggcgtgatgctggccggccgcggtctgggccagggctgggcttactgctaccaatgccaaagccaggtgccgccacgcagcggacactgctctgcctgccgcgtctgcatcctgcgtcgggaccaccactgccgcctgctgggccgctgcgtgggcttcggcaactaccggcccttcctgtgcctgctgcttcatgccgccggcgtcctgctccacgtctctgtgctgctgggccctgcactgtcggccctgctgcgagcccacacgcccctccacatggctgccctcctcctgcttccctggctcatgttgctcacaggcagagtgtctctggcacagtttgccttggccttcgtgacggacacgtgcgtggcgggtgcgctgctgtgcggggctgggctgctcttccatgggatgctgctgctgcggggccagaccacatgggagtgggctcggggccagcactcctatgacctgggtccctgccacaacctgcaggcagccctggggccccgctgggccctcgtctggctctggcccttcctggcctccccattgcctggggatgggatcaccttccagaccacagcagatgtgggacacacagcctcctgactccaggaagagccagagctgtgcagggaggaaggggtgagaggggggcccccacacctagactcagtaaggaagtcgggttggaccttaacatctgcattggacaactccaccccttccttggccttgcccctgcccgcctacactcctacgtgtccagggcttgggccgtgacttaggcagaggagtgcagaggagggtctggcaggggctgctcaggccgcctagctgcccctttgccaggttaataaagcactgacttgtttctcagcctccctccatctttgcatagtttctggcccctcactttgttgctggggctgtttctgggaccctctgtagggcctggaaactgcaggatgcctgagggtctcaggggctggggctctacctcccctggcctgggtgagttgggggtggggcaccagcacgccaaggcagtgtcctactgatccaggctatgagaatccaaacattctttcccaggtttggcattttatagttagaagcatttctgcaacagcagtttcatggaacctctcttagctaacctggtccatggggcagcagttacgctctaagaatccatgtggtaagatcatggtgcggcaaatggaggcagggtccaacccaggtctttgtgcttttgcctttacccttgcacagctggaggaaatgagtaggaaagaaatcaaggtaaagaaatgcgctggggctgtttgggcatctgtggagggtggtgctgacagggctaggcctgcacctctctggcctcctcaagagctgcttgttaaatgtttccgtgtaaatagaatgaatagagaccgccatttccacatggcaggcctaaacacatgtgttcgtctcagttttctcttaggatctctctaagatgatagtaaagaaaatcaaaaataatacaaagggaaagaaaacaggagggaagacagtagaacacagagcctgaccacattttcttttttctctctgttgccggggctggagtgcagtggcacgatctcggttcactgtaacctccacctcccgggttcaagtgattcggcctcccgagttgctgggattacagacacccgccactatgcccggctgatttttttttttttcttttttgagacggagttttgctcttgttgctcaggcaggagtgcaatggcgtgatctcggctcactgcaacctccgcctcctgggttcaagcgattctcctgcctcagcctcccgagtagctgggattacaggtgcccgccaccattcctggctaatttttgtatttttagtagagacgggggtttcaccatgttggccaggcaggtctcaaactcgtgaccttgtgatccgcccgccttggcctcccgaagtgctggaattacaggtgtgagccattgcgcctggccatgcccagctaatttttttgtatttttagtatagacagggtttcaccatgttggccaggctgaacttgaattcctggcacctgcctccacctccgtctcccaaagtgctaggattacaggcgtgagctaccgtgcctggctgacaattttttattattttattttattttattttattttattttatttgagacagactcttgttctgttgccaggctggagtgcagtggcacgatctcggctcactgcaagctccgccttctgggttcacgccattctcctgcctcagcctctcaagtagctgggactacaggtgcctgccaccacgccaagctaattttttgtatttttagtagagacgaggtttcaccgtgttagccaggatggtctcgatctcctgaccttgtgatccacctgcctcggcctcccaaagtgctgggattacaggtgtgagccaccactcctggccggccaggatggtcttgatctactgacctcgtgatctgcccgccttggcctcccaaagtgctgggattacaggtgtgagccaccgtgcccggccgcctggctgacattttcaaagatggaaagtggatggagaattaagagctgaaattatgtgttcccaaaaggtggggccaaaaggcaagtggaattacctgccagagccccggaggggctcaggaactccaccaggaccatggagggtgaggtgaggcttcggccaacaatggggaccgatggaaagtctatgtaaggatcagtggggtgccgctcccccacatcccacccacaccccacccacatcatgcagccagcagctacacctctgggtggggtggtgtgacgtgaggattatttgaaggataaatggaaccagagaagcttcgggtcttaggcgtactggggaggggtgggtgagaggctagaccaaaaaatggggttaagtgaaagtccatagatactgctggggggcctcccatgaaagaacatgcttgacccccaagaaccttcagagaaacccaccctctgacaggctctgcccatgcccacaaagatctgagctgcttggctggttgtttttgtaacaggcatgctctgttgctattttttaatgacaggaggaacttggtgtacctggcactttgggctgcacagacgcattagcagactcaccttgtcctgtttcatccctcgccctccacaatttcttattttctttctttctctttttattttttgagacagagtttcactcttgttacccaggctggagtgcaatgatgcgatcttggttcaccgaaacctccgcctcccgggttcaagcgattctcctgctgcagcctctcggtagctgggattacaggcatgtgccaccatgcccggctaattgtttttgtatttttagtagagacggggtttctccatgttggtcaggctggtctggaactcctgacctcaggtgatccacctgcctcggcctcccaaagtgccgggattacaggtatgagccactgcgcccagcccacaatatcttattttcatgtttttttgtgtgttttgttttatttttcgagatggagtctctctgttgcccaagctggagtgcaatggcgcgatcttggctcacttcctgggttcaagcgattctcctgccttagcctcccaagtaactgggattgcaggcacccaccatcatgccctgctaaattttgtacttttgtagagatggagtttcaccatgttggtcaggctggtcttgaactgctgacctcaggtgatctgcccaccttggcctcccaaagtgctgggattacaggtgtgagccaccatgcctggactcgttgttgttgttgtttttaattagtgaggagctacaagaacacatttataaaaattaagaggaaacagccccactgcatttgagaaggttaccatttccttcgaagttcctgctgttgccccttcctggtgggggagacactgtcctgtttcagtcattccgttgctttgctttatagttttattaatgtgtttgtgttggctttgcatgttttcaaatatatgaatgaaatcatgcagagtttattcttttacagtttgccttttcacttgattatgttcctgagatgtatccggattattgtgtgtagctgtatggcattccttttccctgctgcctagtgatccattgaaaatacaataattgatttttcta

SEQ ID NO: 204458 - DNA, 1424 bp, Homo sapiens
  Payload ID: 20330
  Gene Name: zinc finger, DHHC-type containing 24
  ENST ID: ENST00000526986
  CDS Start-End: 233-1018
cactccgcggcgttatccgggctccagcgccgcgggattccgagcgcctccactgctggtccgttggccagatcaactcgccgcgtgggccggccgttccctgagagtctgagcgctcgccgcacccccttccgagcttctattggccgtagcagacgtccgtctgccgctatctccgccccaatacggaagcggcctagtcctccggctccgacagctgggtgtccaggccatggggcagccctgggcggctgggagcacggacggggcgcccgcgcagctgcctctcgtgctcaccgcgctgtgggccgcggccgtgggcctggagctggcttacgtgctggtgctcggtcccgggccgccgccgctgggacccctggcccgggccttgcagctggcgctggccgccttccagctgctcaacctgctgggcaacgtggggctcttcctgcgctcggatcccagcatccgtggcgtgatgctggccggccgcggtctgggccagggctgggcttactgctaccaatgccaaagccaggtgccgccacgcagcggacactgctctgcctgccgcgtctgcatcctgcgtcgggaccaccactgccgcctgctgggccgctgcgtgggcttcggcaactaccggcccttcctgtgcctgctgcttcatgccgccggcgtcctgctccacgtctctgtgctgctgggccctgcactgtcggccctgctgcgagcccacacgcccctccacatggctgccctcctcctgcttccctggctcatgttgctcacagacaatccatgtcctgccacagctctgaccaccacaaagaggagtccttggtgtccacgctcgatattgtgcatgtgtctccagcagcttagtgagcaccctcgcctgcctcctgctcatctccacagggaggtcccatcaacacctcaggctcaatgctgcggaaaccagcctcatgcaccttccagcctgaggaacagtgatttgcaggcaacgtgtacctcctaggctgtccctggatttgcagagccttaaagcccactctcatcttgcaagcctctgaagccaccagttttctgagatgttcctcccggccccggagaccacggatgtggctaccttctcagaatatagatgtttccattgcggcaggccgcggcaagccggaactcaacatcaaactggccagaaacctctaggaagacggggacgctgggaaggctcatctgcaaacaagaagcgcaaacactccaatttctctggagcccccgtccctccctgccctgtcagtaactcctctgagtgagtgcctggtctaaagtcccaatctcctcacttacacccagtttaaactcatacagtttttcaggagggaaacttggggcaacatttagcaaaagccttttagtctgtg

SEQ ID NO: 204459 - DNA, 1615 bp, Homo sapiens
  Payload ID: 20330
  Gene Name: zinc finger, DHHC-type containing 24
  ENST ID: ENST00000534073
  CDS Start-End: 34-642
gtcctccggctccgacagctgggtgtccaggccatggggcagccctgggcggctgggagcacggacggggcgcccgcgcagctgcctctcgtgctcaccgcgctgtgggccgcggccgtgggcctggagctggcttacgtgctggtgctcggtcccgggccgccgccgctgggacccctggcccgggccttgcagctggcgctggccgccttccagctgctcaacctgctgggcaacgtggggctcttcctgcgctcggatcccagcatccgtggcgtgatgctggccggccgcggtctgggccagggctgggcttactgctaccaatgccaaagccaggtgccgccacgcagcggacactgctctgcctgccgcgtctgcatcctgcgtcgggaccaccactgccgcctgctgggccgctgcgtgggcttcggcaactaccggcccttcctgtgcctgctgcttcatgccgccggcgtcctgctccacgtctctgtgctgctgggccctgcactgtcggccctgctgcgagcccacacgcccctccacatggctgccctcctcctgcttccctggctcatgttgctcacagcaccttccagcctgaggaacagtgatttgcaggcaacgtgtacctcctaggctgtccctggatttgcagagatggagtctcgctctgttgtccaggctgaagtgccatggtttgatcttggctcactgcaacctccgcctcccaggctcaagcgattctcctacctcaacctcctgagtagctgggattacagccttaaagcccactctcatcttgcaagcctctgaagccaccagttttctgagatgttcctcccggccccggagaccacggatgtggctaccttctcagaatatagatgtttccattgcggcaggccgcggcaagccggaactcaacatcaaactggccagaaacctctaggaagacggggacgctgggaaggctcatctgcaaacaagaagcgcaaacactccaatttctctggagcccccgtccctccctgccctgtcagtaactcctctgagtgagtgcctggtctaaagtcccaatctcctcacttacacccagtttaaactcatacagtttttcaggagggaaacttggggcaacatttagcaaaagccttttagtctgtgccttttgactaaacgatgccacttctaggactgcatcctaaggatgtacttaaacaaccgtgcagctgggtgtggtggcccacacctgtaatcccaacactttgagaggctgaggcgggtggatcgcttgagctcaggagttcaagaccagcctgtccaacatggcaaaactttgtctctaccaaaagtacaaaacttagctgggcgtggtggtcccacagatgagaagatgaggtgagaggactgtttgagcccaggtggcataggttgcagtaagctgagattgtaccactgcacttcagcctgggcaagagaacaagattgtctcaaaaacaaacaaacaagcatgcaaggatatttgggtaaaaaggtctatagcattggtattaatagcaaaaaatgaaaaacagtttaaatgtacaataggtgacagggtaaataaatt

SEQ ID NO: 204460 - DNA, 3101 bp, Homo sapiens; identical to SEQ ID NO: 163541
  Payload ID: 20331
  Gene Name: zinc finger, DHHC-type containing 3
  Uniprot ID: Q9NYG2
  ENST ID: ENST00000296127
  CDS Start-End: 275-1258

SEQ ID NO: 204461 - DNA, 1336 bp, Homo sapiens; identical to SEQ ID NO: 163544
  Payload ID: 20331
  Gene Name: zinc finger, DHHC-type containing 3
  ENST ID: ENST00000342790
  CDS Start-End: 259-1260

SEQ ID NO: 204462 - DNA, 2687 bp, Homo sapiens; identical to SEQ ID NO: 163547
  Payload ID: 20331
  Gene Name: zinc finger, DHHC-type containing 3
  Uniprot ID: Q9NYG2
  ENST ID: ENST00000424952
  CDS Start-End: 270-1169

SEQ ID NO: 204463 - DNA, 407 bp, Homo sapiens; identical to SEQ ID NO: 163542
  Payload ID: 20331
  Gene Name: zinc finger, DHHC-type containing 3
  ENST ID: ENST00000443879
  CDS Start-End: 1-182

SEQ ID NO: 204464 - DNA, 3226 bp, Homo sapiens; identical to SEQ ID NO: 163546
  Payload ID: 20331
  Gene Name: zinc finger, DHHC-type containing 3
  ENST ID: ENST00000339420
  CDS Start-End: 1-588

SEQ ID NO: 204465 - DNA, 537 bp, Homo sapiens; identical to SEQ ID NO: 163548
  Payload ID: 20331
  Gene Name: zinc finger, DHHC-type containing 3
  ENST ID: ENST00000455235
  CDS Start-End: 404-537

SEQ ID NO: 204466 - DNA, 540 bp, Homo sapiens; identical to SEQ ID NO: 163545
  Payload ID: 20331
  Gene Name: zinc finger, DHHC-type containing 3
  ENST ID: ENST00000419642
  CDS Start-End: 1-335

SEQ ID NO: 204467 - DNA, 472 bp, Homo sapiens; identical to SEQ ID NO: 163543
  Payload ID: 20331
  Gene Name: zinc finger, DHHC-type containing 3
  ENST ID: ENST00000433512
  CDS Start-End: 188-472

SEQ ID NO: 204468 - DNA, 1259 bp, Homo sapiens
  Payload ID: 20332
  Gene Name: zinc finger, DHHC-type containing 4
  Uniprot ID: Q9NPG8
  ENST ID: ENST00000335965
  CDS Start-End: 209-1243
aagtctcgtatcgcgcccgggaggcgccggagcccagcggctggcgccagatccaggctcctggaagaaccatgtccggcagctactggtcatgccaggcacacactgctgcccaagaggagctgctgtttgaattatctgtgaatgttgggaagaggaatgccagagctgccggctgaaaattacccaaccaagagaaatctgcaggatggactttctggtcctcttcttgttctacctggcttcggtgctgatgggtcttgttcttatctgcgtctgctcgaaaacccatagcttgaaaggcctggccaggggaggagcacagatattttcctgtataattccagaatgtcttcagagagccgtgcatggattgcttcattaccttttccatacgagaaaccacaccttcattgtcctgcacctggtcttgcaagggatggtttatactgagtacacctgggaagtatttggctactgtcaggagctggagttgtccttgcattaccttcttctgccctatctgctgctaggtgtaaacctgttttttttcaccctgacttgtggaaccaatcctggcattataacaaaagcaaatgaattattatttcttcatgtttatgaatttgatgaagtgatgtttccaaagaacgtgaggtgctctacttgtgatttaaggaaaccagctcgatccaagcactgcagtgtgtgtaactggtgtgtgcaccgtttcgaccatcactgtgtttgggtgaacaactgcatcggggcctggaacatcaggtacttcctcatctacgtcttgaccttgacggcctcggctgccaccgtcgccattgtgagcaccacttttctggtccacttggtggtgatgtcagatttataccaggagacttacatcgatgaccttggacacctccatgttatggacacggtctttcttattcagtacctgttcctgacttttccacggattgtcttcatgctgggctttgtcgtggttctgagcttcctcctgggtggctacctgttgtttgtcctgtatctggcggccaccaaccagactactaacgagtggtacagaggtgactgggcctggtgccagcgttgtccccttgtggcctggcctccgtcagcagagccccaagtccaccggaacattcactcccatgggcttcggagcaaccttcaagagatctttctacctgcctttccatgtcatgagaggaagaaacaagaatgacaagtgtatgactgcc

SEQ ID NO: 204469 - DNA, 1942 bp, Homo sapiens
  Payload ID: 20332
  Gene Name: zinc finger, DHHC-type containing 4
  Uniprot ID: Q9NPG8
  ENST ID: ENST00000396706
  CDS Start-End: 444-1478
ccgcctccgcggggctgtgggaagcttgggctgtcccaggaccgtcagtctcctcctctgaccctccctttccccttgtgtgtagggccgccgtcccacccccacctcgcccgagtccggggcggccccggtgtcccctccgagcctgctgcactccacgtccccctaccagggctccagcccccagggaaatctccgaccaggcccgcccaggaggtattctgcctttgactgcaactcttgtcgtcttatgtgggtgttgaattgatctgtctctgcagccagatccaggctcctggaagaaccatgtccggcagctactggtcatgccaggcacacactgctgcccaagaggagctgctgtttgaattatctgtgaatgttgggaagaggaatgccagagctgccggctgaaaattacccaaccaagagaaatctgcaggatggactttctggtcctcttcttgttctacctggcttcggtgctgatgggtcttgttcttatctgcgtctgctcgaaaacccatagcttgaaaggcctggccaggggaggagcacagatattttcctgtataattccagaatgtcttcagagagccgtgcatggattgcttcattaccttttccatacgagaaaccacaccttcattgtcctgcacctggtcttgcaagggatggtttatactgagtacacctgggaagtatttggctactgtcaggagctggagttgtccttgcattaccttcttctgccctatctgctgctaggtgtaaacctgttttttttcaccctgacttgtggaaccaatcctggcattataacaaaagcaaatgaattattatttcttcatgtttatgaatttgatgaagtgatgtttccaaagaacgtgaggtgctctacttgtgatttaaggaaaccagctcgatccaagcactgcagtgtgtgtaactggtgtgtgcaccgtttcgaccatcactgtgtttgggtgaacaactgcatcggggcctggaacatcaggtacttcctcatctacgtcttgaccttgacggcctcggctgccaccgtcgccattgtgagcaccacttttctggtccacttggtggtgatgtcagatttataccaggagacttacatcgatgaccttggacacctccatgttatggacacggtctttcttattcagtacctgttcctgacttttccacggattgtcttcatgctgggctttgtcgtggttctgagcttcctcctgggtggctacctgttgtttgtcctgtatctggcggccaccaaccagactactaacgagtggtacagaggtgactgggcctggtgccagcgttgtccccttgtggcctggcctccgtcagcagagccccaagtccaccggaacattcactcccatgggcttcggagcaaccttcaagagatctttctacctgcctttccatgtcatgagaggaagaaacaagaatgacaagtgtatgactgcctttgagctgtagttcccgtttatttacacatgtggatcctcgttttccaagcatggcttgtttgttttgatttctgctgtgcttataaatcactttcggtgggcaagggagagaggggaaaatgggtgttgactgaggaatcccccttgcttgtcttcttttgaaaccgggcatctctgaagtcctggtgtcaaggggatcaagagatgacttctcagaggttctaggtgatgctgagaccttggtgtctctaaactctgggcatgtggacaggaggggcttgcggccgtgtctctgacctgtgtgatgtgcaggagggtctcattgactcagcgcctgcgcgttgtgcctggctgtgctctcttttatgccccctctattctcctctctcccccaggggattttcatctcaacaacagagtgtcctcacccaggcctgccttccggc
